United States Patent 11,725,251 (METHYLATION MARKERS AND TARGETED METHYLATION PROBE PANEL) - sequence listing, part 3

SEQ ID NO: 23502 - DNA, 30 bp, Homo sapiens; identical to SEQ ID NO: 14017
  misc_feature 1..30: note = chr22:17084014-17084044
  misc_feature 1..30: note = hyper
  source 1..30: mol_type = genomic DNA

SEQ ID NO: 23503 - DNA, 119 bp, Homo sapiens
  misc_feature 1..119: note = chr22:17600967-17601086
  misc_feature 1..119: note = hyper
  source 1..119: mol_type = genomic DNA
cgtggtgccgaagggcgcgcgtagctcgatgaggtctaggatggacgtgcccaggatcagcaccaccttgggagtgaaggcgatggagtagataagccaggccaggtaggcgaaggcga

SEQ ID NO: 23504 - DNA, 34 bp, Homo sapiens
  misc_feature 1..34: note = chr22:17601368-17601402
  misc_feature 1..34: note = hyper
  source 1..34: mol_type = genomic DNA
ggtccagcaggccgccctgcgccagcagcagcac

SEQ ID NO: 23505 - DNA, 206 bp, Homo sapiens; identical to SEQ ID NO: 14020
  misc_feature 1..206: note = chr22:17849555-17849761
  misc_feature 1..206: note = hyper
  source 1..206: mol_type = genomic DNA

SEQ ID NO: 23506 - DNA, 136 bp, Homo sapiens
  misc_feature 1..136: note = chr22:17850318-17850454
  misc_feature 1..136: note = hyper
  source 1..136: mol_type = genomic DNA
ggggagggctagccccgctctggcgggcgggcgcgtggcaggggctcccggaggccccgagctcccgggaggcgctccggccaacttcgggccggtggggaccgggcctgggcgcggggctctgaaggtgtggaag

SEQ ID NO: 23507 - DNA, 53 bp, Homo sapiens; identical to SEQ ID NO: 4894
  misc_feature 1..53: note = chr22:17850978-17851031
  misc_feature 1..53: note = hyper
  source 1..53: mol_type = genomic DNA

SEQ ID NO: 23508 - DNA, 190 bp, Homo sapiens; identical to SEQ ID NO: 14023
  misc_feature 1..190: note = chr22:19016914-19017104
  misc_feature 1..190: note = hyper
  source 1..190: mol_type = genomic DNA

SEQ ID NO: 23509 - DNA, 213 bp, Homo sapiens
  misc_feature 1..213: note = chr22:19017319-19017532
  misc_feature 1..213: note = hyper
  source 1..213: mol_type = genomic DNA
cgtgtgctcggtatgcggggagccccgcggcggggccacctacccggcgggggtcctggaggtgagcgagcggcggctgcaggagggcctggcggcagtgcgcgaggagctgggcgccgggattgaggcgctgcgcgcggagcttcgagcggagctggatgccctgcgcgcgctgctgccgccgccgccgtccccgcctgcccgccgcgagcc

SEQ ID NO: 23510 - DNA, 12 bp, Homo sapiens
  misc_feature 1..12: note = chr22:19017567-19017579
  misc_feature 1..12: note = hyper
  source 1..12: mol_type = genomic DNA
ccctgccgcgga

SEQ ID NO: 23511 - DNA, 282 bp, Homo sapiens
  misc_feature 1..282: note = chr22:19511567-19511849
  misc_feature 1..282: note = hyper
  source 1..282: mol_type = genomic DNA
gcaccgagtcgtacactttgcactgcatgtgcccggtgctctgcaccacgcacgacatccacagccccttccaggtggtctgcgccgtcacgatgttgtggtccaggaaggcggtcacctgccacatgggcagcccgcacgccaggatcagacccccccagcccaccaggcacagcaccaggcccaggatctccaacgctgcggaccccatggctagaggcgagacgcgcacccgaaggcccgcagaacccccaaggccgtgctgcgcggcgccctgggcgg

SEQ ID NO: 23512 - DNA, 67 bp, Homo sapiens; identical to SEQ ID NO: 1519
  misc_feature 1..67: note = chr22:19512252-19512319
  misc_feature 1..67: note = hyper
  source 1..67: mol_type = genomic DNA

SEQ ID NO: 23513 - DNA, 15 bp, Homo sapiens
  misc_feature 1..15: note = chr22:19512376-19512391
  misc_feature 1..15: note = hyper
  source 1..15: mol_type = genomic DNA
cgtagaggccctcgt

SEQ ID NO: 23514 - DNA, 145 bp, Homo sapiens; identical to SEQ ID NO: 14032
  misc_feature 1..145: note = chr22:19742613-19742758
  misc_feature 1..145: note = hyper
  source 1..145: mol_type = genomic DNA

SEQ ID NO: 23515 - DNA, 46 bp, Homo sapiens
  misc_feature 1..46: note = chr22:19742788-19742834
  misc_feature 1..46: note = hyper
  source 1..46: mol_type = genomic DNA
cgcggttcttctctcggcttggcggctggggtccgacgaaggggca

SEQ ID NO: 23516 - DNA, 109 bp, Homo sapiens; identical to SEQ ID NO: 14035
  misc_feature 1..109: note = chr22:20791235-20791344
  misc_feature 1..109: note = hyper
  source 1..109: mol_type = genomic DNA

SEQ ID NO: 23517 - DNA, 30 bp, Homo sapiens; identical to SEQ ID NO: 14036
  misc_feature 1..30: note = chr22:20791681-20791711
  misc_feature 1..30: note = hyper
  source 1..30: mol_type = genomic DNA

SEQ ID NO: 23518 - DNA, 30 bp, Homo sapiens; identical to SEQ ID NO: 14037
  misc_feature 1..30: note = chr22:21319768-21319798
  misc_feature 1..30: note = hyper
  source 1..30: mol_type = genomic DNA

SEQ ID NO: 23519 - DNA, 90 bp, Homo sapiens
  misc_feature 1..90: note = chr22:22862697-22862787
  misc_feature 1..90: note = hyper
  source 1..90: mol_type = genomic DNA
ggcccgggcccagcccgggggtgggggcgtctgcgtgagggagtggaggctgatgtaaaagtggcgcccgctgagattagggaagggggt

SEQ ID NO: 23520 - DNA, 88 bp, Homo sapiens; identical to SEQ ID NO: 4903
  misc_feature 1..88: note = chr22:22863219-22863307
  misc_feature 1..88: note = hyper
  source 1..88: mol_type = genomic DNA

SEQ ID NO: 23521 - DNA, 30 bp, Homo sapiens; identical to SEQ ID NO: 14040
  misc_feature 1..30: note = chr22:23908209-23908239
  misc_feature 1..30: note = hyper
  source 1..30: mol_type = genomic DNA

SEQ ID NO: 23522 - DNA, 30 bp, Homo sapiens; identical to SEQ ID NO: 14041
  misc_feature 1..30: note = chr22:23908658-23908688
  misc_feature 1..30: note = hyper
  source 1..30: mol_type = genomic DNA

SEQ ID NO: 23523 - DNA, 147 bp, Homo sapiens
  misc_feature 1..147: note = chr22:24180540-24180687
  misc_feature 1..147: note = hyper
  source 1..147: mol_type = genomic DNA
tcataaggacgcccccgaagagaaacatgaagacgaagtcggccgtgcggccgcggaaggagccctcttccagcatgcggcagtagcggaacctacggcgtcggtataggaagtgccaccaggcggggcctcagtttccccgtcccg

SEQ ID NO: 23524 - DNA, 228 bp, Homo sapiens
  misc_feature 1..228: note = chr22:24180766-24180994
  misc_feature 1..228: note = hyper
  source 1..228: mol_type = genomic DNA
agaagaagctgaatcccaggggcccgaagaagaggaagttggtgacgagcctccagacctacgggggacgggcggtcaggtgcggggtgggtgggtcgggcccacaggtgcgcggcgcggggcggcctcacctggaacttccggaacacaaggtgcgggttgaagtagagttgaaaggggctgaggagctccagctgctgtggaaccaggggccagtcaagagctgcc

SEQ ID NO: 23525 - DNA, 390 bp, Homo sapiens; identical to SEQ ID NO: 14043
  misc_feature 1..390: note = chr22:24181054-24181444
  misc_feature 1..390: note = hyper
  source 1..390: mol_type = genomic DNA

SEQ ID NO: 23526 - DNA, 258 bp, Homo sapiens; identical to SEQ ID NO: 4904
  misc_feature 1..258: note = chr22:25678357-25678615
  misc_feature 1..258: note = hyper
  source 1..258: mol_type = genomic DNA

SEQ ID NO: 23527 - DNA, 132 bp, Homo sapiens
  misc_feature 1..132: note = chr22:25678616-25678748
  misc_feature 1..132: note = hyper
  source 1..132: mol_type = genomic DNA
ctgggactgtgcgctgaggtgcaccgaccgtcgggccgcgagctccccgcagaccctcgcggaatgagctggggggcggcgcgcgaggcggcggagcggaaggcgcactgcgaccccggcgggctacagcct

SEQ ID NO: 23528 - DNA, 128 bp, Homo sapiens
  misc_feature 1..128: note = chr22:25679337-25679465
  misc_feature 1..128: note = hyper
  source 1..128: mol_type = genomic DNA
gccctgtcctgtcctgtcccatccccgtggttcttcctgttgcattggtgtggtccctgtgggctcgttgcctgtcactcctttgcgctccttcttggtcgctgcttcttccccggctctgtggtccc

SEQ ID NO: 23529 - DNA, 194 bp, Homo sapiens
  misc_feature 1..194: note = chr22:25816913-25817107
  misc_feature 1..194: note = hyper
  source 1..194: mol_type = genomic DNA
gccaaccgagctggccgctgggactctgcacccaggtgcgccaacccttgggcgcacgctccccgcagaccctcgctgaaggagcggtgggcggcgcgccgcgaccctggcgggctacagattacaccgcttgcagggcgctgctggggcgcgcagagcggggctgccccagggtggctcccccaggttggggc

SEQ ID NO: 23530 - DNA, 278 bp, Homo sapiens
  misc_feature 1..278: note = chr22:25817180-25817458
  misc_feature 1..278: note = hyper
  source 1..278: mol_type = genomic DNA
ccaacatggtggacctggaggccgtggtggccgatgtcagttacctgatggccatggagaagagcaaggcgaccccggccgaccacgcctgcaagaggaccgtcctgcccgaacccacgtaccacctgccccggcccgcgccggtccccgacgccgccgccccctgcggccgccagcgaccccctgcgtccgggagaatcgggagctgagccgtcgctgtcccggagcgggtgacacagcggagcgggcgatgcggggccggcctcctggctccagtc

SEQ ID NO: 23531 - DNA, 39 bp, Homo sapiens
  misc_feature 1..39: note = chr22:25817612-25817651
  misc_feature 1..39: note = hyper
  source 1..39: mol_type = genomic DNA
ccctgtcctctcctgtcccatccccgtggttctacctgt

SEQ ID NO: 23532 - DNA, 30 bp, Homo sapiens; identical to SEQ ID NO: 14049
  misc_feature 1..30: note = chr22:26564863-26564893
  misc_feature 1..30: note = hyper
  source 1..30: mol_type = genomic DNA

SEQ ID NO: 23533 - DNA, 177 bp, Homo sapiens; identical to SEQ ID NO: 14050
  misc_feature 1..177: note = chr22:26565184-26565361
  misc_feature 1..177: note = hyper
  source 1..177: mol_type = genomic DNA

SEQ ID NO: 23534 - DNA, 131 bp, Homo sapiens; identical to SEQ ID NO: 14051
  misc_feature 1..131: note = chr22:26565502-26565633
  misc_feature 1..131: note = hyper
  source 1..131: mol_type = genomic DNA

SEQ ID NO: 23535 - DNA, 36 bp, Homo sapiens; identical to SEQ ID NO: 14052
  misc_feature 1..36: note = chr22:26565935-26565971
  misc_feature 1..36: note = hyper
  source 1..36: mol_type = genomic DNA

SEQ ID NO: 23536 - DNA, 129 bp, Homo sapiens; identical to SEQ ID NO: 14053
  misc_feature 1..129: note = chr22:27053864-27053993
  misc_feature 1..129: note = hyper
  source 1..129: mol_type = genomic DNA

SEQ ID NO: 23537 - DNA, 33 bp, Homo sapiens; identical to SEQ ID NO: 14054
  misc_feature 1..33: note = chr22:28197337-28197370
  misc_feature 1..33: note = hyper
  source 1..33: mol_type = genomic DNA

SEQ ID NO: 23538 - DNA, 91 bp, Homo sapiens; identical to SEQ ID NO: 14055
  misc_feature 1..91: note = chr22:28198065-28198156
  misc_feature 1..91: note = hyper
  source 1..91: mol_type = genomic DNA

SEQ ID NO: 23539 - DNA, 30 bp, Homo sapiens; identical to SEQ ID NO: 14056
  misc_feature 1..30: note = chr22:28198371-28198401
  misc_feature 1..30: note = hyper
  source 1..30: mol_type = genomic DNA

SEQ ID NO: 23540 - DNA, 147 bp, Homo sapiens
  misc_feature 1..147: note = chr22:28838292-28838439
  misc_feature 1..147: note = hyper
  source 1..147: mol_type = genomic DNA
cccgcaggctgaaggcccggctatggccagccccaggcgctcaggcaggaggcctctcggcccgccgccccggaaccagctgctgggctggtgtgctggggctgctcgccccccagcggggccctggggaaacggctgccagcggct

SEQ ID NO: 23541 - DNA, 40 bp, Homo sapiens; identical to SEQ ID NO: 14058
  misc_feature 1..40: note = chr22:29075517-29075557
  misc_feature 1..40: note = hyper
  source 1..40: mol_type = genomic DNA

SEQ ID NO: 23542 - DNA, 53 bp, Homo sapiens; identical to SEQ ID NO: 14059
  misc_feature 1..53: note = chr22:29076122-29076175
  misc_feature 1..53: note = hyper
  source 1..53: mol_type = genomic DNA

SEQ ID NO: 23543 - DNA, 42 bp, Homo sapiens; identical to SEQ ID NO: 14060
  misc_feature 1..42: note = chr22:29426589-29426631
  misc_feature 1..42: note = hyper
  source 1..42: mol_type = genomic DNA

SEQ ID NO: 23544 - DNA, 30 bp, Homo sapiens; identical to SEQ ID NO: 14061
  misc_feature 1..30: note = chr22:29876013-29876043
  misc_feature 1..30: note = hyper
  source 1..30: mol_type = genomic DNA

SEQ ID NO: 23545 - DNA, 271 bp, Homo sapiens
  misc_feature 1..271: note = chr22:29876952-29877223
  misc_feature 1..271: note = hyper
  source 1..271: mol_type = genomic DNA
ccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgaggtacgcaggcgcgcgggtggggggaggggcgcccctgctgaccccgcagcgaacttttgggctgcgtgacccaagggggcgctgccgga

SEQ ID NO: 23546 - DNA, 114 bp, Homo sapiens; identical to SEQ ID NO: 14063
  misc_feature 1..114: note = chr22:30116044-30116158
  misc_feature 1..114: note = hyper
  source 1..114: mol_type = genomic DNA

SEQ ID NO: 23547 - DNA, 36 bp, Homo sapiens; identical to SEQ ID NO: 14064
  misc_feature 1..36: note = chr22:30116411-30116447
  misc_feature 1..36: note = hyper
  source 1..36: mol_type = genomic DNA

SEQ ID NO: 23548 - DNA, 78 bp, Homo sapiens; identical to SEQ ID NO: 14065
  misc_feature 1..78: note = chr22:30116757-30116835
  misc_feature 1..78: note = hyper
  source 1..78: mol_type = genomic DNA

SEQ ID NO: 23549 - DNA, 174 bp, Homo sapiens; identical to SEQ ID NO: 14066
  misc_feature 1..174: note = chr22:30938095-30938269
  misc_feature 1..174: note = hyper
  source 1..174: mol_type = genomic DNA

SEQ ID NO: 23550 - DNA, 39 bp, Homo sapiens; identical to SEQ ID NO: 14067
  misc_feature 1..39: note = chr22:30938602-30938641
  misc_feature 1..39: note = hyper
  source 1..39: mol_type = genomic DNA

SEQ ID NO: 23551 - DNA, 114 bp, Homo sapiens
  misc_feature 1..114: note = chr22:31218396-31218510
  misc_feature 1..114: note = hyper
  source 1..114: mol_type = genomic DNA
cgctcaggctgggctcggctcccgcggcgcggacggggttaacgcgctcatgtaccgggtggcgggcggcagtggtgcattgtggtaacgcggcgccgggacccacgagtgtcc

SEQ ID NO: 23552 - DNA, 229 bp, Homo sapiens
  misc_feature 1..229: note = chr22:31218540-31218769
  misc_feature 1..229: note = hyper
  source 1..229: mol_type = genomic DNA
tgcacgcgtccgtgcaagcccccgggacccggcgccatgtagcgccccgccgattggaggctgccccgccgcgggaaatgaagggacgcggctgctgggacacggcctccgtgcgctccttctgcagctccggctgcctgaataaatttaagaagggttagtgcttgccgggcttccacccggagggaggccaggctccccgcgcatgcacgcccggtgcctggctttg

SEQ ID NO: 23553 - DNA, 349 bp, Homo sapiens
  misc_feature 1..349: note = chr22:31480781-31481130
  misc_feature 1..349: note = hyper
  source 1..349: mol_type = genomic DNA
gggatcggtgcctctcgaagtctttccgaccccgggagcggctcctccagcacccggcgcccgccattactgcgccccgcgcgccggcccggcccccgctggcctcgtggcaagaacgggggcgtcccgagccgggctcctccccgcggggccgggccatataaggaaaagctaggcccgctccgcccgccctgcgccccagcgtctggccgatttggggacgcgggcagtcgcttccggccccggctcccgcacattcttgaggattgggccggggatgggaggaatggggacgcctggggacttgcacgccgcgtgcccctccaccacccgccgggacgccctctgc

SEQ ID NO: 23554 - DNA, 73 bp, Homo sapiens
  misc_feature 1..73: note = chr22:31481332-31481405
  misc_feature 1..73: note = hyper
  source 1..73: mol_type = genomic DNA
ccttcagcgccccctggcgaggcttccctccaccgccggcgggacccccatgggcaaccgggggagctgggac

SEQ ID NO: 23555 - DNA, 30 bp, Homo sapiens; identical to SEQ ID NO: 14070
  misc_feature 1..30: note = chr22:32572248-32572278
  misc_feature 1..30: note = hyper
  source 1..30: mol_type = genomic DNA

SEQ ID NO: 23556 - DNA, 37 bp, Homo sapiens; identical to SEQ ID NO: 14071
  misc_feature 1..37: note = chr22:33197694-33197731
  misc_feature 1..37: note = hyper
  source 1..37: mol_type = genomic DNA

SEQ ID NO: 23557 - DNA, 69 bp, Homo sapiens
  misc_feature 1..69: note = chr22:33454366-33454435
  misc_feature 1..69: note = hyper
  source 1..69: mol_type = genomic DNA
tgcccctcaacgcgcgcgagcgcccccgcccggcggcccggcctccccgcgccgcggcgccccattggc

SEQ ID NO: 23558 - DNA, 30 bp, Homo sapiens; identical to SEQ ID NO: 14075
  misc_feature 1..30: note = chr22:35420285-35420315
  misc_feature 1..30: note = hyper
  source 1..30: mol_type = genomic DNA

SEQ ID NO: 23559 - DNA, 30 bp, Homo sapiens; identical to SEQ ID NO: 14076
  misc_feature 1..30: note = chr22:36553195-36553225
  misc_feature 1..30: note = hyper
  source 1..30: mol_type = genomic DNA

SEQ ID NO: 23560 - DNA, 52 bp, Homo sapiens; identical to SEQ ID NO: 14077
  misc_feature 1..52: note = chr22:37730735-37730787
  misc_feature 1..52: note = hyper
  source 1..52: mol_type = genomic DNA

SEQ ID NO: 23561 - DNA, 69 bp, Homo sapiens; identical to SEQ ID NO: 14078
  misc_feature 1..69: note = chr22:37731155-37731224
  misc_feature 1..69: note = hyper
  source 1..69: mol_type = genomic DNA

SEQ ID NO: 23562 - skipped

SEQ ID NO: 23563 - DNA, 60 bp, Homo sapiens; identical to SEQ ID NO: 14080
  misc_feature 1..60: note = chr22:38221288-38221348
  misc_feature 1..60: note = hyper
  source 1..60: mol_type = genomic DNA

SEQ ID NO: 23564 - DNA, 30 bp, Homo sapiens; identical to SEQ ID NO: 14083
  misc_feature 1..30: note = chr22:38478441-38478471
  misc_feature 1..30: note = hyper
  source 1..30: mol_type = genomic DNA

SEQ ID NO: 23565 - DNA, 48 bp, Homo sapiens
  misc_feature 1..48: note = chr22:39853473-39853521
  misc_feature 1..48: note = hyper
  source 1..48: mol_type = genomic DNA
acgccagcatctccccgccggggaccccgggggccgcggagccgccgc

SEQ ID NO: 23566 - DNA, 30 bp, Homo sapiens; identical to SEQ ID NO: 14085
  misc_feature 1..30: note = chr22:39854232-39854262
  misc_feature 1..30: note = hyper
  source 1..30: mol_type = genomic DNA

SEQ ID NO: 23567 - DNA, 30 bp, Homo sapiens; identical to SEQ ID NO: 14086
  misc_feature 1..30: note = chr22:39942115-39942145
  misc_feature 1..30: note = hyper
  source 1..30: mol_type = genomic DNA

SEQ ID NO: 23568 - DNA, 60 bp, Homo sapiens
  misc_feature 1..60: note = chr22:39954516-39954576
  misc_feature 1..60: note = hyper
  source 1..60: mol_type = genomic DNA
gggggaatcccgggcagggtttaactttcccggaggcgggggtggcggagaccccccctt

SEQ ID NO: 23569 - DNA, 109 bp, Homo sapiens; identical to SEQ ID NO: 14088
  misc_feature 1..109: note = chr22:40081839-40081948
  misc_feature 1..109: note = hyper
  source 1..109: mol_type = genomic DNA

SEQ ID NO: 23570 - DNA, 105 bp, Homo sapiens; identical to SEQ ID NO: 14089
  misc_feature 1..105: note = chr22:42307095-42307200
  misc_feature 1..105: note = hyper
  source 1..105: mol_type = genomic DNA

SEQ ID NO: 23571 - DNA, 45 bp, Homo sapiens
  misc_feature 1..45: note = chr22:42310042-42310087
  misc_feature 1..45: note = hyper
  source 1..45: mol_type = genomic DNA
tgctgggagaaccagcgcttcgagagcggcgggaaggatcagcgg

SEQ ID NO: 23572 - DNA, 231 bp, Homo sapiens
  misc_feature 1..231: note = chr22:42310220-42310451
  misc_feature 1..231: note = hyper
  source 1..231: mol_type = genomic DNA
gcgctgcgacgccgcacacagcgtagacggccgtatggctgcgctcgcggccggggtcccggggcgctgcggtgtcgcgggcgcgggcgggcggccggcctgtctggacccaggccggcgtgtcgtagttggaacagcggctctggtcgaggcgccgcggcccgtcgtggcagcagaagcggtagccgcacgtgccgcagcagaagctgtaggctccggagctgcagttga

SEQ ID NO: 23573 - DNA, 123 bp, Homo sapiens; identical to SEQ ID NO: 14091
  misc_feature 1..123: note = chr22:42311386-42311509
  misc_feature 1..123: note = hyper
  source 1..123: mol_type = genomic DNA

SEQ ID NO: 23574 - DNA, 88 bp, Homo sapiens
  misc_feature 1..88: note = chr22:42353892-42353980
  misc_feature 1..88: note = hyper
  source 1..88: mol_type = genomic DNA
ctgagccgacttgcaaaggggataggcgggcggcaccgggcgccctcccccagcccgccccgcccgcccagcccggagacccccaagg

SEQ ID NO: 23575 - DNA, 75 bp, Homo sapiens; identical to SEQ ID NO: 14093
  misc_feature 1..75: note = chr22:42679405-42679480
  misc_feature 1..75: note = hyper
  source 1..75: mol_type = genomic DNA

SEQ ID NO: 23576 - DNA, 215 bp, Homo sapiens; identical to SEQ ID NO: 14094
  misc_feature 1..215: note = chr22:42679916-42680131
  misc_feature 1..215: note = hyper
  source 1..215: mol_type = genomic DNA

SEQ ID NO: 23577 - DNA, 68 bp, Homo sapiens; identical to SEQ ID NO: 14095
  misc_feature 1..68: note = chr22:42896621-42896689
  misc_feature 1..68: note = hyper
  source 1..68: mol_type = genomic DNA

SEQ ID NO: 23578 - DNA, 37 bp, Homo sapiens; identical to SEQ ID NO: 14096
  misc_feature 1..37: note = chr22:43739465-43739502
  misc_feature 1..37: note = hyper
  source 1..37: mol_type = genomic DNA

SEQ ID NO: 23579 - skipped

SEQ ID NO: 23580 - DNA, 81 bp, Homo sapiens
  misc_feature 1..81: note = chr22:44258285-44258366
  misc_feature 1..81: note = hyper
  source 1..81: mol_type = genomic DNA
cgccgcctcccggctcgcagcccgcacgcgcccgcgcccgcgcccgcgcccgcgccccgcacacgctcgcgccccaccggc

SEQ ID NO: 23581 - DNA, 13 bp, Homo sapiens
  misc_feature 1..13: note = chr22:44258506-44258519
  misc_feature 1..13: note = hyper
  source 1..13: mol_type = genomic DNA
tcctccccgcccc

SEQ ID NO: 23582 - DNA, 30 bp, Homo sapiens; identical to SEQ ID NO: 14099
  misc_feature 1..30: note = chr22:44263900-44263930
  misc_feature 1..30: note = hyper
  source 1..30: mol_type = genomic DNA

SEQ ID NO: 23583 - DNA, 139 bp, Homo sapiens; identical to SEQ ID NO: 14101
  misc_feature 1..139: note = chr22:44726839-44726978
  misc_feature 1..139: note = hyper
  source 1..139: mol_type = genomic DNA

SEQ ID NO: 23584 - DNA, 93 bp, Homo sapiens; identical to SEQ ID NO: 14102
  misc_feature 1..93: note = chr22:44727446-44727539
  misc_feature 1..93: note = hyper
  source 1..93: mol_type = genomic DNA

SEQ ID NO: 23585 - DNA, 137 bp, Homo sapiens; identical to SEQ ID NO: 14103
  misc_feature 1..137: note = chr22:44727790-44727927
  misc_feature 1..137: note = hyper
  source 1..137: mol_type = genomic DNA

SEQ ID NO: 23586 - DNA, 46 bp, Homo sapiens; identical to SEQ ID NO: 14104
  misc_feature 1..46: note = chr22:45016369-45016415
  misc_feature 1..46: note = hyper
  source 1..46: mol_type = genomic DNA

SEQ ID NO: 23587 - DNA, 13 bp, Homo sapiens
  misc_feature 1..13: note = chr22:45403133-45403146
  misc_feature 1..13: note = hyper
  source 1..13: mol_type = genomic DNA
ccccctcccatca

SEQ ID NO: 23588 - DNA, 209 bp, Homo sapiens
  misc_feature 1..209: note = chr22:45404433-45404642
  misc_feature 1..209: note = hyper
  source 1..209: mol_type = genomic DNA
cgctgagcgcggcgatccgcggctgcctttcgtggagctgcttcttgaggtcgccgttctgcggaaacacggaggagcgggctcaggcaggccacccggggtcaggtgcaccccagcaccgcgggccgcggcaccccccgcccggagccccacgggcggggccggccgcagcgcaccccaagtttcccgggccgcgtcctgcacgcgcg

SEQ ID NO: 23589 - DNA, 209 bp, Homo sapiens
  misc_feature 1..209: note = chr22:45405061-45405270
  misc_feature 1..209: note = hyper
  source 1..209: mol_type = genomic DNA
gggaccggctcacgaaggggccccctccaggcaccctcccagtcatgcagaccctacatcgcttaagagaagactccaggctcgggtcccacgcgtcctcgatcccgcaaactgtgcaggacagcgccaggggcaggcggaggggagcccagaagggggtccgcgcgtgtgctcactccctcgccccccgcccccgggcaggctccagc

SEQ ID NO: 23590 - DNA, 24 bp, Homo sapiens
  misc_feature 1..24: note = chr22:45405596-45405620
  misc_feature 1..24: note = hyper
  source 1..24: mol_type = genomic DNA
gggaagacaggcttccgggcgccg

SEQ ID NO: 23591 - DNA, 232 bp, Homo sapiens
  misc_feature 1..232: note = chr22:45406039-45406271
  misc_feature 1..232: note = hyper
  source 1..232: mol_type = genomic DNA
cggtcgccggctccggggactgctcgggccgggcgctcggagaggacgactgcggagtcatcctctccgtccccgggccaacccggggaacgcggcgcccccaccccctgcgccgtgtaacgccgggatcaggacactttccgctgggaggctgcgagtccgtgtttccatttctcctcaccctggtcctcggctccctcctttcccccctcctccgcctccctctgatatt

SEQ ID NO: 23592 - DNA, 54 bp, Homo sapiens; identical to SEQ ID NO: 14113
  misc_feature 1..54: note = chr22:46658689-46658743
  misc_feature 1..54: note = hyper
  source 1..54: mol_type = genomic DNA

SEQ ID NO: 23593 - DNA, 455 bp, Homo sapiens
  misc_feature 1..455: note = chr22:48886204-48886659
  misc_feature 1..455: note = hyper
  source 1..455: mol_type = genomic DNA
gggcgtgagctgagggctggggtagggggtgaccgccgcgggctccctgttgcctggagtgaagggtggggggtggcctgtgcccctgccgaggctccaggcgggtggaatgaggggtggttggagtcccgggtgcagactccagcctcggcgctggggagggtgctcagcatcccggggcacgttcgcggctggtggggtaagtgggggccgctcagcgtcccgggcacaggctctggccccagatggcgcgggctggtcggcttcagctccgggagctccgggcttcttgtcttcagcgggagaataggacgggtgctggggagcacctgtcatggagaattgccatgggcgcgggaggtgatggaaaaatatggattctttacaaaaaaaaaaaaaaaaggccagcaccgaacctccctccacagacaccacctcctccagagccccgggcc

SEQ ID NO: 23594 - DNA, 88 bp, Homo sapiens
  misc_feature 1..88: note = chr22:48886849-48886937
  misc_feature 1..88: note = hyper
  source 1..88: mol_type = genomic DNA
ctagaaatgctgtggcaccgagcggggaggggtcgccaagcctgggggtctcaacccgagctgcccaggcagacgaggccaccgtggg

SEQ ID NO: 23595 - DNA, 201 bp, Homo sapiens; identical to SEQ ID NO: 1525
  misc_feature 1..201: note = chr22:48971758-48971959
  misc_feature 1..201: note = hyper
  source 1..201: mol_type = genomic DNA

SEQ ID NO: 23596 - DNA, 176 bp, Homo sapiens; identical to SEQ ID NO: 1526
  misc_feature 1..176: note = chr22:48971960-48972136
  misc_feature 1..176: note = hyper
  source 1..176: mol_type = genomic DNA

SEQ ID NO: 23597 - DNA, 37 bp, Homo sapiens; identical to SEQ ID NO: 14120
  misc_feature 1..37: note = chr22:50421971-50422008
  misc_feature 1..37: note = hyper
  source 1..37: mol_type = genomic DNA

SEQ ID NO: 23598 - DNA, 48 bp, Homo sapiens; identical to SEQ ID NO: 14121
  misc_feature 1..48: note = chr22:50453483-50453531
  misc_feature 1..48: note = hyper
  source 1..48: mol_type = genomic DNA

SEQ ID NO: 23599 - DNA, 176 bp, Homo sapiens
  misc_feature 1..176: note = chr22:50496971-50497147
  misc_feature 1..176: note = hyper
  source 1..176: mol_type = genomic DNA
cgcccccctgtggaggtcacactccatcccccaccaggtcacaaagacccgcgggtcacatcctgcccctccccctcgggccccccaggcccgccaggccttctcgccctccccggggccctcatgccgccctctgtccctgggcccttccccgacgcgaggctggagcggcgggg

SEQ ID NO: 23600 - DNA, 16 bp, Homo sapiens
  misc_feature 1..16: note = chr22:50623656-50623672
  misc_feature 1..16: note = hyper
  source 1..16: mol_type = genomic DNA
ctgagcgtccgggtcc

SEQ ID NO: 23601 - DNA, 46 bp, Homo sapiens
  misc_feature 1..46: note = chr22:50623815-50623861
  misc_feature 1..46: note = hyper
  source 1..46: mol_type = genomic DNA
cccgggtcggggaccgctctgggccgacccccggaggacggactag

SEQ ID NO: 23602 - DNA, 70 bp, Homo sapiens
  misc_feature 1..70: note = chr22:51112080-51112150
  misc_feature 1..70: note = hyper
  source 1..70: mol_type = genomic DNA
ccctaggcccttccccgtaggtcgcgcccccatcccgccgtcgctaaggtgacggggagggggcgacagg

SEQ ID NO: 23603 - DNA, 96 bp, Homo sapiens; identical to SEQ ID NO: 14129
  misc_feature 1..96: note = chrX:3264807-3264903
  misc_feature 1..96: note = hyper
  source 1..96: mol_type = genomic DNA

SEQ ID NO: 23604 - DNA, 29 bp, Homo sapiens
  misc_feature 1..29: note = chrX:3265150-3265179
  misc_feature 1..29: note = hyper
  source 1..29: mol_type = genomic DNA
cgggctggccccgccggcatcccactagc

SEQ ID NO: 23605 - DNA, 20 bp, Homo sapiens
  misc_feature 1..20: note = chrX:6143666-6143686
  misc_feature 1..20: note = hyper
  source 1..20: mol_type = genomic DNA
gcttcgtcaggataacgagg

SEQ ID NO: 23606 - DNA, 199 bp, Homo sapiens; identical to SEQ ID NO: 14132
  misc_feature 1..199: note = chrX:6143746-6143945
  misc_feature 1..199: note = hyper
  source 1..199: mol_type = genomic DNA

SEQ ID NO: 23607 - DNA, 30 bp, Homo sapiens; identical to SEQ ID NO: 14133
  misc_feature 1..30: note = chrX:6144913-6144943
  misc_feature 1..30: note = hyper
  source 1..30: mol_type = genomic DNA

SEQ ID NO: 23608 - DNA, 88 bp, Homo sapiens
  misc_feature 1..88: note = chrX:6145243-6145331
  misc_feature 1..88: note = hyper
  source 1..88: mol_type = genomic DNA
gggaagagggggtggcggttgcgttttccagggctgtagaggtggtgcgcctattggaaccgactcctcagcctcctcccccgtcccc

SEQ ID NO: 23609 - DNA, 30 bp, Homo sapiens; identical to SEQ ID NO: 14135
  misc_feature 1..30: note = chrX:8698521-8698551
  misc_feature 1..30: note = hyper
  source 1..30: mol_type = genomic DNA

SEQ ID NO: 23610 - DNA, 21 bp, Homo sapiens
  misc_feature 1..21: note = chrX:8698842-8698863
  misc_feature 1..21: note = hyper
  source 1..21: mol_type = genomic DNA
gaagagaaaaataagcggagg

SEQ ID NO: 23611 - DNA, 161 bp, Homo sapiens
  misc_feature 1..161: note = chrX:8698897-8699058
  misc_feature 1..161: note = hyper
  source 1..161: mol_type = genomic DNA
aggcagcagctgcactcgctcgcgctgagtccggaacctgctctcgtgcgcccacccgcacccggagcctcgcgcaagtcccgcgggggtccgcgccacagggcagagtcccggcaacccgctggagccaagcgcgcggctcccggagcctcccacacaag

SEQ ID NO: 23612 - DNA, 71 bp, Homo sapiens; identical to SEQ ID NO: 14137
  misc_feature 1..71: note = chrX:8699110-8699181
  misc_feature 1..71: note = hyper
  source 1..71: mol_type = genomic DNA

SEQ ID NO: 23613 - DNA, 145 bp, Homo sapiens; identical to SEQ ID NO: 14139
  misc_feature 1..145: note = chrX:13956384-13956529
  misc_feature 1..145: note = hyper
  source 1..145: mol_type = genomic DNA

SEQ ID NO: 23614 - DNA, 281 bp, Homo sapiens; identical to SEQ ID NO: 14140
  misc_feature 1..281: note = chrX:13956777-13957058
  misc_feature 1..281: note = hyper
  source 1..281: mol_type = genomic DNA

SEQ ID NO: 23615 - DNA, 30 bp, Homo sapiens; identical to SEQ ID NO: 14141
  misc_feature 1..30: note = chrX:16730016-16730046
  misc_feature 1..30: note = hyper
  source 1..30: mol_type = genomic DNA

SEQ ID NO: 23616 - DNA, 40 bp, Homo sapiens; identical to SEQ ID NO: 14142
  misc_feature 1..40: note = chrX:40017828-40017868
  misc_feature 1..40: note = hyper
  source 1..40: mol_type = genomic DNA

SEQ ID NO: 23617 - DNA, 38 bp, Homo sapiens; identical to SEQ ID NO: 14143
  misc_feature 1..38: note = chrX:40034521-40034559
  misc_feature 1..38: note = hyper
  source 1..38: mol_type = genomic DNA

SEQ ID NO: 23618 - DNA, 172 bp, Homo sapiens; identical to SEQ ID NO: 14144
  misc_feature 1..172: note = chrX:91035629-91035801
  misc_feature 1..172: note = hyper
  source 1..172: mol_type = genomic DNA

SEQ ID NO: 23619 - DNA, 34 bp, Homo sapiens; identical to SEQ ID NO: 14145
  misc_feature 1..34: note = chrX:91037095-91037129
  misc_feature 1..34: note = hyper
  source 1..34: mol_type = genomic DNA

SEQ ID NO: 23620 - DNA, 43 bp, Homo sapiens; identical to SEQ ID NO: 14147
  misc_feature 1..43: note = AC211950.2_11234-25326:13516-13559
  misc_feature 1..43: note = hyper
  source 1..43: mol_type = genomic DNA

SEQ ID NO: 23621 - DNA, 131 bp, Homo sapiens
  misc_feature 1..131: note = AC241851.2_88-34049:15130-15261
  misc_feature 1..131: note = hyper
  source 1..131: mol_type = genomic DNA
cttgcccccaccgcccgggctttttgcgccgcggctttttgctgctatttgtccctgccaccgcggcgttttgcccccgcagccgcggctccttgccccctacgcggcttcctgcctccgccaccgtggct

SEQ ID NO: 23622 - DNA, 200 bp, Homo sapiens
  misc_feature 1..200: note = AC241851.2_88-34049:15350-15550
  misc_feature 1..200: note = hyper
  source 1..200: mol_type = genomic DNA
acagcggcggctttctgcccctgcctctgagggtttttgcggctttatgtccccgctgtcgtggctttttgccgccgcggcttttggccccctccgccgcggctttttgcggcttttggcacccaacgccgcggctttttggggcttttggtccccgccaccggggcttttttcccccaccgccgcaggtttttcccgcc

SEQ ID NO: 23623 - DNA, 85 bp, Homo sapiens
  misc_feature 1..85: note = AEKP01168736.1_1-4752:1669-1754
  misc_feature 1..85: note = hyper
  source 1..85: mol_type = genomic DNA
gtctaagctagggcccggggtccaaaggaaaggctttcagatctgagctccgcggctctggcggcggtggagctgggagcccgcg

SEQ ID NO: 23624 - DNA, 344 bp, Homo sapiens
  misc_feature 1..344: note = AEKP01168736.1_1-4752:2287-2631
  misc_feature 1..344: note = hyper
  source 1..344: mol_type = genomic DNA
gggcacttagggtgagcatgggggcaaagccgcagacgagggtgctgcacagaactccggggtcctgcacccatggattcctccgtcctatccagtgcagagcccgtgcacaccgctgatgaaccccttcaggctggagaacgtgacagtcagcgaatcgagccggcaacttctcagtgagtccggggagggtgaggatggagggagcgccccggtcctagccgtgagttctggagcctttcccaaaacagccgggcttcggggcctgcggagagggcggctggggtggcctctgacagcccagcctgagaatggagtgggcttaagaccggggggcagggtct

SEQ ID NO: 23625 - DNA, 82 bp, Homo sapiens; identical to SEQ ID NO: 14151
  misc_feature 1..82: note = JH159140.1:144237-144319
  misc_feature 1..82: note = hyper
  source 1..82: mol_type = genomic DNA

SEQ ID NO: 23626 - DNA, 36 bp, Homo sapiens; identical to SEQ ID NO: 4929
  misc_feature 1..36: note = JH636052.4:1362180-1362216
  misc_feature 1..36: note = hyper
  source 1..36: mol_type = genomic DNA

SEQ ID NO: 23627 - DNA, 34 bp, Homo sapiens
  misc_feature 1..34: note = JH636052.4:5118735-5118769
  misc_feature 1..34: note = hyper
  source 1..34: mol_type = genomic DNA
gggcgaaggccattccgctgcccttccagcttcg

SEQ ID NO: 23628 - DNA, 26 bp, Homo sapiens
  misc_feature 1..26: note = JH636052.4:5118903-5118929
  misc_feature 1..26: note = hyper
  source 1..26: mol_type = genomic DNA
tgataccagaacgagagttgactgtg

SEQ ID NO: 23629 - DNA, 172 bp, Homo sapiens; identical to SEQ ID NO: 14154
  misc_feature 1..172: note = JH636058.1:413215-413387
  misc_feature 1..172: note = hyper
  source 1..172: mol_type = genomic DNA

SEQ ID NO: 23630 - DNA, 149 bp, Homo sapiens
  misc_feature 1..149: note = chr1:913955-914104
  misc_feature 1..149: note = hypo
  source 1..149: mol_type = genomic DNA
cctgaaggtagccaggcctgggcgggaaccctgccagaggctgggggagggacgccgccgtcacatgggcccgaacacagggcaacggcggcgcagagccaaccccctgaacaacccgggtgcttggactgggccgccccatctggact

SEQ ID NO: 23631 - DNA, 33 bp, Homo sapiens; identical to SEQ ID NO: 14156
  misc_feature 1..33: note = chr1:942352-942385
  misc_feature 1..33: note = hypo
  source 1..33: mol_type = genomic DNA

SEQ ID NO: 23632 - DNA, 34 bp, Homo sapiens; identical to SEQ ID NO: 14157
  misc_feature 1..34: note = chr1:1050115-1050149
  misc_feature 1..34: note = hypo
  source 1..34: mol_type = genomic DNA

SEQ ID NO: 23633 - DNA, 14 bp, Homo sapiens
  misc_feature 1..14: note = chr1:1080824-1080838
  misc_feature 1..14: note = hypo
  source 1..14: mol_type = genomic DNA
gcacggctgaccca

SEQ ID NO: 23634 - DNA, 155 bp, Homo sapiens; identical to SEQ ID NO: 14159
  misc_feature 1..155: note = chr1:1145553-1145708
  misc_feature 1..155: note = hypo
  source 1..155: mol_type = genomic DNA

SEQ ID NO: 23635 - DNA, 41 bp, Homo sapiens
  misc_feature 1..41: note = chr1:1146693-1146734
  misc_feature 1..41: note = hypo
  source 1..41: mol_type = genomic DNA
tgcagcccacagtgccggtcggagactcccgtctgccaagg

SEQ ID NO: 23636 - DNA, 12 bp, Homo sapiens
  misc_feature 1..12: note = chr1:1146818-1146830
  misc_feature 1..12: note = hypo
  source 1..12: mol_type = genomic DNA
tgcagagttggc

SEQ ID NO: 23637 - DNA, 129 bp, Homo sapiens; identical to SEQ ID NO: 14162
  misc_feature 1..129: note = chr1:1238321-1238450
  misc_feature 1..129: note = hypo
  source 1..129: mol_type = genomic DNA

SEQ ID NO: 23638 - DNA, 30 bp, Homo sapiens; identical to SEQ ID NO: 14163
  misc_feature 1..30: note = chr1:1245257-1245287
  misc_feature 1..30: note = hypo
  source 1..30: mol_type = genomic DNA

SEQ ID NO: 23639 - DNA, 72 bp, Homo sapiens; identical to SEQ ID NO: 14164
  misc_feature 1..72: note = chr1:1267177-1267249
  misc_feature 1..72: note = hypo
  source 1..72: mol_type = genomic DNA

SEQ ID NO: 23640 - DNA, 207 bp, Homo sapiens
  misc_feature 1..207: note = chr1:1267699-1267906
  misc_feature 1..207: note = hypo
  source 1..207: mol_type = genomic DNA
gaaccagagcagcgtgcaggtggtgctgctgttcgcctccgtgcacgccgcccacgccctcttcaactacagcatcagcagcaggctctcgcccaaggtgtgggtggccagcgaggcctggctgacctctgacctggtcatggggctgcccggcatggcccagatgggcacggtgcttggcttcctccagaggggtgcccagctgca

SEQ ID NO: 23641 - DNA, 129 bp, Homo sapiens; identical to SEQ ID NO: 14167
  misc_feature 1..129: note = chr1:1856222-1856351
  misc_feature 1..129: note = hypo
  source 1..129: mol_type = genomic DNA

SEQ ID NO: 23642 - DNA, 30 bp, Homo sapiens; identical to SEQ ID NO: 14169
  misc_feature 1..30: note = chr1:1915087-1915117
  misc_feature 1..30: note = hypo
  source 1..30: mol_type = genomic DNA

SEQ ID NO: 23643 - DNA, 38 bp, Homo sapiens; identical to SEQ ID NO: 14170
  misc_feature 1..38: note = chr1:2013465-2013503
  misc_feature 1..38: note = hypo
  source 1..38: mol_type = genomic DNA

SEQ ID NO: 23644 - DNA, 30 bp, Homo sapiens; identical to SEQ ID NO: 14172
  misc_feature 1..30: note = chr1:2141654-2141684
  misc_feature 1..30: note = hypo
  source 1..30: mol_type = genomic DNA

SEQ ID NO: 23645 - DNA, 38 bp, Homo sapiens
  misc_feature 1..38: note = chr1:2263131-2263169
  misc_feature 1..38: note = hypo
  source 1..38: mol_type = genomic DNA
gggaacagtcaaagacgactttgcaggatcctgcctga

SEQ ID NO: 23646 - DNA, 81 bp, Homo sapiens
  misc_feature 1..81: note = chr1:2263263-2263344
  misc_feature 1..81: note = hypo
  source 1..81: mol_type = genomic DNA
tgcgcctctccctcgtgcggctctcccgcccctgcgcctctccctcgtgcgcctctcccgcccctgcgcctctccctcgtg

SEQ ID NO: 23647 - DNA, 86 bp, Homo sapiens
  misc_feature 1..86: note = chr1:2267466-2267552
  misc_feature 1..86: note = hypo
  source 1..86: mol_type = genomic DNA
gtgtccccgcctgcacgtgccgcggtgtgcacctggtcccactcctgtcctccagctcacagagtcccctcaagccactgccctga

SEQ ID NO: 23648 - DNA, 102 bp, Homo sapiens; identical to SEQ ID NO: 14175
  misc_feature 1..102: note = chr1:2275689-2275791
  misc_feature 1..102: note = hypo
  source 1..102: mol_type = genomic DNA

SEQ ID NO: 23649 - DNA, 49 bp, Homo sapiens; identical to SEQ ID NO: 14177
  misc_feature 1..49: note = chr1:2307845-2307894
  misc_feature 1..49: note = hypo
  source 1..49: mol_type = genomic DNA

SEQ ID NO: 23650 - DNA, 131 bp, Homo sapiens
  misc_feature 1..131: note = chr1:2308245-2308376
  misc_feature 1..131: note = hypo
  source 1..131: mol_type = genomic DNA
actgatccaatagcccggtcttgtctaattcacgttatcaatcacacctttgacaattcggctgtttctgtttcatgtaccccaagcaggaacgagcaagagcttattaaatagggtgcaggggaggctcc

SEQ ID NO: 23651 - DNA, 22 bp, Homo sapiens
  misc_feature 1..22: note = chr1:2308636-2308658
  misc_feature 1..22: note = hypo
  source 1..22: mol_type = genomic DNA
ggtcacacgacctttggggaag

SEQ ID NO: 23652 - DNA, 49 bp, Homo sapiens; identical to SEQ ID NO: 14180
  misc_feature 1..49: note = chr1:2338188-2338237
  misc_feature 1..49: note = hypo
  source 1..49: mol_type = genomic DNA

SEQ ID NO: 23653 - DNA, 348 bp, Homo sapiens; identical to SEQ ID NO: 14181
  misc_feature 1..348: note = chr1:2359972-2360320
  misc_feature 1..348: note = hypo
  source 1..348: mol_type = genomic DNA

SEQ ID NO: 23654 - skipped

SEQ ID NO: 23655 - DNA, 147 bp, Homo sapiens
  misc_feature 1..147: note = chr1:2397031-2397178
  misc_feature 1..147: note = hypo
  source 1..147: mol_type = genomic DNA
acctgccacccgccgggccaaatgctctcaaagacagaattctgcttaaatgcccagaaaagagatttaggagatcagaatcttaagcaaattaacatgtgcagcgggcggcttttaatcaccgcctttaatcgcaggccgcggtga

SEQ ID NO: 23656 - DNA, 59 bp, Homo sapiens
  misc_feature 1..59: note = chr1:2428272-2428331
  misc_feature 1..59: note = hypo
  source 1..59: mol_type = genomic DNA
ccagctggcaggtgtcgtccttcagcgagaccaaggcccaccagattctgcagcagaag

SEQ ID NO: 23657 - DNA, 30 bp, Homo sapiens; identical to SEQ ID NO: 14184
  misc_feature 1..30: note = chr1:2468639-2468669
  misc_feature 1..30: note = hypo
  source 1..30: mol_type = genomic DNA

SEQ ID NO: 23658 - DNA, 18 bp, Homo sapiens
  misc_feature 1..18: note = chr1:2507045-2507063
  misc_feature 1..18: note = hypo
  source 1..18: mol_type = genomic DNA
ctcacaggctcacagcgg

SEQ ID NO: 23659 - DNA, 66 bp, Homo sapiens; identical to SEQ ID NO: 14186
  misc_feature 1..66: note = chr1:2537084-2537150
  misc_feature 1..66: note = hypo
  source 1..66: mol_type = genomic DNA

SEQ ID NO: 23660 - DNA, 79 bp, Homo sapiens; identical to SEQ ID NO: 14187
  misc_feature 1..79: note = chr1:2537758-2537837
  misc_feature 1..79: note = hypo
  source 1..79: mol_type = genomic DNA

SEQ ID NO: 23661 - DNA, 113 bp, Homo sapiens; identical to SEQ ID NO: 14188
  misc_feature 1..113: note = chr1:2708372-2708485
  misc_feature 1..113: note = hypo
  source 1..113: mol_type = genomic DNA

SEQ ID NO: 23662 - DNA, 136 bp, Homo sapiens; identical to SEQ ID NO: 14189
  misc_feature 1..136: note = chr1:2725529-2725665
  misc_feature 1..136: note = hypo
  source 1..136: mol_type = genomic DNA

SEQ ID NO: 23663 - DNA, 54 bp, Homo sapiens; identical to SEQ ID NO: 14190
  misc_feature 1..54: note = chr1:3078787-3078841
  misc_feature 1..54: note = hypo
  source 1..54: mol_type = genomic DNA

SEQ ID NO: 23664 - DNA, 56 bp, Homo sapiens; identical to SEQ ID NO: 14192
  misc_feature 1..56: note = chr1:3111327-3111383
  misc_feature 1..56: note = hypo
  source 1..56: mol_type = genomic DNA

SEQ ID NO: 23665 - DNA, 39 bp, Homo sapiens; identical to SEQ ID NO: 14193
  misc_feature 1..39: note = chr1:3411209-3411248
  misc_feature 1..39: note = hypo
  source 1..39: mol_type = genomic DNA

SEQ ID NO: 23666 - DNA, 30 bp, Homo sapiens; identical to SEQ ID NO: 14195
  misc_feature 1..30: note = chr1:3680070-3680100
  misc_feature 1..30: note = hypo
  source 1..30: mol_type = genomic DNA

SEQ ID NO: 23667 - DNA, 26 bp, Homo sapiens
  misc_feature 1..26: note = chr1:3683818-3683844
  misc_feature 1..26: note = hypo
  source 1..26: mol_type = genomic DNA
agctcaccaagcgggactgtgtcatc

SEQ ID NO: 23668 - DNA, 180 bp, Homo sapiens; identical to SEQ ID NO: 14197
  misc_feature 1..180: note = chr1:4082823-4083003
  misc_feature 1..180: note = hypo
  source 1..180: mol_type = genomic DNA

SEQ ID NO: 23669 - skipped

SEQ ID NO: 23670 - DNA, 141 bp, Homo sapiens; identical to SEQ ID NO: 14199
  misc_feature 1..141: note = chr1:4402113-4402254
  misc_feature 1..141: note = hypo
  source 1..141: mol_type = genomic DNA

SEQ ID NO: 23671 - DNA, 30 bp, Homo sapiens; identical to SEQ ID NO: 14200
  misc_feature 1..30: note = chr1:4486536-4486566
  misc_feature 1..30: note = hypo
  source 1..30: mol_type = genomic DNA

SEQ ID NO: 23672 - DNA, 53 bp, Homo sapiens; identical to SEQ ID NO: 14201
  misc_feature 1..53: note = chr1:4772565-4772618
  misc_feature 1..53: note = hypo
  source 1..53: mol_type = genomic DNA

SEQ ID NO: 23673 - DNA, 32 bp, Homo sapiens
  misc_feature 1..32: note = chr1:6166321-6166353
  misc_feature 1..32: note = hypo
  source 1..32: mol_type = genomic DNA
gggaagtctcgaggacggctagatatctgtca

SEQ ID NO: 23674 - DNA, 30 bp, Homo sapiens; identical to SEQ ID NO: 14204
  misc_feature 1..30: note = chr1:6360980-6361010
  misc_feature 1..30: note = hypo
  source 1..30: mol_type = genomic DNA

SEQ ID NO: 23675 - DNA, 56 bp, Homo sapiens; identical to SEQ ID NO: 14205
  misc_feature 1..56: note = chr1:6391449-6391505
  misc_feature 1..56: note = hypo
  source 1..56: mol_type = genomic DNA

SEQ ID NO: 23676 - DNA, 98 bp, Homo sapiens; identical to SEQ ID NO: 14207
  misc_feature 1..98: note = chr1:11036301-11036399
  misc_feature 1..98: note = hypo
  source 1..98: mol_type = genomic DNA

SEQ ID NO: 23677 - DNA, 30 bp, Homo sapiens; identical to SEQ ID NO: 14208
  misc_feature 1..30: note = chr1:11131698-11131728
  misc_feature 1..30: note = hypo
  source 1..30: mol_type = genomic DNA

SEQ ID NO: 23678 - DNA, 54 bp, Homo sapiens
  misc_feature 1..54: note = chr1:11936694-11936748
  misc_feature 1..54: note = hypo
  source 1..54: mol_type = genomic DNA
gatgtgaagtagcttcgggcagaactccaaaccttagagagatcatttgaaaat

SEQ ID NO: 23679 - DNA, 13 bp, Homo sapiens
  misc_feature 1..13: note = chr1:14730412-14730425
  misc_feature 1..13: note = hypo
  source 1..13: mol_type = genomic DNA
aagaagaggtctc

SEQ ID NO: 23680 - DNA, 41 bp, Homo sapiens; identical to SEQ ID NO: 14212
  misc_feature 1..41: note = chr1:16534552-16534593
  misc_feature 1..41: note = hypo
  source 1..41: mol_type = genomic DNA

SEQ ID NO: 23681 - DNA, 30 bp, Homo sapiens; identical to SEQ ID NO: 14213
  misc_feature 1..30: note = chr1:19213653-19213683
  misc_feature 1..30: note = hypo
  source 1..30: mol_type = genomic DNA

SEQ ID NO: 23682 - DNA, 64 bp, Homo sapiens; identical to SEQ ID NO: 14214
  misc_feature 1..64: note = chr1:21042770-21042834
  misc_feature 1..64: note = hypo
  source 1..64: mol_type = genomic DNA

SEQ ID NO: 23683 - DNA, 30 bp, Homo sapiens; identical to SEQ ID NO: 14215
  misc_feature 1..30: note = chr1:22777528-22777558
  misc_feature 1..30: note = hypo
  source 1..30: mol_type = genomic DNA

SEQ ID NO: 23684 - skipped

SEQ ID NO: 23685 - DNA, 42 bp, Homo sapiens; identical to SEQ ID NO: 14217
  misc_feature 1..42: note = chr1:24119192-24119234
  misc_feature 1..42: note = hypo
  source 1..42: mol_type = genomic DNA

SEQ ID NO: 23686 - DNA, 19 bp, Homo sapiens
  misc_feature 1..19: note = chr1:27844548-27844567
  misc_feature 1..19: note = hypo
  source 1..19: mol_type = genomic DNA
agcacgctcctcaccagcc

SEQ ID NO: 23687 - DNA, 30 bp, Homo sapiens; identical to SEQ ID NO: 14220
  misc_feature 1..30: note = chr1:29074253-29074283
  misc_feature 1..30: note = hypo
  source 1..30: mol_type = genomic DNA

SEQ ID NO: 23688 - DNA, 16 bp, Homo sapiens
  misc_feature 1..16: note = chr1:29516596-29516612
  misc_feature 1..16: note = hypo
  source 1..16: mol_type = genomic DNA
atagtcaaggccgggc

SEQ ID NO: 23689 - DNA, 143 bp, Homo sapiens; identical to SEQ ID NO: 14223
  misc_feature 1..143: note = chr1:33473115-33473258
  misc_feature 1..143: note = hypo
  source 1..143: mol_type = genomic DNA

SEQ ID NO: 23690 - DNA, 20 bp, Homo sapiens
  misc_feature 1..20: note = chr1:35660562-35660582
  misc_feature 1..20: note = hypo
  source 1..20: mol_type = genomic DNA
aggcgggaccgggtgcggtg

SEQ ID NO: 23691 - DNA, 23 bp, Homo sapiens
  misc_feature 1..23: note = chr1:36563456-36563479
  misc_feature 1..23: note = hypo
  source 1..23: mol_type = genomic DNA
tggctgggttgtagccgctgtgg

SEQ ID NO: 23692 - DNA, 49 bp, Homo sapiens
  misc_feature 1..49: note = chr1:36563522-36563571
  misc_feature 1..49: note = hypo
  source 1..49: mol_type = genomic DNA
cggggaagggcgaggtgagcaccgcagtgaaggccggtgtggcatgggc

SEQ ID NO: 23693 - DNA, 61 bp, Homo sapiens
  misc_feature 1..61: note = chr1:38398348-38398409
  misc_feature 1..61: note = hypo
  source 1..61: mol_type = genomic DNA
attttatatacaaggcaaccaagttcagagaggttaagtctgaggtcgcagagtgactagc

SEQ ID NO: 23694 - DNA, 156 bp, Homo sapiens; identical to SEQ ID NO: 1533
  misc_feature 1..156: note = chr1:39416821-39416977
  misc_feature 1..156: note = hypo
  source 1..156: mol_type = genomic DNA

SEQ ID NO: 23695 - DNA, 30 bp, Homo sapiens; identical to SEQ ID NO: 14229
  misc_feature 1..30: note = chr1:40905137-40905167
  misc_feature 1..30: note = hypo
  source 1..30: mol_type = genomic DNA

SEQ ID NO: 23696 - DNA, 83 bp, Homo sapiens
  misc_feature 1..83: note = chr1:41991702-41991785
  misc_feature 1..83: note = hypo
  source 1..83: mol_type = genomic DNA
tgcctggttccagcacagaggggcaggaggtggctgggaggaggtgagcaagggacagcgtgtcggggcgggggggctccacc

SEQ ID NO: 23697 - DNA, 30 bp, Homo sapiens; identical to SEQ ID NO: 14231
  misc_feature 1..30: note = chr1:43826882-43826912
  misc_feature 1..30: note = hypo
  source 1..30: mol_type = genomic DNA

SEQ ID NO: 23698 - DNA, 30 bp, Homo sapiens; identical to SEQ ID NO: 14233
  misc_feature 1..30: note = chr1:44068855-44068885
  misc_feature 1..30: note = hypo
  source 1..30: mol_type = genomic DNA

SEQ ID NO: 23699 - DNA, 43 bp, Homo sapiens; identical to SEQ ID NO: 14234
  misc_feature 1..43: note = chr1:44351190-44351233
  misc_feature 1..43: note = hypo
  source 1..43: mol_type = genomic DNA

SEQ ID NO: 23700 - DNA, 144 bp, Homo sapiens; identical to SEQ ID NO: 14235
  misc_feature 1..144: note = chr1:44497527-44497671
  misc_feature 1..144: note = hypo
  source 1..144: mol_type = genomic DNA

SEQ ID NO: 23701 - DNA, 77 bp, Homo sapiens; identical to SEQ ID NO: 14237
  misc_feature 1..77: note = chr1:45280503-45280580
  misc_feature 1..77: note = hypo
  source 1..77: mol_type = genomic DNA

SEQ ID NO: 23702 - DNA, 37 bp, Homo sapiens; identical to SEQ ID NO: 1534
  misc_feature 1..37: note = chr1:45645619-45645656
  misc_feature 1..37: note = hypo
  source 1..37: mol_type = genomic DNA

SEQ ID NO: 23703 - DNA, 38 bp, Homo sapiens; identical to SEQ ID NO: 14239
  misc_feature 1..38: note = chr1:46079131-46079169
  misc_feature 1..38: note = hypo
  source 1..38: mol_type = genomic DNA

SEQ ID NO: 23704 - DNA, 10 bp, Homo sapiens
  misc_feature 1..10: note = chr1:53129144-53129154
  misc_feature 1..10: note = hypo
  source 1..10: mol_type = genomic DNA
acatgtggcc

SEQ ID NO: 23705 - DNA, 30 bp, Homo sapiens; identical to SEQ ID NO: 14241
  misc_feature 1..30: note = chr1:53990562-53990592
  misc_feature 1..30: note = hypo
  source 1..30: mol_type = genomic DNA

SEQ ID NO: 23706 - DNA, 36 bp, Homo sapiens
  misc_feature 1..36: note = chr1:54586590-54586626
  misc_feature 1..36: note = hypo
  source 1..36: mol_type = genomic DNA
gtggtggcagtggggcgagagagaaaggagtggact

SEQ ID NO: 23707 - DNA, 261 bp, Homo sapiens
  misc_feature 1..261: note = chr1:54586736-54586997
  misc_feature 1..261: note = hypo
  source 1..261: mol_type = genomic DNA
caggagaggctcagggagcgccaatgattccgtgtgaggcacagggcgtggctgcgggtgggtgggagggcgactgcagcatgggaaatttcggtggagaaccagatcaggagtcaccaaataccatggagatggtaacaaagcctacagggaggcagggattgtgcggggagtctgcagcagcaaaacccctgctgggatgaggggccgggccctctctgaccccagaccaggcaaggctcccgtcgtccccactttgcc

SEQ ID NO: 23708 - DNA, 49 bp, Homo sapiens
  misc_feature 1..49: note = chr1:70672878-70672927
  misc_feature 1..49: note = hypo
  source 1..49: mol_type = genomic DNA
ttttaaaggaaaacgaccgtagcagcttttgcaacgttattaatgaggt

SEQ ID NO: 23709 - DNA, 30 bp, Homo sapiens; identical to SEQ ID NO: 14245
  misc_feature 1..30: note = chr1:78244815-78244845
  misc_feature 1..30: note = hypo
  source 1..30: mol_type = genomic DNA

SEQ ID NO: 23710 - DNA, 30 bp, Homo sapiens; identical to SEQ ID NO: 14247
  misc_feature 1..30: note = chr1:92494939-92494969
  misc_feature 1..30: note = hypo
  source 1..30: mol_type = genomic DNA

SEQ ID NO: 23711 - DNA, 98 bp, Homo sapiens; identical to SEQ ID NO: 14249
  misc_feature 1..98: note = chr1:99611990-99612088
  misc_feature 1..98: note = hypo
  source 1..98: mol_type = genomic DNA

SEQ ID NO: 23712 - DNA, 38 bp, Homo sapiens; identical to SEQ ID NO: 14250
  misc_feature 1..38: note = chr1:99612148-99612186
  misc_feature 1..38: note = hypo
  source 1..38: mol_type = genomic DNA

SEQ ID NO: 23713 - DNA, 86 bp, Homo sapiens; identical to SEQ ID NO: 4943
  misc_feature 1..86: note = chr1:100437183-100437269
  misc_feature 1..86: note = hypo
  source 1..86: mol_type = genomic DNA

SEQ ID NO: 23714 - DNA, 26 bp, Homo sapiens
  misc_feature 1..26: note = chr1:100814757-100814783
  misc_feature 1..26: note = hypo
  source 1..26: mol_type = genomic DNA
aaaaaaaaaggcgttgttttcaaact

SEQ ID NO: 23715 - DNA, 20 bp, Homo sapiens
  misc_feature 1..20: note = chr1:109076917-109076937
  misc_feature 1..20: note = hypo
  source 1..20: mol_type = genomic DNA
ttcaccgtgttagccaggat

SEQ ID NO: 23716 - DNA, 22 bp, Homo sapiens
  misc_feature 1..22: note = chr1:109593505-109593527
  misc_feature 1..22: note = hypo
  source 1..22: mol_type = genomic DNA
tcaagggccaggcaccgcggct

SEQ ID NO: 23717 - DNA, 79 bp, Homo sapiens; identical to SEQ ID NO: 14256
  misc_feature 1..79: note = chr1:110726679-110726758
  misc_feature 1..79: note = hypo
  source 1..79: mol_type = genomic DNA

SEQ ID NO: 23718 - DNA, 30 bp, Homo sapiens; identical to SEQ ID NO: 14258
  misc_feature 1..30: note = chr1:110884166-110884196
  misc_feature 1..30: note = hypo
  source 1..30: mol_type = genomic DNA

SEQ ID NO: 23719 - DNA, 64 bp, Homo sapiens
  misc_feature 1..64: note = chr1:112084890-112084954
  misc_feature 1..64: note = hypo
  source 1..64: mol_type = genomic DNA
caggatcagacctgccggttcgaacacacgcgacaagagcaaagaagttaaaagagaagtgtct

SEQ ID NO: 23720 - DNA, 86 bp, Homo sapiens
  misc_feature 1..86: note = chr1:112084984-112085070
  misc_feature 1..86: note = hypo
  source 1..86: mol_type = genomic DNA
gtgccagctgagaggtggtagagcaggaagctgcctgaggacctccatttatttggtgaaaaactgggctccgcccttaagagagc

SEQ ID NO: 23721 - DNA, 30 bp, Homo sapiens; identical to SEQ ID NO: 14260
  misc_feature 1..30: note = chr1:113751257-113751287
  misc_feature 1..30: note = hypo
  source 1..30: mol_type = genomic DNA

SEQ ID NO: 23722 - DNA, 30 bp, Homo sapiens; identical to SEQ ID NO: 14262
  misc_feature 1..30: note = chr1:116574202-116574232
  misc_feature 1..30: note = hypo
  source 1..30: mol_type = genomic DNA

SEQ ID NO: 23723 - DNA, 30 bp, Homo sapiens; identical to SEQ ID NO: 14263
  misc_feature 1..30: note = chr1:150602992-150603022
  misc_feature 1..30: note = hypo
  source 1..30: mol_type = genomic DNA

SEQ ID NO: 23724 - DNA, 30 bp, Homo sapiens; identical to SEQ ID NO: 14264
  misc_feature 1..30: note = chr1:150850705-150850735
  misc_feature 1..30: note = hypo
  source 1..30: mol_type = genomic DNA

SEQ ID NO: 23725 - DNA, 102 bp, Homo sapiens; identical to SEQ ID NO: 1538
  misc_feature 1..102: note = chr1:151252684-151252786
  misc_feature 1..102: note = hypo
  source 1..102: mol_type = genomic DNA

SEQ ID NO: 23726 - DNA, 49 bp, Homo sapiens
  misc_feature 1..49: note = chr1:153540047-153540096
  misc_feature 1..49: note = hypo
  source 1..49: mol_type = genomic DNA
ctcggcctgctgctgcgtgtcccttaaacacaccggcacatgcaactag

SEQ ID NO: 23727 - DNA, 88 bp, Homo sapiens
  misc_feature 1..88: note = chr1:153540154-153540242
  misc_feature 1..88: note = hypo
  source 1..88: mol_type = genomic DNA
ccatgccctctatcctgctgaaatccaacccccccttcaaaggccactgcagggagccttcccagggcccaaccggattcagtgtcta

SEQ ID NO: 23728 - DNA, 98 bp, Homo sapiens; identical to SEQ ID NO: 14271
  misc_feature 1..98: note = chr1:155160925-155161023
  misc_feature 1..98: note = hypo
  source 1..98: mol_type = genomic DNA

SEQ ID NO: 23729 - skipped

SEQ ID NO: 23730 - DNA, 40 bp, Homo sapiens; identical to SEQ ID NO: 1540
  misc_feature 1..40: note = chr1:156030121-156030161
  misc_feature 1..40: note = hypo
  source 1..40: mol_type = genomic DNA

SEQ ID NO: 23731 - DNA, 23 bp, Homo sapiens
  misc_feature 1..23: note = chr1:156031582-156031605
  misc_feature 1..23: note = hypo
  source 1..23: mol_type = genomic DNA
tttttttttctgagacggagtct

SEQ ID NO: 23732 - DNA, 47 bp, Homo sapiens; identical to SEQ ID NO: 14276
  misc_feature 1..47: note = chr1:156433495-156433542
  misc_feature 1..47: note = hypo
  source 1..47: mol_type = genomic DNA

SEQ ID NO: 23733 - DNA, 89 bp, Homo sapiens; identical to SEQ ID NO: 14277
  misc_feature 1..89: note = chr1:156843312-156843401
  misc_feature 1..89: note = hypo
  source 1..89: mol_type = genomic DNA

SEQ ID NO: 23734 - DNA, 75 bp, Homo sapiens
  misc_feature 1..75: note = chr1:157247388-157247463
  misc_feature 1..75: note = hypo
  source 1..75: mol_type = genomic DNA
ggtggattattaggaggcttccatgtagagccgcggcccagtggcctgcagggcctctgacggcagaggcaagca

SEQ ID NO: 23735 - DNA, 136 bp, Homo sapiens
  misc_feature 1..136: note = chr1:157458773-157458909
  misc_feature 1..136: note = hypo
  source 1..136: mol_type = genomic DNA
gacttggcaaccagccggacactgattccattcctgcttctaccgctaagctctgtcatccagcagatcctcaatggcctcatctggaaaatgggataatacttcctctgcagggttgctgggaggactaaataga

SEQ ID NO: 23736 - DNA, 28 bp, Homo sapiens
  misc_feature 1..28: note = chr1:157791984-157792012
  misc_feature 1..28: note = hypo
  source 1..28: mol_type = genomic DNA
aacttgaacataaggcgggcggatcacg

SEQ ID NO: 23737 - DNA, 48 bp, Homo sapiens
  misc_feature 1..48: note = chr1:157895443-157895491
  misc_feature 1..48: note = hypo
  source 1..48: mol_type = genomic DNA
gaaagagtccagggccggcggggtgctatgaggcgaggacttcctgag

SEQ ID NO: 23738 - DNA, 141 bp, Homo sapiens; identical to SEQ ID NO: 14282
  misc_feature 1..141: note = chr1:158169208-158169349
  misc_feature 1..141: note = hypo
  source 1..141: mol_type = genomic DNA

SEQ ID NO: 23739 - DNA, 30 bp, Homo sapiens; identical to SEQ ID NO: 14283
  misc_feature 1..30: note = chr1:158237112-158237142
  misc_feature 1..30: note = hypo
  source 1..30: mol_type = genomic DNA

SEQ ID NO: 23740 - DNA, 20 bp, Homo sapiens
  misc_feature 1..20: note = chr1:158366698-158366718
  misc_feature 1..20: note = hypo
  source 1..20: mol_type = genomic DNA
tattttggccaggggcggtg

SEQ ID NO: 23741 - DNA, 16 bp, Homo sapiens
  misc_feature 1..16: note = chr1:158591676-158591692
  misc_feature 1..16: note = hypo
  source 1..16: mol_type = genomic DNA
ggagtcttgctctgtc

SEQ ID NO: 23742 - DNA, 30 bp, Homo sapiens; identical to SEQ ID NO: 14287
  misc_feature 1..30: note = chr1:158639324-158639354
  misc_feature 1..30: note = hypo
  source 1..30: mol_type = genomic DNA

SEQ ID NO: 23743 - DNA, 17 bp, Homo sapiens
  misc_feature 1..17: note = chr1:158730575-158730592
  misc_feature 1..17: note = hypo
  source 1..17: mol_type = genomic DNA
ctgggtgcagtggctcg

SEQ ID NO: 23744 - DNA, 23 bp, Homo sapiens
  misc_feature 1..23: note = chr1:158748794-158748817
  misc_feature 1..23: note = hypo
  source 1..23: mol_type = genomic DNA
cgagactgcgtctcaaaaaaaaa

SEQ ID NO: 23745 - DNA, 169 bp, Homo sapiens; identical to SEQ ID NO: 14290
  misc_feature 1..169: note = chr1:159883486-159883655
  misc_feature 1..169: note = hypo
  source 1..169: mol_type = genomic DNA

SEQ ID NO: 23746 - DNA, 30 bp, Homo sapiens; identical to SEQ ID NO: 14291
  misc_feature 1..30: note = chr1:159932029-159932059
  misc_feature 1..30: note = hypo
  source 1..30: mol_type = genomic DNA

SEQ ID NO: 23747 - DNA, 26 bp, Homo sapiens
  misc_feature 1..26: note = chr1:160451209-160451235
  misc_feature 1..26: note = hypo
  source 1..26: mol_type = genomic DNA
ctgttcctattcggccatcttggctg

SEQ ID NO: 23748 - DNA, 19 bp, Homo sapiens
  misc_feature 1..19: note = chr1:160693915-160693934
  misc_feature 1..19: note = hypo
  source 1..19: mol_type = genomic DNA
ctgtcctcctgaaaacggg

SEQ ID NO: 23749 - DNA, 30 bp, Homo sapiens; identical to SEQ ID NO: 14294
  misc_feature 1..30: note = chr1:160853373-160853403
  misc_feature 1..30: note = hypo
  source 1..30: mol_type = genomic DNA

SEQ ID NO: 23750 - DNA, 35 bp, Homo sapiens; identical to SEQ ID NO: 14295
  misc_feature 1..35: note = chr1:160880659-160880694
  misc_feature 1..35: note = hypo
  source 1..35: mol_type = genomic DNA

SEQ ID NO: 23751 - DNA, 16 bp, Homo sapiens
  misc_feature 1..16: note = chr1:161007746-161007762
  misc_feature 1..16: note = hypo
  source 1..16: mol_type = genomic DNA
ccgcttgcccatctga

SEQ ID NO: 23752 - DNA, 28 bp, Homo sapiens
  misc_feature 1..28: note = chr1:161367768-161367796
  misc_feature 1..28: note = hypo
  source 1..28: mol_type = genomic DNA
gcgtgaaacaccgcgcctggccaaaaaa

SEQ ID NO: 23753 - DNA, 22 bp, Homo sapiens
  misc_feature 1..22: note = chr1:161442419-161442441
  misc_feature 1..22: note = hypo
  source 1..22: mol_type = genomic DNA
cggcgggcagtctctcgaccct

SEQ ID NO: 23754 - DNA, 30 bp, Homo sapiens; identical to SEQ ID NO: 14301
  misc_feature 1..30: note = chr1:161913509-161913539
  misc_feature 1..30: note = hypo
  source 1..30: mol_type = genomic DNA

SEQ ID NO: 23755 - DNA, 19 bp, Homo sapiens
  misc_feature 1..19: note = chr1:167789093-167789112
  misc_feature 1..19: note = hypo
  source 1..19: mol_type = genomic DNA
cgcccggcatgattttcta

SEQ ID NO: 23756 - DNA, 30 bp, Homo sapiens; identical to SEQ ID NO: 14304
  misc_feature 1..30: note = chr1:168150766-168150796
  misc_feature 1..30: note = hypo
  source 1..30: mol_type = genomic DNA

SEQ ID NO: 23757 - DNA, 30 bp, Homo sapiens; identical to SEQ ID NO: 14306
  misc_feature 1..30: note = chr1:173993077-173993107
  misc_feature 1..30: note = hypo
  source 1..30: mol_type = genomic DNA

SEQ ID NO: 23758 - DNA, 36 bp, Homo sapiens; identical to SEQ ID NO: 14307
  misc_feature 1..36: note = chr1:175365715-175365751
  misc_feature 1..36: note = hypo
  source 1..36: mol_type = genomic DNA

SEQ ID NO: 23759 - DNA, 78 bp, Homo sapiens; identical to SEQ ID NO: 14308
  misc_feature 1..78: note = chr1:175372494-175372572
  misc_feature 1..78: note = hypo
  source 1..78: mol_type = genomic DNA

SEQ ID NO: 23760 - DNA, 30 bp, Homo sapiens; identical to SEQ ID NO: 14309
  misc_feature 1..30: note = chr1:179849955-179849985
  misc_feature 1..30: note = hypo
  source 1..30: mol_type = genomic DNA

SEQ ID NO: 23761 - DNA, 30 bp, Homo sapiens; identical to SEQ ID NO: 14310
  misc_feature 1..30: note = chr1:180235694-180235724
  misc_feature 1..30: note = hypo
  source 1..30: mol_type = genomic DNA

SEQ ID NO: 23762 - DNA, 30 bp, Homo sapiens; identical to SEQ ID NO: 14313
  misc_feature 1..30: note = chr1:200519350-200519380
  misc_feature 1..30: note = hypo
  source 1..30: mol_type = genomic DNA

SEQ ID NO: 23763 - DNA, 30 bp, Homo sapiens; identical to SEQ ID NO: 14314
  misc_feature 1..30: note = chr1:200864028-200864058
  misc_feature 1..30: note = hypo
  source 1..30: mol_type = genomic DNA

SEQ ID NO: 23764 - DNA, 30 bp, Homo sapiens; identical to SEQ ID NO: 14315
  misc_feature 1..30: note = chr1:201244396-201244426
  misc_feature 1..30: note = hypo
  source 1..30: mol_type = genomic DNA

SEQ ID NO: 23765 - DNA, 30 bp, Homo sapiens; identical to SEQ ID NO: 14316
  misc_feature 1..30: note = chr1:201797425-201797455
  misc_feature 1..30: note = hypo
  source 1..30: mol_type = genomic DNA

SEQ ID NO: 23766 - DNA, 42 bp, Homo sapiens; identical to SEQ ID NO: 14317
  misc_feature 1..42: note = chr1:201982442-201982484
  misc_feature 1..42: note = hypo
  source 1..42: mol_type = genomic DNA

SEQ ID NO: 23767 - DNA, 31 bp, Homo sapiens
  misc_feature 1..31: note = chr1:201983200-201983231
  misc_feature 1..31: note = hypo
  source 1..31: mol_type = genomic DNA
gcgctcacactcccaccgccctctttctggc

SEQ ID NO: 23768 - DNA, 132 bp, Homo sapiens; identical to SEQ ID NO: 14320
  misc_feature 1..132: note = chr1:202312002-202312134
  misc_feature 1..132: note = hypo
  source 1..132: mol_type = genomic DNA

SEQ ID NO: 23769 - DNA, 30 bp, Homo sapiens; identical to SEQ ID NO: 14321
  misc_feature 1..30: note = chr1:202995301-202995331
  misc_feature 1..30: note = hypo
  source 1..30: mol_type = genomic DNA

SEQ ID NO: 23770 - DNA, 62 bp, Homo sapiens; identical to SEQ ID NO: 14322
  misc_feature 1..62: note = chr1:204588321-204588383
  misc_feature 1..62: note = hypo
  source 1..62: mol_type = genomic DNA

SEQ ID NO: 23771 - DNA, 46 bp, Homo sapiens; identical to SEQ ID NO: 14323
  misc_feature 1..46: note = chr1:204721217-204721263
  misc_feature 1..46: note = hypo
  source 1..46: mol_type = genomic DNA

SEQ ID NO: 23772 - DNA, 104 bp, Homo sapiens; identical to SEQ ID NO: 14324
  misc_feature 1..104: note = chr1:205310685-205310789
  misc_feature 1..104: note = hypo
  source 1..104: mol_type = genomic DNA

SEQ ID NO: 23773 - DNA, 30 bp, Homo sapiens; identical to SEQ ID NO: 14325
  misc_feature 1..30: note = chr1:207656486-207656516
  misc_feature 1..30: note = hypo
  source 1..30: mol_type = genomic DNA

SEQ ID NO: 23774 - DNA, 77 bp, Homo sapiens; identical to SEQ ID NO: 14326
  misc_feature 1..77: note = chr1:207991495-207991572
  misc_feature 1..77: note = hypo
  source 1..77: mol_type = genomic DNA

SEQ ID NO: 23775 - DNA, 175 bp, Homo sapiens; identical to SEQ ID NO: 14327
  misc_feature 1..175: note = chr1:209601406-209601581
  misc_feature 1..175: note = hypo
  source 1..175: mol_type = genomic DNA

SEQ ID NO: 23776 - DNA, 154 bp, Homo sapiens; identical to SEQ ID NO: 14328
  misc_feature 1..154: note = chr1:209999773-209999927
  misc_feature 1..154: note = hypo
  source 1..154: mol_type = genomic DNA

SEQ ID NO: 23777 - DNA, 84 bp, Homo sapiens; identical to SEQ ID NO: 4958
  misc_feature 1..84: note = chr1:213189757-213189841
  misc_feature 1..84: note = hypo
  source 1..84: mol_type = genomic DNA

SEQ ID NO: 23778 - DNA, 20 bp, Homo sapiens
  misc_feature 1..20: note = chr1:223907539-223907559
  misc_feature 1..20: note = hypo
  source 1..20: mol_type = genomic DNA
gcgcgcgtataatgcagtat

SEQ ID NO: 23779 - DNA, 30 bp, Homo sapiens; identical to SEQ ID NO: 14332
  misc_feature 1..30: note = chr1:224267844-224267874
  misc_feature 1..30: note = hypo
  source 1..30: mol_type = genomic DNA

SEQ ID NO: 23780 - DNA, 121 bp, Homo sapiens; identical to SEQ ID NO: 14333
  misc_feature 1..121: note = chr1:226062878-226062999
  misc_feature 1..121: note = hypo
  source 1..121: mol_type = genomic DNA

SEQ ID NO: 23781 - DNA, 93 bp, Homo sapiens; identical to SEQ ID NO: 14334
  misc_feature 1..93: note = chr1:226163122-226163215
  misc_feature 1..93: note = hypo
  source 1..93: mol_type = genomic DNA

SEQ ID NO: 23782 - DNA, 42 bp, Homo sapiens; identical to SEQ ID NO: 14335
  misc_feature 1..42: note = chr1:227750829-227750871
  misc_feature 1..42: note = hypo
  source 1..42: mol_type = genomic DNA

SEQ ID NO: 23783 - DNA, 30 bp, Homo sapiens; identical to SEQ ID NO: 14336
  misc_feature 1..30: note = chr1:227921541-227921571
  misc_feature 1..30: note = hypo
  source 1..30: mol_type = genomic DNA

SEQ ID NO: 23784 - DNA, 156 bp, Homo sapiens
  misc_feature 1..156: note = chr1:228529016-228529172
  misc_feature 1..156: note = hypo
  source 1..156: mol_type = genomic DNA
tggccacacctgcagccgctggtccagggtggcctgaatgtttcctcgtcgggtcccacatctgttgaggatggtcagcccgtgtccccctccctgtgctgacaccctcccccacccacagctgagcagcatcgacctgaacgaccaggtggaggg

SEQ ID NO: 23785 - DNA, 30 bp, Homo sapiens; identical to SEQ ID NO: 14338
  misc_feature 1..30: note = chr1:228536492-228536522
  misc_feature 1..30: note = hypo
  source 1..30: mol_type = genomic DNA

SEQ ID NO: 23786 - DNA, 30 bp, Homo sapiens; identical to SEQ ID NO: 14339
  misc_feature 1..30: note = chr1:228552593-228552623
  misc_feature 1..30: note = hypo
  source 1..30: mol_type = genomic DNA

SEQ ID NO: 23787 - DNA, 30 bp, Homo sapiens; identical to SEQ ID NO: 14341
  misc_feature 1..30: note = chr1:228919370-228919400
  misc_feature 1..30: note = hypo
  source 1..30: mol_type = genomic DNA

SEQ ID NO: 23788 - DNA, 53 bp, Homo sapiens; identical to SEQ ID NO: 14343
  misc_feature 1..53: note = chr1:230453632-230453685
  misc_feature 1..53: note = hypo
  source 1..53: mol_type = genomic DNA

SEQ ID NO: 23789 - DNA, 30 bp, Homo sapiens; identical to SEQ ID NO: 14344
  misc_feature 1..30: note = chr1:231163109-231163139
  misc_feature 1..30: note = hypo
  source 1..30: mol_type = genomic DNA

SEQ ID NO: 23790 - DNA, 30 bp, Homo sapiens; identical to SEQ ID NO: 14346
  misc_feature 1..30: note = chr1:234621166-234621196
  misc_feature 1..30: note = hypo
  source 1..30: mol_type = genomic DNA

SEQ ID NO: 23791 - DNA, 30 bp, Homo sapiens; identical to SEQ ID NO: 14347
  misc_feature 1..30: note = chr1:234882549-234882579
  misc_feature 1..30: note = hypo
  source 1..30: mol_type = genomic DNA

SEQ ID NO: 23792 - DNA, 30 bp, Homo sapiens; identical to SEQ ID NO: 14348
  misc_feature 1..30: note = chr1:234959409-234959439
  misc_feature 1..30: note = hypo
  source 1..30: mol_type = genomic DNA

SEQ ID NO: 23793 - DNA, 30 bp, Homo sapiens; identical to SEQ ID NO: 14349
  misc_feature 1..30: note = chr1:235267149-235267179
  misc_feature 1..30: note = hypo
  source 1..30: mol_type = genomic DNA

SEQ ID NO: 23794 - DNA, 96 bp, Homo sapiens; identical to SEQ ID NO: 14350
  misc_feature 1..96: note = chr1:235325416-235325512
  misc_feature 1..96: note = hypo
  source 1..96: mol_type = genomic DNA

SEQ ID NO: 23795 - DNA, 169 bp, Homo sapiens; identical to SEQ ID NO: 14351
  misc_feature 1..169: note = chr1:240463082-240463251
  misc_feature 1..169: note = hypo
  source 1..169: mol_type = genomic DNA

SEQ ID NO: 23796 - DNA, 177 bp, Homo sapiens; identical to SEQ ID NO: 14352
  misc_feature 1..177: note = chr1:242286750-242286927
  misc_feature 1..177: note = hypo
  source 1..177: mol_type = genomic DNA

SEQ ID NO: 23797 - DNA, 30 bp, Homo sapiens; identical to SEQ ID NO: 14353
  misc_feature 1..30: note = chr1:243057075-243057105
  misc_feature 1..30: note = hypo
  source 1..30: mol_type = genomic DNA

SEQ ID NO: 23798 - DNA, 30 bp, Homo sapiens; identical to SEQ ID NO: 14354
  misc_feature 1..30: note = chr1:244143029-244143059
  misc_feature 1..30: note = hypo
  source 1..30: mol_type = genomic DNA

SEQ ID NO: 23799 - DNA, 34 bp, Homo sapiens
  misc_feature 1..34: note = chr1:245135719-245135753
  misc_feature 1..34: note = hypo
  source 1..34: mol_type = genomic DNA
tgtatccttgtagtccgtggacagcagcctggac

SEQ ID NO: 23800 - DNA, 197 bp, Homo sapiens; identical to SEQ ID NO: 14356
  misc_feature 1..197: note = chr1:245772643-245772840
  misc_feature 1..197: note = hypo
  source 1..197: mol_type = genomic DNA

SEQ ID NO: 23801 - DNA, 30 bp, Homo sapiens; identical to SEQ ID NO: 14357
  misc_feature 1..30: note = chr1:245986707-245986737
  misc_feature 1..30: note = hypo
  source 1..30: mol_type = genomic DNA

SEQ ID NO: 23802 - DNA, 30 bp, Homo sapiens; identical to SEQ ID NO: 14358
  misc_feature 1..30: note = chr1:246172269-246172299
  misc_feature 1..30: note = hypo
  source 1..30: mol_type = genomic DNA

SEQ ID NO: 23803 - DNA, 30 bp, Homo sapiens; identical to SEQ ID NO: 14359
  misc_feature 1..30: note = chr1:247589929-247589959
  misc_feature 1..30: note = hypo
  source 1..30: mol_type = genomic DNA

SEQ ID NO: 23804 - DNA, 172 bp, Homo sapiens; identical to SEQ ID NO: 14360
  misc_feature 1..172: note = chr1:247709336-247709508
  misc_feature 1..172: note = hypo
  source 1..172: mol_type = genomic DNA

SEQ ID NO: 23805 - DNA, 180 bp, Homo sapiens; identical to SEQ ID NO: 14361
  misc_feature 1..180: note = chr1:247752018-247752198
  misc_feature 1..180: note = hypo
  source 1..180: mol_type = genomic DNA

SEQ ID NO: 23806 - DNA, 87 bp, Homo sapiens; identical to SEQ ID NO: 14364
  misc_feature 1..87: note = chr1:248099843-248099930
  misc_feature 1..87: note = hypo
  source 1..87: mol_type = genomic DNA

SEQ ID NO: 23807 - DNA, 11 bp, Homo sapiens
  misc_feature 1..11: note = chr1:248328690-248328701
  misc_feature 1..11: note = hypo
  source 1..11: mol_type = genomic DNA
gctccgtctga

SEQ ID NO: 23808 - DNA, 100 bp, Homo sapiens; identical to SEQ ID NO: 14366
  misc_feature 1..100: note = chr2:314569-314669
  misc_feature 1..100: note = hypo
  source 1..100: mol_type = genomic DNA

SEQ ID NO: 23809 - DNA, 30 bp, Homo sapiens; identical to SEQ ID NO: 14367
  misc_feature 1..30: note = chr2:484928-484958
  misc_feature 1..30: note = hypo
  source 1..30: mol_type = genomic DNA

SEQ ID NO: 23810 - DNA, 14 bp, Homo sapiens
  misc_feature 1..14: note = chr2:496214-496228
  misc_feature 1..14: note = hypo
  source 1..14: mol_type = genomic DNA
gaagctacaggagg

SEQ ID NO: 23811 - skipped

SEQ ID NO: 23812 - DNA, 30 bp, Homo sapiens; identical to SEQ ID NO: 14370
  misc_feature 1..30: note = chr2:1893031-1893061
  misc_feature 1..30: note = hypo
  source 1..30: mol_type = genomic DNA

SEQ ID NO: 23813 - DNA, 189 bp, Homo sapiens; identical to SEQ ID NO: 14371
  misc_feature 1..189: note = chr2:2522670-2522859
  misc_feature 1..189: note = hypo
  source 1..189: mol_type = genomic DNA

SEQ ID NO: 23814 - DNA, 64 bp, Homo sapiens; identical to SEQ ID NO: 14372
  misc_feature 1..64: note = chr2:2725048-2725112
  misc_feature 1..64: note = hypo
  source 1..64: mol_type = genomic DNA

SEQ ID NO: 23815 - DNA, 30 bp, Homo sapiens; identical to SEQ ID NO: 14373
  misc_feature 1..30: note = chr2:3331786-3331816
  misc_feature 1..30: note = hypo
  source 1..30: mol_type = genomic DNA

SEQ ID NO: 23816 - DNA, 61 bp, Homo sapiens; identical to SEQ ID NO: 14374
  misc_feature 1..61: note = chr2:3833825-3833886
  misc_feature 1..61: note = hypo
  source 1..61: mol_type = genomic DNA

SEQ ID NO: 23817 - DNA, 57 bp, Homo sapiens; identical to SEQ ID NO: 14375
  misc_feature 1..57: note = chr2:5704308-5704365
  misc_feature 1..57: note = hypo
  source 1..57: mol_type = genomic DNA

SEQ ID NO: 23818 - DNA, 30 bp, Homo sapiens; identical to SEQ ID NO: 14376
  misc_feature 1..30: note = chr2:7036178-7036208
  misc_feature 1..30: note = hypo
  source 1..30: mol_type = genomic DNA

SEQ ID NO: 23819 - DNA, 272 bp, Homo sapiens; identical to SEQ ID NO: 14377
  misc_feature 1..272: note = chr2:7172487-7172759
  misc_feature 1..272: note = hypo
  source 1..272: mol_type = genomic DNA

SEQ ID NO: 23820 - DNA, 171 bp, Homo sapiens; identical to SEQ ID NO: 14378
  misc_feature 1..171: note = chr2:8833973-8834144
  misc_feature 1..171: note = hypo
  source 1..171: mol_type = genomic DNA

SEQ ID NO: 23821 - DNA, 30 bp, Homo sapiens; identical to SEQ ID NO: 14379
  misc_feature 1..30: note = chr2:8834800-8834830
  misc_feature 1..30: note = hypo
  source 1..30: mol_type = genomic DNA

SEQ ID NO: 23822 - DNA, 24 bp, Homo sapiens
  misc_feature 1..24: note = chr2:8835577-8835601
  misc_feature 1..24: note = hypo
  source 1..24: mol_type = genomic DNA
gattccaggcgtgaccccctgcgc

SEQ ID NO: 23823 - DNA, 92 bp, Homo sapiens; identical to SEQ ID NO: 14381
  misc_feature 1..92: note = chr2:8978147-8978239
  misc_feature 1..92: note = hypo
  source 1..92: mol_type = genomic DNA

SEQ ID NO: 23824 - DNA, 180 bp, Homo sapiens; identical to SEQ ID NO: 14383
  misc_feature 1..180: note = chr2:9352635-9352815
  misc_feature 1..180: note = hypo
  source 1..180: mol_type = genomic DNA

SEQ ID NO: 23825 - DNA, 118 bp, Homo sapiens
  misc_feature 1..118: note = chr2:10153325-10153443
  misc_feature 1..118: note = hypo
  source 1..118: mol_type = genomic DNA
atgggagagtcaggtggacaggattgcgtatagccggatcaggtgggcaggcatgcgtatgagcgagtcaggtgggcagacatgcgtatgggcgggtcaggtggacaggcgtgtgtat

SEQ ID NO: 23826 - DNA, 240 bp, Homo sapiens; identical to SEQ ID NO: 4962
  misc_feature 1..240: note = chr2:10153898-10154138
  misc_feature 1..240: note = hypo
  source 1..240: mol_type = genomic DNA

SEQ ID NO: 23827 - DNA, 12 bp, Homo sapiens
  misc_feature 1..12: note = chr2:10154918-10154930
  misc_feature 1..12: note = hypo
  source 1..12: mol_type = genomic DNA
ggtcaggtgtgc

SEQ ID NO: 23828 - DNA, 77 bp, Homo sapiens; identical to SEQ ID NO: 14389
  misc_feature 1..77: note = chr2:10344641-10344718
  misc_feature 1..77: note = hypo
  source 1..77: mol_type = genomic DNA

SEQ ID NO: 23829 - DNA, 136 bp, Homo sapiens; identical to SEQ ID NO: 14390
  misc_feature 1..136: note = chr2:10924927-10925063
  misc_feature 1..136: note = hypo
  source 1..136: mol_type = genomic DNA

SEQ ID NO: 23830 - DNA, 30 bp, Homo sapiens; identical to SEQ ID NO: 14391
  misc_feature 1..30: note = chr2:11538637-11538667
  misc_feature 1..30: note = hypo
  source 1..30: mol_type = genomic DNA

SEQ ID NO: 23831 - DNA, 30 bp, Homo sapiens; identical to SEQ ID NO: 14392
  misc_feature 1..30: note = chr2:18453289-18453319
  misc_feature 1..30: note = hypo
  source 1..30: mol_type = genomic DNA

SEQ ID NO: 23832 - DNA, 23 bp, Homo sapiens
  misc_feature 1..23: note = chr2:20253274-20253297
  misc_feature 1..23: note = hypo
  source 1..23: mol_type = genomic DNA
taagatcaggggagccgggcgcg

SEQ ID NO: 23833 - DNA, 42 bp, Homo sapiens; identical to SEQ ID NO: 14394
  misc_feature 1..42: note = chr2:20431336-20431378
  misc_feature 1..42: note = hypo
  source 1..42: mol_type = genomic DNA

SEQ ID NO: 23834 - DNA, 142 bp, Homo sapiens; identical to SEQ ID NO: 14395
  misc_feature 1..142: note = chr2:20432683-20432825
  misc_feature 1..142: note = hypo
  source 1..142: mol_type = genomic DNA

SEQ ID NO: 23835 - DNA, 30 bp, Homo sapiens; identical to SEQ ID NO: 14396
  misc_feature 1..30: note = chr2:20456198-20456228
  misc_feature 1..30: note = hypo
  source 1..30: mol_type = genomic DNA

SEQ ID NO: 23836 - DNA, 30 bp, Homo sapiens; identical to SEQ ID NO: 14398
  misc_feature 1..30: note = chr2:25241776-25241806
  misc_feature 1..30: note = hypo
  source 1..30: mol_type = genomic DNA

SEQ ID NO: 23837 - DNA, 42 bp, Homo sapiens; identical to SEQ ID NO: 14399
  misc_feature 1..42: note = chr2:27090590-27090632
  misc_feature 1..42: note = hypo
  source 1..42: mol_type = genomic DNA

SEQ ID NO: 23838 - DNA, 111 bp, Homo sapiens
  misc_feature 1..111: note = chr2:27887555-27887666
  misc_feature 1..111: note = hypo
  source 1..111: mol_type = genomic DNA
aggaatcaagtctggcctatcatcttcagacggctgtacacattgctatatttctgaaagtcatgttcacaatcccgaactctaaaataacttgtttggccaggcgcggtg

SEQ ID NO: 23839 - DNA, 22 bp, Homo sapiens
  misc_feature 1..22: note = chr2:32263988-32264010
  misc_feature 1..22: note = hypo
  source 1..22: mol_type = genomic DNA
tgataggcgtgggccatcgcgc

SEQ ID NO: 23840 - DNA, 27 bp, Homo sapiens
  misc_feature 1..27: note = chr2:32551637-32551664
  misc_feature 1..27: note = hypo
  source 1..27: mol_type = genomic DNA
tgtgagccaccgcgcccagcctaccct

SEQ ID NO: 23841 - DNA, 45 bp, Homo sapiens; identical to SEQ ID NO: 14404
  misc_feature 1..45: note = chr2:33313226-33313271
  misc_feature 1..45: note = hypo
  source 1..45: mol_type = genomic DNA

SEQ ID NO: 23842 - DNA, 34 bp, Homo sapiens; identical to SEQ ID NO: 14405
  misc_feature 1..34: note = chr2:36824207-36824241
  misc_feature 1..34: note = hypo
  source 1..34: mol_type = genomic DNA

SEQ ID NO: 23843 - DNA, 189 bp, Homo sapiens; identical to SEQ ID NO: 4967
  misc_feature 1..189: note = chr2:43408168-43408357
  misc_feature 1..189: note = hypo
  source 1..189: mol_type = genomic DNA

SEQ ID NO: 23844 - DNA, 39 bp, Homo sapiens; identical to SEQ ID NO: 14407
  misc_feature 1..39: note = chr2:43412683-43412722
  misc_feature 1..39: note = hypo
  source 1..39: mol_type = genomic DNA

SEQ ID NO: 23845 - DNA, 40 bp, Homo sapiens; identical to SEQ ID NO: 14408
  misc_feature 1..40: note = chr2:43824353-43824393
  misc_feature 1..40: note = hypo
  source 1..40: mol_type = genomic DNA

SEQ ID NO: 23846 - DNA, 34 bp, Homo sapiens; identical to SEQ ID NO: 14409
  misc_feature 1..34: note = chr2:44224213-44224247
  misc_feature 1..34: note = hypo
  source 1..34: mol_type = genomic DNA

SEQ ID NO: 23847 - DNA, 16 bp, Homo sapiens
  misc_feature 1..16: note = chr2:55669245-55669261
  misc_feature 1..16: note = hypo
  source 1..16: mol_type = genomic DNA
tggagccaagatggcc

SEQ ID NO: 23848 - DNA, 30 bp, Homo sapiens; identical to SEQ ID NO: 14413
  misc_feature 1..30: note = chr2:60442223-60442253
  misc_feature 1..30: note = hypo
  source 1..30: mol_type = genomic DNA

SEQ ID NO: 23849 - DNA, 110 bp, Homo sapiens; identical to SEQ ID NO: 14414
  misc_feature 1..110: note = chr2:60705907-60706017
  misc_feature 1..110: note = hypo
  source 1..110: mol_type = genomic DNA

SEQ ID NO: 23850 - DNA, 30 bp, Homo sapiens; identical to SEQ ID NO: 14415
  misc_feature 1..30: note = chr2:60887794-60887824
  misc_feature 1..30: note = hypo
  source 1..30: mol_type = genomic DNA

SEQ ID NO: 23851 - DNA, 30 bp, Homo sapiens; identical to SEQ ID NO: 14416
  misc_feature 1..30: note = chr2:61406196-61406226
  misc_feature 1..30: note = hypo
  source 1..30: mol_type = genomic DNA

SEQ ID NO: 23852 - DNA, 86 bp, Homo sapiens; identical to SEQ ID NO: 4970
  misc_feature 1..86: note = chr2:62589799-62589885
  misc_feature 1..86: note = hypo
  source 1..86: mol_type = genomic DNA

SEQ ID NO: 23853 - DNA, 76 bp, Homo sapiens; identical to SEQ ID NO: 14418
  misc_feature 1..76: note = chr2:64835557-64835633
  misc_feature 1..76: note = hypo
  source 1..76: mol_type = genomic DNA

SEQ ID NO: 23854 - DNA, 20 bp, Homo sapiens
  misc_feature 1..20: note = chr2:69720191-69720211
  misc_feature 1..20: note = hypo
  source 1..20: mol_type = genomic DNA
gaggcaggagaatggcgtga

SEQ ID NO: 23855 - DNA, 48 bp, Homo sapiens; identical to SEQ ID NO: 14421
  misc_feature 1..48: note = chr2:70364215-70364263
  misc_feature 1..48: note = hypo
  source 1..48: mol_type = genomic DNA

SEQ ID NO: 23856 - DNA, 30 bp, Homo sapiens; identical to SEQ ID NO: 14422
  misc_feature 1..30: note = chr2:70367818-70367848
  misc_feature 1..30: note = hypo
  source 1..30: mol_type = genomic DNA

SEQ ID NO: 23857 - DNA, 75 bp, Homo sapiens; identical to SEQ ID NO: 14423
  misc_feature 1..75: note = chr2:72778920-72778995
  misc_feature 1..75: note = hypo
  source 1..75: mol_type = genomic DNA

SEQ ID NO: 23858 - DNA, 58 bp, Homo sapiens
  misc_feature 1..58: note = chr2:74454261-74454319
  misc_feature 1..58: note = hypo
  source 1..58: mol_type = genomic DNA
ggggacagcgggggctcagccaggcagccagaccccgagggcccgctgggtcctggga

SEQ ID NO: 23859 - DNA, 25 bp, Homo sapiens
  misc_feature 1..25: note = chr2:74700453-74700478
  misc_feature 1..25: note = hypo
  source 1..25: mol_type = genomic DNA
tttctttttttgagacgaagttttg

SEQ ID NO: 23860 - DNA, 24 bp, Homo sapiens
  misc_feature 1..24: note = chr2:85838299-85838323
  misc_feature 1..24: note = hypo
  source 1..24: mol_type = genomic DNA
cagcctgggcgacagagacctagt

SEQ ID NO: 23861 - DNA, 43 bp, Homo sapiens; identical to SEQ ID NO: 4973
  misc_feature 1..43: note = chr2:86423726-86423769
  misc_feature 1..43: note = hypo
  source 1..43: mol_type = genomic DNA

SEQ ID NO: 23862 - DNA, 65 bp, Homo sapiens
  misc_feature 1..65: note = chr2:88990264-88990329
  misc_feature 1..65: note = hypo
  source 1..65: mol_type = genomic DNA
gcccataccagtgacttgcgctcacggaagagttctgaaggcctggaatgcgtttgaagatgagt

SEQ ID NO: 23863 - DNA, 30 bp, Homo sapiens; identical to SEQ ID NO: 14430
  misc_feature 1..30: note = chr2:95742145-95742175
  misc_feature 1..30: note = hypo
  source 1..30: mol_type = genomic DNA

SEQ ID NO: 23864 - DNA, 40 bp, Homo sapiens
  misc_feature 1..40: note = chr2:95941812-95941852
  misc_feature 1..40: note = hypo
  source 1..40: mol_type = genomic DNA
cacaaggcgctggcctgtgagcgcgcggccctcatggtct

SEQ ID NO: 23865 - DNA, 24 bp, Homo sapiens
  misc_feature 1..24: note = chr2:96872240-96872264
  misc_feature 1..24: note = hypo
  source 1..24: mol_type = genomic DNA
cttaaaagtggaacacggccgggc

SEQ ID NO: 23866 - DNA, 30 bp, Homo sapiens; identical to SEQ ID NO: 14435
  misc_feature 1..30: note = chr2:98025687-98025717
  misc_feature 1..30: note = hypo
  source 1..30: mol_type = genomic DNA

SEQ ID NO: 23867 - DNA, 28 bp, Homo sapiens
  misc_feature 1..28: note = chr2:101835069-101835097
  misc_feature 1..28: note = hypo
  source 1..28: mol_type = genomic DNA
gcatgagccaccgcgcccagcctagtca

SEQ ID NO: 23868 - DNA, 157 bp, Homo sapiens; identical to SEQ ID NO: 14438
  misc_feature 1..157: note = chr2:105972350-105972507
  misc_feature 1..157: note = hypo
  source 1..157: mol_type = genomic DNA

SEQ ID NO: 23869 - DNA, 191 bp, Homo sapiens; identical to SEQ ID NO: 14439
  misc_feature 1..191: note = chr2:106016141-106016332
  misc_feature 1..191: note = hypo
  source 1..191: mol_type = genomic DNA

SEQ ID NO: 23870 - DNA, 30 bp, Homo sapiens; identical to SEQ ID NO: 14441
  misc_feature 1..30: note = chr2:106672847-106672877
  misc_feature 1..30: note = hypo
  source 1..30: mol_type = genomic DNA

SEQ ID NO: 23871 - DNA, 30 bp, Homo sapiens
  misc_feature 1..30: note = chr2:106959338-106959368
  misc_feature 1..30: note = hypo
  source 1..30: mol_type = genomic DNA
acactccctgcctctcgaggactctgcttg

SEQ ID NO: 23872 - DNA, 55 bp, Homo sapiens
  misc_feature 1..55: note = chr2:106959988-106960043
  misc_feature 1..55: note = hypo
  source 1..55: mol_type = genomic DNA
cattgcaggggtgatgggacagccctgcttttgagaggcgcggcactctgccaag

SEQ ID NO: 23873 - DNA, 183 bp, Homo sapiens; identical to SEQ ID NO: 14444
  misc_feature 1..183: note = chr2:107460171-107460354
  misc_feature 1..183: note = hypo
  source 1..183: mol_type = genomic DNA

SEQ ID NO: 23874 - DNA, 30 bp, Homo sapiens; identical to SEQ ID NO: 14445
  misc_feature 1..30: note = chr2:108160895-108160925
  misc_feature 1..30: note = hypo
  source 1..30: mol_type = genomic DNA

SEQ ID NO: 23875 - DNA, 30 bp, Homo sapiens; identical to SEQ ID NO: 14447
  misc_feature 1..30: note = chr2:113013287-113013317
  misc_feature 1..30: note = hypo
  source 1..30: mol_type = genomic DNA

SEQ ID NO: 23876 - DNA, 30 bp, Homo sapiens; identical to SEQ ID NO: 14448
  misc_feature 1..30: note = chr2:113103393-113103423
  misc_feature 1..30: note = hypo
  source 1..30: mol_type = genomic DNA

SEQ ID NO: 23877 - DNA, 255 bp, Homo sapiens
  misc_feature 1..255: note = chr2:120980098-120980353
  misc_feature 1..255: note = hypo
  source 1..255: mol_type = genomic DNA
gcaggatgttgaccgagcacaggatctccagctccagcgacctatcgtgtcgaaagccccagacgcaggcagccacggacacgggggacacgaagaagagaggcatgaagaccagcagccagaagtgggtgcccctctccaccctgtcgcagaccaggacttcgaacatgagcagcagcaggtggatgcccacagcgatcagcatggctttgaactccacacaggcctctccctcggtgcggtagcgagggttgc

SEQ ID NO: 23878 - DNA, 97 bp, Homo sapiens
  misc_feature 1..97: note = chr2:120980395-120980492
  misc_feature 1..97: note = hypo
  source 1..97: mol_type = genomic DNA
gaagcttccacagccatatgggggcaaagacggcccagtagctccattggatgatgccgtccaggcggaggggcagcagcaccgagaagagcagcag

SEQ ID NO: 23879 - DNA, 122 bp, Homo sapiens
  misc_feature 1..122: note = chr2:122495413-122495535
  misc_feature 1..122: note = hypo
  source 1..122: mol_type = genomic DNA
ttacagcctgagggcagcatggctgctttaagagaccaaagaggcttgtgggggagaggcacactgggtggcgccggagggtcccccttaggaggtggcgttagcaccgaggcctgaaggct

SEQ ID NO: 23880 - DNA, 135 bp, Homo sapiens; identical to SEQ ID NO: 14452
  misc_feature 1..135: note = chr2:127422944-127423079
  misc_feature 1..135: note = hypo
  source 1..135: mol_type = genomic DNA

SEQ ID NO: 23881 - DNA, 25 bp, Homo sapiens
  misc_feature 1..25: note = chr2:127428985-127429010
  misc_feature 1..25: note = hypo
  source 1..25: mol_type = genomic DNA
gctttatcacaggcacgagcacagg

SEQ ID NO: 23882 - DNA, 40 bp, Homo sapiens; identical to SEQ ID NO: 14455
  misc_feature 1..40: note = chr2:127435251-127435291
  misc_feature 1..40: note = hypo
  source 1..40: mol_type = genomic DNA

SEQ ID NO: 23883 - DNA, 30 bp, Homo sapiens; identical to SEQ ID NO: 14456
  misc_feature 1..30: note = chr2:127438110-127438140
  misc_feature 1..30: note = hypo
  source 1..30: mol_type = genomic DNA

SEQ ID NO: 23884 - DNA, 30 bp, Homo sapiens; identical to SEQ ID NO: 14457
  misc_feature 1..30: note = chr2:127438702-127438732
  misc_feature 1..30: note = hypo
  source 1..30: mol_type = genomic DNA

SEQ ID NO: 23885 - DNA, 63 bp, Homo sapiens; identical to SEQ ID NO: 14458
  misc_feature 1..63: note = chr2:127801172-127801235
  misc_feature 1..63: note = hypo
  source 1..63: mol_type = genomic DNA

SEQ ID NO: 23886 - DNA, 22 bp, Homo sapiens
  misc_feature 1..22: note = chr2:131114462-131114484
  misc_feature 1..22: note = hypo
  source 1..22: mol_type = genomic DNA
tataaagattctaaacgtgggc

SEQ ID NO: 23887 - DNA, 261 bp, Homo sapiens; identical to SEQ ID NO: 14463
  misc_feature 1..261: note = chr2:131967115-131967376
  misc_feature 1..261: note = hypo
  source 1..261: mol_type = genomic DNA

SEQ ID NO: 23888 - DNA, 19 bp, Homo sapiens
  misc_feature 1..19: note = chr2:145167762-145167781
  misc_feature 1..19: note = hypo
  source 1..19: mol_type = genomic DNA
accgcgcccagccataaaa

SEQ ID NO: 23889 - DNA, 34 bp, Homo sapiens
  misc_feature 1..34: note = chr2:148776775-148776809
  misc_feature 1..34: note = hypo
  source 1..34: mol_type = genomic DNA
gcaatgatgcataaacggggtccactgcccaaac

SEQ ID NO: 23890 - DNA, 34 bp, Homo sapiens; identical to SEQ ID NO: 14466
  misc_feature 1..34: note = chr2:152266037-152266071
  misc_feature 1..34: note = hypo
  source 1..34: mol_type = genomic DNA

SEQ ID NO: 23891 - skipped

SEQ ID NO: 23892 - DNA, 20 bp, Homo sapiens
  misc_feature 1..20: note = chr2:173036684-173036704
  misc_feature 1..20: note = hypo
  source 1..20: mol_type = genomic DNA
caccgcgcccagcccaataa

SEQ ID NO: 23893 - DNA, 38 bp, Homo sapiens; identical to SEQ ID NO: 14474
  misc_feature 1..38: note = chr2:177498112-177498150
  misc_feature 1..38: note = hypo
  source 1..38: mol_type = genomic DNA

SEQ ID NO: 23894 - DNA, 32 bp, Homo sapiens; identical to SEQ ID NO: 14476
  misc_feature 1..32: note = chr2:180886813-180886845
  misc_feature 1..32: note = hypo
  source 1..32: mol_type = genomic DNA

SEQ ID NO: 23895 - DNA, 30 bp, Homo sapiens; identical to SEQ ID NO: 14477
  misc_feature 1..30: note = chr2:188236072-188236102
  misc_feature 1..30: note = hypo
  source 1..30: mol_type = genomic DNA

SEQ ID NO: 23896 - DNA, 30 bp, Homo sapiens; identical to SEQ ID NO: 14478
  misc_feature 1..30: note = chr2:200524640-200524670
  misc_feature 1..30: note = hypo
  source 1..30: mol_type = genomic DNA

SEQ ID NO: 23897 - DNA, 30 bp, Homo sapiens; identical to SEQ ID NO: 14479
  misc_feature 1..30: note = chr2:203129332-203129362
  misc_feature 1..30: note = hypo
  source 1..30: mol_type = genomic DNA

SEQ ID NO: 23898 - DNA, 23 bp, Homo sapiens
  misc_feature 1..23: note = chr2:203484340-203484363
  misc_feature 1..23: note = hypo
  source 1..23: mol_type = genomic DNA
tgccatatcgggtgcaccagtta

SEQ ID NO: 23899 - DNA, 86 bp, Homo sapiens; identical to SEQ ID NO: 14481
  misc_feature 1..86: note = chr2:207557814-207557900
  misc_feature 1..86: note = hypo
  source 1..86: mol_type = genomic DNA

SEQ ID NO: 23900 - DNA, 30 bp, Homo sapiens; identical to SEQ ID NO: 14482
  misc_feature 1..30: note = chr2:220316287-220316317
  misc_feature 1..30: note = hypo
  source 1..30: mol_type = genomic DNA

SEQ ID NO: 23901 - DNA, 30 bp, Homo sapiens; identical to SEQ ID NO: 14483
  misc_feature 1..30: note = chr2:223764711-223764741
  misc_feature 1..30: note = hypo
  source 1..30: mol_type = genomic DNA

SEQ ID NO: 23902 - DNA, 30 bp, Homo sapiens; identical to SEQ ID NO: 14485
  misc_feature 1..30: note = chr2:232485651-232485681
  misc_feature 1..30: note = hypo
  source 1..30: mol_type = genomic DNA

SEQ ID NO: 23903 - DNA, 20 bp, Homo sapiens
  misc_feature 1..20: note = chr2:233750505-233750525
  misc_feature 1..20: note = hypo
  source 1..20: mol_type = genomic DNA
gtgacacatggggcccggca

SEQ ID NO: 23904 - DNA, 30 bp, Homo sapiens; identical to SEQ ID NO: 14487
  misc_feature 1..30: note = chr2:233960620-233960650
  misc_feature 1..30: note = hypo
  source 1..30: mol_type = genomic DNA

SEQ ID NO: 23905 - DNA, 123 bp, Homo sapiens; identical to SEQ ID NO: 14488
  misc_feature 1..123: note = chr2:234109988-234110111
  misc_feature 1..123: note = hypo
  source 1..123: mol_type = genomic DNA

SEQ ID NO: 23906 - DNA, 165 bp, Homo sapiens; identical to SEQ ID NO: 14489
  misc_feature 1..165: note = chr2:234369732-234369897
  misc_feature 1..165: note = hypo
  source 1..165: mol_type = genomic DNA

SEQ ID NO: 23907 - DNA, 67 bp, Homo sapiens; identical to SEQ ID NO: 14490
  misc_feature 1..67: note = chr2:239051088-239051155
  misc_feature 1..67: note = hypo
  source 1..67: mol_type = genomic DNA

SEQ ID NO: 23908 - DNA, 43 bp, Homo sapiens
  misc_feature 1..43: note = chr2:239957287-239957330
  misc_feature 1..43: note = hypo
  source 1..43: mol_type = genomic DNA
tcctgcgggctcccccgtgggccaagtctcctaaactgggcca

SEQ ID NO: 23909 - DNA, 48 bp, Homo sapiens; identical to SEQ ID NO: 14492
  misc_feature 1..48: note = chr2:239997539-239997587
  misc_feature 1..48: note = hypo
  source 1..48: mol_type = genomic DNA

SEQ ID NO: 23910 - DNA, 30 bp, Homo sapiens; identical to SEQ ID NO: 14493
  misc_feature 1..30: note = chr2:240103944-240103974
  misc_feature 1..30: note = hypo
  source 1..30: mol_type = genomic DNA

SEQ ID NO: 23911 - DNA, 58 bp, Homo sapiens
  misc_feature 1..58: note = chr2:240169051-240169109
  misc_feature 1..58: note = hypo
  source 1..58: mol_type = genomic DNA
cctgcagggtttggggtggaatatcccccctgtcgagtggagacgaggctgacatgag

SEQ ID NO: 23912 - DNA, 30 bp, Homo sapiens; identical to SEQ ID NO: 14496
  misc_feature 1..30: note = chr2:240658886-240658916
  misc_feature 1..30: note = hypo
  source 1..30: mol_type = genomic DNA

SEQ ID NO: 23913 - DNA, 126 bp, Homo sapiens; identical to SEQ ID NO: 14497
  misc_feature 1..126: note = chr2:240809527-240809653
  misc_feature 1..126: note = hypo
  source 1..126: mol_type = genomic DNA

SEQ ID NO: 23914 - DNA, 13 bp, Homo sapiens
  misc_feature 1..13: note = chr2:241095772-241095785
  misc_feature 1..13: note = hypo
  source 1..13: mol_type = genomic DNA
attcatgaagagt

SEQ ID NO: 23915 - DNA, 21 bp, Homo sapiens
  misc_feature 1..21: note = chr2:241544980-241545001
  misc_feature 1..21: note = hypo
  source 1..21: mol_type = genomic DNA
ttctggggtgagtgtcgagat

SEQ ID NO: 23916 - DNA, 58 bp, Homo sapiens; identical to SEQ ID NO: 14500
  misc_feature 1..58: note = chr2:241722184-241722242
  misc_feature 1..58: note = hypo
  source 1..58: mol_type = genomic DNA

SEQ ID NO: 23917 - DNA, 207 bp, Homo sapiens
  misc_feature 1..207: note = chr2:241864987-241865194
  misc_feature 1..207: note = hypo
  source 1..207: mol_type = genomic DNA
gtgggggcagagcagcggctgtgcacctgagcccaggtcagttaggcccagagggtttggggttccattcaagccccttgacttggggactctgagcgcctctcttaggagaggcttcctacccccaccatgccctgtgggttctctgtccaggagcaccggcctctgtcaggtgaacgcgctcctgcgggagcagctggaacatat

SEQ ID NO: 23918 - DNA, 46 bp, Homo sapiens; identical to SEQ ID NO: 14502
  misc_feature 1..46: note = chr2:242004922-242004968
  misc_feature 1..46: note = hypo
  source 1..46: mol_type = genomic DNA

SEQ ID NO: 23919 - DNA, 43 bp, Homo sapiens; identical to SEQ ID NO: 14503
  misc_feature 1..43: note = chr2:242009609-242009652
  misc_feature 1..43: note = hypo
  source 1..43: mol_type = genomic DNA

SEQ ID NO: 23920 - DNA, 30 bp, Homo sapiens; identical to SEQ ID NO: 14504
  misc_feature 1..30: note = chr2:242436356-242436386
  misc_feature 1..30: note = hypo
  source 1..30: mol_type = genomic DNA

SEQ ID NO: 23921 - DNA, 120 bp, Homo sapiens; identical to SEQ ID NO: 4988
  misc_feature 1..120: note = chr2:242636861-242636981
  misc_feature 1..120: note = hypo
  source 1..120: mol_type = genomic DNA

SEQ ID NO: 23922 - DNA, 91 bp, Homo sapiens; identical to SEQ ID NO: 4989
  misc_feature 1..91: note = chr2:242637041-242637132
  misc_feature 1..91: note = hypo
  source 1..91: mol_type = genomic DNA

SEQ ID NO: 23923 - DNA, 33 bp, Homo sapiens; identical to SEQ ID NO: 14508
  misc_feature 1..33: note = chr2:242672951-242672984
  misc_feature 1..33: note = hypo
  source 1..33: mol_type = genomic DNA

SEQ ID NO: 23924 - DNA, 34 bp, Homo sapiens
  misc_feature 1..34: note = chr2:242756110-242756144
  misc_feature 1..34: note = hypo
  source 1..34: mol_type = genomic DNA
ggacagcagccctggcggagcaccggtccatgaa

SEQ ID NO: 23925 - DNA, 243 bp, Homo sapiens
  misc_feature 1..243: note = chr2:242756297-242756540
  misc_feature 1..243: note = hypo
  source 1..243: mol_type = genomic DNA
cagcgcccgggacctcaccgaggaggccatcggtggtgccgtgcagggtaggcgggcagggtgccggtctgggtccctttgattggccacggtccacatggaagggagattccagcgggaaattgccattctgccccacccctgtctccagccacaagggaaccaaccatccctttccccaggactgttctgcgcctcccgtcccaggcaaatccctctccccaggaccgtcctgagcctccc

SEQ ID NO: 23926 - DNA, 52 bp, Homo sapiens; identical to SEQ ID NO: 14510
  misc_feature 1..52: note = chr2:242757509-242757561
  misc_feature 1..52: note = hypo
  source 1..52: mol_type = genomic DNA

SEQ ID NO: 23927 - DNA, 36 bp, Homo sapiens; identical to SEQ ID NO: 14511
  misc_feature 1..36: note = chr2:242794906-242794942
  misc_feature 1..36: note = hypo
  source 1..36: mol_type = genomic DNA

SEQ ID NO: 23928 - DNA, 32 bp, Homo sapiens
  misc_feature 1..32: note = chr2:242833159-242833191
  misc_feature 1..32: note = hypo
  source 1..32: mol_type = genomic DNA
cttggcaaggcaggtggcggcaccaacaggcc

SEQ ID NO: 23929 - DNA, 33 bp, Homo sapiens
  misc_feature 1..33: note = chr2:242833525-242833558
  misc_feature 1..33: note = hypo
  source 1..33: mol_type = genomic DNA
caggagctcagaccccggcatcagaccggcctc

SEQ ID NO: 23930 - skipped

SEQ ID NO: 23931 - DNA, 47 bp, Homo sapiens; identical to SEQ ID NO: 14517
  misc_feature 1..47: note = chr2:242985116-242985163
  misc_feature 1..47: note = hypo
  source 1..47: mol_type = genomic DNA

SEQ ID NO: 23932 - DNA, 30 bp, Homo sapiens; identical to SEQ ID NO: 14518
  misc_feature 1..30: note = chr3:3167687-3167717
  misc_feature 1..30: note = hypo
  source 1..30: mol_type = genomic DNA

SEQ ID NO: 23933 - DNA, 30 bp, Homo sapiens; identical to SEQ ID NO: 14520
  misc_feature 1..30: note = chr3:12586227-12586257
  misc_feature 1..30: note = hypo
  source 1..30: mol_type = genomic DNA

SEQ ID NO: 23934 - DNA, 40 bp, Homo sapiens
  misc_feature 1..40: note = chr3:13679132-13679172
  misc_feature 1..40: note = hypo
  source 1..40: mol_type = genomic DNA
agctcaacttccagacgggcctcctggtgcctgcgcatat

SEQ ID NO: 23935 - DNA, 30 bp, Homo sapiens; identical to SEQ ID NO: 14522
  misc_feature 1..30: note = chr3:13680779-13680809
  misc_feature 1..30: note = hypo
  source 1..30: mol_type = genomic DNA

SEQ ID NO: 23936 - DNA, 66 bp, Homo sapiens; identical to SEQ ID NO: 14524
  misc_feature 1..66: note = chr3:17499802-17499868
  misc_feature 1..66: note = hypo
  source 1..66: mol_type = genomic DNA

SEQ ID NO: 23937 - DNA, 95 bp, Homo sapiens; identical to SEQ ID NO: 14525
  misc_feature 1..95: note = chr3:32151324-32151419
  misc_feature 1..95: note = hypo
  source 1..95: mol_type = genomic DNA

SEQ ID NO: 23938 - DNA, 163 bp, Homo sapiens; identical to SEQ ID NO: 14526
  misc_feature 1..163: note = chr3:33841159-33841322
  misc_feature 1..163: note = hypo
  source 1..163: mol_type = genomic DNA

SEQ ID NO: 23939 - DNA, 37 bp, Homo sapiens; identical to SEQ ID NO: 14527
  misc_feature 1..37: note = chr3:40501058-40501095
  misc_feature 1..37: note = hypo
  source 1..37: mol_type = genomic DNA

SEQ ID NO: 23940 - DNA, 21 bp, Homo sapiens
  misc_feature 1..21: note = chr3:43664372-43664393
  misc_feature 1..21: note = hypo
  source 1..21: mol_type = genomic DNA
tttgagatagagcctcgcaat

SEQ ID NO: 23941 - DNA, 30 bp, Homo sapiens; identical to SEQ ID NO: 14530
  misc_feature 1..30: note = chr3:45885052-45885082
  misc_feature 1..30: note = hypo
  source 1..30: mol_type = genomic DNA

SEQ ID NO: 23942 - DNA, 22 bp, Homo sapiens
  misc_feature 1..22: note = chr3:47555871-47555893
  misc_feature 1..22: note = hypo
  source 1..22: mol_type = genomic DNA
gccgacacggaattatatcttg

SEQ ID NO: 23943 - DNA, 170 bp, Homo sapiens; identical to SEQ ID NO: 14533
  misc_feature 1..170: note = chr3:48636676-48636846
  misc_feature 1..170: note = hypo
  source 1..170: mol_type = genomic DNA

SEQ ID NO: 23944 - DNA, 30 bp, Homo sapiens; identical to SEQ ID NO: 14534
  misc_feature 1..30: note = chr3:48948476-48948506
  misc_feature 1..30: note = hypo
  source 1..30: mol_type = genomic DNA

SEQ ID NO: 23945 - DNA, 19 bp, Homo sapiens
  misc_feature 1..19: note = chr3:49056918-49056937
  misc_feature 1..19: note = hypo
  source 1..19: mol_type = genomic DNA
tttttttttttgagacgga

SEQ ID NO: 23946 - DNA, 44 bp, Homo sapiens; identical to SEQ ID NO: 14537
  misc_feature 1..44: note = chr3:49940550-49940594
  misc_feature 1..44: note = hypo
  source 1..44: mol_type = genomic DNA

SEQ ID NO: 23947 - DNA, 30 bp, Homo sapiens; identical to SEQ ID NO: 14539
  misc_feature 1..30: note = chr3:50425383-50425413
  misc_feature 1..30: note = hypo
  source 1..30: mol_type = genomic DNA

SEQ ID NO: 23948 - DNA, 173 bp, Homo sapiens; identical to SEQ ID NO: 14540
  misc_feature 1..173: note = chr3:50433950-50434123
  misc_feature 1..173: note = hypo
  source 1..173: mol_type = genomic DNA

SEQ ID NO: 23949 - DNA, 14 bp, Homo sapiens
  misc_feature 1..14: note = chr3:50575602-50575616
  misc_feature 1..14: note = hypo
  source 1..14: mol_type = genomic DNA
ggggctcaagcaat

SEQ ID NO: 23950 - DNA, 240 bp, Homo sapiens; identical to SEQ ID NO: 14543
  misc_feature 1..240: note = chr3:52553207-52553447
  misc_feature 1..240: note = hypo
  source 1..240: mol_type = genomic DNA

SEQ ID NO: 23951 - DNA, 30 bp, Homo sapiens; identical to SEQ ID NO: 14544
  misc_feature 1..30: note = chr3:52900819-52900849
  misc_feature 1..30: note = hypo
  source 1..30: mol_type = genomic DNA

SEQ ID NO: 23952 - DNA, 30 bp, Homo sapiens; identical to SEQ ID NO: 14546
  misc_feature 1..30: note = chr3:53033605-53033635
  misc_feature 1..30: note = hypo
  source 1..30: mol_type = genomic DNA

SEQ ID NO: 23953 - DNA, 83 bp, Homo sapiens; identical to SEQ ID NO: 14547
  misc_feature 1..83: note = chr3:69740999-69741082
  misc_feature 1..83: note = hypo
  source 1..83: mol_type = genomic DNA

SEQ ID NO: 23954 - DNA, 21 bp, Homo sapiens
  misc_feature 1..21: note = chr3:70083716-70083737
  misc_feature 1..21: note = hypo
  source 1..21: mol_type = genomic DNA
aggcgtggtggctcacgctta

SEQ ID NO: 23955 - DNA, 22 bp, Homo sapiens
  misc_feature 1..22: note = chr3:73045583-73045605
  misc_feature 1..22: note = hypo
  source 1..22: mol_type = genomic DNA
ttctgaacgtgaagtgtataca

SEQ ID NO: 23956 - DNA, 17 bp, Homo sapiens
  misc_feature 1..17: note = chr3:86960228-86960245
  misc_feature 1..17: note = hypo
  source 1..17: mol_type = genomic DNA
tgaaagttgacacttcg

SEQ ID NO: 23957 - DNA, 163 bp, Homo sapiens; identical to SEQ ID NO: 14551
  misc_feature 1..163: note = chr3:87782694-87782857
  misc_feature 1..163: note = hypo
  source 1..163: mol_type = genomic DNA

SEQ ID NO: 23958 - DNA, 34 bp, Homo sapiens
  misc_feature 1..34: note = chr3:101231070-101231104
  misc_feature 1..34: note = hypo
  source 1..34: mol_type = genomic DNA
ctgtaagcatatgagtcctcgtcctctcctccta

SEQ ID NO: 23959 - DNA, 30 bp, Homo sapiens; identical to SEQ ID NO: 14555
  misc_feature 1..30: note = chr3:107833994-107834024
  misc_feature 1..30: note = hypo
  source 1..30: mol_type = genomic DNA

SEQ ID NO: 23960 - DNA, 22 bp, Homo sapiens
  misc_feature 1..22: note = chr3:113557437-113557459
  misc_feature 1..22: note = hypo
  source 1..22: mol_type = genomic DNA
aagtttccgagcaattcacctt

SEQ ID NO: 23961 - DNA, 49 bp, Homo sapiens; identical to SEQ ID NO: 14557
  misc_feature 1..49: note = chr3:115752446-115752495
  misc_feature 1..49: note = hypo
  source 1..49: mol_type = genomic DNA

SEQ ID NO: 23962 - DNA, 37 bp, Homo sapiens; identical to SEQ ID NO: 14558
  misc_feature 1..37: note = chr3:118976384-118976421
  misc_feature 1..37: note = hypo
  source 1..37: mol_type = genomic DNA

SEQ ID NO: 23963 - DNA, 120 bp, Homo sapiens; identical to SEQ ID NO: 14559
  misc_feature 1..120: note = chr3:119815773-119815893
  misc_feature 1..120: note = hypo
  source 1..120: mol_type = genomic DNA

SEQ ID NO: 23964 - DNA, 18 bp, Homo sapiens
  misc_feature 1..18: note = chr3:119817451-119817469
  misc_feature 1..18: note = hypo
  source 1..18: mol_type = genomic DNA
aaacgctaggattactgg

SEQ ID NO: 23965 - DNA, 25 bp, Homo sapiens
  misc_feature 1..25: note = chr3:121265940-121265965
  misc_feature 1..25: note = hypo
  source 1..25: mol_type = genomic DNA
aaataaaagagatctcgccggccgt

SEQ ID NO: 23966 - DNA, 79 bp, Homo sapiens; identical to SEQ ID NO: 4998
  misc_feature 1..79: note = chr3:122234561-122234640
  misc_feature 1..79: note = hypo
  source 1..79: mol_type = genomic DNA

SEQ ID NO: 23967 - DNA, 29 bp, Homo sapiens
  misc_feature 1..29: note = chr3:122573648-122573677
  misc_feature 1..29: note = hypo
  source 1..29: mol_type = genomic DNA
gactcaaaggctgggcgcggtggctcacg

SEQ ID NO: 23968 - skipped

SEQ ID NO: 23969 - DNA, 102 bp, Homo sapiens; identical to SEQ ID NO: 14566
  misc_feature 1..102: note = chr3:125456444-125456546
  misc_feature 1..102: note = hypo
  source 1..102: mol_type = genomic DNA

SEQ ID NO: 23970 - DNA, 39 bp, Homo sapiens; identical to SEQ ID NO: 14567
  misc_feature 1..39: note = chr3:125785793-125785832
  misc_feature 1..39: note = hypo
  source 1..39: mol_type = genomic DNA

SEQ ID NO: 23971 - DNA, 130 bp, Homo sapiens; identical to SEQ ID NO: 14568
  misc_feature 1..130: note = chr3:126195886-126196016
  misc_feature 1..130: note = hypo
  source 1..130: mol_type = genomic DNA

SEQ ID NO: 23972 - DNA, 30 bp, Homo sapiens; identical to SEQ ID NO: 14570
  misc_feature 1..30: note = chr3:134320427-134320457
  misc_feature 1..30: note = hypo
  source 1..30: mol_type = genomic DNA

SEQ ID NO: 23973 - DNA, 111 bp, Homo sapiens
  misc_feature 1..111: note = chr3:136582951-136583062
  misc_feature 1..111: note = hypo
  source 1..111: mol_type = genomic DNA
aataaaatgtgtatttatttttctaggcattatcctttgtccaggtttctgcagtgctttcaggtccatctaaataaaatttgaaacctacgtgtaatgttggccgggctc

SEQ ID NO: 23974 - DNA, 32 bp, Homo sapiens; identical to SEQ ID NO: 14572
  misc_feature 1..32: note = chr3:137561189-137561221
  misc_feature 1..32: note = hypo
  source 1..32: mol_type = genomic DNA

SEQ ID NO: 23975 - DNA, 57 bp, Homo sapiens; identical to SEQ ID NO: 14573
  misc_feature 1..57: note = chr3:137717830-137717887
  misc_feature 1..57: note = hypo
  source 1..57: mol_type = genomic DNA

SEQ ID NO: 23976 - DNA, 33 bp, Homo sapiens
  misc_feature 1..33: note = chr3:141482073-141482106
  misc_feature 1..33: note = hypo
  source 1..33: mol_type = genomic DNA
agccatagtgctgtgtttcggtcaaacaacagc

SEQ ID NO: 23977 - DNA, 35 bp, Homo sapiens; identical to SEQ ID NO: 5001
  misc_feature 1..35: note = chr3:142913215-142913250
  misc_feature 1..35: note = hypo
  source 1..35: mol_type = genomic DNA

SEQ ID NO: 23978 - DNA, 21 bp, Homo sapiens
  misc_feature 1..21: note = chr3:142977041-142977062
  misc_feature 1..21: note = hypo
  source 1..21: mol_type = genomic DNA
acagagcgatactccatctca

SEQ ID NO: 23979 - DNA, 45 bp, Homo sapiens; identical to SEQ ID NO: 14579
  misc_feature 1..45: note = chr3:143092973-143093018
  misc_feature 1..45: note = hypo
  source 1..45: mol_type = genomic DNA

SEQ ID NO: 23980 - DNA, 22 bp, Homo sapiens
  misc_feature 1..22: note = chr3:143210840-143210862
  misc_feature 1..22: note = hypo
  source 1..22: mol_type = genomic DNA
cacctaccacttggccgggtgt

SEQ ID NO: 23981 - DNA, 27 bp, Homo sapiens
  misc_feature 1..27: note = chr3:148802983-148803010
  misc_feature 1..27: note = hypo
  source 1..27: mol_type = genomic DNA
actacaattatgggccggatgcggtgg

SEQ ID NO: 23982 - DNA, 161 bp, Homo sapiens; identical to SEQ ID NO: 14584
  misc_feature 1..161: note = chr3:150135175-150135336
  misc_feature 1..161: note = hypo
  source 1..161: mol_type = genomic DNA

SEQ ID NO: 23983 - DNA, 76 bp, Homo sapiens; identical to SEQ ID NO: 14585
  misc_feature 1..76: note = chr3:150237920-150237996
  misc_feature 1..76: note = hypo
  source 1..76: mol_type = genomic DNA

SEQ ID NO: 23984 - DNA, 19 bp, Homo sapiens
  misc_feature 1..19: note = chr3:152744869-152744888
  misc_feature 1..19: note = hypo
  source 1..19: mol_type = genomic DNA
actccgtctcaaataaata

SEQ ID NO: 23985 - DNA, 27 bp, Homo sapiens
  misc_feature 1..27: note = chr3:152829598-152829625
  misc_feature 1..27: note = hypo
  source 1..27: mol_type = genomic DNA
ggcgtgagcgaccgcacccagctgata

SEQ ID NO: 23986 - DNA, 58 bp, Homo sapiens; identical to SEQ ID NO: 14590
  misc_feature 1..58: note = chr3:172384961-172385019
  misc_feature 1..58: note = hypo
  source 1..58: mol_type = genomic DNA

SEQ ID NO: 23987 - DNA, 37 bp, Homo sapiens; identical to SEQ ID NO: 14592
  misc_feature 1..37: note = chr3:172470190-172470227
  misc_feature 1..37: note = hypo
  source 1..37: mol_type = genomic DNA

SEQ ID NO: 23988 - DNA, 23 bp, Homo sapiens
  misc_feature 1..23: note = chr3:179171196-179171219
  misc_feature 1..23: note = hypo
  source 1..23: mol_type = genomic DNA
accgatcccggccccatattctt

SEQ ID NO: 23989 - DNA, 25 bp, Homo sapiens
  misc_feature 1..25: note = chr3:182812783-182812808
  misc_feature 1..25: note = hypo
  source 1..25: mol_type = genomic DNA
tgccctggccaggcacggtggctca

SEQ ID NO: 23990 - DNA, 38 bp, Homo sapiens; identical to SEQ ID NO: 14597
  misc_feature 1..38: note = chr3:182987877-182987915
  misc_feature 1..38: note = hypo
  source 1..38: mol_type = genomic DNA

SEQ ID NO: 23991 - DNA, 22 bp, Homo sapiens
  misc_feature 1..22: note = chr3:183183665-183183687
  misc_feature 1..22: note = hypo
  source 1..22: mol_type = genomic DNA
ttacaggcgtgagccactgccc

SEQ ID NO: 23992 - DNA, 48 bp, Homo sapiens; identical to SEQ ID NO: 14599
  misc_feature 1..48: note = chr3:183622035-183622083
  misc_feature 1..48: note = hypo
  source 1..48: mol_type = genomic DNA

SEQ ID NO: 23993 - DNA, 30 bp, Homo sapiens; identical to SEQ ID NO: 14600
  misc_feature 1..30: note = chr3:183648152-183648182
  misc_feature 1..30: note = hypo
  source 1..30: mol_type = genomic DNA

SEQ ID NO: 23994 - DNA, 171 bp, Homo sapiens; identical to SEQ ID NO: 14601
  misc_feature 1..171: note = chr3:183684023-183684194
  misc_feature 1..171: note = hypo
  source 1..171: mol_type = genomic DNA

SEQ ID NO: 23995 - DNA, 30 bp, Homo sapiens; identical to SEQ ID NO: 5005
  misc_feature 1..30: note = chr3:183965921-183965951
  misc_feature 1..30: note = hypo
  source 1..30: mol_type = genomic DNA

SEQ ID NO: 23996 - DNA, 42 bp, Homo sapiens; identical to SEQ ID NO: 14604
  misc_feature 1..42: note = chr3:184200659-184200701
  misc_feature 1..42: note = hypo
  source 1..42: mol_type = genomic DNA

SEQ ID NO: 23997 - DNA, 59 bp, Homo sapiens; identical to SEQ ID NO: 14605
  misc_feature 1..59: note = chr3:184785167-184785226
  misc_feature 1..59: note = hypo
  source 1..59: mol_type = genomic DNA

SEQ ID NO: 23998 - DNA, 16 bp, Homo sapiens
  misc_feature 1..16: note = chr3:185001919-185001935
  misc_feature 1..16: note = hypo
  source 1..16: mol_type = genomic DNA
gcggccactttccttt

SEQ ID NO: 23999 - DNA, 23 bp, Homo sapiens
  misc_feature 1..23: note = chr3:185270882-185270905
  misc_feature 1..23: note = hypo
  source 1..23: mol_type = genomic DNA
aaaagaaaaacaggccggcacgg

SEQ ID NO: 24000 - DNA, 30 bp, Homo sapiens; identical to SEQ ID NO: 14609
  misc_feature 1..30: note = chr3:185278325-185278355
  misc_feature 1..30: note = hypo
  source 1..30: mol_type = genomic DNA

SEQ ID NO: 24001 - DNA, 44 bp, Homo sapiens
  misc_feature 1..44: note = chr3:185363261-185363305
  misc_feature 1..44: note = hypo
  source 1..44: mol_type = genomic DNA
tgtcaggtgttggaagggctacattcatccgttgttttgctggt

SEQ ID NO: 24002 - DNA, 25 bp, Homo sapiens
  misc_feature 1..25: note = chr3:185551925-185551950
  misc_feature 1..25: note = hypo
  source 1..25: mol_type = genomic DNA
atcccaggctgggtgcggtggctca

SEQ ID NO: 24003 - DNA, 107 bp, Homo sapiens
  misc_feature 1..107: note = chr3:193548530-193548637
  misc_feature 1..107: note = hypo
  source 1..107: mol_type = genomic DNA
caaccacctatttatcgttgcccaggctcctaggcctggatctgtcagccagggcctgcccatggccctgggaggtgatgggagtggtggtagtttcagtctctgat

SEQ ID NO: 24004 - DNA, 30 bp, Homo sapiens; identical to SEQ ID NO: 14615
  misc_feature 1..30: note = chr3:193588129-193588159
  misc_feature 1..30: note = hypo
  source 1..30: mol_type = genomic DNA

SEQ ID NO: 24005 - DNA, 36 bp, Homo sapiens; identical to SEQ ID NO: 14616
  misc_feature 1..36: note = chr3:193922775-193922811
  misc_feature 1..36: note = hypo
  source 1..36: mol_type = genomic DNA

SEQ ID NO: 24006 - DNA, 30 bp, Homo sapiens; identical to SEQ ID NO: 14618
  misc_feature 1..30: note = chr3:195536686-195536716
  misc_feature 1..30: note = hypo
  source 1..30: mol_type = genomic DNA

SEQ ID NO: 24007 - DNA, 59 bp, Homo sapiens; identical to SEQ ID NO: 14620
  misc_feature 1..59: note = chr3:195597490-195597549
  misc_feature 1..59: note = hypo
  source 1..59: mol_type = genomic DNA

SEQ ID NO: 24008 - DNA, 68 bp, Homo sapiens; identical to SEQ ID NO: 14621
  misc_feature 1..68: note = chr3:195599772-195599840
  misc_feature 1..68: note = hypo
  source 1..68: mol_type = genomic DNA

SEQ ID NO: 24009 - DNA, 77 bp, Homo sapiens; identical to SEQ ID NO: 14622
  misc_feature 1..77: note = chr3:195600494-195600571
  misc_feature 1..77: note = hypo
  source 1..77: mol_type = genomic DNA

SEQ ID NO: 24010 - DNA, 110 bp, Homo sapiens; identical to SEQ ID NO: 14623
  misc_feature 1..110: note = chr3:195600916-195601026
  misc_feature 1..110: note = hypo
  source 1..110: mol_type = genomic DNA

SEQ ID NO: 24011 - DNA, 36 bp, Homo sapiens; identical to SEQ ID NO: 14624
  misc_feature 1..36: note = chr3:195637307-195637343
  misc_feature 1..36: note = hypo
  source 1..36: mol_type = genomic DNA

SEQ ID NO: 24012 - DNA, 30 bp, Homo sapiens; identical to SEQ ID NO: 14625
  misc_feature 1..30: note = chr3:195648737-195648767
  misc_feature 1..30: note = hypo
  source 1..30: mol_type = genomic DNA

SEQ ID NO: 24013 - DNA, 30 bp, Homo sapiens; identical to SEQ ID NO: 14627
  misc_feature 1..30: note = chr3:196256292-196256322
  misc_feature 1..30: note = hypo
  source 1..30: mol_type = genomic DNA

SEQ ID NO: 24014 - DNA, 30 bp, Homo sapiens; identical to SEQ ID NO: 14628
  misc_feature 1..30: note = chr3:196294577-196294607
  misc_feature 1..30: note = hypo
  source 1..30: mol_type = genomic DNA

SEQ ID NO: 24015 - DNA, 137 bp, Homo sapiens
  misc_feature 1..137: note = chr3:196387158-196387295
  misc_feature 1..137: note = hypo
  source 1..137: mol_type = genomic DNA
caacctcccctgcatcgtggacttcgggctcacgcggctgcgggtcctcaacgtcagctacaacgtcctggagtggttcctcgcgaccgggggagaggctgccttcgagctggagacgctggacctgtctcacaacc

SEQ ID NO: 24016 - DNA, 213 bp, Homo sapiens
  misc_feature 1..213: note = chr3:196387415-196387628
  misc_feature 1..213: note = hypo
  source 1..213: mol_type = genomic DNA
cccagttcctcctcgtggacggcaacgtgaccaacatcaccaccgtcagcctctgggaagaattctcctccagcgacctcgcagatctccgcttcctggacatgagccagaaccagttccagtacctgccagacggcttcctgaggaaaatgccttccctctcccacctgaacctccaccagaattgcctgatgacgcttcacattcgggagc

SEQ ID NO: 24017 - DNA, 30 bp, Homo sapiens; identical to SEQ ID NO: 14632
  misc_feature 1..30: note = chr3:196754516-196754546
  misc_feature 1..30: note = hypo
  source 1..30: mol_type = genomic DNA

SEQ ID NO: 24018 - DNA, 34 bp, Homo sapiens; identical to SEQ ID NO: 14633
  misc_feature 1..34: note = chr3:197313900-197313934
  misc_feature 1..34: note = hypo
  source 1..34: mol_type = genomic DNA

SEQ ID NO: 24019 - DNA, 34 bp, Homo sapiens; identical to SEQ ID NO: 14635
  misc_feature 1..34: note = chr3:197327804-197327838
  misc_feature 1..34: note = hypo
  source 1..34: mol_type = genomic DNA

SEQ ID NO: 24020 - DNA, 32 bp, Homo sapiens; identical to SEQ ID NO: 14636
  misc_feature 1..32: note = chr3:197402171-197402203
  misc_feature 1..32: note = hypo
  source 1..32: mol_type = genomic DNA

SEQ ID NO: 24021 - DNA, 61 bp, Homo sapiens; identical to SEQ ID NO: 14637
  misc_feature 1..61: note = chr4:619541-619602
  misc_feature 1..61: note = hypo
  source 1..61: mol_type = genomic DNA

SEQ ID NO: 24022 - DNA, 30 bp, Homo sapiens; identical to SEQ ID NO: 14638
  misc_feature 1..30: note = chr4:628444-628474
  misc_feature 1..30: note = hypo
  source 1..30: mol_type = genomic DNA

SEQ ID NO: 24023 - DNA, 284 bp, Homo sapiens
  misc_feature 1..284: note = chr4:650912-651196
  misc_feature 1..284: note = hypo
  source 1..284: mol_type = genomic DNA
gtgctcatgtgtgtgcggtatgcatgcggccagggagaggacgacaaagggcccccccgggagcaggagcctctgcagagcacccgggagaccccacacagaagcactgcgacaccatggtggcagccccaggacctgcccgccgagccacggggcctggcacacaggcacatgggagggggcgcgccgggagcgctgagcgccagtgacactgccatcccctccagtccctgacacagttcctgggctggtcagtgatgaacaccgacacctacgacaagatg

SEQ ID NO: 24024 - DNA, 53 bp, Homo sapiens
  misc_feature 1..53: note = chr4:651261-651314
  misc_feature 1..53: note = hypo
  source 1..53: mol_type = genomic DNA
ggacgagatccagctcatcctggtgcggcggggcaggacgtccaggggtcacc

SEQ ID NO: 24025 - DNA, 137 bp, Homo sapiens; identical to SEQ ID NO: 14640
  misc_feature 1..137: note = chr4:660921-661058
  misc_feature 1..137: note = hypo
  source 1..137: mol_type = genomic DNA

SEQ ID NO: 24026 - DNA, 59 bp, Homo sapiens; identical to SEQ ID NO: 14641
  misc_feature 1..59: note = chr4:718181-718240
  misc_feature 1..59: note = hypo
  source 1..59: mol_type = genomic DNA

SEQ ID NO: 24027 - DNA, 102 bp, Homo sapiens; identical to SEQ ID NO: 14642
  misc_feature 1..102: note = chr4:738388-738490
  misc_feature 1..102: note = hypo
  source 1..102: mol_type = genomic DNA

SEQ ID NO: 24028 - DNA, 82 bp, Homo sapiens; identical to SEQ ID NO: 14643
  misc_feature 1..82: note = chr4:828978-829060
  misc_feature 1..82: note = hypo
  source 1..82: mol_type = genomic DNA

SEQ ID NO: 24029 - DNA, 22 bp, Homo sapiens
  misc_feature 1..22: note = chr4:829641-829663
  misc_feature 1..22: note = hypo
  source 1..22: mol_type = genomic DNA
agctccccgaggaaagagtgcc

SEQ ID NO: 24030 - DNA, 416 bp, Homo sapiens
  misc_feature 1..416: note = chr4:955919-956335
  misc_feature 1..416: note = hypo
  source 1..416: mol_type = genomic DNA
ccctgagctccccaacagctctgccggcaggcagagacaagagcaaggaccaccctggcaccaagccgagcacccaggagagggcagcatgggcaggtcctggccaggctctgtcgccagctggctcagcacaatccccagcagtggctactttctgtgtctccctcaactgcccgctttgcagaggggatgatgcgggcgcgtacacccgagtgtggctgggaagaggacgcccgttgtgacgcgtgtagcggggtcatatgcaggagcctggaaggcaccccacgccgggctgccctgtaccttggggggctctgcgtctgccgtgtcgttctctgcactgccagcctcgtgggcatccagcaggatggtccagcggtccatgagcacggcgtcggcctcgtccacagacagca

SEQ ID NO: 24031 - DNA, 179 bp, Homo sapiens; identical to SEQ ID NO: 14647
  misc_feature 1..179: note = chr4:956578-956757
  misc_feature 1..179: note = hypo
  source 1..179: mol_type = genomic DNA

SEQ ID NO: 24032 - DNA, 42 bp, Homo sapiens; identical to SEQ ID NO: 14648
  misc_feature 1..42: note = chr4:1016960-1017002
  misc_feature 1..42: note = hypo
  source 1..42: mol_type = genomic DNA

SEQ ID NO: 24033 - DNA, 36 bp, Homo sapiens; identical to SEQ ID NO: 14649
  misc_feature 1..36: note = chr4:1024375-1024411
  misc_feature 1..36: note = hypo
  source 1..36: mol_type = genomic DNA

SEQ ID NO: 24034 - DNA, 53 bp, Homo sapiens
  misc_feature 1..53: note = chr4:1025875-1025928
  misc_feature 1..53: note = hypo
  source 1..53: mol_type = genomic DNA
cctgggcacgcaggccgacatggattctgtggctgaggccgtcagcgtgtgaa

SEQ ID NO: 24035 - DNA, 63 bp, Homo sapiens
  misc_feature 1..63: note = chr4:1026074-1026137
  misc_feature 1..63: note = hypo
  source 1..63: mol_type = genomic DNA
tctgaggggcaaccccaccagcctgcttgggccccagcgtcttctcagcgtctgcctcctgtg

SEQ ID NO: 24036 - DNA, 117 bp, Homo sapiens; identical to SEQ ID NO: 14651
  misc_feature 1..117: note = chr4:1036393-1036510
  misc_feature 1..117: note = hypo
  source 1..117: mol_type = genomic DNA

SEQ ID NO: 24037 - DNA, 108 bp, Homo sapiens; identical to SEQ ID NO: 14652
  misc_feature 1..108: note = chr4:1299074-1299182
  misc_feature 1..108: note = hypo
  source 1..108: mol_type = genomic DNA

SEQ ID NO: 24038 - DNA, 30 bp, Homo sapiens; identical to SEQ ID NO: 5013
  misc_feature 1..30: note = chr4:1299450-1299480
  misc_feature 1..30: note = hypo
  source 1..30: mol_type = genomic DNA

SEQ ID NO: 24039 - DNA, 88 bp, Homo sapiens; identical to SEQ ID NO: 14654
  misc_feature 1..88: note = chr4:1332572-1332660
  misc_feature 1..88: note = hypo
  source 1..88: mol_type = genomic DNA

SEQ ID NO: 24040 - DNA, 178 bp, Homo sapiens; identical to SEQ ID NO: 14655
  misc_feature 1..178: note = chr4:1332886-1333064
  misc_feature 1..178: note = hypo
  source 1..178: mol_type = genomic DNA

SEQ ID NO: 24041 - DNA, 27 bp, Homo sapiens
  misc_feature 1..27: note = chr4:1338688-1338715
  misc_feature 1..27: note = hypo
  source 1..27: mol_type = genomic DNA
ctggcagaagcttcccggcagagggat

SEQ ID NO: 24042 - DNA, 138 bp, Homo sapiens; identical to SEQ ID NO: 14657
  misc_feature 1..138: note = chr4:1504936-1505074
  misc_feature 1..138: note = hypo
  source 1..138: mol_type = genomic DNA

SEQ ID NO: 24043 - DNA, 24 bp, Homo sapiens
  misc_feature 1..24: note = chr4:1512344-1512368
  misc_feature 1..24: note = hypo
  source 1..24: mol_type = genomic DNA
tgcggttttaacctgcgttttcct

SEQ ID NO: 24044 - DNA, 21 bp, Homo sapiens
  misc_feature 1..21: note = chr4:1556398-1556419
  misc_feature 1..21: note = hypo
  source 1..21: mol_type = genomic DNA
tgtccacccccagaccgcctt

SEQ ID NO: 24045 - DNA, 30 bp, Homo sapiens; identical to SEQ ID NO: 14660
  misc_feature 1..30: note = chr4:1562145-1562175
  misc_feature 1..30: note = hypo
  source 1..30: mol_type = genomic DNA

SEQ ID NO: 24046 - DNA, 21 bp, Homo sapiens
  misc_feature 1..21: note = chr4:1576463-1576484
  misc_feature 1..21: note = hypo
  source 1..21: mol_type = genomic DNA
aggtgggcctggagccggtgg

SEQ ID NO: 24047 - DNA, 82 bp, Homo sapiens
  misc_feature 1..82: note = chr4:1616600-1616682
  misc_feature 1..82: note = hypo
  source 1..82: mol_type = genomic DNA
ggggtgccccatggccgtcctatgctgacggacaccagatggcatttcagcaccgggcacaggggccgctttaaacagcaaa

SEQ ID NO: 24048 - DNA, 235 bp, Homo sapiens; identical to SEQ ID NO: 14663
  misc_feature 1..235: note = chr4:1687244-1687479
  misc_feature 1..235: note = hypo
  source 1..235: mol_type = genomic DNA

SEQ ID NO: 24049 - DNA, 82 bp, Homo sapiens; identical to SEQ ID NO: 14664
  misc_feature 1..82: note = chr4:1803282-1803364
  misc_feature 1..82: note = hypo
  source 1..82: mol_type = genomic DNA

SEQ ID NO: 24050 - DNA, 147 bp, Homo sapiens; identical to SEQ ID NO: 14665
  misc_feature 1..147: note = chr4:1807505-1807652
  misc_feature 1..147: note = hypo
  source 1..147: mol_type = genomic DNA

SEQ ID NO: 24051 - DNA, 61 bp, Homo sapiens; identical to SEQ ID NO: 14666
  misc_feature 1..61: note = chr4:1977033-1977094
  misc_feature 1..61: note = hypo
  source 1..61: mol_type = genomic DNA

SEQ ID NO: 24052 - DNA, 74 bp, Homo sapiens; identical to SEQ ID NO: 14668
  misc_feature 1..74: note = chr4:1994756-1994830
  misc_feature 1..74: note = hypo
  source 1..74: mol_type = genomic DNA

SEQ ID NO: 24053 - DNA, 33 bp, Homo sapiens; identical to SEQ ID NO: 14669
  misc_feature 1..33: note = chr4:2065634-2065667
  misc_feature 1..33: note = hypo
  source 1..33: mol_type = genomic DNA

SEQ ID NO: 24054 - DNA, 91 bp, Homo sapiens
  misc_feature 1..91: note = chr4:2305827-2305918
  misc_feature 1..91: note = hypo
  source 1..91: mol_type = genomic DNA
gtgcctctgcagccagctcctgcccctgcccctcctcacacacagaccccacactcggccagggcccagcacctgccggtggccaagatgg

SEQ ID NO: 24055 - skipped

SEQ ID NO: 24056 - DNA, 36 bp, Homo sapiens; identical to SEQ ID NO: 14673
  misc_feature 1..36: note = chr4:2932947-2932983
  misc_feature 1..36: note = hypo
  source 1..36: mol_type = genomic DNA

SEQ ID NO: 24057 - DNA, 30 bp, Homo sapiens; identical to SEQ ID NO: 14674
  misc_feature 1..30: note = chr4:3310521-3310551
  misc_feature 1..30: note = hypo
  source 1..30: mol_type = genomic DNA

SEQ ID NO: 24058 - DNA, 47 bp, Homo sapiens; identical to SEQ ID NO: 14675
  misc_feature 1..47: note = chr4:3445894-3445941
  misc_feature 1..47: note = hypo
  source 1..47: mol_type = genomic DNA

SEQ ID NO: 24059 - DNA, 304 bp, Homo sapiens; identical to SEQ ID NO: 14676
  misc_feature 1..304: note = chr4:3446463-3446767
  misc_feature 1..304: note = hypo
  source 1..304: mol_type = genomic DNA

SEQ ID NO: 24060 - DNA, 82 bp, Homo sapiens; identical to SEQ ID NO: 14678
  misc_feature 1..82: note = chr4:4256159-4256241
  misc_feature 1..82: note = hypo
  source 1..82: mol_type = genomic DNA

SEQ ID NO: 24061 - DNA, 31 bp, Homo sapiens
  misc_feature 1..31: note = chr4:6670153-6670184
  misc_feature 1..31: note = hypo
  source 1..31: mol_type = genomic DNA
acgtgcaagacaccacgttttactgccccgc

SEQ ID NO: 24062 - DNA, 37 bp, Homo sapiens; identical to SEQ ID NO: 14680
  misc_feature 1..37: note = chr4:6719869-6719906
  misc_feature 1..37: note = hypo
  source 1..37: mol_type = genomic DNA

SEQ ID NO: 24063 - DNA, 17 bp, Homo sapiens
  misc_feature 1..17: note = chr4:6748557-6748574
  misc_feature 1..17: note = hypo
  source 1..17: mol_type = genomic DNA
gtcggcctgggtctgga

SEQ ID NO: 24064 - DNA, 110 bp, Homo sapiens; identical to SEQ ID NO: 14683
  misc_feature 1..110: note = chr4:7047093-7047203
  misc_feature 1..110: note = hypo
  source 1..110: mol_type = genomic DNA

SEQ ID NO: 24065 - DNA, 30 bp, Homo sapiens
  misc_feature 1..30: note = chr4:7647740-7647770
  misc_feature 1..30: note = hypo
  source 1..30: mol_type = genomic DNA
tgccctagagtcaaacgtgttcattcggtc

SEQ ID NO: 24066 - skipped

SEQ ID NO: 24067 - DNA, 179 bp, Homo sapiens; identical to SEQ ID NO: 14685
  misc_feature 1..179: note = chr4:7741325-7741504
  misc_feature 1..179: note = hypo
  source 1..179: mol_type = genomic DNA

SEQ ID NO: 24068 - DNA, 38 bp, Homo sapiens; identical to SEQ ID NO: 14686
  misc_feature 1..38: note = chr4:8607740-8607778
  misc_feature 1..38: note = hypo
  source 1..38: mol_type = genomic DNA

SEQ ID NO: 24069 - DNA, 33 bp, Homo sapiens; identical to SEQ ID NO: 14687
  misc_feature 1..33: note = chr4:8608618-8608651
  misc_feature 1..33: note = hypo
  source 1..33: mol_type = genomic DNA

SEQ ID NO: 24070 - DNA, 30 bp, Homo sapiens; identical to SEQ ID NO: 14688
  misc_feature 1..30: note = chr4:8615890-8615920
  misc_feature 1..30: note = hypo
  source 1..30: mol_type = genomic DNA

SEQ ID NO: 24071 - DNA, 55 bp, Homo sapiens; identical to SEQ ID NO: 14689
  misc_feature 1..55: note = chr4:39448324-39448379
  misc_feature 1..55: note = hypo
  source 1..55: mol_type = genomic DNA

SEQ ID NO: 24072 - DNA, 98 bp, Homo sapiens; identical to SEQ ID NO: 5017
  misc_feature 1..98: note = chr4:39816677-39816775
  misc_feature 1..98: note = hypo
  source 1..98: mol_type = genomic DNA

SEQ ID NO: 24073 - DNA, 38 bp, Homo sapiens; identical to SEQ ID NO: 5018
  misc_feature 1..38: note = chr4:39817075-39817113
  misc_feature 1..38: note = hypo
  source 1..38: mol_type = genomic DNA

SEQ ID NO: 24074 - DNA, 23 bp, Homo sapiens
  misc_feature 1..23: note = chr4:40910280-40910303
  misc_feature 1..23: note = hypo
  source 1..23: mol_type = genomic DNA
actgtgagaaaagaacgtttctg

SEQ ID NO: 24075 - DNA, 28 bp, Homo sapiens
  misc_feature 1..28: note = chr4:74468515-74468543
  misc_feature 1..28: note = hypo
  source 1..28: mol_type = genomic DNA
caagtttcggccaggcgcggtggctcat

SEQ ID NO: 24076 - DNA, 44 bp, Homo sapiens
  misc_feature 1..44: note = chr4:75241435-75241479
  misc_feature 1..44: note = hypo
  source 1..44: mol_type = genomic DNA
accctagtttgcaagtgtttgggagcagacgcatattgcaggaa

SEQ ID NO: 24077 - DNA, 30 bp, Homo sapiens; identical to SEQ ID NO: 14695
  misc_feature 1..30: note = chr4:76912406-76912436
  misc_feature 1..30: note = hypo
  source 1..30: mol_type = genomic DNA

SEQ ID NO: 24078 - DNA, 41 bp, Homo sapiens; identical to SEQ ID NO: 14696
  misc_feature 1..41: note = chr4:84169961-84170002
  misc_feature 1..41: note = hypo
  source 1..41: mol_type = genomic DNA

SEQ ID NO: 24079 - DNA, 37 bp, Homo sapiens; identical to SEQ ID NO: 14697
  misc_feature 1..37: note = chr4:87899606-87899643
  misc_feature 1..37: note = hypo
  source 1..37: mol_type = genomic DNA

SEQ ID NO: 24080 - DNA, 18 bp, Homo sapiens
  misc_feature 1..18: note = chr4:95762911-95762929
  misc_feature 1..18: note = hypo
  source 1..18: mol_type = genomic DNA
attcggccatcttggctc

SEQ ID NO: 24081 - DNA, 24 bp, Homo sapiens
  misc_feature 1..24: note = chr4:110735814-110735838
  misc_feature 1..24: note = hypo
  source 1..24: mol_type = genomic DNA
accacgccccgcctacaaaggtat

SEQ ID NO: 24082 - DNA, 30 bp, Homo sapiens; identical to SEQ ID NO: 14701
  misc_feature 1..30: note = chr4:113154853-113154883
  misc_feature 1..30: note = hypo
  source 1..30: mol_type = genomic DNA

SEQ ID NO: 24083 - DNA, 12 bp, Homo sapiens
  misc_feature 1..12: note = chr4:113559151-113559163
  misc_feature 1..12: note = hypo
  source 1..12: mol_type = genomic DNA
tattaaaacatt

SEQ ID NO: 24084 - DNA, 34 bp, Homo sapiens; identical to SEQ ID NO: 14703
  misc_feature 1..34: note = chr4:113559426-113559460
  misc_feature 1..34: note = hypo
  source 1..34: mol_type = genomic DNA

SEQ ID NO: 24085 - DNA, 89 bp, Homo sapiens; identical to SEQ ID NO: 14704
  misc_feature 1..89: note = chr4:123866964-123867053
  misc_feature 1..89: note = hypo
  source 1..89: mol_type = genomic DNA

SEQ ID NO: 24086 - DNA, 27 bp, Homo sapiens
  misc_feature 1..27: note = chr4:128984288-128984315
  misc_feature 1..27: note = hypo
  source 1..27: mol_type = genomic DNA
aaagtaaaaatgggccggcgcggtggc

SEQ ID NO: 24087 - DNA, 135 bp, Homo sapiens; identical to SEQ ID NO: 14706
  misc_feature 1..135: note = chr4:154216763-154216898
  misc_feature 1..135: note = hypo
  source 1..135: mol_type = genomic DNA

SEQ ID NO: 24088 - DNA, 65 bp, Homo sapiens; identical to SEQ ID NO: 14707
  misc_feature 1..65: note = chr4:154540165-154540230
  misc_feature 1..65: note = hypo
  source 1..65: mol_type = genomic DNA

SEQ ID NO: 24089 - DNA, 67 bp, Homo sapiens; identical to SEQ ID NO: 14708
  misc_feature 1..67: note = chr4:170484641-170484708
  misc_feature 1..67: note = hypo
  source 1..67: mol_type = genomic DNA

SEQ ID NO: 24090 - DNA, 132 bp, Homo sapiens
  misc_feature 1..132: note = chr5:480880-481012
  misc_feature 1..132: note = hypo
  source 1..132: mol_type = genomic DNA
caagcaaacacagatcgctcagaaaatgggaacccagggcaaattgtatgtgctccttactgggtttattataagtgtcacatgttttttataataaaacataggtgatttcaccttaatggacaaactctt

SEQ ID NO: 24091 - DNA, 30 bp, Homo sapiens; identical to SEQ ID NO: 14711
  misc_feature 1..30: note = chr5:488962-488992
  misc_feature 1..30: note = hypo
  source 1..30: mol_type = genomic DNA

SEQ ID NO: 24092 - DNA, 219 bp, Homo sapiens
  misc_feature 1..219: note = chr5:491536-491755
  misc_feature 1..219: note = hypo
  source 1..219: mol_type = genomic DNA
tgcagtcctcctcctctccctgggacctggtggccggcgagtgtggacggacccctacctctgcccagtgccggaggaagagcggcagcccctggccacctgcagcccccaagccgagctgccgagatgggaactcctccccaagcagaacacgtgctgggacctggggacgcgcaggggactggccttggtcacgagggcctacggggctgccagcca

SEQ ID NO: 24093 - DNA, 32 bp, Homo sapiens; identical to SEQ ID NO: 14713
  misc_feature 1..32: note = chr5:492064-492096
  misc_feature 1..32: note = hypo
  source 1..32: mol_type = genomic DNA

SEQ ID NO: 24094 - DNA, 72 bp, Homo sapiens
  misc_feature 1..72: note = chr5:538686-538758
  misc_feature 1..72: note = hypo
  source 1..72: mol_type = genomic DNA
cctgtgcctgcctgacgatgccgcctcagccgcccagggctccctcagggaaaacgtcgccaagcaccgacg

SEQ ID NO: 24095 - DNA, 145 bp, Homo sapiens
  misc_feature 1..145: note = chr5:538806-538951
  misc_feature 1..145: note = hypo
  source 1..145: mol_type = genomic DNA
tgtggcaccaggctggccaggggactgttggaacatttgcggaggagcacagttgccatttccttcatgccacacctgccccagcttgtgtctgtgtgtgatggcacggtttgggctggcaggaggggcacgggtgcttgggtgt

SEQ ID NO: 24096 - DNA, 333 bp, Homo sapiens
  misc_feature 1..333: note = chr5:554538-554871
  misc_feature 1..333: note = hypo
  source 1..333: mol_type = genomic DNA
ggataaaccaggggtggggtctgggtcacaggatgacccgggggtgggtcacgggataaaccaggggtggggggctgggtcacgggatgaacggggggcgggtcacaggatgaaccgtgggcgggtcatgggataaaccagggtggggtctgggtcacaggatgacccgggggtgggtcacgggataaaccaggggtggggggtgggtcacgggatgaacggggggcgggtcacaggatgaaccgtgggtgggtcatgggataaaccagggtggggtctgggtcacgggatgaacggggttgggggctgggtcacgggatgaaccggggggtg

SEQ ID NO: 24097 - DNA, 16 bp, Homo sapiens
  misc_feature 1..16: note = chr5:554900-554916
  misc_feature 1..16: note = hypo
  source 1..16: mol_type = genomic DNA
tcacgggctaaaccgg

SEQ ID NO: 24098 - skipped

SEQ ID NO: 24099 - DNA, 94 bp, Homo sapiens; identical to SEQ ID NO: 14717
  misc_feature 1..94: note = chr5:556211-556305
  misc_feature 1..94: note = hypo
  source 1..94: mol_type = genomic DNA

SEQ ID NO: 24100 - skipped

SEQ ID NO: 24101 - DNA, 17 bp, Homo sapiens
  misc_feature 1..17: note = chr5:678006-678023
  misc_feature 1..17: note = hypo
  source 1..17: mol_type = genomic DNA
gccggaaggcctcctcc

SEQ ID NO: 24102 - DNA, 30 bp, Homo sapiens; identical to SEQ ID NO: 14719
  misc_feature 1..30: note = chr5:1003129-1003159
  misc_feature 1..30: note = hypo
  source 1..30: mol_type = genomic DNA

SEQ ID NO: 24103 - DNA, 38 bp, Homo sapiens; identical to SEQ ID NO: 14720
  misc_feature 1..38: note = chr5:1021444-1021482
  misc_feature 1..38: note = hypo
  source 1..38: mol_type = genomic DNA

SEQ ID NO: 24104 - DNA, 230 bp, Homo sapiens
  misc_feature 1..230: note = chr5:1034370-1034600
  misc_feature 1..230: note = hypo
  source 1..230: mol_type = genomic DNA
gtggaggaggacgaccgccaggagtggacgttcacgctctatgactttgacaactgcgggaaggtcaccagggaggtaggtgagcttgtgtttgcgtcaggtccacagtagtagacagacggggcagacagactgtgctggcctcgcgatacctcagggggcaggaggggacctgcctgctgcgaggtcctcatgccagctgggcttgcgtctccccagggcccagttca

SEQ ID NO: 24105 - DNA, 82 bp, Homo sapiens; identical to SEQ ID NO: 14722
  misc_feature 1..82: note = chr5:1073600-1073682
  misc_feature 1..82: note = hypo
  source 1..82: mol_type = genomic DNA

SEQ ID NO: 24106 - DNA, 136 bp, Homo sapiens; identical to SEQ ID NO: 14723
  misc_feature 1..136: note = chr5:1073918-1074054
  misc_feature 1..136: note = hypo
  source 1..136: mol_type = genomic DNA

SEQ ID NO: 24107 - DNA, 125 bp, Homo sapiens; identical to SEQ ID NO: 5026
  misc_feature 1..125: note = chr5:1174263-1174388
  misc_feature 1..125: note = hypo
  source 1..125: mol_type = genomic DNA

SEQ ID NO: 24108 - DNA, 32 bp, Homo sapiens; identical to SEQ ID NO: 14725
  misc_feature 1..32: note = chr5:1189595-1189627
  misc_feature 1..32: note = hypo
  source 1..32: mol_type = genomic DNA

SEQ ID NO: 24109 - DNA, 29 bp, Homo sapiens
  misc_feature 1..29: note = chr5:1193944-1193973
  misc_feature 1..29: note = hypo
  source 1..29: mol_type = genomic DNA
tctgagcggaacagcgagccacctgcagc

SEQ ID NO: 24110 - DNA, 16 bp, Homo sapiens
  misc_feature 1..16: note = chr5:1221181-1221197
  misc_feature 1..16: note = hypo
  source 1..16: mol_type = genomic DNA
gttcgggtagcagaac

SEQ ID NO: 24111 - DNA, 30 bp, Homo sapiens; identical to SEQ ID NO: 14728
  misc_feature 1..30: note = chr5:1223271-1223301
  misc_feature 1..30: note = hypo
  source 1..30: mol_type = genomic DNA

SEQ ID NO: 24112 - DNA, 30 bp, Homo sapiens; identical to SEQ ID NO: 14729
  misc_feature 1..30: note = chr5:1233049-1233079
  misc_feature 1..30: note = hypo
  source 1..30: mol_type = genomic DNA

SEQ ID NO: 24113 - DNA, 47 bp, Homo sapiens; identical to SEQ ID NO: 14731
  misc_feature 1..47: note = chr5:1746593-1746640
  misc_feature 1..47: note = hypo
  source 1..47: mol_type = genomic DNA

SEQ ID NO: 24114 - DNA, 19 bp, Homo sapiens
  misc_feature 1..19: note = chr5:1747003-1747022
  misc_feature 1..19: note = hypo
  source 1..19: mol_type = genomic DNA
tgggtgctgggtccccggc

SEQ ID NO: 24115 - DNA, 56 bp, Homo sapiens
  misc_feature 1..56: note = chr5:1747098-1747154
  misc_feature 1..56: note = hypo
  source 1..56: mol_type = genomic DNA
caccacagcggaagtcggtctctctcatcctggagtccgcgcggctgagggcgagg

SEQ ID NO: 24116 - DNA, 30 bp, Homo sapiens; identical to SEQ ID NO: 14733
  misc_feature 1..30: note = chr5:1795233-1795263
  misc_feature 1..30: note = hypo
  source 1..30: mol_type = genomic DNA

SEQ ID NO: 24117 - DNA, 30 bp, Homo sapiens; identical to SEQ ID NO: 14734
  misc_feature 1..30: note = chr5:1865547-1865577
  misc_feature 1..30: note = hypo
  source 1..30: mol_type = genomic DNA

SEQ ID NO: 24118 - DNA, 30 bp, Homo sapiens; identical to SEQ ID NO: 14735
  misc_feature 1..30: note = chr5:1949574-1949604
  misc_feature 1..30: note = hypo
  source 1..30: mol_type = genomic DNA

SEQ ID NO: 24119 - DNA, 17 bp, Homo sapiens
  misc_feature 1..17: note = chr5:1950777-1950794
  misc_feature 1..17: note = hypo
  source 1..17: mol_type = genomic DNA
ccctcggcagcttcacg

SEQ ID NO: 24120 - DNA, 211 bp, Homo sapiens
  misc_feature 1..211: note = chr5:1950960-1951171
  misc_feature 1..211: note = hypo
  source 1..211: mol_type = genomic DNA
gtgcatgcctgcgtcatctgctgtgtatgtgtcatctgttgtgcatgcgtgtgtcgtctgctgtgggcgcgtgagtcatctgctctgtgtgcttgtgccgtctgctgtgcctgcgtcatcgtctgctgtgcgtgtgtcatctgtgcgtgtgtcatctgctgtgcgtgagtcatctgctgtgcgtgtgtcatctgtgcgtgtgtcatctgct

SEQ ID NO: 24121 - DNA, 150 bp, Homo sapiens; identical to SEQ ID NO: 14737
  misc_feature 1..150: note = chr5:2136920-2137070
  misc_feature 1..150: note = hypo
  source 1..150: mol_type = genomic DNA

SEQ ID NO: 24122 - DNA, 30 bp, Homo sapiens; identical to SEQ ID NO: 14738
  misc_feature 1..30: note = chr5:2180638-2180668
  misc_feature 1..30: note = hypo
  source 1..30: mol_type = genomic DNA

SEQ ID NO: 24123 - DNA, 68 bp, Homo sapiens; identical to SEQ ID NO: 14739
  misc_feature 1..68: note = chr5:2369614-2369682
  misc_feature 1..68: note = hypo
  source 1..68: mol_type = genomic DNA

SEQ ID NO: 24124 - skipped

SEQ ID NO: 24125 - DNA, 19 bp, Homo sapiens
  misc_feature 1..19: note = chr5:2541611-2541630
  misc_feature 1..19: note = hypo
  source 1..19: mol_type = genomic DNA
gtgccgactctgatgtgcg

SEQ ID NO: 24126 - DNA, 30 bp, Homo sapiens; identical to SEQ ID NO: 14741
  misc_feature 1..30: note = chr5:3221107-3221137
  misc_feature 1..30: note = hypo
  source 1..30: mol_type = genomic DNA

SEQ ID NO: 24127 - DNA, 198 bp, Homo sapiens
  misc_feature 1..198: note = chr5:3324844-3325042
  misc_feature 1..198: note = hypo
  source 1..198: mol_type = genomic DNA
caagagcaaagccaccgctccacgcctgcccggggaattggtggccgagcttatctgggaccactggtccacgcgatgccccgtgacgggccaggaagggttcaggcttggaaatgtcggacggggacgactctgggccttgctggttggtggagctgggagcagcttcattctcctctgactgtgtggacacagccc

SEQ ID NO: 24128 - skipped

SEQ ID NO: 24129 - DNA, 30 bp, Homo sapiens; identical to SEQ ID NO: 14744
  misc_feature 1..30: note = chr5:3740976-3741006
  misc_feature 1..30: note = hypo
  source 1..30: mol_type = genomic DNA

SEQ ID NO: 24130 - DNA, 165 bp, Homo sapiens; identical to SEQ ID NO: 14745
  misc_feature 1..165: note = chr5:3806428-3806593
  misc_feature 1..165: note = hypo
  source 1..165: mol_type = genomic DNA

SEQ ID NO: 24131 - DNA, 10 bp, Homo sapiens
  misc_feature 1..10: note = chr5:4144357-4144367
  misc_feature 1..10: note = hypo
  source 1..10: mol_type = genomic DNA
atgtgttctg

SEQ ID NO: 24132 - DNA, 32 bp, Homo sapiens; identical to SEQ ID NO: 14747
  misc_feature 1..32: note = chr5:4629575-4629607
  misc_feature 1..32: note = hypo
  source 1..32: mol_type = genomic DNA

SEQ ID NO: 24133 - DNA, 20 bp, Homo sapiens
  misc_feature 1..20: note = chr5:10248726-10248746
  misc_feature 1..20: note = hypo
  source 1..20: mol_type = genomic DNA
tatagcgcactgtaaactga

SEQ ID NO: 24134 - DNA, 167 bp, Homo sapiens; identical to SEQ ID NO: 14749
  misc_feature 1..167: note = chr5:10267279-10267446
  misc_feature 1..167: note = hypo
  source 1..167: mol_type = genomic DNA

SEQ ID NO: 24135 - DNA, 30 bp, Homo sapiens; identical to SEQ ID NO: 14750
  misc_feature 1..30: note = chr5:10675402-10675432
  misc_feature 1..30: note = hypo
  source 1..30: mol_type = genomic DNA

SEQ ID NO: 24136 - DNA, 30 bp, Homo sapiens; identical to SEQ ID NO: 14751
  misc_feature 1..30: note = chr5:14732034-14732064
  misc_feature 1..30: note = hypo
  source 1..30: mol_type = genomic DNA

SEQ ID NO: 24137 - DNA, 28 bp, Homo sapiens
  misc_feature 1..28: note = chr5:14774569-14774597
  misc_feature 1..28: note = hypo
  source 1..28: mol_type = genomic DNA
acagtcgcgctctgtcgcccagtctgga

SEQ ID NO: 24138 - DNA, 30 bp, Homo sapiens; identical to SEQ ID NO: 14753
  misc_feature 1..30: note = chr5:16032780-16032810
  misc_feature 1..30: note = hypo
  source 1..30: mol_type = genomic DNA

SEQ ID NO: 24139 - DNA, 78 bp, Homo sapiens; identical to SEQ ID NO: 14754
  misc_feature 1..78: note = chr5:16436327-16436405
  misc_feature 1..78: note = hypo
  source 1..78: mol_type = genomic DNA

SEQ ID NO: 24140 - DNA, 57 bp, Homo sapiens; identical to SEQ ID NO: 14756
  misc_feature 1..57: note = chr5:17502391-17502448
  misc_feature 1..57: note = hypo
  source 1..57: mol_type = genomic DNA

SEQ ID NO: 24141 - DNA, 16 bp, Homo sapiens
  misc_feature 1..16: note = chr5:32526565-32526581
  misc_feature 1..16: note = hypo
  source 1..16: mol_type = genomic DNA
cttctccacgccgggc

SEQ ID NO: 24142 - DNA, 30 bp, Homo sapiens; identical to SEQ ID NO: 14758
  misc_feature 1..30: note = chr5:33162572-33162602
  misc_feature 1..30: note = hypo
  source 1..30: mol_type = genomic DNA

SEQ ID NO: 24143 - DNA, 25 bp, Homo sapiens
  misc_feature 1..25: note = chr5:33234426-33234451
  misc_feature 1..25: note = hypo
  source 1..25: mol_type = genomic DNA
tgagctgacacgcctggctgaattt

SEQ ID NO: 24144 - DNA, 27 bp, Homo sapiens
  misc_feature 1..27: note = chr5:33298124-33298151
  misc_feature 1..27: note = hypo
  source 1..27: mol_type = genomic DNA
gcaccctgctggcgcaccctgctggcg

SEQ ID NO: 24145 - DNA, 35 bp, Homo sapiens; identical to SEQ ID NO: 14761
  misc_feature 1..35: note = chr5:37255512-37255547
  misc_feature 1..35: note = hypo
  source 1..35: mol_type = genomic DNA

SEQ ID NO: 24146 - DNA, 16 bp, Homo sapiens
  misc_feature 1..16: note = chr5:39343165-39343181
  misc_feature 1..16: note = hypo
  source 1..16: mol_type = genomic DNA
tgaacaggaacagctc

SEQ ID NO: 24147 - DNA, 33 bp, Homo sapiens; identical to SEQ ID NO: 1561
  misc_feature 1..33: note = chr5:43402630-43402663
  misc_feature 1..33: note = hypo
  source 1..33: mol_type = genomic DNA

SEQ ID NO: 24148 - DNA, 30 bp, Homo sapiens; identical to SEQ ID NO: 14764
  misc_feature 1..30: note = chr5:64860574-64860604
  misc_feature 1..30: note = hypo
  source 1..30: mol_type = genomic DNA

SEQ ID NO: 24149 - DNA, 30 bp, Homo sapiens; identical to SEQ ID NO: 14765
  misc_feature 1..30: note = chr5:67840329-67840359
  misc_feature 1..30: note = hypo
  source 1..30: mol_type = genomic DNA

SEQ ID NO: 24150 - DNA, 22 bp, Homo sapiens
  misc_feature 1..22: note = chr5:68391002-68391024
  misc_feature 1..22: note = hypo
  source 1..22: mol_type = genomic DNA
gtaatagcattataacgtaact

SEQ ID NO: 24151 - DNA, 21 bp, Homo sapiens
  misc_feature 1..21: note = chr5:74536034-74536055
  misc_feature 1..21: note = hypo
  source 1..21: mol_type = genomic DNA
aatttttttttgagacggagt

SEQ ID NO: 24152 - DNA, 17 bp, Homo sapiens
  misc_feature 1..17: note = chr5:77047294-77047311
  misc_feature 1..17: note = hypo
  source 1..17: mol_type = genomic DNA
gccggccagcctgacca

SEQ ID NO: 24153 - DNA, 30 bp, Homo sapiens; identical to SEQ ID NO: 14769
  misc_feature 1..30: note = chr5:78985161-78985191
  misc_feature 1..30: note = hypo
  source 1..30: mol_type = genomic DNA

SEQ ID NO: 24154 - DNA, 30 bp, Homo sapiens; identical to SEQ ID NO: 5034
  misc_feature 1..30: note = chr5:79947734-79947764
  misc_feature 1..30: note = hypo
  source 1..30: mol_type = genomic DNA

SEQ ID NO: 24155 - DNA, 30 bp, Homo sapiens; identical to SEQ ID NO: 14774
  misc_feature 1..30: note = chr5:98201074-98201104
  misc_feature 1..30: note = hypo
  source 1..30: mol_type = genomic DNA

SEQ ID NO: 24156 - DNA, 172 bp, Homo sapiens; identical to SEQ ID NO: 14776
  misc_feature 1..172: note = chr5:112198328-112198500
  misc_feature 1..172: note = hypo
  source 1..172: mol_type = genomic DNA

SEQ ID NO: 24157 - DNA, 30 bp, Homo sapiens; identical to SEQ ID NO: 14777
  misc_feature 1..30: note = chr5:126200056-126200086
  misc_feature 1..30: note = hypo
  source 1..30: mol_type = genomic DNA

SEQ ID NO: 24158 - DNA, 30 bp, Homo sapiens; identical to SEQ ID NO: 14778
  misc_feature 1..30: note = chr5:131610019-131610049
  misc_feature 1..30: note = hypo
  source 1..30: mol_type = genomic DNA

SEQ ID NO: 24159 - DNA, 30 bp, Homo sapiens; identical to SEQ ID NO: 14779
  misc_feature 1..30: note = chr5:132083934-132083964
  misc_feature 1..30: note = hypo
  source 1..30: mol_type = genomic DNA

SEQ ID NO: 24160 - DNA, 31 bp, Homo sapiens; identical to SEQ ID NO: 14780
  misc_feature 1..31: note = chr5:137548023-137548054
  misc_feature 1..31: note = hypo
  source 1..31: mol_type = genomic DNA

SEQ ID NO: 24161 - DNA, 30 bp, Homo sapiens; identical to SEQ ID NO: 14781
  misc_feature 1..30: note = chr5:137769708-137769738
  misc_feature 1..30: note = hypo
  source 1..30: mol_type = genomic DNA

SEQ ID NO: 24162 - DNA, 19 bp, Homo sapiens
  misc_feature 1..19: note = chr5:139556366-139556385
  misc_feature 1..19: note = hypo
  source 1..19: mol_type = genomic DNA
agacctggcctggtgcggt

SEQ ID NO: 24163 - DNA, 30 bp, Homo sapiens; identical to SEQ ID NO: 14784
  misc_feature 1..30: note = chr5:151383730-151383760
  misc_feature 1..30: note = hypo
  source 1..30: mol_type = genomic DNA

SEQ ID NO: 24164 - DNA, 12 bp, Homo sapiens
  misc_feature 1..12: note = chr5:157078407-157078419
  misc_feature 1..12: note = hypo
  source 1..12: mol_type = genomic DNA
cgagcctgcagt

SEQ ID NO: 24165 - DNA, 39 bp, Homo sapiens; identical to SEQ ID NO: 14789
  misc_feature 1..39: note = chr5:158612937-158612976
  misc_feature 1..39: note = hypo
  source 1..39: mol_type = genomic DNA

SEQ ID NO: 24166 - DNA, 22 bp, Homo sapiens
  misc_feature 1..22: note = chr5:159672080-159672102
  misc_feature 1..22: note = hypo
  source 1..22: mol_type = genomic DNA
ggtaggggctgggtgcggtggc

SEQ ID NO: 24167 - skipped

SEQ ID NO: 24168 - DNA, 141 bp, Homo sapiens; identical to SEQ ID NO: 14792
  misc_feature 1..141: note = chr5:168192180-168192321
  misc_feature 1..141: note = hypo
  source 1..141: mol_type = genomic DNA

SEQ ID NO: 24169 - DNA, 30 bp, Homo sapiens; identical to SEQ ID NO: 14793
  misc_feature 1..30: note = chr5:168268106-168268136
  misc_feature 1..30: note = hypo
  source 1..30: mol_type = genomic DNA

SEQ ID NO: 24170 - DNA, 17 bp, Homo sapiens
  misc_feature 1..17: note = chr5:168337470-168337487
  misc_feature 1..17: note = hypo
  source 1..17: mol_type = genomic DNA
gggcgtggtggctcacg

SEQ ID NO: 24171 - DNA, 30 bp, Homo sapiens; identical to SEQ ID NO: 14795
  misc_feature 1..30: note = chr5:169157436-169157466
  misc_feature 1..30: note = hypo
  source 1..30: mol_type = genomic DNA

SEQ ID NO: 24172 - DNA, 30 bp, Homo sapiens; identical to SEQ ID NO: 14797
  misc_feature 1..30: note = chr5:172235667-172235697
  misc_feature 1..30: note = hypo
  source 1..30: mol_type = genomic DNA

SEQ ID NO: 24173 - DNA, 30 bp, Homo sapiens; identical to SEQ ID NO: 14798
  misc_feature 1..30: note = chr5:175610717-175610747
  misc_feature 1..30: note = hypo
  source 1..30: mol_type = genomic DNA

SEQ ID NO: 24174 - DNA, 17 bp, Homo sapiens
  misc_feature 1..17: note = chr5:175876289-175876306
  misc_feature 1..17: note = hypo
  source 1..17: mol_type = genomic DNA
cccccaggccaggagcg

SEQ ID NO: 24175 - DNA, 17 bp, Homo sapiens
  misc_feature 1..17: note = chr5:175876606-175876623
  misc_feature 1..17: note = hypo
  source 1..17: mol_type = genomic DNA
ttcgggagatcaaatgg

SEQ ID NO: 24176 - DNA, 30 bp, Homo sapiens; identical to SEQ ID NO: 14801
  misc_feature 1..30: note = chr5:175924856-175924886
  misc_feature 1..30: note = hypo
  source 1..30: mol_type = genomic DNA

SEQ ID NO: 24177 - DNA, 30 bp, Homo sapiens; identical to SEQ ID NO: 14803
  misc_feature 1..30: note = chr5:175975036-175975066
  misc_feature 1..30: note = hypo
  source 1..30: mol_type = genomic DNA

SEQ ID NO: 24178 - DNA, 23 bp, Homo sapiens
  misc_feature 1..23: note = chr5:175978997-175979020
  misc_feature 1..23: note = hypo
  source 1..23: mol_type = genomic DNA
accgcgcccggttaatagttccc

SEQ ID NO: 24179 - DNA, 30 bp, Homo sapiens; identical to SEQ ID NO: 14805
  misc_feature 1..30: note = chr5:176225880-176225910
  misc_feature 1..30: note = hypo
  source 1..30: mol_type = genomic DNA

SEQ ID NO: 24180 - DNA, 92 bp, Homo sapiens; identical to SEQ ID NO: 14806
  misc_feature 1..92: note = chr5:176315380-176315472
  misc_feature 1..92: note = hypo
  source 1..92: mol_type = genomic DNA

SEQ ID NO: 24181 - DNA, 20 bp, Homo sapiens
  misc_feature 1..20: note = chr5:177019993-177020013
  misc_feature 1..20: note = hypo
  source 1..20: mol_type = genomic DNA
ccttctgtcacttttcgtta

SEQ ID NO: 24182 - DNA, 25 bp, Homo sapiens
  misc_feature 1..25: note = chr5:177031197-177031222
  misc_feature 1..25: note = hypo
  source 1..25: mol_type = genomic DNA
cggcctccctcggaagtgttccgtc

SEQ ID NO: 24183 - DNA, 37 bp, Homo sapiens
  misc_feature 1..37: note = chr5:177713468-177713505
  misc_feature 1..37: note = hypo
  source 1..37: mol_type = genomic DNA
actcagcttcgtctttaattcccgacagtcctgtcat

SEQ ID NO: 24184 - DNA, 30 bp, Homo sapiens; identical to SEQ ID NO: 14810
  misc_feature 1..30: note = chr5:177982679-177982709
  misc_feature 1..30: note = hypo
  source 1..30: mol_type = genomic DNA

SEQ ID NO: 24185 - DNA, 30 bp, Homo sapiens; identical to SEQ ID NO: 14811
  misc_feature 1..30: note = chr5:178481870-178481900
  misc_feature 1..30: note = hypo
  source 1..30: mol_type = genomic DNA

SEQ ID NO: 24186 - DNA, 34 bp, Homo sapiens; identical to SEQ ID NO: 14812
  misc_feature 1..34: note = chr5:178565449-178565483
  misc_feature 1..34: note = hypo
  source 1..34: mol_type = genomic DNA

SEQ ID NO: 24187 - DNA, 37 bp, Homo sapiens
  misc_feature 1..37: note = chr5:178655871-178655908
  misc_feature 1..37: note = hypo
  source 1..37: mol_type = genomic DNA
ctgcactgaagtctgtggtgtgcggtcacctgagaac

SEQ ID NO: 24188 - DNA, 49 bp, Homo sapiens; identical to SEQ ID NO: 14815
  misc_feature 1..49: note = chr5:178665413-178665462
  misc_feature 1..49: note = hypo
  source 1..49: mol_type = genomic DNA

SEQ ID NO: 24189 - DNA, 30 bp, Homo sapiens; identical to SEQ ID NO: 14816
  misc_feature 1..30: note = chr5:178878685-178878715
  misc_feature 1..30: note = hypo
  source 1..30: mol_type = genomic DNA

SEQ ID NO: 24190 - DNA, 27 bp, Homo sapiens
  misc_feature 1..27: note = chr5:178969579-178969606
  misc_feature 1..27: note = hypo
  source 1..27: mol_type = genomic DNA
agaatgggccaggtgcggtggctcacg

SEQ ID NO: 24191 - DNA, 41 bp, Homo sapiens
  misc_feature 1..41: note = chr5:179214072-179214113
  misc_feature 1..41: note = hypo
  source 1..41: mol_type = genomic DNA
aggggtggggcccagcgggatcccagcatcgtggctctggc

SEQ ID NO: 24192 - DNA, 69 bp, Homo sapiens
  misc_feature 1..69: note = chr5:179214196-179214265
  misc_feature 1..69: note = hypo
  source 1..69: mol_type = genomic DNA
gggactgagtgaggagaccagtcaccacccggtgcaaactgagtcccttccacgcgggaaagggccacg

SEQ ID NO: 24193 - DNA, 30 bp, Homo sapiens; identical to SEQ ID NO: 14819
  misc_feature 1..30: note = chr5:180041104-180041134
  misc_feature 1..30: note = hypo
  source 1..30: mol_type = genomic DNA

SEQ ID NO: 24194 - DNA, 53 bp, Homo sapiens; identical to SEQ ID NO: 14820
  misc_feature 1..53: note = chr5:180057500-180057553
  misc_feature 1..53: note = hypo
  source 1..53: mol_type = genomic DNA

SEQ ID NO: 24195 - DNA, 33 bp, Homo sapiens; identical to SEQ ID NO: 14821
  misc_feature 1..33: note = chr5:180709002-180709035
  misc_feature 1..33: note = hypo
  source 1..33: mol_type = genomic DNA

SEQ ID NO: 24196 - DNA, 35 bp, Homo sapiens; identical to SEQ ID NO: 14822
  misc_feature 1..35: note = chr6:348724-348759
  misc_feature 1..35: note = hypo
  source 1..35: mol_type = genomic DNA

SEQ ID NO: 24197 - DNA, 39 bp, Homo sapiens; identical to SEQ ID NO: 14823
  misc_feature 1..39: note = chr6:448927-448966
  misc_feature 1..39: note = hypo
  source 1..39: mol_type = genomic DNA

SEQ ID NO: 24198 - DNA, 65 bp, Homo sapiens
  misc_feature 1..65: note = chr6:3285157-3285222
  misc_feature 1..65: note = hypo
  source 1..65: mol_type = genomic DNA
atagtgtccaacctacggccaacttcagctgcagttcttggagggcaacggggagaaagagaaaa

SEQ ID NO: 24199 - DNA, 30 bp, Homo sapiens; identical to SEQ ID NO: 14827
  misc_feature 1..30: note = chr6:6045657-6045687
  misc_feature 1..30: note = hypo
  source 1..30: mol_type = genomic DNA

SEQ ID NO: 24200 - skipped

SEQ ID NO: 24201 - DNA, 61 bp, Homo sapiens; identical to SEQ ID NO: 14829
  misc_feature 1..61: note = chr6:6534792-6534853
  misc_feature 1..61: note = hypo
  source 1..61: mol_type = genomic DNA

SEQ ID NO: 24202 - DNA, 66 bp, Homo sapiens; identical to SEQ ID NO: 14830
  misc_feature 1..66: note = chr6:6891420-6891486
  misc_feature 1..66: note = hypo
  source 1..66: mol_type = genomic DNA

SEQ ID NO: 24203 - DNA, 21 bp, Homo sapiens
  misc_feature 1..21: note = chr6:7237775-7237796
  misc_feature 1..21: note = hypo
  source 1..21: mol_type = genomic DNA
cgctcgcgttggggcttgcag

SEQ ID NO: 24204 - DNA, 16 bp, Homo sapiens
  misc_feature 1..16: note = chr6:10595805-10595821
  misc_feature 1..16: note = hypo
  source 1..16: mol_type = genomic DNA
ccggttggttgggttg

SEQ ID NO: 24205 - DNA, 22 bp, Homo sapiens
  misc_feature 1..22: note = chr6:12288681-12288703
  misc_feature 1..22: note = hypo
  source 1..22: mol_type = genomic DNA
tgtcctccgggagctgtggcct

SEQ ID NO: 24206 - DNA, 30 bp, Homo sapiens; identical to SEQ ID NO: 14834
  misc_feature 1..30: note = chr6:13293172-13293202
  misc_feature 1..30: note = hypo
  source 1..30: mol_type = genomic DNA

SEQ ID NO: 24207 - DNA, 38 bp, Homo sapiens; identical to SEQ ID NO: 14835
  misc_feature 1..38: note = chr6:15456030-15456068
  misc_feature 1..38: note = hypo
  source 1..38: mol_type = genomic DNA

SEQ ID NO: 24208 - DNA, 21 bp, Homo sapiens
  misc_feature 1..21: note = chr6:16197009-16197030
  misc_feature 1..21: note = hypo
  source 1..21: mol_type = genomic DNA
agtagaaaacaaaagcgggct

SEQ ID NO: 24209 - DNA, 25 bp, Homo sapiens
  misc_feature 1..25: note = chr6:16218445-16218470
  misc_feature 1..25: note = hypo
  source 1..25: mol_type = genomic DNA
gcctgcacaccggggctgtaaatgg

SEQ ID NO: 24210 - DNA, 30 bp, Homo sapiens; identical to SEQ ID NO: 14838
  misc_feature 1..30: note = chr6:16293453-16293483
  misc_feature 1..30: note = hypo
  source 1..30: mol_type = genomic DNA

SEQ ID NO: 24211 - DNA, 17 bp, Homo sapiens
  misc_feature 1..17: note = chr6:18035850-18035867
  misc_feature 1..17: note = hypo
  source 1..17: mol_type = genomic DNA
gtcctcaccactctccg

SEQ ID NO: 24212 - DNA, 92 bp, Homo sapiens; identical to SEQ ID NO: 14840
  misc_feature 1..92: note = chr6:20239485-20239577
  misc_feature 1..92: note = hypo
  source 1..92: mol_type = genomic DNA

SEQ ID NO: 24213 - DNA, 102 bp, Homo sapiens
  misc_feature 1..102: note = chr6:34170868-34170970
  misc_feature 1..102: note = hypo
  source 1..102: mol_type = genomic DNA
cttctgtcggctccatggagccggaggcccgggtctgcctccgtttggtttgggtggccatggtttgggtggctgcagcggcaccccagggcgctcctgccc

SEQ ID NO: 24214 - DNA, 18 bp, Homo sapiens
  misc_feature 1..18: note = chr6:34171061-34171079
  misc_feature 1..18: note = hypo
  source 1..18: mol_type = genomic DNA
caccgccaggagtgtggg

SEQ ID NO: 24215 - DNA, 30 bp, Homo sapiens; identical to SEQ ID NO: 14846
  misc_feature 1..30: note = chr6:34514348-34514378
  misc_feature 1..30: note = hypo
  source 1..30: mol_type = genomic DNA

SEQ ID NO: 24216 - DNA, 23 bp, Homo sapiens
  misc_feature 1..23: note = chr6:34854786-34854809
  misc_feature 1..23: note = hypo
  source 1..23: mol_type = genomic DNA
tgggtccctgatcaccgggtgcg

SEQ ID NO: 24217 - DNA, 30 bp, Homo sapiens; identical to SEQ ID NO: 14848
  misc_feature 1..30: note = chr6:35149810-35149840
  misc_feature 1..30: note = hypo
  source 1..30: mol_type = genomic DNA

SEQ ID NO: 24218 - DNA, 27 bp, Homo sapiens
  misc_feature 1..27: note = chr6:35150080-35150107
  misc_feature 1..27: note = hypo
  source 1..27: mol_type = genomic DNA
gcagccaccgggcgcccagctggggtc

SEQ ID NO: 24219 - DNA, 37 bp, Homo sapiens; identical to SEQ ID NO: 14850
  misc_feature 1..37: note = chr6:35309524-35309561
  misc_feature 1..37: note = hypo
  source 1..37: mol_type = genomic DNA

SEQ ID NO: 24220 - DNA, 30 bp, Homo sapiens; identical to SEQ ID NO: 14851
  misc_feature 1..30: note = chr6:36165619-36165649
  misc_feature 1..30: note = hypo
  source 1..30: mol_type = genomic DNA

SEQ ID NO: 24221 - DNA, 30 bp, Homo sapiens; identical to SEQ ID NO: 14852
  misc_feature 1..30: note = chr6:36831576-36831606
  misc_feature 1..30: note = hypo
  source 1..30: mol_type = genomic DNA

SEQ ID NO: 24222 - DNA, 177 bp, Homo sapiens
  misc_feature 1..177: note = chr6:37024382-37024559
  misc_feature 1..177: note = hypo
  source 1..177: mol_type = genomic DNA
ggtctccaggagaggcgggcacttcctccgccccagcccagggtcctgttcaatccttattgaggagtttcctggcgacaggcagtgacctgtcggctgcctgtgtgggaagccgcttggcgtggccctccccatctcattagtggtgattcacctggactcacctggctgtcaggg

SEQ ID NO: 24223 - DNA, 44 bp, Homo sapiens
  misc_feature 1..44: note = chr6:37024589-37024633
  misc_feature 1..44: note = hypo
  source 1..44: mol_type = genomic DNA
agcaggcaccctctgaggggcagagacctcgttccctcagctcc

SEQ ID NO: 24224 - DNA, 30 bp, Homo sapiens; identical to SEQ ID NO: 14854
  misc_feature 1..30: note = chr6:37053276-37053306
  misc_feature 1..30: note = hypo
  source 1..30: mol_type = genomic DNA

SEQ ID NO: 24225 - DNA, 30 bp, Homo sapiens; identical to SEQ ID NO: 14855
  misc_feature 1..30: note = chr6:37391410-37391440
  misc_feature 1..30: note = hypo
  source 1..30: mol_type = genomic DNA

SEQ ID NO: 24226 - DNA, 36 bp, Homo sapiens; identical to SEQ ID NO: 5047
  misc_feature 1..36: note = chr6:42062066-42062102
  misc_feature 1..36: note = hypo
  source 1..36: mol_type = genomic DNA

SEQ ID NO: 24227 - DNA, 23 bp, Homo sapiens
  misc_feature 1..23: note = chr6:42813507-42813530
  misc_feature 1..23: note = hypo
  source 1..23: mol_type = genomic DNA
ttatagattcctggccgggcgcg

SEQ ID NO: 24228 - DNA, 38 bp, Homo sapiens; identical to SEQ ID NO: 14858
  misc_feature 1..38: note = chr6:42846392-42846430
  misc_feature 1..38: note = hypo
  source 1..38: mol_type = genomic DNA

SEQ ID NO: 24229 - DNA, 37 bp, Homo sapiens; identical to SEQ ID NO: 14859
  misc_feature 1..37: note = chr6:42846610-42846647
  misc_feature 1..37: note = hypo
  source 1..37: mol_type = genomic DNA

SEQ ID NO: 24230 - DNA, 90 bp, Homo sapiens; identical to SEQ ID NO: 14860
  misc_feature 1..90: note = chr6:43424517-43424607
  misc_feature 1..90: note = hypo
  source 1..90: mol_type = genomic DNA

SEQ ID NO: 24231 - DNA, 30 bp, Homo sapiens; identical to SEQ ID NO: 14862
  misc_feature 1..30: note = chr6:43486338-43486368
  misc_feature 1..30: note = hypo
  source 1..30: mol_type = genomic DNA

SEQ ID NO: 24232 - DNA, 41 bp, Homo sapiens; identical to SEQ ID NO: 14865
  misc_feature 1..41: note = chr6:44437145-44437186
  misc_feature 1..41: note = hypo
  source 1..41: mol_type = genomic DNA

SEQ ID NO: 24233 - DNA, 25 bp, Homo sapiens
  misc_feature 1..25: note = chr6:52156895-52156920
  misc_feature 1..25: note = hypo
  source 1..25: mol_type = genomic DNA
gtttcaaaactttggcgccgggcgc

SEQ ID NO: 24234 - DNA, 30 bp, Homo sapiens; identical to SEQ ID NO: 14867
  misc_feature 1..30: note = chr6:52268217-52268247
  misc_feature 1..30: note = hypo
  source 1..30: mol_type = genomic DNA

SEQ ID NO: 24235 - DNA, 180 bp, Homo sapiens; identical to SEQ ID NO: 5048
  misc_feature 1..180: note = chr6:52928863-52929043
  misc_feature 1..180: note = hypo
  source 1..180: mol_type = genomic DNA

SEQ ID NO: 24236 - DNA, 21 bp, Homo sapiens
  misc_feature 1..21: note = chr6:57694617-57694638
  misc_feature 1..21: note = hypo
  source 1..21: mol_type = genomic DNA
aagaaccgccagtaacaacat

SEQ ID NO: 24237 - DNA, 23 bp, Homo sapiens
  misc_feature 1..23: note = chr6:74234189-74234212
  misc_feature 1..23: note = hypo
  source 1..23: mol_type = genomic DNA
gaaaagatgatggcccggtgcgg

SEQ ID NO: 24238 - DNA, 102 bp, Homo sapiens; identical to SEQ ID NO: 14871
  misc_feature 1..102: note = chr6:84513455-84513557
  misc_feature 1..102: note = hypo
  source 1..102: mol_type = genomic DNA

SEQ ID NO: 24239 - DNA, 68 bp, Homo sapiens
  misc_feature 1..68: note = chr6:86302345-86302413
  misc_feature 1..68: note = hypo
  source 1..68: mol_type = genomic DNA
tcaattttaacctttcggaatatttcaggtttttttggggagggtggcatcaagtcctcttaagaata

SEQ ID NO: 24240 - DNA, 81 bp, Homo sapiens; identical to SEQ ID NO: 14873
  misc_feature 1..81: note = chr6:89857646-89857727
  misc_feature 1..81: note = hypo
  source 1..81: mol_type = genomic DNA

SEQ ID NO: 24241 - DNA, 30 bp, Homo sapiens; identical to SEQ ID NO: 14874
  misc_feature 1..30: note = chr6:90367322-90367352
  misc_feature 1..30: note = hypo
  source 1..30: mol_type = genomic DNA

SEQ ID NO: 24242 - DNA, 29 bp, Homo sapiens
  misc_feature 1..29: note = chr6:99396702-99396731
  misc_feature 1..29: note = hypo
  source 1..29: mol_type = genomic DNA
gctgggattacagccgtgagccaccgcgc

SEQ ID NO: 24243 - DNA, 30 bp, Homo sapiens; identical to SEQ ID NO: 14876
  misc_feature 1..30: note = chr6:105750542-105750572
  misc_feature 1..30: note = hypo
  source 1..30: mol_type = genomic DNA

SEQ ID NO: 24244 - DNA, 31 bp, Homo sapiens
  misc_feature 1..31: note = chr6:108280352-108280383
  misc_feature 1..31: note = hypo
  source 1..31: mol_type = genomic DNA
gacagatttgaatctacgctgtgcccatctt

SEQ ID NO: 24245 - DNA, 17 bp, Homo sapiens
  misc_feature 1..17: note = chr6:109057736-109057753
  misc_feature 1..17: note = hypo
  source 1..17: mol_type = genomic DNA
tgttaggaatattctcg

SEQ ID NO: 24246 - DNA, 82 bp, Homo sapiens; identical to SEQ ID NO: 14879
  misc_feature 1..82: note = chr6:109059835-109059917
  misc_feature 1..82: note = hypo
  source 1..82: mol_type = genomic DNA

SEQ ID NO: 24247 - DNA, 30 bp, Homo sapiens; identical to SEQ ID NO: 14880
  misc_feature 1..30: note = chr6:116574057-116574087
  misc_feature 1..30: note = hypo
  source 1..30: mol_type = genomic DNA

SEQ ID NO: 24248 - DNA, 99 bp, Homo sapiens; identical to SEQ ID NO: 5053
  misc_feature 1..99: note = chr6:137144497-137144596
  misc_feature 1..99: note = hypo
  source 1..99: mol_type = genomic DNA

SEQ ID NO: 24249 - DNA, 92 bp, Homo sapiens; identical to SEQ ID NO: 14884
  misc_feature 1..92: note = chr6:138790478-138790570
  misc_feature 1..92: note = hypo
  source 1..92: mol_type = genomic DNA

SEQ ID NO: 24250 - DNA, 151 bp, Homo sapiens; identical to SEQ ID NO: 14885
  misc_feature 1..151: note = chr6:149177419-149177570
  misc_feature 1..151: note = hypo
  source 1..151: mol_type = genomic DNA

SEQ ID NO: 24251 - DNA, 30 bp, Homo sapiens; identical to SEQ ID NO: 14887
  misc_feature 1..30: note = chr6:155988231-155988261
  misc_feature 1..30: note = hypo
  source 1..30: mol_type = genomic DNA

SEQ ID NO: 24252 - DNA, 39 bp, Homo sapiens; identical to SEQ ID NO: 14888
  misc_feature 1..39: note = chr6:157478299-157478338
  misc_feature 1..39: note = hypo
  source 1..39: mol_type = genomic DNA

SEQ ID NO: 24253 - DNA, 30 bp, Homo sapiens; identical to SEQ ID NO: 14889
  misc_feature 1..30: note = chr6:157637384-157637414
  misc_feature 1..30: note = hypo
  source 1..30: mol_type = genomic DNA

SEQ ID NO: 24254 - DNA, 30 bp, Homo sapiens; identical to SEQ ID NO: 14890
  misc_feature 1..30: note = chr6:157638386-157638416
  misc_feature 1..30: note = hypo
  source 1..30: mol_type = genomic DNA

SEQ ID NO: 24255 - DNA, 30 bp, Homo sapiens; identical to SEQ ID NO: 14891
  misc_feature 1..30: note = chr6:158119028-158119058
  misc_feature 1..30: note = hypo
  source 1..30: mol_type = genomic DNA

SEQ ID NO: 24256 - DNA, 82 bp, Homo sapiens; identical to SEQ ID NO: 14892
  misc_feature 1..82: note = chr6:159049801-159049883
  misc_feature 1..82: note = hypo
  source 1..82: mol_type = genomic DNA

SEQ ID NO: 24257 - DNA, 30 bp, Homo sapiens; identical to SEQ ID NO: 14893
  misc_feature 1..30: note = chr6:159569380-159569410
  misc_feature 1..30: note = hypo
  source 1..30: mol_type = genomic DNA

SEQ ID NO: 24258 - DNA, 55 bp, Homo sapiens; identical to SEQ ID NO: 14894
  misc_feature 1..55: note = chr6:160511899-160511954
  misc_feature 1..55: note = hypo
  source 1..55: mol_type = genomic DNA

SEQ ID NO: 24259 - DNA, 39 bp, Homo sapiens; identical to SEQ ID NO: 14895
  misc_feature 1..39: note = chr6:161672733-161672772
  misc_feature 1..39: note = hypo
  source 1..39: mol_type = genomic DNA

SEQ ID NO: 24260 - DNA, 32 bp, Homo sapiens; identical to SEQ ID NO: 14896
  misc_feature 1..32: note = chr6:161690517-161690549
  misc_feature 1..32: note = hypo
  source 1..32: mol_type = genomic DNA

SEQ ID NO: 24261 - DNA, 80 bp, Homo sapiens
  misc_feature 1..80: note = chr6:161780139-161780219
  misc_feature 1..80: note = hypo
  source 1..80: mol_type = genomic DNA
ataggtgcatgccaatcccttcattttctaggagcactgctgcatgcaatggagtaataaggacacgctgggtaaattat

SEQ ID NO: 24262 - DNA, 41 bp, Homo sapiens; identical to SEQ ID NO: 14898
  misc_feature 1..41: note = chr6:162257990-162258031
  misc_feature 1..41: note = hypo
  source 1..41: mol_type = genomic DNA

SEQ ID NO: 24263 - DNA, 18 bp, Homo sapiens
  misc_feature 1..18: note = chr6:164114295-164114313
  misc_feature 1..18: note = hypo
  source 1..18: mol_type = genomic DNA
ttatttttttgagaccga

SEQ ID NO: 24264 - DNA, 44 bp, Homo sapiens; identical to SEQ ID NO: 14900
  misc_feature 1..44: note = chr6:164183729-164183773
  misc_feature 1..44: note = hypo
  source 1..44: mol_type = genomic DNA

SEQ ID NO: 24265 - DNA, 15 bp, Homo sapiens
  misc_feature 1..15: note = chr6:164197003-164197018
  misc_feature 1..15: note = hypo
  source 1..15: mol_type = genomic DNA
cgtcttctgacaaac

SEQ ID NO: 24266 - DNA, 18 bp, Homo sapiens
  misc_feature 1..18: note = chr6:164215474-164215492
  misc_feature 1..18: note = hypo
  source 1..18: mol_type = genomic DNA
gggcctggtggctcacgc

SEQ ID NO: 24267 - DNA, 64 bp, Homo sapiens
  misc_feature 1..64: note = chr6:164228363-164228427
  misc_feature 1..64: note = hypo
  source 1..64: mol_type = genomic DNA
aacagagggaccctccctgctgttctgttcacacggaagcgtgtctcagcgtctgggggcttgg

SEQ ID NO: 24268 - DNA, 20 bp, Homo sapiens
  misc_feature 1..20: note = chr6:164283234-164283254
  misc_feature 1..20: note = hypo
  source 1..20: mol_type = genomic DNA
gaagcatgtccccagcgtgg

SEQ ID NO: 24269 - DNA, 30 bp, Homo sapiens; identical to SEQ ID NO: 14906
  misc_feature 1..30: note = chr6:164288079-164288109
  misc_feature 1..30: note = hypo
  source 1..30: mol_type = genomic DNA

SEQ ID NO: 24270 - DNA, 36 bp, Homo sapiens; identical to SEQ ID NO: 14907
  misc_feature 1..36: note = chr6:164322607-164322643
  misc_feature 1..36: note = hypo
  source 1..36: mol_type = genomic DNA

SEQ ID NO: 24271 - DNA, 30 bp, Homo sapiens; identical to SEQ ID NO: 14908
  misc_feature 1..30: note = chr6:164323901-164323931
  misc_feature 1..30: note = hypo
  source 1..30: mol_type = genomic DNA

SEQ ID NO: 24272 - DNA, 30 bp, Homo sapiens; identical to SEQ ID NO: 14909
  misc_feature 1..30: note = chr6:166891687-166891717
  misc_feature 1..30: note = hypo
  source 1..30: mol_type = genomic DNA

SEQ ID NO: 24273 - DNA, 109 bp, Homo sapiens
  misc_feature 1..109: note = chr6:166944403-166944512
  misc_feature 1..109: note = hypo
  source 1..109: mol_type = genomic DNA
aggccccatccagcccaacagcctgctcgcagcctgctgctctgctttcccaatgccgctccacggcagaacatatgtgggagaatggtatttacgcaatacagctctt

SEQ ID NO: 24274 - DNA, 32 bp, Homo sapiens; identical to SEQ ID NO: 14911
  misc_feature 1..32: note = chr6:167835094-167835126
  misc_feature 1..32: note = hypo
  source 1..32: mol_type = genomic DNA

SEQ ID NO: 24275 - DNA, 30 bp, Homo sapiens; identical to SEQ ID NO: 14912
  misc_feature 1..30: note = chr6:168453452-168453482
  misc_feature 1..30: note = hypo
  source 1..30: mol_type = genomic DNA

SEQ ID NO: 24276 - DNA, 30 bp, Homo sapiens; identical to SEQ ID NO: 14914
  misc_feature 1..30: note = chr6:169562411-169562441
  misc_feature 1..30: note = hypo
  source 1..30: mol_type = genomic DNA

SEQ ID NO: 24277 - DNA, 77 bp, Homo sapiens
  misc_feature 1..77: note = chr6:170475028-170475105
  misc_feature 1..77: note = hypo
  source 1..77: mol_type = genomic DNA
ttcttgggtgacaatcgaggggtcctgacccagcacccgtgggcacacccttatttggaaattgggcctagcccgga

SEQ ID NO: 24278 - DNA, 217 bp, Homo sapiens
  misc_feature 1..217: note = chr6:170475267-170475484
  misc_feature 1..217: note = hypo
  source 1..217: mol_type = genomic DNA
ggcactgagagaccggtgccgccccccgccgtccacacaacccgggcctcgggcagcaccagcaggacttttattcctcaccccgcacgccgccgtccatctcctaggccagcgtgattcttctgagtgcagctgggtctcctcctgggagatccggtggctctagcagcgtgggtgctgggaacaggaccagcctcgccggcggacagtgtggacg

SEQ ID NO: 24279 - DNA, 24 bp, Homo sapiens
  misc_feature 1..24: note = chr7:328544-328568
  misc_feature 1..24: note = hypo
  source 1..24: mol_type = genomic DNA
gattacaggcgtgagtcaccgtgc

SEQ ID NO: 24280 - DNA, 30 bp, Homo sapiens; identical to SEQ ID NO: 14918
  misc_feature 1..30: note = chr7:409617-409647
  misc_feature 1..30: note = hypo
  source 1..30: mol_type = genomic DNA

SEQ ID NO: 24281 - DNA, 208 bp, Homo sapiens
  misc_feature 1..208: note = chr7:431492-431700
  misc_feature 1..208: note = hypo
  source 1..208: mol_type = genomic DNA
agggagcggccgccagccgctaggatcccgatgccgccgcaagtaaggacaggcccgggtgctgccgcaggaggccaggcctgcgctcgccgctgtggaatgtgtgtttgtctgatgagcatccctgcagggccccagatggagggtgtgacaaggatgggggctgagtctccagggcccgggggcacctgcacgctgcccctggcag

SEQ ID NO: 24282 - DNA, 30 bp, Homo sapiens; identical to SEQ ID NO: 14921
  misc_feature 1..30: note = chr7:502957-502987
  misc_feature 1..30: note = hypo
  source 1..30: mol_type = genomic DNA

SEQ ID NO: 24283 - DNA, 30 bp, Homo sapiens; identical to SEQ ID NO: 14924
  misc_feature 1..30: note = chr7:819668-819698
  misc_feature 1..30: note = hypo
  source 1..30: mol_type = genomic DNA

SEQ ID NO: 24284 - DNA, 404 bp, Homo sapiens; identical to SEQ ID NO: 14925
  misc_feature 1..404: note = chr7:834330-834734
  misc_feature 1..404: note = hypo
  source 1..404: mol_type = genomic DNA

SEQ ID NO: 24285 - DNA, 83 bp, Homo sapiens; identical to SEQ ID NO: 14926
  misc_feature 1..83: note = chr7:1027233-1027316
  misc_feature 1..83: note = hypo
  source 1..83: mol_type = genomic DNA

SEQ ID NO: 24286 - DNA, 55 bp, Homo sapiens
  misc_feature 1..55: note = chr7:1054524-1054579
  misc_feature 1..55: note = hypo
  source 1..55: mol_type = genomic DNA
gccccttcctgcctgcgggccctccctgccctgcagggacggtgcagtgagcaca

SEQ ID NO: 24287 - DNA, 38 bp, Homo sapiens
  misc_feature 1..38: note = chr7:1308497-1308535
  misc_feature 1..38: note = hypo
  source 1..38: mol_type = genomic DNA
cccggcctgttccgcgtgcaacgcgctgttctcccatc

SEQ ID NO: 24288 - DNA, 106 bp, Homo sapiens
  misc_feature 1..106: note = chr7:1325704-1325810
  misc_feature 1..106: note = hypo
  source 1..106: mol_type = genomic DNA
ccccgcggcgtggcacggcctgggcgttggatgcagcagtgaacgggacccacgcggggactcagggtatgacgggcagaggggtaggtggggtgggggcaggtga

SEQ ID NO: 24289 - DNA, 32 bp, Homo sapiens; identical to SEQ ID NO: 14932
  misc_feature 1..32: note = chr7:1351574-1351606
  misc_feature 1..32: note = hypo
  source 1..32: mol_type = genomic DNA

SEQ ID NO: 24290 - DNA, 43 bp, Homo sapiens; identical to SEQ ID NO: 14933
  misc_feature 1..43: note = chr7:1384833-1384876
  misc_feature 1..43: note = hypo
  source 1..43: mol_type = genomic DNA

SEQ ID NO: 24291 - DNA, 57 bp, Homo sapiens; identical to SEQ ID NO: 14934
  misc_feature 1..57: note = chr7:1395730-1395787
  misc_feature 1..57: note = hypo
  source 1..57: mol_type = genomic DNA

SEQ ID NO: 24292 - DNA, 22 bp, Homo sapiens
  misc_feature 1..22: note = chr7:1459019-1459041
  misc_feature 1..22: note = hypo
  source 1..22: mol_type = genomic DNA
ccacttccacctgcccgggcct

SEQ ID NO: 24293 - DNA, 30 bp, Homo sapiens; identical to SEQ ID NO: 14936
  misc_feature 1..30: note = chr7:1460840-1460870
  misc_feature 1..30: note = hypo
  source 1..30: mol_type = genomic DNA

SEQ ID NO: 24294 - DNA, 30 bp, Homo sapiens; identical to SEQ ID NO: 14938
  misc_feature 1..30: note = chr7:1598982-1599012
  misc_feature 1..30: note = hypo
  source 1..30: mol_type = genomic DNA

SEQ ID NO: 24295 - DNA, 13 bp, Homo sapiens
  misc_feature 1..13: note = chr7:1641923-1641936
  misc_feature 1..13: note = hypo
  source 1..13: mol_type = genomic DNA
tgccttccaggtg

SEQ ID NO: 24296 - DNA, 30 bp, Homo sapiens; identical to SEQ ID NO: 14942
  misc_feature 1..30: note = chr7:1694042-1694072
  misc_feature 1..30: note = hypo
  source 1..30: mol_type = genomic DNA

SEQ ID NO: 24297 - DNA, 30 bp, Homo sapiens; identical to SEQ ID NO: 14944
  misc_feature 1..30: note = chr7:1734737-1734767
  misc_feature 1..30: note = hypo
  source 1..30: mol_type = genomic DNA

SEQ ID NO: 24298 - DNA, 59 bp, Homo sapiens; identical to SEQ ID NO: 14945
  misc_feature 1..59: note = chr7:1783243-1783302
  misc_feature 1..59: note = hypo
  source 1..59: mol_type = genomic DNA

SEQ ID NO: 24299 - DNA, 47 bp, Homo sapiens; identical to SEQ ID NO: 14947
  misc_feature 1..47: note = chr7:2110154-2110201
  misc_feature 1..47: note = hypo
  source 1..47: mol_type = genomic DNA

SEQ ID NO: 24300 - DNA, 33 bp, Homo sapiens
  misc_feature 1..33: note = chr7:2232930-2232963
  misc_feature 1..33: note = hypo
  source 1..33: mol_type = genomic DNA
ctccgacagccaccacgtcctggagagaaagcg

SEQ ID NO: 24301 - DNA, 160 bp, Homo sapiens; identical to SEQ ID NO: 14951
  misc_feature 1..160: note = chr7:2564711-2564871
  misc_feature 1..160: note = hypo
  source 1..160: mol_type = genomic DNA

SEQ ID NO: 24302 - DNA, 28 bp, Homo sapiens
  misc_feature 1..28: note = chr7:2566630-2566658
  misc_feature 1..28: note = hypo
  source 1..28: mol_type = genomic DNA
gggtctctctaagcggcatgactctaca

SEQ ID NO: 24303 - DNA, 210 bp, Homo sapiens; identical to SEQ ID NO: 14953
  misc_feature 1..210: note = chr7:2686448-2686658
  misc_feature 1..210: note = hypo
  source 1..210: mol_type = genomic DNA

SEQ ID NO: 24304 - DNA, 28 bp, Homo sapiens
  misc_feature 1..28: note = chr7:2731870-2731898
  misc_feature 1..28: note = hypo
  source 1..28: mol_type = genomic DNA
gggttgaaagaggaccgagcttggccgg

SEQ ID NO: 24305 - DNA, 35 bp, Homo sapiens; identical to SEQ ID NO: 14955
  misc_feature 1..35: note = chr7:2798456-2798491
  misc_feature 1..35: note = hypo
  source 1..35: mol_type = genomic DNA

SEQ ID NO: 24306 - DNA, 30 bp, Homo sapiens; identical to SEQ ID NO: 14956
  misc_feature 1..30: note = chr7:3033477-3033507
  misc_feature 1..30: note = hypo
  source 1..30: mol_type = genomic DNA

SEQ ID NO: 24307 - DNA, 61 bp, Homo sapiens; identical to SEQ ID NO: 14958
  misc_feature 1..61: note = chr7:4214953-4215014
  misc_feature 1..61: note = hypo
  source 1..61: mol_type = genomic DNA

SEQ ID NO: 24308 - DNA, 30 bp, Homo sapiens; identical to SEQ ID NO: 14959
  misc_feature 1..30: note = chr7:4751426-4751456
  misc_feature 1..30: note = hypo
  source 1..30: mol_type = genomic DNA

SEQ ID NO: 24309 - DNA, 82 bp, Homo sapiens; identical to SEQ ID NO: 14960
  misc_feature 1..82: note = chr7:4781972-4782054
  misc_feature 1..82: note = hypo
  source 1..82: mol_type = genomic DNA

SEQ ID NO: 24310 - DNA, 87 bp, Homo sapiens; identical to SEQ ID NO: 14961
  misc_feature 1..87: note = chr7:4813783-4813870
  misc_feature 1..87: note = hypo
  source 1..87: mol_type = genomic DNA

SEQ ID NO: 24311 - DNA, 161 bp, Homo sapiens; identical to SEQ ID NO: 14962
  misc_feature 1..161: note = chr7:4840190-4840351
  misc_feature 1..161: note = hypo
  source 1..161: mol_type = genomic DNA

SEQ ID NO: 24312 - DNA, 50 bp, Homo sapiens; identical to SEQ ID NO: 14963
  misc_feature 1..50: note = chr7:4841057-4841107
  misc_feature 1..50: note = hypo
  source 1..50: mol_type = genomic DNA

SEQ ID NO: 24313 - DNA, 113 bp, Homo sapiens
  misc_feature 1..113: note = chr7:4856871-4856984
  misc_feature 1..113: note = hypo
  source 1..113: mol_type = genomic DNA
tggagacatagtagacgcactgctggaaggcgtacagcaccacctcctccagcaccgccatggcctcctcgctggccgtcagcgtgcaggagaacagcgattccttcgagcct

SEQ ID NO: 24314 - DNA, 30 bp, Homo sapiens; identical to SEQ ID NO: 14965
  misc_feature 1..30: note = chr7:5316401-5316431
  misc_feature 1..30: note = hypo
  source 1..30: mol_type = genomic DNA

SEQ ID NO: 24315 - DNA, 23 bp, Homo sapiens
  misc_feature 1..23: note = chr7:5589502-5589525
  misc_feature 1..23: note = hypo
  source 1..23: mol_type = genomic DNA
agtaagtgaagaggccgggcgcg

SEQ ID NO: 24316 - DNA, 35 bp, Homo sapiens; identical to SEQ ID NO: 14967
  misc_feature 1..35: note = chr7:5647869-5647904
  misc_feature 1..35: note = hypo
  source 1..35: mol_type = genomic DNA

SEQ ID NO: 24317 - DNA, 26 bp, Homo sapiens
  misc_feature 1..26: note = chr7:5648393-5648419
  misc_feature 1..26: note = hypo
  source 1..26: mol_type = genomic DNA
accccataccccgagggtggctcctc

SEQ ID NO: 24318 - DNA, 37 bp, Homo sapiens; identical to SEQ ID NO: 14970
  misc_feature 1..37: note = chr7:6143252-6143289
  misc_feature 1..37: note = hypo
  source 1..37: mol_type = genomic DNA

SEQ ID NO: 24319 - DNA, 60 bp, Homo sapiens
  misc_feature 1..60: note = chr7:6443376-6443436
  misc_feature 1..60: note = hypo
  source 1..60: mol_type = genomic DNA
tgttcctttgggtctgtgaggttctgtaaactgtgctagtgctgacgatgttctgtacaa

SEQ ID NO: 24320 - DNA, 86 bp, Homo sapiens; identical to SEQ ID NO: 14972
  misc_feature 1..86: note = chr7:6499253-6499339
  misc_feature 1..86: note = hypo
  source 1..86: mol_type = genomic DNA

SEQ ID NO: 24321 - DNA, 70 bp, Homo sapiens
  misc_feature 1..70: note = chr7:6524907-6524977
  misc_feature 1..70: note = hypo
  source 1..70: mol_type = genomic DNA
aaacttgaatatttctacgggatggggacgtcacaagaaattgcaaacaaaaaaagctgacaaacaggat

SEQ ID NO: 24322 - DNA, 75 bp, Homo sapiens
  misc_feature 1..75: note = chr7:6525012-6525087
  misc_feature 1..75: note = hypo
  source 1..75: mol_type = genomic DNA
aaacgcacagttcgcagttcaaaaagcagggcgggggcgaggacctggtgcggtggctcatgcctgtagtcccaa

SEQ ID NO: 24323 - DNA, 23 bp, Homo sapiens
  misc_feature 1..23: note = chr7:6560212-6560235
  misc_feature 1..23: note = hypo
  source 1..23: mol_type = genomic DNA
gctggaagaagctctcgagggcc

SEQ ID NO: 24324 - DNA, 56 bp, Homo sapiens
  misc_feature 1..56: note = chr7:6560345-6560401
  misc_feature 1..56: note = hypo
  source 1..56: mol_type = genomic DNA
ggaggtgagcgccgacgacgggttgggtgagtccagagaatcggagtctgctggga

SEQ ID NO: 24325 - DNA, 30 bp, Homo sapiens; identical to SEQ ID NO: 14975
  misc_feature 1..30: note = chr7:7102938-7102968
  misc_feature 1..30: note = hypo
  source 1..30: mol_type = genomic DNA

SEQ ID NO: 24326 - DNA, 273 bp, Homo sapiens; identical to SEQ ID NO: 1572
  misc_feature 1..273: note = chr7:7605157-7605430
  misc_feature 1..273: note = hypo
  source 1..273: mol_type = genomic DNA

SEQ ID NO: 24327 - DNA, 24 bp, Homo sapiens
  misc_feature 1..24: note = chr7:20710238-20710262
  misc_feature 1..24: note = hypo
  source 1..24: mol_type = genomic DNA
aagaagcaagctggccgggtgcgg

SEQ ID NO: 24328 - DNA, 186 bp, Homo sapiens; identical to SEQ ID NO: 14980
  misc_feature 1..186: note = chr7:25495487-25495673
  misc_feature 1..186: note = hypo
  source 1..186: mol_type = genomic DNA

SEQ ID NO: 24329 - DNA, 29 bp, Homo sapiens
  misc_feature 1..29: note = chr7:25530898-25530927
  misc_feature 1..29: note = hypo
  source 1..29: mol_type = genomic DNA
aatttgtattaaaggcggggcgcagtgac

SEQ ID NO: 24330 - DNA, 30 bp, Homo sapiens; identical to SEQ ID NO: 14982
  misc_feature 1..30: note = chr7:31116621-31116651
  misc_feature 1..30: note = hypo
  source 1..30: mol_type = genomic DNA

SEQ ID NO: 24331 - DNA, 84 bp, Homo sapiens; identical to SEQ ID NO: 5064
  misc_feature 1..84: note = chr7:36428640-36428724
  misc_feature 1..84: note = hypo
  source 1..84: mol_type = genomic DNA

SEQ ID NO: 24332 - DNA, 30 bp, Homo sapiens; identical to SEQ ID NO: 14984
  misc_feature 1..30: note = chr7:37264509-37264539
  misc_feature 1..30: note = hypo
  source 1..30: mol_type = genomic DNA

SEQ ID NO: 24333 - DNA, 181 bp, Homo sapiens; identical to SEQ ID NO: 14985
  misc_feature 1..181: note = chr7:37279183-37279364
  misc_feature 1..181: note = hypo
  source 1..181: mol_type = genomic DNA

SEQ ID NO: 24334 - DNA, 39 bp, Homo sapiens; identical to SEQ ID NO: 14986
  misc_feature 1..39: note = chr7:37770953-37770992
  misc_feature 1..39: note = hypo
  source 1..39: mol_type = genomic DNA

SEQ ID NO: 24335 - DNA, 30 bp, Homo sapiens; identical to SEQ ID NO: 14987
  misc_feature 1..30: note = chr7:38740329-38740359
  misc_feature 1..30: note = hypo
  source 1..30: mol_type = genomic DNA

SEQ ID NO: 24336 - DNA, 17 bp, Homo sapiens
  misc_feature 1..17: note = chr7:43767864-43767881
  misc_feature 1..17: note = hypo
  source 1..17: mol_type = genomic DNA
tacgttttaaatggtga

SEQ ID NO: 24337 - DNA, 33 bp, Homo sapiens; identical to SEQ ID NO: 14989
  misc_feature 1..33: note = chr7:43865061-43865094
  misc_feature 1..33: note = hypo
  source 1..33: mol_type = genomic DNA

SEQ ID NO: 24338 - DNA, 93 bp, Homo sapiens; identical to SEQ ID NO: 14990
  misc_feature 1..93: note = chr7:43865154-43865247
  misc_feature 1..93: note = hypo
  source 1..93: mol_type = genomic DNA

SEQ ID NO: 24339 - DNA, 28 bp, Homo sapiens
  misc_feature 1..28: note = chr7:44083432-44083460
  misc_feature 1..28: note = hypo
  source 1..28: mol_type = genomic DNA
gagccaccgtgcccggcaggatttatat

SEQ ID NO: 24340 - DNA, 30 bp, Homo sapiens; identical to SEQ ID NO: 14992
  misc_feature 1..30: note = chr7:44151353-44151383
  misc_feature 1..30: note = hypo
  source 1..30: mol_type = genomic DNA

SEQ ID NO: 24341 - DNA, 41 bp, Homo sapiens; identical to SEQ ID NO: 5065
  misc_feature 1..41: note = chr7:44151615-44151656
  misc_feature 1..41: note = hypo
  source 1..41: mol_type = genomic DNA

SEQ ID NO: 24342 - DNA, 30 bp, Homo sapiens; identical to SEQ ID NO: 14994
  misc_feature 1..30: note = chr7:44152191-44152221
  misc_feature 1..30: note = hypo
  source 1..30: mol_type = genomic DNA

SEQ ID NO: 24343 - DNA, 20 bp, Homo sapiens
  misc_feature 1..20: note = chr7:45027140-45027160
  misc_feature 1..20: note = hypo
  source 1..20: mol_type = genomic DNA
cagagcgagactctgtctca

SEQ ID NO: 24344 - DNA, 128 bp, Homo sapiens
  misc_feature 1..128: note = chr7:50438648-50438776
  misc_feature 1..128: note = hypo
  source 1..128: mol_type = genomic DNA
ggagtgagcgatttaggaactcacagaagggcacggccaggcaactcgggccctggcaaatgttccatagagacagcatccatggggttgaaccaagcacaatgcctgcaaatcgggcaggcgggttc

SEQ ID NO: 24345 - DNA, 30 bp, Homo sapiens; identical to SEQ ID NO: 15000
  misc_feature 1..30: note = chr7:54794762-54794792
  misc_feature 1..30: note = hypo
  source 1..30: mol_type = genomic DNA

SEQ ID NO: 24346 - DNA, 37 bp, Homo sapiens; identical to SEQ ID NO: 15001
  misc_feature 1..37: note = chr7:55145943-55145980
  misc_feature 1..37: note = hypo
  source 1..37: mol_type = genomic DNA

SEQ ID NO: 24347 - DNA, 91 bp, Homo sapiens; identical to SEQ ID NO: 15003
  misc_feature 1..91: note = chr7:65880043-65880134
  misc_feature 1..91: note = hypo
  source 1..91: mol_type = genomic DNA

SEQ ID NO: 24348 - DNA, 42 bp, Homo sapiens; identical to SEQ ID NO: 15004
  misc_feature 1..42: note = chr7:69036110-69036152
  misc_feature 1..42: note = hypo
  source 1..42: mol_type = genomic DNA

SEQ ID NO: 24349 - DNA, 179 bp, Homo sapiens; identical to SEQ ID NO: 15005
  misc_feature 1..179: note = chr7:69313694-69313873
  misc_feature 1..179: note = hypo
  source 1..179: mol_type = genomic DNA

SEQ ID NO: 24350 - DNA, 41 bp, Homo sapiens; identical to SEQ ID NO: 15007
  misc_feature 1..41: note = chr7:97797757-97797798
  misc_feature 1..41: note = hypo
  source 1..41: mol_type = genomic DNA

SEQ ID NO: 24351 - DNA, 198 bp, Homo sapiens; identical to SEQ ID NO: 15009
  misc_feature 1..198: note = chr7:98183080-98183278
  misc_feature 1..198: note = hypo
  source 1..198: mol_type = genomic DNA

SEQ ID NO: 24352 - DNA, 30 bp, Homo sapiens; identical to SEQ ID NO: 15011
  misc_feature 1..30: note = chr7:98991702-98991732
  misc_feature 1..30: note = hypo
  source 1..30: mol_type = genomic DNA

SEQ ID NO: 24353 - DNA, 273 bp, Homo sapiens; identical to SEQ ID NO: 15012
  misc_feature 1..273: note = chr7:99020719-99020992
  misc_feature 1..273: note = hypo
  source 1..273: mol_type = genomic DNA

SEQ ID NO: 24354 - DNA, 37 bp, Homo sapiens; identical to SEQ ID NO: 15013
  misc_feature 1..37: note = chr7:99700198-99700235
  misc_feature 1..37: note = hypo
  source 1..37: mol_type = genomic DNA

SEQ ID NO: 24355 - DNA, 49 bp, Homo sapiens
  misc_feature 1..49: note = chr7:100088134-100088183
  misc_feature 1..49: note = hypo
  source 1..49: mol_type = genomic DNA
agcagaggtcgaggacggtgcccgggcctggaatggcagtgccgagggt

SEQ ID NO: 24356 - DNA, 30 bp, Homo sapiens; identical to SEQ ID NO: 15015
  misc_feature 1..30: note = chr7:100179772-100179802
  misc_feature 1..30: note = hypo
  source 1..30: mol_type = genomic DNA

SEQ ID NO: 24357 - DNA, 30 bp, Homo sapiens; identical to SEQ ID NO: 15016
  misc_feature 1..30: note = chr7:100799119-100799149
  misc_feature 1..30: note = hypo
  source 1..30: mol_type = genomic DNA

SEQ ID NO: 24358 - DNA, 67 bp, Homo sapiens; identical to SEQ ID NO: 5069
  misc_feature 1..67: note = chr7:101652623-101652690
  misc_feature 1..67: note = hypo
  source 1..67: mol_type = genomic DNA

SEQ ID NO: 24359 - DNA, 78 bp, Homo sapiens; identical to SEQ ID NO: 15018
  misc_feature 1..78: note = chr7:101656381-101656459
  misc_feature 1..78: note = hypo
  source 1..78: mol_type = genomic DNA

SEQ ID NO: 24360 - DNA, 24 bp, Homo sapiens
  misc_feature 1..24: note = chr7:102782042-102782066
  misc_feature 1..24: note = hypo
  source 1..24: mol_type = genomic DNA
atcttcttagattcacggtatctt

SEQ ID NO: 24361 - DNA, 30 bp, Homo sapiens; identical to SEQ ID NO: 1575
  misc_feature 1..30: note = chr7:128097589-128097619
  misc_feature 1..30: note = hypo
  source 1..30: mol_type = genomic DNA

SEQ ID NO: 24362 - DNA, 30 bp, Homo sapiens; identical to SEQ ID NO: 15024
  misc_feature 1..30: note = chr7:128493200-128493230
  misc_feature 1..30: note = hypo
  source 1..30: mol_type = genomic DNA

SEQ ID NO: 24363 - DNA, 30 bp, Homo sapiens; identical to SEQ ID NO: 15025
  misc_feature 1..30: note = chr7:128528857-128528887
  misc_feature 1..30: note = hypo
  source 1..30: mol_type = genomic DNA

SEQ ID NO: 24364 - DNA, 30 bp, Homo sapiens; identical to SEQ ID NO: 15026
  misc_feature 1..30: note = chr7:128529102-128529132
  misc_feature 1..30: note = hypo
  source 1..30: mol_type = genomic DNA

SEQ ID NO: 24365 - DNA, 18 bp, Homo sapiens
  misc_feature 1..18: note = chr7:129794721-129794739
  misc_feature 1..18: note = hypo
  source 1..18: mol_type = genomic DNA
gtgcgcccatcagggtgt

SEQ ID NO: 24366 - DNA, 30 bp, Homo sapiens; identical to SEQ ID NO: 15029
  misc_feature 1..30: note = chr7:131231034-131231064
  misc_feature 1..30: note = hypo
  source 1..30: mol_type = genomic DNA

SEQ ID NO: 24367 - DNA, 20 bp, Homo sapiens
  misc_feature 1..20: note = chr7:135196094-135196114
  misc_feature 1..20: note = hypo
  source 1..20: mol_type = genomic DNA
tttttttttttgagacggag

SEQ ID NO: 24368 - DNA, 135 bp, Homo sapiens; identical to SEQ ID NO: 15032
  misc_feature 1..135: note = chr7:135401363-135401498
  misc_feature 1..135: note = hypo
  source 1..135: mol_type = genomic DNA

SEQ ID NO: 24369 - DNA, 30 bp, Homo sapiens; identical to SEQ ID NO: 15033
  misc_feature 1..30: note = chr7:137664095-137664125
  misc_feature 1..30: note = hypo
  source 1..30: mol_type = genomic DNA

SEQ ID NO: 24370 - DNA, 41 bp, Homo sapiens; identical to SEQ ID NO: 15034
  misc_feature 1..41: note = chr7:139650651-139650692
  misc_feature 1..41: note = hypo
  source 1..41: mol_type = genomic DNA

SEQ ID NO: 24371 - DNA, 21 bp, Homo sapiens
  misc_feature 1..21: note = chr7:140026923-140026944
  misc_feature 1..21: note = hypo
  source 1..21: mol_type = genomic DNA
acggagcgagattctgtctca

SEQ ID NO: 24372 - DNA, 16 bp, Homo sapiens
  misc_feature 1..16: note = chr7:140097283-140097299
  misc_feature 1..16: note = hypo
  source 1..16: mol_type = genomic DNA
gcgcccaacccgaagc

SEQ ID NO: 24373 - DNA, 30 bp, Homo sapiens; identical to SEQ ID NO: 15037
  misc_feature 1..30: note = chr7:140156648-140156678
  misc_feature 1..30: note = hypo
  source 1..30: mol_type = genomic DNA

SEQ ID NO: 24374 - DNA, 86 bp, Homo sapiens
  misc_feature 1..86: note = chr7:148640250-148640336
  misc_feature 1..86: note = hypo
  source 1..86: mol_type = genomic DNA
ttcaatgtgctaaatgtgataggcacttcaatatccacttcaggtgacaaataattagaaatgaggtccaccgtgaaggaaatgga

SEQ ID NO: 24375 - DNA, 63 bp, Homo sapiens
  misc_feature 1..63: note = chr7:148846075-148846138
  misc_feature 1..63: note = hypo
  source 1..63: mol_type = genomic DNA
cttaaattctctaggcgtcacgtttaaaaagtaaaaagccaggcgctgtgttgtgcacgcctg

SEQ ID NO: 24376 - DNA, 71 bp, Homo sapiens
  misc_feature 1..71: note = chr7:150049533-150049604
  misc_feature 1..71: note = hypo
  source 1..71: mol_type = genomic DNA
accagaatgtcttatcgttgaaattattttttacttccttttgaaatgcttgagtttttttgtttgttttg

SEQ ID NO: 24377 - DNA, 30 bp, Homo sapiens; identical to SEQ ID NO: 15041
  misc_feature 1..30: note = chr7:150070259-150070289
  misc_feature 1..30: note = hypo
  source 1..30: mol_type = genomic DNA

SEQ ID NO: 24378 - DNA, 76 bp, Homo sapiens; identical to SEQ ID NO: 15042
  misc_feature 1..76: note = chr7:150746248-150746324
  misc_feature 1..76: note = hypo
  source 1..76: mol_type = genomic DNA

SEQ ID NO: 24379 - DNA, 99 bp, Homo sapiens; identical to SEQ ID NO: 15043
  misc_feature 1..99: note = chr7:150774704-150774803
  misc_feature 1..99: note = hypo
  source 1..99: mol_type = genomic DNA

SEQ ID NO: 24380 - DNA, 30 bp, Homo sapiens; identical to SEQ ID NO: 15044
  misc_feature 1..30: note = chr7:150823844-150823874
  misc_feature 1..30: note = hypo
  source 1..30: mol_type = genomic DNA

SEQ ID NO: 24381 - DNA, 19 bp, Homo sapiens
  misc_feature 1..19: note = chr7:150870889-150870908
  misc_feature 1..19: note = hypo
  source 1..19: mol_type = genomic DNA
tccccgtgccaagggccac

SEQ ID NO: 24382 - DNA, 57 bp, Homo sapiens; identical to SEQ ID NO: 15046
  misc_feature 1..57: note = chr7:150871142-150871199
  misc_feature 1..57: note = hypo
  source 1..57: mol_type = genomic DNA

SEQ ID NO: 24383 - DNA, 18 bp, Homo sapiens
  misc_feature 1..18: note = chr7:151591649-151591667
  misc_feature 1..18: note = hypo
  source 1..18: mol_type = genomic DNA
ggctcaagccctccccga

SEQ ID NO: 24384 - DNA, 43 bp, Homo sapiens; identical to SEQ ID NO: 15048
  misc_feature 1..43: note = chr7:152337501-152337544
  misc_feature 1..43: note = hypo
  source 1..43: mol_type = genomic DNA

SEQ ID NO: 24385 - DNA, 175 bp, Homo sapiens; identical to SEQ ID NO: 15049
  misc_feature 1..175: note = chr7:152693809-152693984
  misc_feature 1..175: note = hypo
  source 1..175: mol_type = genomic DNA

SEQ ID NO: 24386 - DNA, 30 bp, Homo sapiens; identical to SEQ ID NO: 15051
  misc_feature 1..30: note = chr7:154670104-154670134
  misc_feature 1..30: note = hypo
  source 1..30: mol_type = genomic DNA

SEQ ID NO: 24387 - DNA, 32 bp, Homo sapiens; identical to SEQ ID NO: 15052
  misc_feature 1..32: note = chr7:155202839-155202871
  misc_feature 1..32: note = hypo
  source 1..32: mol_type = genomic DNA

SEQ ID NO: 24388 - DNA, 43 bp, Homo sapiens; identical to SEQ ID NO: 15053
  misc_feature 1..43: note = chr7:155363419-155363462
  misc_feature 1..43: note = hypo
  source 1..43: mol_type = genomic DNA

SEQ ID NO: 24389 - DNA, 14 bp, Homo sapiens
  misc_feature 1..14: note = chr7:155580876-155580890
  misc_feature 1..14: note = hypo
  source 1..14: mol_type = genomic DNA
atcgacagctaaaa

SEQ ID NO: 24390 - DNA, 100 bp, Homo sapiens; identical to SEQ ID NO: 15058
  misc_feature 1..100: note = chr7:155753587-155753687
  misc_feature 1..100: note = hypo
  source 1..100: mol_type = genomic DNA

SEQ ID NO: 24391 - DNA, 131 bp, Homo sapiens; identical to SEQ ID NO: 15059
  misc_feature 1..131: note = chr7:155899015-155899146
  misc_feature 1..131: note = hypo
  source 1..131: mol_type = genomic DNA

SEQ ID NO: 24392 - DNA, 86 bp, Homo sapiens
  misc_feature 1..86: note = chr7:156744713-156744799
  misc_feature 1..86: note = hypo
  source 1..86: mol_type = genomic DNA
tcatataaacttagatattacttttaaacaagtttgaaattgtttttaggacactttccctccaaaattagcggtttgtttaattt

SEQ ID NO: 24393 - DNA, 25 bp, Homo sapiens
  misc_feature 1..25: note = chr7:156832823-156832848
  misc_feature 1..25: note = hypo
  source 1..25: mol_type = genomic DNA
aagcggacttgggagcgacggggtt

SEQ ID NO: 24394 - DNA, 28 bp, Homo sapiens
  misc_feature 1..28: note = chr7:156880561-156880589
  misc_feature 1..28: note = hypo
  source 1..28: mol_type = genomic DNA
gcacggccctcggcgtggatatccggaa

SEQ ID NO: 24395 - DNA, 63 bp, Homo sapiens; identical to SEQ ID NO: 15064
  misc_feature 1..63: note = chr7:157084534-157084597
  misc_feature 1..63: note = hypo
  source 1..63: mol_type = genomic DNA

SEQ ID NO: 24396 - DNA, 30 bp, Homo sapiens
  misc_feature 1..30: note = chr7:157085343-157085373
  misc_feature 1..30: note = hypo
  source 1..30: mol_type = genomic DNA
gggggaggccaggaccgtggagttctagag

SEQ ID NO: 24397 - DNA, 17 bp, Homo sapiens
  misc_feature 1..17: note = chr7:157085946-157085963
  misc_feature 1..17: note = hypo
  source 1..17: mol_type = genomic DNA
gagcctctgctcccacg

SEQ ID NO: 24398 - DNA, 33 bp, Homo sapiens
  misc_feature 1..33: note = chr7:157086082-157086115
  misc_feature 1..33: note = hypo
  source 1..33: mol_type = genomic DNA
gttctccggatctccagacgtttaggctgaaag

SEQ ID NO: 24399 - DNA, 239 bp, Homo sapiens; identical to SEQ ID NO: 15067
  misc_feature 1..239: note = chr7:157255083-157255322
  misc_feature 1..239: note = hypo
  source 1..239: mol_type = genomic DNA

SEQ ID NO: 24400 - DNA, 236 bp, Homo sapiens
  misc_feature 1..236: note = chr7:157262579-157262815
  misc_feature 1..236: note = hypo
  source 1..236: mol_type = genomic DNA
actccagggtgaacccgggactcctgagtgggcgcccaggcccctctagtgctggccgcctctgcttccctctccaggcccacctgccggccaccacagtggcccccagcgcccagcccaggtcccccacgccggcttctctcggcccaggtcactctcttcacactgtcatctgccagtcacttgcacactctgattcccaaggcgactctgctgcaggcacacgccctcagcaa

SEQ ID NO: 24401 - DNA, 276 bp, Homo sapiens
  misc_feature 1..276: note = chr7:157263018-157263294
  misc_feature 1..276: note = hypo
  source 1..276: mol_type = genomic DNA
ggcctggattgggtgtgtccgtgtgtccggcactggcctgcgttgggtgtgtccgtgtgtccggcgctggcctgggttgggtgtgtccgtgtgtccggcgctggcctgggttgggtgtgtccatgtgtccggcgctggcctgggttgggtgtgtccgtgtgtccggcgctggcctgggttgggtgtgtccgtgtgtccggcgctggcctgggttgggtgtgtccgtgtgtccggcgctggcctgggttgggtgtgtccgtgtgtccggcgctggcc

SEQ ID NO: 24402 - DNA, 30 bp, Homo sapiens; identical to SEQ ID NO: 15069
  misc_feature 1..30: note = chr7:157294288-157294318
  misc_feature 1..30: note = hypo
  source 1..30: mol_type = genomic DNA

SEQ ID NO: 24403 - DNA, 57 bp, Homo sapiens; identical to SEQ ID NO: 15070
  misc_feature 1..57: note = chr7:157337964-157338021
  misc_feature 1..57: note = hypo
  source 1..57: mol_type = genomic DNA

SEQ ID NO: 24404 - DNA, 43 bp, Homo sapiens; identical to SEQ ID NO: 15071
  misc_feature 1..43: note = chr7:157353030-157353073
  misc_feature 1..43: note = hypo
  source 1..43: mol_type = genomic DNA

SEQ ID NO: 24405 - DNA, 65 bp, Homo sapiens; identical to SEQ ID NO: 15072
  misc_feature 1..65: note = chr7:157396449-157396514
  misc_feature 1..65: note = hypo
  source 1..65: mol_type = genomic DNA

SEQ ID NO: 24406 - DNA, 167 bp, Homo sapiens; identical to SEQ ID NO: 15073
  misc_feature 1..167: note = chr7:157403604-157403771
  misc_feature 1..167: note = hypo
  source 1..167: mol_type = genomic DNA

SEQ ID NO: 24407 - DNA, 32 bp, Homo sapiens; identical to SEQ ID NO: 15074
  misc_feature 1..32: note = chr7:157448480-157448512
  misc_feature 1..32: note = hypo
  source 1..32: mol_type = genomic DNA

SEQ ID NO: 24408 - DNA, 48 bp, Homo sapiens; identical to SEQ ID NO: 15075
  misc_feature 1..48: note = chr7:157565500-157565548
  misc_feature 1..48: note = hypo
  source 1..48: mol_type = genomic DNA

SEQ ID NO: 24409 - DNA, 30 bp, Homo sapiens; identical to SEQ ID NO: 15076
  misc_feature 1..30: note = chr7:157568187-157568217
  misc_feature 1..30: note = hypo
  source 1..30: mol_type = genomic DNA

SEQ ID NO: 24410 - DNA, 33 bp, Homo sapiens
  misc_feature 1..33: note = chr7:157584208-157584241
  misc_feature 1..33: note = hypo
  source 1..33: mol_type = genomic DNA
cctccctgcacccgcccccgctccctgcaccca

SEQ ID NO: 24411 - DNA, 30 bp, Homo sapiens; identical to SEQ ID NO: 15079
  misc_feature 1..30: note = chr7:157588963-157588993
  misc_feature 1..30: note = hypo
  source 1..30: mol_type = genomic DNA

SEQ ID NO: 24412 - DNA, 16 bp, Homo sapiens
  misc_feature 1..16: note = chr7:157606736-157606752
  misc_feature 1..16: note = hypo
  source 1..16: mol_type = genomic DNA
gcgaggcagtggtcgc

SEQ ID NO: 24413 - DNA, 30 bp, Homo sapiens; identical to SEQ ID NO: 15081
  misc_feature 1..30: note = chr7:157633412-157633442
  misc_feature 1..30: note = hypo
  source 1..30: mol_type = genomic DNA

SEQ ID NO: 24414 - DNA, 192 bp, Homo sapiens; identical to SEQ ID NO: 15082
  misc_feature 1..192: note = chr7:157659256-157659448
  misc_feature 1..192: note = hypo
  source 1..192: mol_type = genomic DNA

SEQ ID NO: 24415 - DNA, 161 bp, Homo sapiens; identical to SEQ ID NO: 15083
  misc_feature 1..161: note = chr7:157776781-157776942
  misc_feature 1..161: note = hypo
  source 1..161: mol_type = genomic DNA

SEQ ID NO: 24416 - DNA, 30 bp, Homo sapiens; identical to SEQ ID NO: 15084
  misc_feature 1..30: note = chr7:157793858-157793888
  misc_feature 1..30: note = hypo
  source 1..30: mol_type = genomic DNA

SEQ ID NO: 24417 - DNA, 30 bp, Homo sapiens; identical to SEQ ID NO: 15085
  misc_feature 1..30: note = chr7:157877477-157877507
  misc_feature 1..30: note = hypo
  source 1..30: mol_type = genomic DNA

SEQ ID NO: 24418 - DNA, 30 bp, Homo sapiens; identical to SEQ ID NO: 15086
  misc_feature 1..30: note = chr7:157958638-157958668
  misc_feature 1..30: note = hypo
  source 1..30: mol_type = genomic DNA

SEQ ID NO: 24419 - DNA, 34 bp, Homo sapiens; identical to SEQ ID NO: 15087
  misc_feature 1..34: note = chr7:158301521-158301555
  misc_feature 1..34: note = hypo
  source 1..34: mol_type = genomic DNA

SEQ ID NO: 24420 - DNA, 140 bp, Homo sapiens; identical to SEQ ID NO: 15088
  misc_feature 1..140: note = chr8:972710-972850
  misc_feature 1..140: note = hypo
  source 1..140: mol_type = genomic DNA

SEQ ID NO: 24421 - DNA, 30 bp, Homo sapiens; identical to SEQ ID NO: 15089
  misc_feature 1..30: note = chr8:1048584-1048614
  misc_feature 1..30: note = hypo
  source 1..30: mol_type = genomic DNA

SEQ ID NO: 24422 - DNA, 88 bp, Homo sapiens; identical to SEQ ID NO: 15090
  misc_feature 1..88: note = chr8:1137245-1137333
  misc_feature 1..88: note = hypo
  source 1..88: mol_type = genomic DNA

SEQ ID NO: 24423 - DNA, 99 bp, Homo sapiens; identical to SEQ ID NO: 15091
  misc_feature 1..99: note = chr8:1246701-1246800
  misc_feature 1..99: note = hypo
  source 1..99: mol_type = genomic DNA

SEQ ID NO: 24424 - DNA, 102 bp, Homo sapiens; identical to SEQ ID NO: 15092
  misc_feature 1..102: note = chr8:1302692-1302794
  misc_feature 1..102: note = hypo
  source 1..102: mol_type = genomic DNA

SEQ ID NO: 24425 - DNA, 37 bp, Homo sapiens; identical to SEQ ID NO: 15093
  misc_feature 1..37: note = chr8:1471545-1471582
  misc_feature 1..37: note = hypo
  source 1..37: mol_type = genomic DNA

SEQ ID NO: 24426 - DNA, 30 bp, Homo sapiens; identical to SEQ ID NO: 15094
  misc_feature 1..30: note = chr8:2652772-2652802
  misc_feature 1..30: note = hypo
  source 1..30: mol_type = genomic DNA

SEQ ID NO: 24427 - DNA, 28 bp, Homo sapiens
  misc_feature 1..28: note = chr8:8639463-8639491
  misc_feature 1..28: note = hypo
  source 1..28: mol_type = genomic DNA
agcgggatgcagccgtagggccagccac

SEQ ID NO: 24428 - DNA, 30 bp, Homo sapiens; identical to SEQ ID NO: 15096
  misc_feature 1..30: note = chr8:8639731-8639761
  misc_feature 1..30: note = hypo
  source 1..30: mol_type = genomic DNA

SEQ ID NO: 24429 - DNA, 117 bp, Homo sapiens; identical to SEQ ID NO: 15099
  misc_feature 1..117: note = chr8:10529008-10529125
  misc_feature 1..117: note = hypo
  source 1..117: mol_type = genomic DNA

SEQ ID NO: 24430 - skipped

SEQ ID NO: 24431 - DNA, 27 bp, Homo sapiens
  misc_feature 1..27: note = chr8:13654937-13654964
  misc_feature 1..27: note = hypo
  source 1..27: mol_type = genomic DNA
gttatgggccgggtgcggtggctcaca

SEQ ID NO: 24432 - DNA, 30 bp, Homo sapiens; identical to SEQ ID NO: 15102
  misc_feature 1..30: note = chr8:23290404-23290434
  misc_feature 1..30: note = hypo
  source 1..30: mol_type = genomic DNA

SEQ ID NO: 24433 - DNA, 38 bp, Homo sapiens; identical to SEQ ID NO: 15103
  misc_feature 1..38: note = chr8:23399594-23399632
  misc_feature 1..38: note = hypo
  source 1..38: mol_type = genomic DNA

SEQ ID NO: 24434 - skipped

SEQ ID NO: 24435 - DNA, 96 bp, Homo sapiens
  misc_feature 1..96: note = chr8:23423974-23424070
  misc_feature 1..96: note = hypo
  source 1..96: mol_type = genomic DNA
gagttgtgtgtgcaatgcacacccagacacacgcacgcacacacacgcgcgcgcacacacatgcttttttctgttcccctccgctttctgaagcct

SEQ ID NO: 24436 - DNA, 117 bp, Homo sapiens; identical to SEQ ID NO: 15105
  misc_feature 1..117: note = chr8:25397086-25397203
  misc_feature 1..117: note = hypo
  source 1..117: mol_type = genomic DNA

SEQ ID NO: 24437 - DNA, 58 bp, Homo sapiens; identical to SEQ ID NO: 15107
  misc_feature 1..58: note = chr8:42144632-42144690
  misc_feature 1..58: note = hypo
  source 1..58: mol_type = genomic DNA

SEQ ID NO: 24438 - DNA, 30 bp, Homo sapiens; identical to SEQ ID NO: 15108
  misc_feature 1..30: note = chr8:42699267-42699297
  misc_feature 1..30: note = hypo
  source 1..30: mol_type = genomic DNA

SEQ ID NO: 24439 - DNA, 115 bp, Homo sapiens; identical to SEQ ID NO: 15110
  misc_feature 1..115: note = chr8:47093290-47093405
  misc_feature 1..115: note = hypo
  source 1..115: mol_type = genomic DNA

SEQ ID NO: 24440 - DNA, 92 bp, Homo sapiens; identical to SEQ ID NO: 15111
  misc_feature 1..92: note = chr8:47334506-47334598
  misc_feature 1..92: note = hypo
  source 1..92: mol_type = genomic DNA

SEQ ID NO: 24441 - DNA, 30 bp, Homo sapiens; identical to SEQ ID NO: 15112
  misc_feature 1..30: note = chr8:48045032-48045062
  misc_feature 1..30: note = hypo
  source 1..30: mol_type = genomic DNA

SEQ ID NO: 24442 - DNA, 168 bp, Homo sapiens; identical to SEQ ID NO: 15113
  misc_feature 1..168: note = chr8:48294168-48294336
  misc_feature 1..168: note = hypo
  source 1..168: mol_type = genomic DNA

SEQ ID NO: 24443 - DNA, 180 bp, Homo sapiens; identical to SEQ ID NO: 15114
  misc_feature 1..180: note = chr8:49335062-49335242
  misc_feature 1..180: note = hypo
  source 1..180: mol_type = genomic DNA

SEQ ID NO: 24444 - DNA, 30 bp, Homo sapiens; identical to SEQ ID NO: 15115
  misc_feature 1..30: note = chr8:49572124-49572154
  misc_feature 1..30: note = hypo
  source 1..30: mol_type = genomic DNA

SEQ ID NO: 24445 - DNA, 41 bp, Homo sapiens; identical to SEQ ID NO: 15116
  misc_feature 1..41: note = chr8:49609162-49609203
  misc_feature 1..41: note = hypo
  source 1..41: mol_type = genomic DNA

SEQ ID NO: 24446 - DNA, 28 bp, Homo sapiens
  misc_feature 1..28: note = chr8:50015582-50015610
  misc_feature 1..28: note = hypo
  source 1..28: mol_type = genomic DNA
ctatgggaccgggcgtcttggagcaggg

SEQ ID NO: 24447 - DNA, 41 bp, Homo sapiens; identical to SEQ ID NO: 15118
  misc_feature 1..41: note = chr8:50377787-50377828
  misc_feature 1..41: note = hypo
  source 1..41: mol_type = genomic DNA

SEQ ID NO: 24448 - DNA, 34 bp, Homo sapiens; identical to SEQ ID NO: 15119
  misc_feature 1..34: note = chr8:52432891-52432925
  misc_feature 1..34: note = hypo
  source 1..34: mol_type = genomic DNA

SEQ ID NO: 24449 - DNA, 30 bp, Homo sapiens; identical to SEQ ID NO: 15120
  misc_feature 1..30: note = chr8:55689465-55689495
  misc_feature 1..30: note = hypo
  source 1..30: mol_type = genomic DNA

SEQ ID NO: 24450 - DNA, 30 bp, Homo sapiens; identical to SEQ ID NO: 15121
  misc_feature 1..30: note = chr8:56929748-56929778
  misc_feature 1..30: note = hypo
  source 1..30: mol_type = genomic DNA

SEQ ID NO: 24451 - skipped

SEQ ID NO: 24452 - DNA, 54 bp, Homo sapiens
  misc_feature 1..54: note = chr8:58116950-58117004
  misc_feature 1..54: note = hypo
  source 1..54: mol_type = genomic DNA
cagaaacgttgcagccgatggcacggcagtggggaggaaaacgtaggaagcatg

SEQ ID NO: 24453 - DNA, 63 bp, Homo sapiens
  misc_feature 1..63: note = chr8:58130301-58130364
  misc_feature 1..63: note = hypo
  source 1..63: mol_type = genomic DNA
ggaagacacatctgacgagatcgaatgttttgcagaagagccatgtgaccagatccctggttt

SEQ ID NO: 24454 - DNA, 89 bp, Homo sapiens
  misc_feature 1..89: note = chr8:61789885-61789974
  misc_feature 1..89: note = hypo
  source 1..89: mol_type = genomic DNA
ataatgacgacgaggcggatggcggcggggaggctagagcccatttcagaagcctgcagtgaggattccaccagttcacatgcatcggg

SEQ ID NO: 24455 - DNA, 23 bp, Homo sapiens
  misc_feature 1..23: note = chr8:64023521-64023544
  misc_feature 1..23: note = hypo
  source 1..23: mol_type = genomic DNA
accgcgcccggccttaagtgttt

SEQ ID NO: 24456 - DNA, 90 bp, Homo sapiens; identical to SEQ ID NO: 15127
  misc_feature 1..90: note = chr8:65749819-65749909
  misc_feature 1..90: note = hypo
  source 1..90: mol_type = genomic DNA

SEQ ID NO: 24457 - DNA, 30 bp, Homo sapiens; identical to SEQ ID NO: 15129
  misc_feature 1..30: note = chr8:71368455-71368485
  misc_feature 1..30: note = hypo
  source 1..30: mol_type = genomic DNA

SEQ ID NO: 24458 - DNA, 32 bp, Homo sapiens; identical to SEQ ID NO: 15130
  misc_feature 1..32: note = chr8:74332813-74332845
  misc_feature 1..32: note = hypo
  source 1..32: mol_type = genomic DNA

SEQ ID NO: 24459 - DNA, 16 bp, Homo sapiens
  misc_feature 1..16: note = chr8:74889431-74889447
  misc_feature 1..16: note = hypo
  source 1..16: mol_type = genomic DNA
ttggaggtgaagtctc

SEQ ID NO: 24460 - DNA, 30 bp, Homo sapiens; identical to SEQ ID NO: 15135
  misc_feature 1..30: note = chr8:91130098-91130128
  misc_feature 1..30: note = hypo
  source 1..30: mol_type = genomic DNA

SEQ ID NO: 24461 - DNA, 77 bp, Homo sapiens; identical to SEQ ID NO: 15137
  misc_feature 1..77: note = chr8:95416054-95416131
  misc_feature 1..77: note = hypo
  source 1..77: mol_type = genomic DNA

SEQ ID NO: 24462 - DNA, 30 bp, Homo sapiens; identical to SEQ ID NO: 15138
  misc_feature 1..30: note = chr8:96208663-96208693
  misc_feature 1..30: note = hypo
  source 1..30: mol_type = genomic DNA

SEQ ID NO: 24463 - skipped

SEQ ID NO: 24464 - DNA, 30 bp, Homo sapiens; identical to SEQ ID NO: 15140
  misc_feature 1..30: note = chr8:98738336-98738366
  misc_feature 1..30: note = hypo
  source 1..30: mol_type = genomic DNA

SEQ ID NO: 24465 - DNA, 41 bp, Homo sapiens; identical to SEQ ID NO: 15141
  misc_feature 1..41: note = chr8:100026614-100026655
  misc_feature 1..41: note = hypo
  source 1..41: mol_type = genomic DNA

SEQ ID NO: 24466 - DNA, 25 bp, Homo sapiens
  misc_feature 1..25: note = chr8:101156861-101156886
  misc_feature 1..25: note = hypo
  source 1..25: mol_type = genomic DNA
aaaaaaaaaaagcagcggccgggcg

SEQ ID NO: 24467 - DNA, 30 bp, Homo sapiens; identical to SEQ ID NO: 15144
  misc_feature 1..30: note = chr8:104382635-104382665
  misc_feature 1..30: note = hypo
  source 1..30: mol_type = genomic DNA

SEQ ID NO: 24468 - DNA, 30 bp, Homo sapiens; identical to SEQ ID NO: 15145
  misc_feature 1..30: note = chr8:106500552-106500582
  misc_feature 1..30: note = hypo
  source 1..30: mol_type = genomic DNA

SEQ ID NO: 24469 - DNA, 16 bp, Homo sapiens
  misc_feature 1..16: note = chr8:110274990-110275006
  misc_feature 1..16: note = hypo
  source 1..16: mol_type = genomic DNA
aaacctgaatgtggcc

SEQ ID NO: 24470 - DNA, 30 bp, Homo sapiens; identical to SEQ ID NO: 15147
  misc_feature 1..30: note = chr8:110275321-110275351
  misc_feature 1..30: note = hypo
  source 1..30: mol_type = genomic DNA

SEQ ID NO: 24471 - DNA, 171 bp, Homo sapiens; identical to SEQ ID NO: 15148
  misc_feature 1..171: note = chr8:110548417-110548588
  misc_feature 1..171: note = hypo
  source 1..171: mol_type = genomic DNA

SEQ ID NO: 24472 - DNA, 30 bp, Homo sapiens; identical to SEQ ID NO: 15149
  misc_feature 1..30: note = chr8:110961977-110962007
  misc_feature 1..30: note = hypo
  source 1..30: mol_type = genomic DNA

SEQ ID NO: 24473 - DNA, 30 bp, Homo sapiens; identical to SEQ ID NO: 15150
  misc_feature 1..30: note = chr8:117824014-117824044
  misc_feature 1..30: note = hypo
  source 1..30: mol_type = genomic DNA

SEQ ID NO: 24474 - DNA, 38 bp, Homo sapiens; identical to SEQ ID NO: 15151
  misc_feature 1..38: note = chr8:121206396-121206434
  misc_feature 1..38: note = hypo
  source 1..38: mol_type = genomic DNA

SEQ ID NO: 24475 - DNA, 16 bp, Homo sapiens
  misc_feature 1..16: note = chr8:123695516-123695532
  misc_feature 1..16: note = hypo
  source 1..16: mol_type = genomic DNA
gcaggccagttgcgcc

SEQ ID NO: 24476 - DNA, 248 bp, Homo sapiens; identical to SEQ ID NO: 15153
  misc_feature 1..248: note = chr8:123966089-123966337
  misc_feature 1..248: note = hypo
  source 1..248: mol_type = genomic DNA

SEQ ID NO: 24477 - DNA, 97 bp, Homo sapiens; identical to SEQ ID NO: 15154
  misc_feature 1..97: note = chr8:127305217-127305314
  misc_feature 1..97: note = hypo
  source 1..97: mol_type = genomic DNA

SEQ ID NO: 24478 - DNA, 41 bp, Homo sapiens; identical to SEQ ID NO: 15157
  misc_feature 1..41: note = chr8:128889207-128889248
  misc_feature 1..41: note = hypo
  source 1..41: mol_type = genomic DNA

SEQ ID NO: 24479 - DNA, 154 bp, Homo sapiens; identical to SEQ ID NO: 15158
  misc_feature 1..154: note = chr8:129069828-129069982
  misc_feature 1..154: note = hypo
  source 1..154: mol_type = genomic DNA

SEQ ID NO: 24480 - DNA, 30 bp, Homo sapiens; identical to SEQ ID NO: 15159
  misc_feature 1..30: note = chr8:130116433-130116463
  misc_feature 1..30: note = hypo
  source 1..30: mol_type = genomic DNA

SEQ ID NO: 24481 - DNA, 23 bp, Homo sapiens
  misc_feature 1..23: note = chr8:131922190-131922213
  misc_feature 1..23: note = hypo
  source 1..23: mol_type = genomic DNA
tttttttttttgagacggagttt

SEQ ID NO: 24482 - DNA, 30 bp, Homo sapiens; identical to SEQ ID NO: 15161
  misc_feature 1..30: note = chr8:133062835-133062865
  misc_feature 1..30: note = hypo
  source 1..30: mol_type = genomic DNA

SEQ ID NO: 24483 - DNA, 132 bp, Homo sapiens; identical to SEQ ID NO: 15163
  misc_feature 1..132: note = chr8:133811037-133811169
  misc_feature 1..132: note = hypo
  source 1..132: mol_type = genomic DNA

SEQ ID NO: 24484 - DNA, 17 bp, Homo sapiens
  misc_feature 1..17: note = chr8:135301235-135301252
  misc_feature 1..17: note = hypo
  source 1..17: mol_type = genomic DNA
gccggccagatcccaca

SEQ ID NO: 24485 - DNA, 89 bp, Homo sapiens
  misc_feature 1..89: note = chr8:140834148-140834237
  misc_feature 1..89: note = hypo
  source 1..89: mol_type = genomic DNA
tcgtagtgccatgctcggctattggctgggcctaaattgttccttactctgagaattcgttaagtggctgagcaataaagaagagagat

SEQ ID NO: 24486 - DNA, 141 bp, Homo sapiens; identical to SEQ ID NO: 15167
  misc_feature 1..141: note = chr8:141202568-141202709
  misc_feature 1..141: note = hypo
  source 1..141: mol_type = genomic DNA

SEQ ID NO: 24487 - DNA, 30 bp, Homo sapiens; identical to SEQ ID NO: 15168
  misc_feature 1..30: note = chr8:141466682-141466712
  misc_feature 1..30: note = hypo
  source 1..30: mol_type = genomic DNA

SEQ ID NO: 24488 - skipped

SEQ ID NO: 24489 - DNA, 30 bp, Homo sapiens; identical to SEQ ID NO: 15170
  misc_feature 1..30: note = chr8:141597034-141597064
  misc_feature 1..30: note = hypo
  source 1..30: mol_type = genomic DNA

SEQ ID NO: 24490 - DNA, 11 bp, Homo sapiens
  misc_feature 1..11: note = chr8:142535496-142535507
  misc_feature 1..11: note = hypo
  source 1..11: mol_type = genomic DNA
gacctgcctgc

SEQ ID NO: 24491 - DNA, 30 bp, Homo sapiens; identical to SEQ ID NO: 15172
  misc_feature 1..30: note = chr8:142553829-142553859
  misc_feature 1..30: note = hypo
  source 1..30: mol_type = genomic DNA

SEQ ID NO: 24492 - DNA, 30 bp, Homo sapiens; identical to SEQ ID NO: 15173
  misc_feature 1..30: note = chr8:142560172-142560202
  misc_feature 1..30: note = hypo
  source 1..30: mol_type = genomic DNA

SEQ ID NO: 24493 - DNA, 30 bp, Homo sapiens; identical to SEQ ID NO: 15174
  misc_feature 1..30: note = chr8:142694812-142694842
  misc_feature 1..30: note = hypo
  source 1..30: mol_type = genomic DNA

SEQ ID NO: 24494 - DNA, 170 bp, Homo sapiens; identical to SEQ ID NO: 15175
  misc_feature 1..170: note = chr8:142706692-142706862
  misc_feature 1..170: note = hypo
  source 1..170: mol_type = genomic DNA

SEQ ID NO: 24495 - DNA, 88 bp, Homo sapiens; identical to SEQ ID NO: 15176
  misc_feature 1..88: note = chr8:143054995-143055083
  misc_feature 1..88: note = hypo
  source 1..88: mol_type = genomic DNA

SEQ ID NO: 24496 - DNA, 16 bp, Homo sapiens
  misc_feature 1..16: note = chr8:143089014-143089030
  misc_feature 1..16: note = hypo
  source 1..16: mol_type = genomic DNA
cgagcgcctcagggtc

SEQ ID NO: 24497 - DNA, 33 bp, Homo sapiens; identical to SEQ ID NO: 15178
  misc_feature 1..33: note = chr8:143097424-143097457
  misc_feature 1..33: note = hypo
  source 1..33: mol_type = genomic DNA

SEQ ID NO: 24498 - DNA, 13 bp, Homo sapiens
  misc_feature 1..13: note = chr8:143105231-143105244
  misc_feature 1..13: note = hypo
  source 1..13: mol_type = genomic DNA
gtctcaggcaggc

SEQ ID NO: 24499 - DNA, 30 bp, Homo sapiens; identical to SEQ ID NO: 15180
  misc_feature 1..30: note = chr8:143333589-143333619
  misc_feature 1..30: note = hypo
  source 1..30: mol_type = genomic DNA

SEQ ID NO: 24500 - DNA, 155 bp, Homo sapiens; identical to SEQ ID NO: 15181
  misc_feature 1..155: note = chr8:143405792-143405947
  misc_feature 1..155: note = hypo
  source 1..155: mol_type = genomic DNA

SEQ ID NO: 24501 - DNA, 53 bp, Homo sapiens; identical to SEQ ID NO: 15182
  misc_feature 1..53: note = chr8:143437078-143437131
  misc_feature 1..53: note = hypo
  source 1..53: mol_type = genomic DNA

SEQ ID NO: 24502 - DNA, 30 bp, Homo sapiens; identical to SEQ ID NO: 15183
  misc_feature 1..30: note = chr8:143463651-143463681
  misc_feature 1..30: note = hypo
  source 1..30: mol_type = genomic DNA

SEQ ID NO: 24503 - DNA, 35 bp, Homo sapiens
  misc_feature 1..35: note = chr8:143509422-143509457
  misc_feature 1..35: note = hypo
  source 1..35: mol_type = genomic DNA
gaccgtgggtaatggcgtcaccccatccgccgtct

SEQ ID NO: 24504 - DNA, 30 bp, Homo sapiens; identical to SEQ ID NO: 15185
  misc_feature 1..30: note = chr8:143538458-143538488
  misc_feature 1..30: note = hypo
  source 1..30: mol_type = genomic DNA

SEQ ID NO: 24505 - DNA, 30 bp, Homo sapiens; identical to SEQ ID NO: 15186
  misc_feature 1..30: note = chr8:143557725-143557755
  misc_feature 1..30: note = hypo
  source 1..30: mol_type = genomic DNA

SEQ ID NO: 24506 - DNA, 36 bp, Homo sapiens; identical to SEQ ID NO: 15187
  misc_feature 1..36: note = chr8:143587455-143587491
  misc_feature 1..36: note = hypo
  source 1..36: mol_type = genomic DNA

SEQ ID NO: 24507 - DNA, 162 bp, Homo sapiens; identical to SEQ ID NO: 15188
  misc_feature 1..162: note = chr8:143595620-143595782
  misc_feature 1..162: note = hypo
  source 1..162: mol_type = genomic DNA

SEQ ID NO: 24508 - DNA, 24 bp, Homo sapiens
  misc_feature 1..24: note = chr8:143621956-143621980
  misc_feature 1..24: note = hypo
  source 1..24: mol_type = genomic DNA
caaggtgggtacatgcgagggagg

SEQ ID NO: 24509 - DNA, 21 bp, Homo sapiens
  misc_feature 1..21: note = chr8:143622096-143622117
  misc_feature 1..21: note = hypo
  source 1..21: mol_type = genomic DNA
gcgtcccgagagtgctgtggc

SEQ ID NO: 24510-24511 - skipped (2 entries)

SEQ ID NO: 24512 - DNA, 36 bp, Homo sapiens; identical to SEQ ID NO: 15192
  misc_feature 1..36: note = chr8:144070623-144070659
  misc_feature 1..36: note = hypo
  source 1..36: mol_type = genomic DNA

SEQ ID NO: 24513 - DNA, 72 bp, Homo sapiens; identical to SEQ ID NO: 15193
  misc_feature 1..72: note = chr8:144203849-144203921
  misc_feature 1..72: note = hypo
  source 1..72: mol_type = genomic DNA

SEQ ID NO: 24514 - DNA, 30 bp, Homo sapiens; identical to SEQ ID NO: 15194
  misc_feature 1..30: note = chr8:144208784-144208814
  misc_feature 1..30: note = hypo
  source 1..30: mol_type = genomic DNA

SEQ ID NO: 24515 - DNA, 16 bp, Homo sapiens
  misc_feature 1..16: note = chr8:144238806-144238822
  misc_feature 1..16: note = hypo
  source 1..16: mol_type = genomic DNA
agacatgggcatgcac

SEQ ID NO: 24516 - DNA, 85 bp, Homo sapiens
  misc_feature 1..85: note = chr8:144238901-144238986
  misc_feature 1..85: note = hypo
  source 1..85: mol_type = genomic DNA
cctggggtgtgtgtgtgtgaaggagcagggcgggcacgggtgtgtgtgcacatgctggctgcgtgggcaccgtttgtatgcttgt

SEQ ID NO: 24517 - DNA, 30 bp, Homo sapiens; identical to SEQ ID NO: 15196
  misc_feature 1..30: note = chr8:144293809-144293839
  misc_feature 1..30: note = hypo
  source 1..30: mol_type = genomic DNA

SEQ ID NO: 24518 - DNA, 41 bp, Homo sapiens; identical to SEQ ID NO: 15197
  misc_feature 1..41: note = chr8:144326894-144326935
  misc_feature 1..41: note = hypo
  source 1..41: mol_type = genomic DNA

SEQ ID NO: 24519 - DNA, 57 bp, Homo sapiens; identical to SEQ ID NO: 15199
  misc_feature 1..57: note = chr8:144343530-144343587
  misc_feature 1..57: note = hypo
  source 1..57: mol_type = genomic DNA

SEQ ID NO: 24520 - DNA, 39 bp, Homo sapiens
  misc_feature 1..39: note = chr8:144344254-144344293
  misc_feature 1..39: note = hypo
  source 1..39: mol_type = genomic DNA
tcccacgcccctctccggcagcccctgcccacacccgca

SEQ ID NO: 24521 - DNA, 101 bp, Homo sapiens
  misc_feature 1..101: note = chr8:144344442-144344543
  misc_feature 1..101: note = hypo
  source 1..101: mol_type = genomic DNA
tggtgaggctggatgcctggcatgtctgaacactcacattccccaggcatgcatgtgcagccgccgccgccacccatgtactgtggcgctgacccctcctg

SEQ ID NO: 24522 - DNA, 83 bp, Homo sapiens
  misc_feature 1..83: note = chr8:144360311-144360394
  misc_feature 1..83: note = hypo
  source 1..83: mol_type = genomic DNA
caccagcgctctggacgccccactctgccaggtgagaacgagtttaggggtgcgggctggaggtcagtgtgtctgtccgaagt

SEQ ID NO: 24523 - DNA, 48 bp, Homo sapiens
  misc_feature 1..48: note = chr8:144360453-144360501
  misc_feature 1..48: note = hypo
  source 1..48: mol_type = genomic DNA
tcagactgtctgcctgaaaggtaagggtgaggacgcctgcattctcct

SEQ ID NO: 24524 - DNA, 57 bp, Homo sapiens; identical to SEQ ID NO: 15204
  misc_feature 1..57: note = chr8:144383350-144383407
  misc_feature 1..57: note = hypo
  source 1..57: mol_type = genomic DNA

SEQ ID NO: 24525 - DNA, 179 bp, Homo sapiens; identical to SEQ ID NO: 15205
  misc_feature 1..179: note = chr8:144471637-144471816
  misc_feature 1..179: note = hypo
  source 1..179: mol_type = genomic DNA

SEQ ID NO: 24526 - DNA, 83 bp, Homo sapiens; identical to SEQ ID NO: 15206
  misc_feature 1..83: note = chr8:144589999-144590082
  misc_feature 1..83: note = hypo
  source 1..83: mol_type = genomic DNA

SEQ ID NO: 24527 - DNA, 115 bp, Homo sapiens; identical to SEQ ID NO: 15207
  misc_feature 1..115: note = chr8:144656797-144656912
  misc_feature 1..115: note = hypo
  source 1..115: mol_type = genomic DNA

SEQ ID NO: 24528 - DNA, 55 bp, Homo sapiens
  misc_feature 1..55: note = chr8:144668854-144668909
  misc_feature 1..55: note = hypo
  source 1..55: mol_type = genomic DNA
gtcgggcagcagagccgcccagccgccccacgtgcagctctcacctggcgggagg

SEQ ID NO: 24529 - DNA, 30 bp, Homo sapiens; identical to SEQ ID NO: 15209
  misc_feature 1..30: note = chr8:144676006-144676036
  misc_feature 1..30: note = hypo
  source 1..30: mol_type = genomic DNA

SEQ ID NO: 24530 - DNA, 30 bp, Homo sapiens; identical to SEQ ID NO: 15210
  misc_feature 1..30: note = chr8:144677984-144678014
  misc_feature 1..30: note = hypo
  source 1..30: mol_type = genomic DNA

SEQ ID NO: 24531 - DNA, 27 bp, Homo sapiens
  misc_feature 1..27: note = chr8:145753490-145753517
  misc_feature 1..27: note = hypo
  source 1..27: mol_type = genomic DNA
gcgtgcaggtgggggcggggaagctca

SEQ ID NO: 24532 - DNA, 30 bp, Homo sapiens; identical to SEQ ID NO: 15213
  misc_feature 1..30: note = chr8:146013567-146013597
  misc_feature 1..30: note = hypo
  source 1..30: mol_type = genomic DNA

SEQ ID NO: 24533 - DNA, 30 bp, Homo sapiens; identical to SEQ ID NO: 15216
  misc_feature 1..30: note = chr9:7164747-7164777
  misc_feature 1..30: note = hypo
  source 1..30: mol_type = genomic DNA

SEQ ID NO: 24534 - DNA, 18 bp, Homo sapiens
  misc_feature 1..18: note = chr9:15533133-15533151
  misc_feature 1..18: note = hypo
  source 1..18: mol_type = genomic DNA
agacgtgtttactacaaa

SEQ ID NO: 24535 - DNA, 99 bp, Homo sapiens; identical to SEQ ID NO: 15218
  misc_feature 1..99: note = chr9:32999960-33000059
  misc_feature 1..99: note = hypo
  source 1..99: mol_type = genomic DNA

SEQ ID NO: 24536 - DNA, 24 bp, Homo sapiens
  misc_feature 1..24: note = chr9:33647199-33647223
  misc_feature 1..24: note = hypo
  source 1..24: mol_type = genomic DNA
gcgagactgcgtctcaaaaaaaaa

SEQ ID NO: 24537 - DNA, 75 bp, Homo sapiens; identical to SEQ ID NO: 15220
  misc_feature 1..75: note = chr9:35816231-35816306
  misc_feature 1..75: note = hypo
  source 1..75: mol_type = genomic DNA

SEQ ID NO: 24538 - DNA, 33 bp, Homo sapiens; identical to SEQ ID NO: 15221
  misc_feature 1..33: note = chr9:36257376-36257409
  misc_feature 1..33: note = hypo
  source 1..33: mol_type = genomic DNA

SEQ ID NO: 24539 - DNA, 30 bp, Homo sapiens; identical to SEQ ID NO: 5090
  misc_feature 1..30: note = chr9:37467940-37467970
  misc_feature 1..30: note = hypo
  source 1..30: mol_type = genomic DNA

SEQ ID NO: 24540 - DNA, 30 bp, Homo sapiens; identical to SEQ ID NO: 15224
  misc_feature 1..30: note = chr9:79231349-79231379
  misc_feature 1..30: note = hypo
  source 1..30: mol_type = genomic DNA

SEQ ID NO: 24541 - DNA, 41 bp, Homo sapiens; identical to SEQ ID NO: 15225
  misc_feature 1..41: note = chr9:90322123-90322164
  misc_feature 1..41: note = hypo
  source 1..41: mol_type = genomic DNA

SEQ ID NO: 24542 - DNA, 30 bp, Homo sapiens; identical to SEQ ID NO: 15226
  misc_feature 1..30: note = chr9:90421661-90421691
  misc_feature 1..30: note = hypo
  source 1..30: mol_type = genomic DNA

SEQ ID NO: 24543 - DNA, 39 bp, Homo sapiens; identical to SEQ ID NO: 15227
  misc_feature 1..39: note = chr9:91914149-91914188
  misc_feature 1..39: note = hypo
  source 1..39: mol_type = genomic DNA

SEQ ID NO: 24544 - DNA, 30 bp, Homo sapiens; identical to SEQ ID NO: 15228
  misc_feature 1..30: note = chr9:92897186-92897216
  misc_feature 1..30: note = hypo
  source 1..30: mol_type = genomic DNA

SEQ ID NO: 24545 - DNA, 77 bp, Homo sapiens; identical to SEQ ID NO: 15229
  misc_feature 1..77: note = chr9:92980516-92980593
  misc_feature 1..77: note = hypo
  source 1..77: mol_type = genomic DNA

SEQ ID NO: 24546 - DNA, 30 bp, Homo sapiens; identical to SEQ ID NO: 15231
  misc_feature 1..30: note = chr9:96362025-96362055
  misc_feature 1..30: note = hypo
  source 1..30: mol_type = genomic DNA

SEQ ID NO: 24547 - DNA, 90 bp, Homo sapiens; identical to SEQ ID NO: 5091
  misc_feature 1..90: note = chr9:100397609-100397699
  misc_feature 1..90: note = hypo
  source 1..90: mol_type = genomic DNA

SEQ ID NO: 24548 - DNA, 24 bp, Homo sapiens
  misc_feature 1..24: note = chr9:103174730-103174754
  misc_feature 1..24: note = hypo
  source 1..24: mol_type = genomic DNA
aaatgtccccgtataaatgataaa

SEQ ID NO: 24549 - DNA, 30 bp, Homo sapiens; identical to SEQ ID NO: 15234
  misc_feature 1..30: note = chr9:107712165-107712195
  misc_feature 1..30: note = hypo
  source 1..30: mol_type = genomic DNA

SEQ ID NO: 24550 - skipped

SEQ ID NO: 24551 - DNA, 18 bp, Homo sapiens
  misc_feature 1..18: note = chr9:115087597-115087615
  misc_feature 1..18: note = hypo
  source 1..18: mol_type = genomic DNA
gcccgtctgcacactggg

SEQ ID NO: 24552 - DNA, 30 bp, Homo sapiens; identical to SEQ ID NO: 15237
  misc_feature 1..30: note = chr9:116331277-116331307
  misc_feature 1..30: note = hypo
  source 1..30: mol_type = genomic DNA

SEQ ID NO: 24553 - DNA, 19 bp, Homo sapiens
  misc_feature 1..19: note = chr9:116633864-116633883
  misc_feature 1..19: note = hypo
  source 1..19: mol_type = genomic DNA
aattccacctgccgacgtg

SEQ ID NO: 24554 - DNA, 30 bp, Homo sapiens; identical to SEQ ID NO: 15239
  misc_feature 1..30: note = chr9:123287840-123287870
  misc_feature 1..30: note = hypo
  source 1..30: mol_type = genomic DNA

SEQ ID NO: 24555 - DNA, 30 bp, Homo sapiens; identical to SEQ ID NO: 15240
  misc_feature 1..30: note = chr9:126125543-126125573
  misc_feature 1..30: note = hypo
  source 1..30: mol_type = genomic DNA

SEQ ID NO: 24556 - DNA, 50 bp, Homo sapiens
  misc_feature 1..50: note = chr9:126154254-126154304
  misc_feature 1..50: note = hypo
  source 1..50: mol_type = genomic DNA
ccccacggctgctcccgcctctgcccaccttgtctccgcgtggagttccc

SEQ ID NO: 24557 - DNA, 34 bp, Homo sapiens; identical to SEQ ID NO: 15243
  misc_feature 1..34: note = chr9:126158010-126158044
  misc_feature 1..34: note = hypo
  source 1..34: mol_type = genomic DNA

SEQ ID NO: 24558 - DNA, 44 bp, Homo sapiens; identical to SEQ ID NO: 15244
  misc_feature 1..44: note = chr9:126169447-126169491
  misc_feature 1..44: note = hypo
  source 1..44: mol_type = genomic DNA

SEQ ID NO: 24559 - DNA, 20 bp, Homo sapiens
  misc_feature 1..20: note = chr9:128759954-128759974
  misc_feature 1..20: note = hypo
  source 1..20: mol_type = genomic DNA
aggatcggaaggaatcacac

SEQ ID NO: 24560 - DNA, 30 bp, Homo sapiens; identical to SEQ ID NO: 15246
  misc_feature 1..30: note = chr9:130180052-130180082
  misc_feature 1..30: note = hypo
  source 1..30: mol_type = genomic DNA

SEQ ID NO: 24561 - DNA, 42 bp, Homo sapiens; identical to SEQ ID NO: 15247
  misc_feature 1..42: note = chr9:131060925-131060967
  misc_feature 1..42: note = hypo
  source 1..42: mol_type = genomic DNA

SEQ ID NO: 24562 - DNA, 218 bp, Homo sapiens; identical to SEQ ID NO: 15248
  misc_feature 1..218: note = chr9:131504930-131505148
  misc_feature 1..218: note = hypo
  source 1..218: mol_type = genomic DNA

SEQ ID NO: 24563 - DNA, 124 bp, Homo sapiens
  misc_feature 1..124: note = chr9:131854328-131854452
  misc_feature 1..124: note = hypo
  source 1..124: mol_type = genomic DNA
cacactcacctgcttaccctgaccccgctccaacctgcccaaggtgcggtgctgggcagaagcccaactcttcaagccctcagaagcctctttgaaatatccacttttcgcggctgggcgcggt

SEQ ID NO: 24564 - DNA, 43 bp, Homo sapiens
  misc_feature 1..43: note = chr9:132402797-132402840
  misc_feature 1..43: note = hypo
  source 1..43: mol_type = genomic DNA
cacccccggggctctcgctgaccttcaaagttgagattggccc

SEQ ID NO: 24565 - DNA, 30 bp, Homo sapiens; identical to SEQ ID NO: 15253
  misc_feature 1..30: note = chr9:133518455-133518485
  misc_feature 1..30: note = hypo
  source 1..30: mol_type = genomic DNA

SEQ ID NO: 24566 - DNA, 59 bp, Homo sapiens; identical to SEQ ID NO: 15255
  misc_feature 1..59: note = chr9:133779518-133779577
  misc_feature 1..59: note = hypo
  source 1..59: mol_type = genomic DNA

SEQ ID NO: 24567 - DNA, 85 bp, Homo sapiens; identical to SEQ ID NO: 15256
  misc_feature 1..85: note = chr9:133865386-133865471
  misc_feature 1..85: note = hypo
  source 1..85: mol_type = genomic DNA

SEQ ID NO: 24568 - DNA, 44 bp, Homo sapiens
  misc_feature 1..44: note = chr9:134717269-134717313
  misc_feature 1..44: note = hypo
  source 1..44: mol_type = genomic DNA
gggaagagaaaaagccgagaaaaaagcggtttgaacggggggtg

SEQ ID NO: 24569 - DNA, 52 bp, Homo sapiens; identical to SEQ ID NO: 15261
  misc_feature 1..52: note = chr9:135768018-135768070
  misc_feature 1..52: note = hypo
  source 1..52: mol_type = genomic DNA

SEQ ID NO: 24570 - DNA, 36 bp, Homo sapiens
  misc_feature 1..36: note = chr9:135865054-135865090
  misc_feature 1..36: note = hypo
  source 1..36: mol_type = genomic DNA
ttccgcaggggatcccggccgggtccagtcctgagc

SEQ ID NO: 24571 - DNA, 103 bp, Homo sapiens; identical to SEQ ID NO: 15264
  misc_feature 1..103: note = chr9:136375630-136375733
  misc_feature 1..103: note = hypo
  source 1..103: mol_type = genomic DNA

SEQ ID NO: 24572 - DNA, 30 bp, Homo sapiens; identical to SEQ ID NO: 15265
  misc_feature 1..30: note = chr9:136999528-136999558
  misc_feature 1..30: note = hypo
  source 1..30: mol_type = genomic DNA

SEQ ID NO: 24573 - DNA, 59 bp, Homo sapiens; identical to SEQ ID NO: 15267
  misc_feature 1..59: note = chr9:137710245-137710304
  misc_feature 1..59: note = hypo
  source 1..59: mol_type = genomic DNA

SEQ ID NO: 24574 - DNA, 29 bp, Homo sapiens
  misc_feature 1..29: note = chr9:137718872-137718901
  misc_feature 1..29: note = hypo
  source 1..29: mol_type = genomic DNA
ctgcatcagcttgaacggcctctccttca

SEQ ID NO: 24575 - DNA, 89 bp, Homo sapiens
  misc_feature 1..89: note = chr9:137719001-137719090
  misc_feature 1..89: note = hypo
  source 1..89: mol_type = genomic DNA
tgcttcctaacaacctcagtgccccagaagcagtttcctgccaggggaagagcagctacgttctccccagggaccgccatccccttacc

SEQ ID NO: 24576 - DNA, 34 bp, Homo sapiens; identical to SEQ ID NO: 15269
  misc_feature 1..34: note = chr9:138289547-138289581
  misc_feature 1..34: note = hypo
  source 1..34: mol_type = genomic DNA

SEQ ID NO: 24577 - DNA, 44 bp, Homo sapiens; identical to SEQ ID NO: 15270
  misc_feature 1..44: note = chr9:138562752-138562796
  misc_feature 1..44: note = hypo
  source 1..44: mol_type = genomic DNA

SEQ ID NO: 24578 - DNA, 30 bp, Homo sapiens; identical to SEQ ID NO: 15273
  misc_feature 1..30: note = chr9:138634173-138634203
  misc_feature 1..30: note = hypo
  source 1..30: mol_type = genomic DNA

SEQ ID NO: 24579 - DNA, 35 bp, Homo sapiens; identical to SEQ ID NO: 5098
  misc_feature 1..35: note = chr9:138650129-138650164
  misc_feature 1..35: note = hypo
  source 1..35: mol_type = genomic DNA

SEQ ID NO: 24580 - DNA, 30 bp, Homo sapiens; identical to SEQ ID NO: 15275
  misc_feature 1..30: note = chr9:138659727-138659757
  misc_feature 1..30: note = hypo
  source 1..30: mol_type = genomic DNA

SEQ ID NO: 24581 - DNA, 119 bp, Homo sapiens
  misc_feature 1..119: note = chr9:138660824-138660943
  misc_feature 1..119: note = hypo
  source 1..119: mol_type = genomic DNA
gggcacgtgtgcacacgtgggtgatggtgcatctggggcagggcgcatgtgcacatgtgtgacggtgcgtctggggcaggacgcgtgtgcacacgtgggtgacggtgcgtctggggcag

SEQ ID NO: 24582 - DNA, 134 bp, Homo sapiens
  misc_feature 1..134: note = chr9:138661012-138661146
  misc_feature 1..134: note = hypo
  source 1..134: mol_type = genomic DNA
gtctggggcagggcgcgtgtgcacacgtgggtgacagtgcatctggggcagggcacgtgtgcacgtgtgtgtcggtgtgtctggggcagggcgcgtgtgcatgctgttgggtgatggtgcgtctggggcagggc

SEQ ID NO: 24583 - DNA, 63 bp, Homo sapiens
  misc_feature 1..63: note = chr9:138661870-138661933
  misc_feature 1..63: note = hypo
  source 1..63: mol_type = genomic DNA
tcaccctgctggtgcacacgtcccgcggccagtgagtgccccgtgccccgggggaccgacctc

SEQ ID NO: 24584 - DNA, 40 bp, Homo sapiens; identical to SEQ ID NO: 15278
  misc_feature 1..40: note = chr9:138743731-138743771
  misc_feature 1..40: note = hypo
  source 1..40: mol_type = genomic DNA

SEQ ID NO: 24585 - DNA, 30 bp, Homo sapiens; identical to SEQ ID NO: 15279
  misc_feature 1..30: note = chr9:138780600-138780630
  misc_feature 1..30: note = hypo
  source 1..30: mol_type = genomic DNA

SEQ ID NO: 24586 - DNA, 45 bp, Homo sapiens; identical to SEQ ID NO: 15280
  misc_feature 1..45: note = chr9:138994395-138994440
  misc_feature 1..45: note = hypo
  source 1..45: mol_type = genomic DNA

SEQ ID NO: 24587 - DNA, 30 bp, Homo sapiens; identical to SEQ ID NO: 15282
  misc_feature 1..30: note = chr9:139100397-139100427
  misc_feature 1..30: note = hypo
  source 1..30: mol_type = genomic DNA

SEQ ID NO: 24588 - DNA, 23 bp, Homo sapiens
  misc_feature 1..23: note = chr9:139421932-139421955
  misc_feature 1..23: note = hypo
  source 1..23: mol_type = genomic DNA
cttccatgagtgacccgcacccc

SEQ ID NO: 24589 - DNA, 91 bp, Homo sapiens
  misc_feature 1..91: note = chr9:139421985-139422076
  misc_feature 1..91: note = hypo
  source 1..91: mol_type = genomic DNA
caggggcggtggggagacccctctggggctaaaaagtgaggcttgagatagggaacgccagtctcccccgactggacgagagagctgccct

SEQ ID NO: 24590 - DNA, 40 bp, Homo sapiens; identical to SEQ ID NO: 15284
  misc_feature 1..40: note = chr9:139472499-139472539
  misc_feature 1..40: note = hypo
  source 1..40: mol_type = genomic DNA

SEQ ID NO: 24591 - DNA, 39 bp, Homo sapiens; identical to SEQ ID NO: 15285
  misc_feature 1..39: note = chr9:139506449-139506488
  misc_feature 1..39: note = hypo
  source 1..39: mol_type = genomic DNA

SEQ ID NO: 24592 - DNA, 51 bp, Homo sapiens; identical to SEQ ID NO: 15286
  misc_feature 1..51: note = chr9:139634047-139634098
  misc_feature 1..51: note = hypo
  source 1..51: mol_type = genomic DNA

SEQ ID NO: 24593 - DNA, 40 bp, Homo sapiens
  misc_feature 1..40: note = chr9:139699051-139699091
  misc_feature 1..40: note = hypo
  source 1..40: mol_type = genomic DNA
gaaggagaccagcgagaagtaccgccgggtaagccccagg

SEQ ID NO: 24594 - DNA, 17 bp, Homo sapiens
  misc_feature 1..17: note = chr9:139703929-139703946
  misc_feature 1..17: note = hypo
  source 1..17: mol_type = genomic DNA
atgaaagttggtgtccg

SEQ ID NO: 24595 - DNA, 30 bp, Homo sapiens; identical to SEQ ID NO: 15290
  misc_feature 1..30: note = chr9:139714130-139714160
  misc_feature 1..30: note = hypo
  source 1..30: mol_type = genomic DNA

SEQ ID NO: 24596 - DNA, 30 bp, Homo sapiens; identical to SEQ ID NO: 15291
  misc_feature 1..30: note = chr9:139717804-139717834
  misc_feature 1..30: note = hypo
  source 1..30: mol_type = genomic DNA

SEQ ID NO: 24597 - DNA, 72 bp, Homo sapiens; identical to SEQ ID NO: 15292
  misc_feature 1..72: note = chr9:139809893-139809965
  misc_feature 1..72: note = hypo
  source 1..72: mol_type = genomic DNA

SEQ ID NO: 24598 - DNA, 55 bp, Homo sapiens; identical to SEQ ID NO: 15293
  misc_feature 1..55: note = chr9:139818567-139818622
  misc_feature 1..55: note = hypo
  source 1..55: mol_type = genomic DNA

SEQ ID NO: 24599 - DNA, 50 bp, Homo sapiens
  misc_feature 1..50: note = chr9:139888895-139888945
  misc_feature 1..50: note = hypo
  source 1..50: mol_type = genomic DNA
gatccctgaggccaccggttgcaggaggcctggagtctgcgccttcttag

SEQ ID NO: 24600 - DNA, 30 bp, Homo sapiens; identical to SEQ ID NO: 15296
  misc_feature 1..30: note = chr9:139978966-139978996
  misc_feature 1..30: note = hypo
  source 1..30: mol_type = genomic DNA

SEQ ID NO: 24601 - DNA, 11 bp, Homo sapiens
  misc_feature 1..11: note = chr9:140030528-140030539
  misc_feature 1..11: note = hypo
  source 1..11: mol_type = genomic DNA
aggtgctcagt

SEQ ID NO: 24602 - DNA, 113 bp, Homo sapiens; identical to SEQ ID NO: 15298
  misc_feature 1..113: note = chr9:140107128-140107241
  misc_feature 1..113: note = hypo
  source 1..113: mol_type = genomic DNA

SEQ ID NO: 24603 - DNA, 30 bp, Homo sapiens; identical to SEQ ID NO: 15299
  misc_feature 1..30: note = chr9:140108225-140108255
  misc_feature 1..30: note = hypo
  source 1..30: mol_type = genomic DNA

SEQ ID NO: 24604 - DNA, 71 bp, Homo sapiens
  misc_feature 1..71: note = chr9:140127812-140127883
  misc_feature 1..71: note = hypo
  source 1..71: mol_type = genomic DNA
tcctcaaggtgctgacgaagccgctcacacacctcatcgtgcaggtgaggacggccaccgcccccgcccag

SEQ ID NO: 24605 - DNA, 180 bp, Homo sapiens; identical to SEQ ID NO: 15301
  misc_feature 1..180: note = chr9:140137562-140137742
  misc_feature 1..180: note = hypo
  source 1..180: mol_type = genomic DNA

SEQ ID NO: 24606 - DNA, 12 bp, Homo sapiens
  misc_feature 1..12: note = chr9:140245865-140245877
  misc_feature 1..12: note = hypo
  source 1..12: mol_type = genomic DNA
cgtccagaagga

SEQ ID NO: 24607 - DNA, 30 bp, Homo sapiens; identical to SEQ ID NO: 15303
  misc_feature 1..30: note = chr9:140265779-140265809
  misc_feature 1..30: note = hypo
  source 1..30: mol_type = genomic DNA

SEQ ID NO: 24608 - DNA, 61 bp, Homo sapiens; identical to SEQ ID NO: 15304
  misc_feature 1..61: note = chr9:140267262-140267323
  misc_feature 1..61: note = hypo
  source 1..61: mol_type = genomic DNA

SEQ ID NO: 24609 - DNA, 78 bp, Homo sapiens; identical to SEQ ID NO: 15305
  misc_feature 1..78: note = chr9:140274184-140274262
  misc_feature 1..78: note = hypo
  source 1..78: mol_type = genomic DNA

SEQ ID NO: 24610 - DNA, 97 bp, Homo sapiens
  misc_feature 1..97: note = chr9:140333018-140333115
  misc_feature 1..97: note = hypo
  source 1..97: mol_type = genomic DNA
ctcccgtggccatagaggcatccccggggctcagacggcctcccgtggccatagaggcatccccggggctcagacggtctcccgtggccatagaggc

SEQ ID NO: 24611 - skipped

SEQ ID NO: 24612 - DNA, 142 bp, Homo sapiens; identical to SEQ ID NO: 15308
  misc_feature 1..142: note = chr9:140389345-140389487
  misc_feature 1..142: note = hypo
  source 1..142: mol_type = genomic DNA

SEQ ID NO: 24613 - DNA, 77 bp, Homo sapiens
  misc_feature 1..77: note = chr9:140392377-140392454
  misc_feature 1..77: note = hypo
  source 1..77: mol_type = genomic DNA
aaatccaggaggccacgaagtgtgtttccgagctaagctggggtggggctggggaaatccagccttccatgtgtggt

SEQ ID NO: 24614 - DNA, 153 bp, Homo sapiens
  misc_feature 1..153: note = chr9:140392484-140392637
  misc_feature 1..153: note = hypo
  source 1..153: mol_type = genomic DNA
cggtaaccgtgctttgcccatccccagctcctgcatgccagggcagcatggatgcggagtgtgtggcacccacggcctcacctgtatattgctcgcccggcctccacctccacccagtccagggcaaagtcgatttgccgcacgaaggacgac

SEQ ID NO: 24615 - DNA, 167 bp, Homo sapiens; identical to SEQ ID NO: 15310
  misc_feature 1..167: note = chr9:140396560-140396727
  misc_feature 1..167: note = hypo
  source 1..167: mol_type = genomic DNA

SEQ ID NO: 24616 - DNA, 71 bp, Homo sapiens; identical to SEQ ID NO: 15312
  misc_feature 1..71: note = chr9:140400208-140400279
  misc_feature 1..71: note = hypo
  source 1..71: mol_type = genomic DNA

SEQ ID NO: 24617 - DNA, 45 bp, Homo sapiens; identical to SEQ ID NO: 15313
  misc_feature 1..45: note = chr9:140680320-140680365
  misc_feature 1..45: note = hypo
  source 1..45: mol_type = genomic DNA

SEQ ID NO: 24618 - DNA, 30 bp, Homo sapiens; identical to SEQ ID NO: 15314
  misc_feature 1..30: note = chr9:140727555-140727585
  misc_feature 1..30: note = hypo
  source 1..30: mol_type = genomic DNA

SEQ ID NO: 24619 - DNA, 32 bp, Homo sapiens; identical to SEQ ID NO: 15315
  misc_feature 1..32: note = chr9:140969282-140969314
  misc_feature 1..32: note = hypo
  source 1..32: mol_type = genomic DNA

SEQ ID NO: 24620 - DNA, 145 bp, Homo sapiens; identical to SEQ ID NO: 15316
  misc_feature 1..145: note = chr9:141022582-141022727
  misc_feature 1..145: note = hypo
  source 1..145: mol_type = genomic DNA

SEQ ID NO: 24621 - DNA, 35 bp, Homo sapiens; identical to SEQ ID NO: 15318
  misc_feature 1..35: note = chr10:851432-851467
  misc_feature 1..35: note = hypo
  source 1..35: mol_type = genomic DNA

SEQ ID NO: 24622 - DNA, 21 bp, Homo sapiens
  misc_feature 1..21: note = chr10:978857-978878
  misc_feature 1..21: note = hypo
  source 1..21: mol_type = genomic DNA
gggaccaaaaggccccggccc

SEQ ID NO: 24623 - DNA, 62 bp, Homo sapiens; identical to SEQ ID NO: 15320
  misc_feature 1..62: note = chr10:1156723-1156785
  misc_feature 1..62: note = hypo
  source 1..62: mol_type = genomic DNA

SEQ ID NO: 24624 - DNA, 30 bp, Homo sapiens; identical to SEQ ID NO: 15321
  misc_feature 1..30: note = chr10:1259979-1260009
  misc_feature 1..30: note = hypo
  source 1..30: mol_type = genomic DNA

SEQ ID NO: 24625 - DNA, 30 bp, Homo sapiens; identical to SEQ ID NO: 15322
  misc_feature 1..30: note = chr10:2283030-2283060
  misc_feature 1..30: note = hypo
  source 1..30: mol_type = genomic DNA

SEQ ID NO: 24626 - DNA, 78 bp, Homo sapiens; identical to SEQ ID NO: 15323
  misc_feature 1..78: note = chr10:3161042-3161120
  misc_feature 1..78: note = hypo
  source 1..78: mol_type = genomic DNA

SEQ ID NO: 24627 - DNA, 30 bp, Homo sapiens; identical to SEQ ID NO: 15324
  misc_feature 1..30: note = chr10:3329710-3329740
  misc_feature 1..30: note = hypo
  source 1..30: mol_type = genomic DNA

SEQ ID NO: 24628 - DNA, 35 bp, Homo sapiens
  misc_feature 1..35: note = chr10:3330464-3330499
  misc_feature 1..35: note = hypo
  source 1..35: mol_type = genomic DNA
aggtgagggctcccccgcgccgccctggcgtccag

SEQ ID NO: 24629 - DNA, 15 bp, Homo sapiens
  misc_feature 1..15: note = chr10:3895395-3895410
  misc_feature 1..15: note = hypo
  source 1..15: mol_type = genomic DNA
ggtttccagctgtgt

SEQ ID NO: 24630 - DNA, 30 bp, Homo sapiens; identical to SEQ ID NO: 15327
  misc_feature 1..30: note = chr10:5531069-5531099
  misc_feature 1..30: note = hypo
  source 1..30: mol_type = genomic DNA

SEQ ID NO: 24631 - DNA, 30 bp, Homo sapiens; identical to SEQ ID NO: 15328
  misc_feature 1..30: note = chr10:5538908-5538938
  misc_feature 1..30: note = hypo
  source 1..30: mol_type = genomic DNA

SEQ ID NO: 24632 - DNA, 112 bp, Homo sapiens; identical to SEQ ID NO: 15329
  misc_feature 1..112: note = chr10:5540808-5540920
  misc_feature 1..112: note = hypo
  source 1..112: mol_type = genomic DNA

SEQ ID NO: 24633 - DNA, 312 bp, Homo sapiens; identical to SEQ ID NO: 15330
  misc_feature 1..312: note = chr10:5541199-5541511
  misc_feature 1..312: note = hypo
  source 1..312: mol_type = genomic DNA

SEQ ID NO: 24634 - DNA, 30 bp, Homo sapiens; identical to SEQ ID NO: 15331
  misc_feature 1..30: note = chr10:5553298-5553328
  misc_feature 1..30: note = hypo
  source 1..30: mol_type = genomic DNA

SEQ ID NO: 24635 - DNA, 30 bp, Homo sapiens; identical to SEQ ID NO: 15332
  misc_feature 1..30: note = chr10:5567180-5567210
  misc_feature 1..30: note = hypo
  source 1..30: mol_type = genomic DNA

SEQ ID NO: 24636 - DNA, 30 bp, Homo sapiens; identical to SEQ ID NO: 15333
  misc_feature 1..30: note = chr10:5875038-5875068
  misc_feature 1..30: note = hypo
  source 1..30: mol_type = genomic DNA

SEQ ID NO: 24637 - DNA, 30 bp, Homo sapiens; identical to SEQ ID NO: 15337
  misc_feature 1..30: note = chr10:6159901-6159931
  misc_feature 1..30: note = hypo
  source 1..30: mol_type = genomic DNA

SEQ ID NO: 24638 - DNA, 24 bp, Homo sapiens
  misc_feature 1..24: note = chr10:6199196-6199220
  misc_feature 1..24: note = hypo
  source 1..24: mol_type = genomic DNA
tttttttttttgagacggagtctc

SEQ ID NO: 24639 - DNA, 15 bp, Homo sapiens
  misc_feature 1..15: note = chr10:6564170-6564185
  misc_feature 1..15: note = hypo
  source 1..15: mol_type = genomic DNA
cgggattacaagagt

SEQ ID NO: 24640 - DNA, 47 bp, Homo sapiens; identical to SEQ ID NO: 15340
  misc_feature 1..47: note = chr10:6577682-6577729
  misc_feature 1..47: note = hypo
  source 1..47: mol_type = genomic DNA

SEQ ID NO: 24641 - DNA, 42 bp, Homo sapiens; identical to SEQ ID NO: 15341
  misc_feature 1..42: note = chr10:7203062-7203104
  misc_feature 1..42: note = hypo
  source 1..42: mol_type = genomic DNA

SEQ ID NO: 24642 - DNA, 28 bp, Homo sapiens
  misc_feature 1..28: note = chr10:7205705-7205733
  misc_feature 1..28: note = hypo
  source 1..28: mol_type = genomic DNA
taatgggccacctcccgagggcagactc

SEQ ID NO: 24643 - DNA, 30 bp, Homo sapiens; identical to SEQ ID NO: 15344
  misc_feature 1..30: note = chr10:7213658-7213688
  misc_feature 1..30: note = hypo
  source 1..30: mol_type = genomic DNA

SEQ ID NO: 24644 - DNA, 30 bp, Homo sapiens; identical to SEQ ID NO: 15345
  misc_feature 1..30: note = chr10:7214234-7214264
  misc_feature 1..30: note = hypo
  source 1..30: mol_type = genomic DNA

SEQ ID NO: 24645 - DNA, 30 bp, Homo sapiens
  misc_feature 1..30: note = chr10:7236181-7236211
  misc_feature 1..30: note = hypo
  source 1..30: mol_type = genomic DNA
tcccctacctcccctcgctgcaccccctcg

SEQ ID NO: 24646 - DNA, 30 bp, Homo sapiens; identical to SEQ ID NO: 15347
  misc_feature 1..30: note = chr10:7340032-7340062
  misc_feature 1..30: note = hypo
  source 1..30: mol_type = genomic DNA

SEQ ID NO: 24647 - DNA, 21 bp, Homo sapiens
  misc_feature 1..21: note = chr10:7414164-7414185
  misc_feature 1..21: note = hypo
  source 1..21: mol_type = genomic DNA
ccgccacgcccggccttcttg

SEQ ID NO: 24648 - DNA, 128 bp, Homo sapiens; identical to SEQ ID NO: 15350
  misc_feature 1..128: note = chr10:11472865-11472993
  misc_feature 1..128: note = hypo
  source 1..128: mol_type = genomic DNA

SEQ ID NO: 24649 - DNA, 30 bp, Homo sapiens; identical to SEQ ID NO: 15351
  misc_feature 1..30: note = chr10:13137625-13137655
  misc_feature 1..30: note = hypo
  source 1..30: mol_type = genomic DNA

SEQ ID NO: 24650 - DNA, 126 bp, Homo sapiens; identical to SEQ ID NO: 15352
  misc_feature 1..126: note = chr10:13355078-13355204
  misc_feature 1..126: note = hypo
  source 1..126: mol_type = genomic DNA

SEQ ID NO: 24651 - DNA, 32 bp, Homo sapiens; identical to SEQ ID NO: 15353
  misc_feature 1..32: note = chr10:15000601-15000633
  misc_feature 1..32: note = hypo
  source 1..32: mol_type = genomic DNA

SEQ ID NO: 24652 - DNA, 30 bp, Homo sapiens; identical to SEQ ID NO: 15355
  misc_feature 1..30: note = chr10:16715583-16715613
  misc_feature 1..30: note = hypo
  source 1..30: mol_type = genomic DNA

SEQ ID NO: 24653 - DNA, 35 bp, Homo sapiens
  misc_feature 1..35: note = chr10:17429622-17429657
  misc_feature 1..35: note = hypo
  source 1..35: mol_type = genomic DNA
ggactggactgctgtcacatcgattaacccaaatc

SEQ ID NO: 24654 - DNA, 30 bp, Homo sapiens; identical to SEQ ID NO: 15358
  misc_feature 1..30: note = chr10:24841823-24841853
  misc_feature 1..30: note = hypo
  source 1..30: mol_type = genomic DNA

SEQ ID NO: 24655 - DNA, 22 bp, Homo sapiens
  misc_feature 1..22: note = chr10:26128001-26128023
  misc_feature 1..22: note = hypo
  source 1..22: mol_type = genomic DNA
acttccacggcctggcgcggtg

SEQ ID NO: 24656 - DNA, 30 bp, Homo sapiens; identical to SEQ ID NO: 15360
  misc_feature 1..30: note = chr10:26638451-26638481
  misc_feature 1..30: note = hypo
  source 1..30: mol_type = genomic DNA

SEQ ID NO: 24657 - DNA, 30 bp, Homo sapiens; identical to SEQ ID NO: 15361
  misc_feature 1..30: note = chr10:26733386-26733416
  misc_feature 1..30: note = hypo
  source 1..30: mol_type = genomic DNA

SEQ ID NO: 24658 - DNA, 30 bp, Homo sapiens; identical to SEQ ID NO: 15362
  misc_feature 1..30: note = chr10:26739045-26739075
  misc_feature 1..30: note = hypo
  source 1..30: mol_type = genomic DNA

SEQ ID NO: 24659 - DNA, 30 bp, Homo sapiens; identical to SEQ ID NO: 15363
  misc_feature 1..30: note = chr10:26877730-26877760
  misc_feature 1..30: note = hypo
  source 1..30: mol_type = genomic DNA

SEQ ID NO: 24660 - DNA, 30 bp, Homo sapiens; identical to SEQ ID NO: 15364
  misc_feature 1..30: note = chr10:26926812-26926842
  misc_feature 1..30: note = hypo
  source 1..30: mol_type = genomic DNA

SEQ ID NO: 24661 - DNA, 28 bp, Homo sapiens
  misc_feature 1..28: note = chr10:31892894-31892922
  misc_feature 1..28: note = hypo
  source 1..28: mol_type = genomic DNA
cccgtggccagcacccgaggcctgctgg

SEQ ID NO: 24662 - DNA, 19 bp, Homo sapiens
  misc_feature 1..19: note = chr10:32499025-32499044
  misc_feature 1..19: note = hypo
  source 1..19: mol_type = genomic DNA
caaattctccagtcccgcc

SEQ ID NO: 24663 - DNA, 31 bp, Homo sapiens; identical to SEQ ID NO: 15367
  misc_feature 1..31: note = chr10:38078895-38078926
  misc_feature 1..31: note = hypo
  source 1..31: mol_type = genomic DNA

SEQ ID NO: 24664 - DNA, 39 bp, Homo sapiens; identical to SEQ ID NO: 15368
  misc_feature 1..39: note = chr10:43906055-43906094
  misc_feature 1..39: note = hypo
  source 1..39: mol_type = genomic DNA

SEQ ID NO: 24665 - DNA, 38 bp, Homo sapiens; identical to SEQ ID NO: 15369
  misc_feature 1..38: note = chr10:46221018-46221056
  misc_feature 1..38: note = hypo
  source 1..38: mol_type = genomic DNA

SEQ ID NO: 24666 - DNA, 30 bp, Homo sapiens; identical to SEQ ID NO: 15370
  misc_feature 1..30: note = chr10:49929928-49929958
  misc_feature 1..30: note = hypo
  source 1..30: mol_type = genomic DNA

SEQ ID NO: 24667 - DNA, 42 bp, Homo sapiens
  misc_feature 1..42: note = chr10:50507515-50507557
  misc_feature 1..42: note = hypo
  source 1..42: mol_type = genomic DNA
tgtctggctccttagcgtgggcagggaggctcaagttcatgg

SEQ ID NO: 24668 - DNA, 88 bp, Homo sapiens
  misc_feature 1..88: note = chr10:50507619-50507707
  misc_feature 1..88: note = hypo
  source 1..88: mol_type = genomic DNA
gtgcagggtggtatgtgtgtgccgggagcccattggtgttggggctaaggttcttggtgtgctggatgggcctcggggaccacgtacc

SEQ ID NO: 24669 - DNA, 21 bp, Homo sapiens
  misc_feature 1..21: note = chr10:50748373-50748394
  misc_feature 1..21: note = hypo
  source 1..21: mol_type = genomic DNA
cacgcccggcttgtaacttgc

SEQ ID NO: 24670 - DNA, 80 bp, Homo sapiens; identical to SEQ ID NO: 15373
  misc_feature 1..80: note = chr10:70288112-70288192
  misc_feature 1..80: note = hypo
  source 1..80: mol_type = genomic DNA

SEQ ID NO: 24671 - DNA, 96 bp, Homo sapiens; identical to SEQ ID NO: 15374
  misc_feature 1..96: note = chr10:70476540-70476636
  misc_feature 1..96: note = hypo
  source 1..96: mol_type = genomic DNA

SEQ ID NO: 24672 - DNA, 18 bp, Homo sapiens
  misc_feature 1..18: note = chr10:70483311-70483329
  misc_feature 1..18: note = hypo
  source 1..18: mol_type = genomic DNA
taaaagtaaatgggccgg

SEQ ID NO: 24673 - DNA, 30 bp, Homo sapiens; identical to SEQ ID NO: 15376
  misc_feature 1..30: note = chr10:73466313-73466343
  misc_feature 1..30: note = hypo
  source 1..30: mol_type = genomic DNA

SEQ ID NO: 24674 - DNA, 30 bp, Homo sapiens; identical to SEQ ID NO: 15377
  misc_feature 1..30: note = chr10:77022299-77022329
  misc_feature 1..30: note = hypo
  source 1..30: mol_type = genomic DNA

SEQ ID NO: 24675 - DNA, 30 bp, Homo sapiens; identical to SEQ ID NO: 15378
  misc_feature 1..30: note = chr10:89605951-89605981
  misc_feature 1..30: note = hypo
  source 1..30: mol_type = genomic DNA

SEQ ID NO: 24676 - DNA, 21 bp, Homo sapiens
  misc_feature 1..21: note = chr10:94603316-94603337
  misc_feature 1..21: note = hypo
  source 1..21: mol_type = genomic DNA
atgcatttggccgggcgcggt

SEQ ID NO: 24677 - DNA, 41 bp, Homo sapiens
  misc_feature 1..41: note = chr10:98129781-98129822
  misc_feature 1..41: note = hypo
  source 1..41: mol_type = genomic DNA
catcacactctgccccggccccagcgtctccgggacttacc

SEQ ID NO: 24678 - DNA, 22 bp, Homo sapiens
  misc_feature 1..22: note = chr10:98528164-98528186
  misc_feature 1..22: note = hypo
  source 1..22: mol_type = genomic DNA
cagaccacggactgatacaggt

SEQ ID NO: 24679 - DNA, 55 bp, Homo sapiens; identical to SEQ ID NO: 15384
  misc_feature 1..55: note = chr10:104823193-104823248
  misc_feature 1..55: note = hypo
  source 1..55: mol_type = genomic DNA

SEQ ID NO: 24680 - DNA, 21 bp, Homo sapiens
  misc_feature 1..21: note = chr10:108522437-108522458
  misc_feature 1..21: note = hypo
  source 1..21: mol_type = genomic DNA
agccaccgtgcccagcctatt

SEQ ID NO: 24681 - DNA, 83 bp, Homo sapiens; identical to SEQ ID NO: 15387
  misc_feature 1..83: note = chr10:113623006-113623089
  misc_feature 1..83: note = hypo
  source 1..83: mol_type = genomic DNA

SEQ ID NO: 24682 - DNA, 34 bp, Homo sapiens; identical to SEQ ID NO: 15388
  misc_feature 1..34: note = chr10:115844821-115844855
  misc_feature 1..34: note = hypo
  source 1..34: mol_type = genomic DNA

SEQ ID NO: 24683 - DNA, 21 bp, Homo sapiens
  misc_feature 1..21: note = chr10:116331156-116331177
  misc_feature 1..21: note = hypo
  source 1..21: mol_type = genomic DNA
aacgggcgcctggaggcagaa

SEQ ID NO: 24684 - DNA, 30 bp, Homo sapiens; identical to SEQ ID NO: 15390
  misc_feature 1..30: note = chr10:120791248-120791278
  misc_feature 1..30: note = hypo
  source 1..30: mol_type = genomic DNA

SEQ ID NO: 24685 - DNA, 17 bp, Homo sapiens
  misc_feature 1..17: note = chr10:121354427-121354444
  misc_feature 1..17: note = hypo
  source 1..17: mol_type = genomic DNA
cccggcctgaaggacaa

SEQ ID NO: 24686 - DNA, 30 bp, Homo sapiens; identical to SEQ ID NO: 15392
  misc_feature 1..30: note = chr10:121651072-121651102
  misc_feature 1..30: note = hypo
  source 1..30: mol_type = genomic DNA

SEQ ID NO: 24687 - DNA, 120 bp, Homo sapiens; identical to SEQ ID NO: 15393
  misc_feature 1..120: note = chr10:122492432-122492552
  misc_feature 1..120: note = hypo
  source 1..120: mol_type = genomic DNA

SEQ ID NO: 24688 - DNA, 20 bp, Homo sapiens
  misc_feature 1..20: note = chr10:123688618-123688638
  misc_feature 1..20: note = hypo
  source 1..20: mol_type = genomic DNA
agcactttgggaggccgagg

SEQ ID NO: 24689 - DNA, 58 bp, Homo sapiens
  misc_feature 1..58: note = chr10:126199077-126199135
  misc_feature 1..58: note = hypo
  source 1..58: mol_type = genomic DNA
agaactcttcctccaagagaccacgttcctctggtcctgtctccgtgggccacatcca

SEQ ID NO: 24690 - DNA, 23 bp, Homo sapiens
  misc_feature 1..23: note = chr10:126479341-126479364
  misc_feature 1..23: note = hypo
  source 1..23: mol_type = genomic DNA
cttctttttttgagacggagtca

SEQ ID NO: 24691 - DNA, 44 bp, Homo sapiens; identical to SEQ ID NO: 15397
  misc_feature 1..44: note = chr10:126809890-126809934
  misc_feature 1..44: note = hypo
  source 1..44: mol_type = genomic DNA

SEQ ID NO: 24692 - DNA, 39 bp, Homo sapiens; identical to SEQ ID NO: 15398
  misc_feature 1..39: note = chr10:127463306-127463345
  misc_feature 1..39: note = hypo
  source 1..39: mol_type = genomic DNA

SEQ ID NO: 24693 - DNA, 39 bp, Homo sapiens
  misc_feature 1..39: note = chr10:130203480-130203519
  misc_feature 1..39: note = hypo
  source 1..39: mol_type = genomic DNA
aatggacaacagggaaaatggaggcgcaggtgagaaagg

SEQ ID NO: 24694 - DNA, 38 bp, Homo sapiens; identical to SEQ ID NO: 15400
  misc_feature 1..38: note = chr10:131641111-131641149
  misc_feature 1..38: note = hypo
  source 1..38: mol_type = genomic DNA

SEQ ID NO: 24695 - DNA, 156 bp, Homo sapiens
  misc_feature 1..156: note = chr10:131647747-131647903
  misc_feature 1..156: note = hypo
  source 1..156: mol_type = genomic DNA
caggtgtgcaaggtgcgggggcggacacaaagactgcggcttccggagaggacggctagggggccgcctttgcaagtgctctccaaaataattggtcaccgttctcgagtgcttgggcgtcggcgcatcttgtaagcaacgcaggaagcctcgcac

SEQ ID NO: 24696 - skipped

SEQ ID NO: 24697 - DNA, 131 bp, Homo sapiens; identical to SEQ ID NO: 15402
  misc_feature 1..131: note = chr10:131844101-131844232
  misc_feature 1..131: note = hypo
  source 1..131: mol_type = genomic DNA

SEQ ID NO: 24698 - DNA, 65 bp, Homo sapiens; identical to SEQ ID NO: 15403
  misc_feature 1..65: note = chr10:131844627-131844692
  misc_feature 1..65: note = hypo
  source 1..65: mol_type = genomic DNA

SEQ ID NO: 24699 - DNA, 172 bp, Homo sapiens; identical to SEQ ID NO: 15404
  misc_feature 1..172: note = chr10:131845044-131845216
  misc_feature 1..172: note = hypo
  source 1..172: mol_type = genomic DNA

SEQ ID NO: 24700 - DNA, 132 bp, Homo sapiens; identical to SEQ ID NO: 15407
  misc_feature 1..132: note = chr10:132365736-132365868
  misc_feature 1..132: note = hypo
  source 1..132: mol_type = genomic DNA

SEQ ID NO: 24701 - DNA, 119 bp, Homo sapiens; identical to SEQ ID NO: 15408
  misc_feature 1..119: note = chr10:132976493-132976612
  misc_feature 1..119: note = hypo
  source 1..119: mol_type = genomic DNA

SEQ ID NO: 24702 - DNA, 141 bp, Homo sapiens; identical to SEQ ID NO: 15409
  misc_feature 1..141: note = chr10:133913916-133914057
  misc_feature 1..141: note = hypo
  source 1..141: mol_type = genomic DNA

SEQ ID NO: 24703 - DNA, 57 bp, Homo sapiens; identical to SEQ ID NO: 15410
  misc_feature 1..57: note = chr10:133949378-133949435
  misc_feature 1..57: note = hypo
  source 1..57: mol_type = genomic DNA

SEQ ID NO: 24704 - DNA, 100 bp, Homo sapiens
  misc_feature 1..100: note = chr10:133951502-133951602
  misc_feature 1..100: note = hypo
  source 1..100: mol_type = genomic DNA
agccagcccagacaccgtcttccctgtcatccaaatgatggcacacgggcagtaaaccgtggactgaaaccggtggagctgctctaccacttacacaacc

SEQ ID NO: 24705 - DNA, 119 bp, Homo sapiens; identical to SEQ ID NO: 15412
  misc_feature 1..119: note = chr10:133962676-133962795
  misc_feature 1..119: note = hypo
  source 1..119: mol_type = genomic DNA

SEQ ID NO: 24706 - DNA, 46 bp, Homo sapiens; identical to SEQ ID NO: 15413
  misc_feature 1..46: note = chr10:133984135-133984181
  misc_feature 1..46: note = hypo
  source 1..46: mol_type = genomic DNA

SEQ ID NO: 24707 - DNA, 112 bp, Homo sapiens; identical to SEQ ID NO: 15414
  misc_feature 1..112: note = chr10:134012352-134012464
  misc_feature 1..112: note = hypo
  source 1..112: mol_type = genomic DNA

SEQ ID NO: 24708 - DNA, 30 bp, Homo sapiens; identical to SEQ ID NO: 15415
  misc_feature 1..30: note = chr10:134014429-134014459
  misc_feature 1..30: note = hypo
  source 1..30: mol_type = genomic DNA

SEQ ID NO: 24709 - DNA, 21 bp, Homo sapiens
  misc_feature 1..21: note = chr10:134016388-134016409
  misc_feature 1..21: note = hypo
  source 1..21: mol_type = genomic DNA
ccagaacgcacccctggtcaa

SEQ ID NO: 24710 - DNA, 37 bp, Homo sapiens
  misc_feature 1..37: note = chr10:134022875-134022912
  misc_feature 1..37: note = hypo
  source 1..37: mol_type = genomic DNA
accaggcagaagctgttctctgcgggactttgctgga

SEQ ID NO: 24711 - DNA, 47 bp, Homo sapiens; identical to SEQ ID NO: 15418
  misc_feature 1..47: note = chr10:134093662-134093709
  misc_feature 1..47: note = hypo
  source 1..47: mol_type = genomic DNA

SEQ ID NO: 24712 - DNA, 14 bp, Homo sapiens
  misc_feature 1..14: note = chr10:134095580-134095594
  misc_feature 1..14: note = hypo
  source 1..14: mol_type = genomic DNA
ctccgggggtgggg

SEQ ID NO: 24713 - DNA, 20 bp, Homo sapiens
  misc_feature 1..20: note = chr10:134301075-134301095
  misc_feature 1..20: note = hypo
  source 1..20: mol_type = genomic DNA
cttgggaagctgtgccgcaa

SEQ ID NO: 24714 - DNA, 104 bp, Homo sapiens
  misc_feature 1..104: note = chr10:134301212-134301316
  misc_feature 1..104: note = hypo
  source 1..104: mol_type = genomic DNA
tgcctccacctccagggttccacatccttccagtaggacacaggcagacatcgccttgggaggctgaatttgctcaaacggcaaacacacgatgagagcctggg

SEQ ID NO: 24715 - DNA, 180 bp, Homo sapiens; identical to SEQ ID NO: 15421
  misc_feature 1..180: note = chr10:134481125-134481305
  misc_feature 1..180: note = hypo
  source 1..180: mol_type = genomic DNA

SEQ ID NO: 24716 - DNA, 48 bp, Homo sapiens
  misc_feature 1..48: note = chr10:134607922-134607970
  misc_feature 1..48: note = hypo
  source 1..48: mol_type = genomic DNA
tctgagctctcagggcgttgcttctttgcccatttatcccgggtcttg

SEQ ID NO: 24717 - DNA, 13 bp, Homo sapiens
  misc_feature 1..13: note = chr10:134608183-134608196
  misc_feature 1..13: note = hypo
  source 1..13: mol_type = genomic DNA
aaagaggggagga

SEQ ID NO: 24718 - DNA, 38 bp, Homo sapiens; identical to SEQ ID NO: 15423
  misc_feature 1..38: note = chr10:134610885-134610923
  misc_feature 1..38: note = hypo
  source 1..38: mol_type = genomic DNA

SEQ ID NO: 24719 - DNA, 66 bp, Homo sapiens
  misc_feature 1..66: note = chr10:134665081-134665147
  misc_feature 1..66: note = hypo
  source 1..66: mol_type = genomic DNA
ggcattttccagaaccgtacctaagtggaggcgcacagagtgctgtctttccgtctggttcatttt

SEQ ID NO: 24720 - DNA, 30 bp, Homo sapiens; identical to SEQ ID NO: 15425
  misc_feature 1..30: note = chr10:134671588-134671618
  misc_feature 1..30: note = hypo
  source 1..30: mol_type = genomic DNA

SEQ ID NO: 24721 - DNA, 77 bp, Homo sapiens; identical to SEQ ID NO: 15426
  misc_feature 1..77: note = chr10:134682737-134682814
  misc_feature 1..77: note = hypo
  source 1..77: mol_type = genomic DNA

SEQ ID NO: 24722 - DNA, 21 bp, Homo sapiens
  misc_feature 1..21: note = chr10:134683679-134683700
  misc_feature 1..21: note = hypo
  source 1..21: mol_type = genomic DNA
atgagacggtgaactgagtcg

SEQ ID NO: 24723 - DNA, 38 bp, Homo sapiens; identical to SEQ ID NO: 15428
  misc_feature 1..38: note = chr10:134690510-134690548
  misc_feature 1..38: note = hypo
  source 1..38: mol_type = genomic DNA

SEQ ID NO: 24724 - DNA, 144 bp, Homo sapiens
  misc_feature 1..144: note = chr10:134699728-134699872
  misc_feature 1..144: note = hypo
  source 1..144: mol_type = genomic DNA
ccttggagaattctgcgttcacaaacacagacctgtgtttccacgtattaaagattggcgagcaggacttggggtcctttcaggagttgcatggaaagctcccccgcggccgaggacacagcgccacgtgcacgctcgggagtc

SEQ ID NO: 24725 - DNA, 74 bp, Homo sapiens; identical to SEQ ID NO: 15430
  misc_feature 1..74: note = chr10:134731905-134731979
  misc_feature 1..74: note = hypo
  source 1..74: mol_type = genomic DNA

SEQ ID NO: 24726 - DNA, 41 bp, Homo sapiens; identical to SEQ ID NO: 15431
  misc_feature 1..41: note = chr10:134732884-134732925
  misc_feature 1..41: note = hypo
  source 1..41: mol_type = genomic DNA

SEQ ID NO: 24727 - DNA, 222 bp, Homo sapiens
  misc_feature 1..222: note = chr10:134733275-134733497
  misc_feature 1..222: note = hypo
  source 1..222: mol_type = genomic DNA
gcctgctctggtcacaggcgctgcgtgtcctccgagtgacagcagtgacaggcgggacagggcagccgcacacctcataggccgtggctgtcatcacaggctggggggtcccgtctgtggcgggactcccaggcagggacctcgtcccaccatcctggagcaggtggcctggcgagtccccagacggccacatgcagggtcagctcagccgccacagacact

SEQ ID NO: 24728 - DNA, 75 bp, Homo sapiens
  misc_feature 1..75: note = chr10:134733617-134733692
  misc_feature 1..75: note = hypo
  source 1..75: mol_type = genomic DNA
cgctgacggtgtggtgccacgccttcgcacagaggtaggtgaaccggcccctgttcttcccggtggagactgagg

SEQ ID NO: 24729 - DNA, 30 bp, Homo sapiens; identical to SEQ ID NO: 15433
  misc_feature 1..30: note = chr10:134734085-134734115
  misc_feature 1..30: note = hypo
  source 1..30: mol_type = genomic DNA

SEQ ID NO: 24730 - DNA, 82 bp, Homo sapiens
  misc_feature 1..82: note = chr10:134738296-134738378
  misc_feature 1..82: note = hypo
  source 1..82: mol_type = genomic DNA
gcgtggcgcacaccacgtggatgacccgggggtcgcccaggcgcacggctcgctgcagcgcgacgtctagcctctgtatgat

SEQ ID NO: 24731 - DNA, 26 bp, Homo sapiens
  misc_feature 1..26: note = chr10:134738642-134738668
  misc_feature 1..26: note = hypo
  source 1..26: mol_type = genomic DNA
gactcagcgggcgctgctcccttcct

SEQ ID NO: 24732 - DNA, 224 bp, Homo sapiens; identical to SEQ ID NO: 15436
  misc_feature 1..224: note = chr10:134834692-134834916
  misc_feature 1..224: note = hypo
  source 1..224: mol_type = genomic DNA

SEQ ID NO: 24733 - DNA, 30 bp, Homo sapiens; identical to SEQ ID NO: 15437
  misc_feature 1..30: note = chr10:134855649-134855679
  misc_feature 1..30: note = hypo
  source 1..30: mol_type = genomic DNA

SEQ ID NO: 24734 - DNA, 37 bp, Homo sapiens; identical to SEQ ID NO: 15438
  misc_feature 1..37: note = chr10:134875820-134875857
  misc_feature 1..37: note = hypo
  source 1..37: mol_type = genomic DNA

SEQ ID NO: 24735 - DNA, 49 bp, Homo sapiens; identical to SEQ ID NO: 15439
  misc_feature 1..49: note = chr10:134895296-134895345
  misc_feature 1..49: note = hypo
  source 1..49: mol_type = genomic DNA

SEQ ID NO: 24736 - DNA, 39 bp, Homo sapiens; identical to SEQ ID NO: 15440
  misc_feature 1..39: note = chr10:134898411-134898450
  misc_feature 1..39: note = hypo
  source 1..39: mol_type = genomic DNA

SEQ ID NO: 24737 - DNA, 149 bp, Homo sapiens; identical to SEQ ID NO: 15441
  misc_feature 1..149: note = chr10:134913803-134913952
  misc_feature 1..149: note = hypo
  source 1..149: mol_type = genomic DNA

SEQ ID NO: 24738 - DNA, 195 bp, Homo sapiens
  misc_feature 1..195: note = chr10:134940950-134941145
  misc_feature 1..195: note = hypo
  source 1..195: mol_type = genomic DNA
ggacctggggcttgccgagagctgcgcccctcccagctcgcacccccgaggagtgcgcagcgccccctcctctcccagggagtccaacctaatctttgcctttggacaaggcaggcctggtttgccttctatgggaggggcctggggacaaatagcgatttggcaacagcacagagctcagctgagaagggaaac

SEQ ID NO: 24739 - DNA, 96 bp, Homo sapiens
  misc_feature 1..96: note = chr10:134941178-134941274
  misc_feature 1..96: note = hypo
  source 1..96: mol_type = genomic DNA
tgcccagagccagcctggaacctctcattcagggccctcagttccttctgcggccccaggatggcccgcccgtctgccctccgccttgccccgccc

SEQ ID NO: 24740 - DNA, 30 bp, Homo sapiens; identical to SEQ ID NO: 15443
  misc_feature 1..30: note = chr10:134941647-134941677
  misc_feature 1..30: note = hypo
  source 1..30: mol_type = genomic DNA

SEQ ID NO: 24741 - DNA, 309 bp, Homo sapiens
  misc_feature 1..309: note = chr10:134942531-134942840
  misc_feature 1..309: note = hypo
  source 1..309: mol_type = genomic DNA
cctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcaggga

SEQ ID NO: 24742 - DNA, 11 bp, Homo sapiens
  misc_feature 1..11: note = chr10:134943114-134943125
  misc_feature 1..11: note = hypo
  source 1..11: mol_type = genomic DNA
tttcagaagcc

SEQ ID NO: 24743 - DNA, 510 bp, Homo sapiens; identical to SEQ ID NO: 15445
  misc_feature 1..510: note = chr10:134996387-134996897
  misc_feature 1..510: note = hypo
  source 1..510: mol_type = genomic DNA

SEQ ID NO: 24744 - DNA, 56 bp, Homo sapiens
  misc_feature 1..56: note = chr10:135002007-135002063
  misc_feature 1..56: note = hypo
  source 1..56: mol_type = genomic DNA
tgtccacactgacctcgccgctctcctgcccacagtgggtgtccctgcaggacctc

SEQ ID NO: 24745 - DNA, 24 bp, Homo sapiens
  misc_feature 1..24: note = chr10:135002156-135002180
  misc_feature 1..24: note = hypo
  source 1..24: mol_type = genomic DNA
ggtgacgcacgcaccatcccatcc

SEQ ID NO: 24746 - DNA, 205 bp, Homo sapiens; identical to SEQ ID NO: 15447
  misc_feature 1..205: note = chr10:135011834-135012039
  misc_feature 1..205: note = hypo
  source 1..205: mol_type = genomic DNA

SEQ ID NO: 24747 - DNA, 195 bp, Homo sapiens; identical to SEQ ID NO: 15448
  misc_feature 1..195: note = chr10:135015152-135015347
  misc_feature 1..195: note = hypo
  source 1..195: mol_type = genomic DNA

SEQ ID NO: 24748 - DNA, 32 bp, Homo sapiens; identical to SEQ ID NO: 15449
  misc_feature 1..32: note = chr10:135017129-135017161
  misc_feature 1..32: note = hypo
  source 1..32: mol_type = genomic DNA

SEQ ID NO: 24749 - DNA, 30 bp, Homo sapiens; identical to SEQ ID NO: 15450
  misc_feature 1..30: note = chr10:135017385-135017415
  misc_feature 1..30: note = hypo
  source 1..30: mol_type = genomic DNA

SEQ ID NO: 24750 - DNA, 34 bp, Homo sapiens
  misc_feature 1..34: note = chr10:135020767-135020801
  misc_feature 1..34: note = hypo
  source 1..34: mol_type = genomic DNA
acgtcaacaagcacccgggcggccggcagaaggc

SEQ ID NO: 24751 - DNA, 30 bp, Homo sapiens; identical to SEQ ID NO: 15452
  misc_feature 1..30: note = chr10:135023111-135023141
  misc_feature 1..30: note = hypo
  source 1..30: mol_type = genomic DNA

SEQ ID NO: 24752 - DNA, 36 bp, Homo sapiens
  misc_feature 1..36: note = chr10:135023434-135023470
  misc_feature 1..36: note = hypo
  source 1..36: mol_type = genomic DNA
gtctcctgagggtggcgcggtttcacccagtgaaga

SEQ ID NO: 24753 - DNA, 30 bp, Homo sapiens; identical to SEQ ID NO: 15454
  misc_feature 1..30: note = chr10:135035009-135035039
  misc_feature 1..30: note = hypo
  source 1..30: mol_type = genomic DNA

SEQ ID NO: 24754 - DNA, 49 bp, Homo sapiens; identical to SEQ ID NO: 15455
  misc_feature 1..49: note = chr10:135069848-135069897
  misc_feature 1..49: note = hypo
  source 1..49: mol_type = genomic DNA

SEQ ID NO: 24755 - DNA, 14 bp, Homo sapiens
  misc_feature 1..14: note = chr11:394801-394815
  misc_feature 1..14: note = hypo
  source 1..14: mol_type = genomic DNA
ttggcacatggcag

SEQ ID NO: 24756 - DNA, 139 bp, Homo sapiens; identical to SEQ ID NO: 15457
  misc_feature 1..139: note = chr11:445925-446064
  misc_feature 1..139: note = hypo
  source 1..139: mol_type = genomic DNA

SEQ ID NO: 24757 - DNA, 18 bp, Homo sapiens
  misc_feature 1..18: note = chr11:447613-447631
  misc_feature 1..18: note = hypo
  source 1..18: mol_type = genomic DNA
gcccggccttctctgcca

SEQ ID NO: 24758 - DNA, 78 bp, Homo sapiens; identical to SEQ ID NO: 15459
  misc_feature 1..78: note = chr11:449595-449673
  misc_feature 1..78: note = hypo
  source 1..78: mol_type = genomic DNA

SEQ ID NO: 24759 - DNA, 470 bp, Homo sapiens; identical to SEQ ID NO: 15460
  misc_feature 1..470: note = chr11:562246-562716
  misc_feature 1..470: note = hypo
  source 1..470: mol_type = genomic DNA

SEQ ID NO: 24760 - DNA, 30 bp, Homo sapiens; identical to SEQ ID NO: 15461
  misc_feature 1..30: note = chr11:762939-762969
  misc_feature 1..30: note = hypo
  source 1..30: mol_type = genomic DNA

SEQ ID NO: 24761 - skipped

SEQ ID NO: 24762 - DNA, 80 bp, Homo sapiens; identical to SEQ ID NO: 15465
  misc_feature 1..80: note = chr11:859292-859372
  misc_feature 1..80: note = hypo
  source 1..80: mol_type = genomic DNA

SEQ ID NO: 24763 - DNA, 180 bp, Homo sapiens; identical to SEQ ID NO: 15466
  misc_feature 1..180: note = chr11:862671-862851
  misc_feature 1..180: note = hypo
  source 1..180: mol_type = genomic DNA

SEQ ID NO: 24764 - DNA, 68 bp, Homo sapiens; identical to SEQ ID NO: 15467
  misc_feature 1..68: note = chr11:864749-864817
  misc_feature 1..68: note = hypo
  source 1..68: mol_type = genomic DNA

SEQ ID NO: 24765 - DNA, 123 bp, Homo sapiens; identical to SEQ ID NO: 15468
  misc_feature 1..123: note = chr11:865692-865815
  misc_feature 1..123: note = hypo
  source 1..123: mol_type = genomic DNA

SEQ ID NO: 24766 - DNA, 30 bp, Homo sapiens; identical to SEQ ID NO: 15469
  misc_feature 1..30: note = chr11:866956-866986
  misc_feature 1..30: note = hypo
  source 1..30: mol_type = genomic DNA

SEQ ID NO: 24767 - DNA, 30 bp, Homo sapiens; identical to SEQ ID NO: 15470
  misc_feature 1..30: note = chr11:875487-875517
  misc_feature 1..30: note = hypo
  source 1..30: mol_type = genomic DNA

SEQ ID NO: 24768 - DNA, 61 bp, Homo sapiens; identical to SEQ ID NO: 15471
  misc_feature 1..61: note = chr11:985399-985460
  misc_feature 1..61: note = hypo
  source 1..61: mol_type = genomic DNA

SEQ ID NO: 24769 - DNA, 30 bp, Homo sapiens; identical to SEQ ID NO: 15472
  misc_feature 1..30: note = chr11:986983-987013
  misc_feature 1..30: note = hypo
  source 1..30: mol_type = genomic DNA

SEQ ID NO: 24770 - DNA, 48 bp, Homo sapiens
  misc_feature 1..48: note = chr11:1029190-1029238
  misc_feature 1..48: note = hypo
  source 1..48: mol_type = genomic DNA
gagcgcccctccccacgggccacagggctcgtcctacctggaggagga

SEQ ID NO: 24771 - DNA, 18 bp, Homo sapiens
  misc_feature 1..18: note = chr11:1029403-1029421
  misc_feature 1..18: note = hypo
  source 1..18: mol_type = genomic DNA
ggccgctggagccagaca

SEQ ID NO: 24772 - DNA, 31 bp, Homo sapiens
  misc_feature 1..31: note = chr11:1030184-1030215
  misc_feature 1..31: note = hypo
  source 1..31: mol_type = genomic DNA
gagagagagtgcctgcgactgccctcacctt

SEQ ID NO: 24773 - DNA, 59 bp, Homo sapiens; identical to SEQ ID NO: 15475
  misc_feature 1..59: note = chr11:1075796-1075855
  misc_feature 1..59: note = hypo
  source 1..59: mol_type = genomic DNA

SEQ ID NO: 24774 - DNA, 35 bp, Homo sapiens; identical to SEQ ID NO: 15476
  misc_feature 1..35: note = chr11:1077652-1077687
  misc_feature 1..35: note = hypo
  source 1..35: mol_type = genomic DNA

SEQ ID NO: 24775 - DNA, 57 bp, Homo sapiens; identical to SEQ ID NO: 15477
  misc_feature 1..57: note = chr11:1095083-1095140
  misc_feature 1..57: note = hypo
  source 1..57: mol_type = genomic DNA

SEQ ID NO: 24776 - DNA, 30 bp, Homo sapiens; identical to SEQ ID NO: 15478
  misc_feature 1..30: note = chr11:1104124-1104154
  misc_feature 1..30: note = hypo
  source 1..30: mol_type = genomic DNA

SEQ ID NO: 24777 - DNA, 30 bp, Homo sapiens; identical to SEQ ID NO: 15479
  misc_feature 1..30: note = chr11:1142462-1142492
  misc_feature 1..30: note = hypo
  source 1..30: mol_type = genomic DNA

SEQ ID NO: 24778 - DNA, 30 bp, Homo sapiens; identical to SEQ ID NO: 15480
  misc_feature 1..30: note = chr11:1151771-1151801
  misc_feature 1..30: note = hypo
  source 1..30: mol_type = genomic DNA

SEQ ID NO: 24779 - DNA, 16 bp, Homo sapiens
  misc_feature 1..16: note = chr11:1214917-1214933
  misc_feature 1..16: note = hypo
  source 1..16: mol_type = genomic DNA
ccggggcagccactcc

SEQ ID NO: 24780 - DNA, 32 bp, Homo sapiens
  misc_feature 1..32: note = chr11:1215867-1215899
  misc_feature 1..32: note = hypo
  source 1..32: mol_type = genomic DNA
gtttgccaacaacaccgagggccagtgcggtg

SEQ ID NO: 24781 - DNA, 27 bp, Homo sapiens
  misc_feature 1..27: note = chr11:1244354-1244381
  misc_feature 1..27: note = hypo
  source 1..27: mol_type = genomic DNA
tgggtgccccgagcgcgtgccggacgc

SEQ ID NO: 24782 - DNA, 66 bp, Homo sapiens
  misc_feature 1..66: note = chr11:1244465-1244531
  misc_feature 1..66: note = hypo
  source 1..66: mol_type = genomic DNA
ggcgggggtctctgcaggtcgcttgcctgggagcttctcctgcagagtgcacgggcagatccccct

SEQ ID NO: 24783 - DNA, 67 bp, Homo sapiens; identical to SEQ ID NO: 15484
  misc_feature 1..67: note = chr11:1247815-1247882
  misc_feature 1..67: note = hypo
  source 1..67: mol_type = genomic DNA

SEQ ID NO: 24784 - DNA, 94 bp, Homo sapiens
  misc_feature 1..94: note = chr11:1250924-1251018
  misc_feature 1..94: note = hypo
  source 1..94: mol_type = genomic DNA
gtgctggatgacatcacgcactctggctgcctgcccctcgggcagtgcccctgcacccacggcggccgcacctacagcccgggcacctccttca

SEQ ID NO: 24785 - DNA, 105 bp, Homo sapiens; identical to SEQ ID NO: 15486
  misc_feature 1..105: note = chr11:1252902-1253007
  misc_feature 1..105: note = hypo
  source 1..105: mol_type = genomic DNA

SEQ ID NO: 24786 - DNA, 279 bp, Homo sapiens; identical to SEQ ID NO: 15487
  misc_feature 1..279: note = chr11:1255015-1255294
  misc_feature 1..279: note = hypo
  source 1..279: mol_type = genomic DNA

SEQ ID NO: 24787 - DNA, 30 bp, Homo sapiens; identical to SEQ ID NO: 15488
  misc_feature 1..30: note = chr11:1256469-1256499
  misc_feature 1..30: note = hypo
  source 1..30: mol_type = genomic DNA

SEQ ID NO: 24788 - DNA, 106 bp, Homo sapiens; identical to SEQ ID NO: 15489
  misc_feature 1..106: note = chr11:1257713-1257819
  misc_feature 1..106: note = hypo
  source 1..106: mol_type = genomic DNA

SEQ ID NO: 24789 - DNA, 30 bp, Homo sapiens; identical to SEQ ID NO: 15491
  misc_feature 1..30: note = chr11:1276708-1276738
  misc_feature 1..30: note = hypo
  source 1..30: mol_type = genomic DNA

SEQ ID NO: 24790 - DNA, 161 bp, Homo sapiens; identical to SEQ ID NO: 15492
  misc_feature 1..161: note = chr11:1382237-1382398
  misc_feature 1..161: note = hypo
  source 1..161: mol_type = genomic DNA

SEQ ID NO: 24791 - DNA, 76 bp, Homo sapiens; identical to SEQ ID NO: 15493
  misc_feature 1..76: note = chr11:1430992-1431068
  misc_feature 1..76: note = hypo
  source 1..76: mol_type = genomic DNA

SEQ ID NO: 24792 - DNA, 30 bp, Homo sapiens; identical to SEQ ID NO: 15494
  misc_feature 1..30: note = chr11:1444922-1444952
  misc_feature 1..30: note = hypo
  source 1..30: mol_type = genomic DNA

SEQ ID NO: 24793 - DNA, 30 bp, Homo sapiens; identical to SEQ ID NO: 15495
  misc_feature 1..30: note = chr11:1455198-1455228
  misc_feature 1..30: note = hypo
  source 1..30: mol_type = genomic DNA

SEQ ID NO: 24794 - DNA, 30 bp, Homo sapiens; identical to SEQ ID NO: 15496
  misc_feature 1..30: note = chr11:1461990-1462020
  misc_feature 1..30: note = hypo
  source 1..30: mol_type = genomic DNA

SEQ ID NO: 24795 - DNA, 76 bp, Homo sapiens
  misc_feature 1..76: note = chr11:1464204-1464280
  misc_feature 1..76: note = hypo
  source 1..76: mol_type = genomic DNA
cagggaatgtgggggcgtctggcaccacagccctggaggcctccttgagggccctgcggtgcaccatcaccctggg

SEQ ID NO: 24796 - DNA, 33 bp, Homo sapiens
  misc_feature 1..33: note = chr11:1464428-1464461
  misc_feature 1..33: note = hypo
  source 1..33: mol_type = genomic DNA
ggtgggaccccagcctgccgcacccccaggtgc

SEQ ID NO: 24797 - DNA, 243 bp, Homo sapiens; identical to SEQ ID NO: 15498
  misc_feature 1..243: note = chr11:1464674-1464917
  misc_feature 1..243: note = hypo
  source 1..243: mol_type = genomic DNA

SEQ ID NO: 24798 - DNA, 127 bp, Homo sapiens; identical to SEQ ID NO: 15499
  misc_feature 1..127: note = chr11:1466979-1467106
  misc_feature 1..127: note = hypo
  source 1..127: mol_type = genomic DNA

SEQ ID NO: 24799 - DNA, 71 bp, Homo sapiens
  misc_feature 1..71: note = chr11:1469157-1469228
  misc_feature 1..71: note = hypo
  source 1..71: mol_type = genomic DNA
gggcaggcacatgggcgggtctggtggcgggctgggctgcagggctcctgctgcggtgaagccagccagca

SEQ ID NO: 24800 - DNA, 40 bp, Homo sapiens
  misc_feature 1..40: note = chr11:1471880-1471920
  misc_feature 1..40: note = hypo
  source 1..40: mol_type = genomic DNA
cgccaaaggagagcccggctggcacgcccaaccccacgcc

SEQ ID NO: 24801 - DNA, 33 bp, Homo sapiens; identical to SEQ ID NO: 15502
  misc_feature 1..33: note = chr11:1477820-1477853
  misc_feature 1..33: note = hypo
  source 1..33: mol_type = genomic DNA

SEQ ID NO: 24802 - DNA, 62 bp, Homo sapiens; identical to SEQ ID NO: 15503
  misc_feature 1..62: note = chr11:1669565-1669627
  misc_feature 1..62: note = hypo
  source 1..62: mol_type = genomic DNA

SEQ ID NO: 24803 - DNA, 33 bp, Homo sapiens; identical to SEQ ID NO: 15504
  misc_feature 1..33: note = chr11:1856532-1856565
  misc_feature 1..33: note = hypo
  source 1..33: mol_type = genomic DNA

SEQ ID NO: 24804 - DNA, 33 bp, Homo sapiens; identical to SEQ ID NO: 15506
  misc_feature 1..33: note = chr11:1955358-1955391
  misc_feature 1..33: note = hypo
  source 1..33: mol_type = genomic DNA

SEQ ID NO: 24805 - DNA, 19 bp, Homo sapiens
  misc_feature 1..19: note = chr11:1957372-1957391
  misc_feature 1..19: note = hypo
  source 1..19: mol_type = genomic DNA
aagctagcccacagccggg

SEQ ID NO: 24806 - DNA, 120 bp, Homo sapiens; identical to SEQ ID NO: 15508
  misc_feature 1..120: note = chr11:1958184-1958304
  misc_feature 1..120: note = hypo
  source 1..120: mol_type = genomic DNA

SEQ ID NO: 24807 - DNA, 45 bp, Homo sapiens
  misc_feature 1..45: note = chr11:1959032-1959077
  misc_feature 1..45: note = hypo
  source 1..45: mol_type = genomic DNA
ctgagggtgggcagtcggcgtggtgtgcatgtgcctgcgtgtgtg

SEQ ID NO: 24808 - DNA, 35 bp, Homo sapiens
  misc_feature 1..35: note = chr11:1959187-1959222
  misc_feature 1..35: note = hypo
  source 1..35: mol_type = genomic DNA
aagcactcctgtcctccacccgccttcacccctca

SEQ ID NO: 24809 - DNA, 41 bp, Homo sapiens; identical to SEQ ID NO: 15510
  misc_feature 1..41: note = chr11:1981275-1981316
  misc_feature 1..41: note = hypo
  source 1..41: mol_type = genomic DNA

SEQ ID NO: 24810 - DNA, 30 bp, Homo sapiens; identical to SEQ ID NO: 15511
  misc_feature 1..30: note = chr11:2037043-2037073
  misc_feature 1..30: note = hypo
  source 1..30: mol_type = genomic DNA

SEQ ID NO: 24811 - skipped

SEQ ID NO: 24812 - DNA, 40 bp, Homo sapiens; identical to SEQ ID NO: 15514
  misc_feature 1..40: note = chr11:2278423-2278463
  misc_feature 1..40: note = hypo
  source 1..40: mol_type = genomic DNA

SEQ ID NO: 24813 - DNA, 45 bp, Homo sapiens
  misc_feature 1..45: note = chr11:2438144-2438189
  misc_feature 1..45: note = hypo
  source 1..45: mol_type = genomic DNA
atgaagcatggaatggcatacgcttcaacacggaggaaccgtcaa

SEQ ID NO: 24814 - DNA, 30 bp, Homo sapiens; identical to SEQ ID NO: 15517
  misc_feature 1..30: note = chr11:2543418-2543448
  misc_feature 1..30: note = hypo
  source 1..30: mol_type = genomic DNA

SEQ ID NO: 24815 - DNA, 76 bp, Homo sapiens; identical to SEQ ID NO: 15518
  misc_feature 1..76: note = chr11:2596517-2596593
  misc_feature 1..76: note = hypo
  source 1..76: mol_type = genomic DNA

SEQ ID NO: 24816 - DNA, 30 bp, Homo sapiens; identical to SEQ ID NO: 15519
  misc_feature 1..30: note = chr11:2818227-2818257
  misc_feature 1..30: note = hypo
  source 1..30: mol_type = genomic DNA

SEQ ID NO: 24817 - DNA, 30 bp, Homo sapiens; identical to SEQ ID NO: 15520
  misc_feature 1..30: note = chr11:2829204-2829234
  misc_feature 1..30: note = hypo
  source 1..30: mol_type = genomic DNA

SEQ ID NO: 24818 - DNA, 30 bp, Homo sapiens; identical to SEQ ID NO: 15522
  misc_feature 1..30: note = chr11:3828932-3828962
  misc_feature 1..30: note = hypo
  source 1..30: mol_type = genomic DNA

SEQ ID NO: 24819 - DNA, 26 bp, Homo sapiens
  misc_feature 1..26: note = chr11:5169023-5169049
  misc_feature 1..26: note = hypo
  source 1..26: mol_type = genomic DNA
tttttttttttttttcggagacagag

SEQ ID NO: 24820 - DNA, 159 bp, Homo sapiens; identical to SEQ ID NO: 15524
  misc_feature 1..159: note = chr11:5192016-5192175
  misc_feature 1..159: note = hypo
  source 1..159: mol_type = genomic DNA

SEQ ID NO: 24821 - DNA, 80 bp, Homo sapiens; identical to SEQ ID NO: 15525
  misc_feature 1..80: note = chr11:6497229-6497309
  misc_feature 1..80: note = hypo
  source 1..80: mol_type = genomic DNA

SEQ ID NO: 24822 - DNA, 30 bp, Homo sapiens; identical to SEQ ID NO: 15526
  misc_feature 1..30: note = chr11:6731043-6731073
  misc_feature 1..30: note = hypo
  source 1..30: mol_type = genomic DNA

SEQ ID NO: 24823 - DNA, 101 bp, Homo sapiens; identical to SEQ ID NO: 15529
  misc_feature 1..101: note = chr11:10865201-10865302
  misc_feature 1..101: note = hypo
  source 1..101: mol_type = genomic DNA

SEQ ID NO: 24824 - DNA, 87 bp, Homo sapiens; identical to SEQ ID NO: 15530
  misc_feature 1..87: note = chr11:14564357-14564444
  misc_feature 1..87: note = hypo
  source 1..87: mol_type = genomic DNA

SEQ ID NO: 24825 - DNA, 88 bp, Homo sapiens; identical to SEQ ID NO: 15531
  misc_feature 1..88: note = chr11:17100697-17100785
  misc_feature 1..88: note = hypo
  source 1..88: mol_type = genomic DNA

SEQ ID NO: 24826 - DNA, 37 bp, Homo sapiens; identical to SEQ ID NO: 15532
  misc_feature 1..37: note = chr11:19137271-19137308
  misc_feature 1..37: note = hypo
  source 1..37: mol_type = genomic DNA

SEQ ID NO: 24827 - DNA, 139 bp, Homo sapiens; identical to SEQ ID NO: 15533
  misc_feature 1..139: note = chr11:27495284-27495423
  misc_feature 1..139: note = hypo
  source 1..139: mol_type = genomic DNA

SEQ ID NO: 24828 - DNA, 17 bp, Homo sapiens
  misc_feature 1..17: note = chr11:33181188-33181205
  misc_feature 1..17: note = hypo
  source 1..17: mol_type = genomic DNA
cgcgcctgtactcccag

SEQ ID NO: 24829 - DNA, 29 bp, Homo sapiens
  misc_feature 1..29: note = chr11:33202774-33202803
  misc_feature 1..29: note = hypo
  source 1..29: mol_type = genomic DNA
acacctgtaattagccgggtgtggtggtg

SEQ ID NO: 24830 - DNA, 30 bp, Homo sapiens; identical to SEQ ID NO: 15536
  misc_feature 1..30: note = chr11:33270025-33270055
  misc_feature 1..30: note = hypo
  source 1..30: mol_type = genomic DNA

SEQ ID NO: 24831 - DNA, 19 bp, Homo sapiens
  misc_feature 1..19: note = chr11:33277689-33277708
  misc_feature 1..19: note = hypo
  source 1..19: mol_type = genomic DNA
ccaccgcgcccggcctcct

SEQ ID NO: 24832 - DNA, 30 bp, Homo sapiens; identical to SEQ ID NO: 15538
  misc_feature 1..30: note = chr11:34534277-34534307
  misc_feature 1..30: note = hypo
  source 1..30: mol_type = genomic DNA

SEQ ID NO: 24833 - DNA, 24 bp, Homo sapiens
  misc_feature 1..24: note = chr11:34535069-34535093
  misc_feature 1..24: note = hypo
  source 1..24: mol_type = genomic DNA
gtgtcaaacagctcccggaggccc

SEQ ID NO: 24834 - DNA, 80 bp, Homo sapiens
  misc_feature 1..80: note = chr11:34535123-34535203
  misc_feature 1..80: note = hypo
  source 1..80: mol_type = genomic DNA
tggagctggagatggacgagcagacccaggccccaggccgagcctctgagccctgacaccccttacgattcatccaaaaa

SEQ ID NO: 24835 - DNA, 30 bp, Homo sapiens; identical to SEQ ID NO: 15540
  misc_feature 1..30: note = chr11:35134309-35134339
  misc_feature 1..30: note = hypo
  source 1..30: mol_type = genomic DNA

SEQ ID NO: 24836 - DNA, 83 bp, Homo sapiens; identical to SEQ ID NO: 15542
  misc_feature 1..83: note = chr11:44922891-44922974
  misc_feature 1..83: note = hypo
  source 1..83: mol_type = genomic DNA

SEQ ID NO: 24837 - DNA, 32 bp, Homo sapiens; identical to SEQ ID NO: 15543
  misc_feature 1..32: note = chr11:46298483-46298515
  misc_feature 1..32: note = hypo
  source 1..32: mol_type = genomic DNA

SEQ ID NO: 24838 - DNA, 30 bp, Homo sapiens; identical to SEQ ID NO: 15545
  misc_feature 1..30: note = chr11:57150498-57150528
  misc_feature 1..30: note = hypo
  source 1..30: mol_type = genomic DNA

SEQ ID NO: 24839 - DNA, 76 bp, Homo sapiens
  misc_feature 1..76: note = chr11:57235330-57235406
  misc_feature 1..76: note = hypo
  source 1..76: mol_type = genomic DNA
tctccaccatctacccgggcactttccgccacttgcaagccctggaggagctggacctcggtgacaaccggcacct

SEQ ID NO: 24840 - DNA, 30 bp, Homo sapiens; identical to SEQ ID NO: 15547
  misc_feature 1..30: note = chr11:59312651-59312681
  misc_feature 1..30: note = hypo
  source 1..30: mol_type = genomic DNA

SEQ ID NO: 24841 - DNA, 30 bp, Homo sapiens; identical to SEQ ID NO: 15548
  misc_feature 1..30: note = chr11:59609810-59609840
  misc_feature 1..30: note = hypo
  source 1..30: mol_type = genomic DNA

SEQ ID NO: 24842 - DNA, 30 bp, Homo sapiens; identical to SEQ ID NO: 15550
  misc_feature 1..30: note = chr11:60897879-60897909
  misc_feature 1..30: note = hypo
  source 1..30: mol_type = genomic DNA

SEQ ID NO: 24843 - DNA, 171 bp, Homo sapiens; identical to SEQ ID NO: 5117
  misc_feature 1..171: note = chr11:60941596-60941767
  misc_feature 1..171: note = hypo
  source 1..171: mol_type = genomic DNA

SEQ ID NO: 24844 - DNA, 30 bp, Homo sapiens; identical to SEQ ID NO: 15552
  misc_feature 1..30: note = chr11:61039084-61039114
  misc_feature 1..30: note = hypo
  source 1..30: mol_type = genomic DNA

SEQ ID NO: 24845 - DNA, 37 bp, Homo sapiens; identical to SEQ ID NO: 15553
  misc_feature 1..37: note = chr11:61049497-61049534
  misc_feature 1..37: note = hypo
  source 1..37: mol_type = genomic DNA

SEQ ID NO: 24846 - DNA, 42 bp, Homo sapiens
  misc_feature 1..42: note = chr11:61664613-61664655
  misc_feature 1..42: note = hypo
  source 1..42: mol_type = genomic DNA
agtaagtggtgatggcggaggtggggtggcttcaggatttgg

SEQ ID NO: 24847 - DNA, 41 bp, Homo sapiens; identical to SEQ ID NO: 15556
  misc_feature 1..41: note = chr11:61669905-61669946
  misc_feature 1..41: note = hypo
  source 1..41: mol_type = genomic DNA

SEQ ID NO: 24848 - DNA, 30 bp, Homo sapiens; identical to SEQ ID NO: 15557
  misc_feature 1..30: note = chr11:61736670-61736700
  misc_feature 1..30: note = hypo
  source 1..30: mol_type = genomic DNA

SEQ ID NO: 24849 - DNA, 30 bp, Homo sapiens; identical to SEQ ID NO: 15559
  misc_feature 1..30: note = chr11:62445455-62445485
  misc_feature 1..30: note = hypo
  source 1..30: mol_type = genomic DNA

SEQ ID NO: 24850 - DNA, 30 bp, Homo sapiens; identical to SEQ ID NO: 15560
  misc_feature 1..30: note = chr11:63783752-63783782
  misc_feature 1..30: note = hypo
  source 1..30: mol_type = genomic DNA

SEQ ID NO: 24851 - skipped

SEQ ID NO: 24852 - DNA, 77 bp, Homo sapiens; identical to SEQ ID NO: 15562
  misc_feature 1..77: note = chr11:63955145-63955222
  misc_feature 1..77: note = hypo
  source 1..77: mol_type = genomic DNA

SEQ ID NO: 24853 - DNA, 30 bp, Homo sapiens; identical to SEQ ID NO: 15564
  misc_feature 1..30: note = chr11:64668004-64668034
  misc_feature 1..30: note = hypo
  source 1..30: mol_type = genomic DNA

SEQ ID NO: 24854 - DNA, 30 bp, Homo sapiens; identical to SEQ ID NO: 15565
  misc_feature 1..30: note = chr11:64977482-64977512
  misc_feature 1..30: note = hypo
  source 1..30: mol_type = genomic DNA

SEQ ID NO: 24855 - DNA, 30 bp, Homo sapiens; identical to SEQ ID NO: 15566
  misc_feature 1..30: note = chr11:65091387-65091417
  misc_feature 1..30: note = hypo
  source 1..30: mol_type = genomic DNA

SEQ ID NO: 24856 - DNA, 30 bp, Homo sapiens; identical to SEQ ID NO: 15567
  misc_feature 1..30: note = chr11:65127486-65127516
  misc_feature 1..30: note = hypo
  source 1..30: mol_type = genomic DNA

SEQ ID NO: 24857 - DNA, 95 bp, Homo sapiens; identical to SEQ ID NO: 15569
  misc_feature 1..95: note = chr11:65551629-65551724
  misc_feature 1..95: note = hypo
  source 1..95: mol_type = genomic DNA

SEQ ID NO: 24858 - DNA, 35 bp, Homo sapiens; identical to SEQ ID NO: 15570
  misc_feature 1..35: note = chr11:65722789-65722824
  misc_feature 1..35: note = hypo
  source 1..35: mol_type = genomic DNA

SEQ ID NO: 24859 - DNA, 30 bp, Homo sapiens; identical to SEQ ID NO: 15571
  misc_feature 1..30: note = chr11:66048072-66048102
  misc_feature 1..30: note = hypo
  source 1..30: mol_type = genomic DNA

SEQ ID NO: 24860 - DNA, 104 bp, Homo sapiens; identical to SEQ ID NO: 15572
  misc_feature 1..104: note = chr11:66325272-66325376
  misc_feature 1..104: note = hypo
  source 1..104: mol_type = genomic DNA

SEQ ID NO: 24861 - DNA, 93 bp, Homo sapiens; identical to SEQ ID NO: 15573
  misc_feature 1..93: note = chr11:66411368-66411461
  misc_feature 1..93: note = hypo
  source 1..93: mol_type = genomic DNA

SEQ ID NO: 24862 - DNA, 35 bp, Homo sapiens
  misc_feature 1..35: note = chr11:66513182-66513217
  misc_feature 1..35: note = hypo
  source 1..35: mol_type = genomic DNA
ggctagaacccagggcgctgactcataggccagtg

SEQ ID NO: 24863 - DNA, 16 bp, Homo sapiens
  misc_feature 1..16: note = chr11:66515380-66515396
  misc_feature 1..16: note = hypo
  source 1..16: mol_type = genomic DNA
gcgcagggcagcatta

SEQ ID NO: 24864 - DNA, 59 bp, Homo sapiens
  misc_feature 1..59: note = chr11:66625148-66625207
  misc_feature 1..59: note = hypo
  source 1..59: mol_type = genomic DNA
ccaagtgggcacctgcgccagccccacctgtgcctgggctgtggccccttcctacaggg

SEQ ID NO: 24865 - DNA, 98 bp, Homo sapiens
  misc_feature 1..98: note = chr11:66625240-66625338
  misc_feature 1..98: note = hypo
  source 1..98: mol_type = genomic DNA
tgctggccagtggagcggccgcctgcccgctgccctgcgtctgccagaacctgtccgagtcgctcagcaccctctgtgcccaccgaggcctgctgttt

SEQ ID NO: 24866 - DNA, 343 bp, Homo sapiens; identical to SEQ ID NO: 15579
  misc_feature 1..343: note = chr11:66625538-66625881
  misc_feature 1..343: note = hypo
  source 1..343: mol_type = genomic DNA

SEQ ID NO: 24867 - DNA, 207 bp, Homo sapiens; identical to SEQ ID NO: 15580
  misc_feature 1..207: note = chr11:66631300-66631507
  misc_feature 1..207: note = hypo
  source 1..207: mol_type = genomic DNA

SEQ ID NO: 24868 - skipped

SEQ ID NO: 24869 - DNA, 45 bp, Homo sapiens
  misc_feature 1..45: note = chr11:67781564-67781609
  misc_feature 1..45: note = hypo
  source 1..45: mol_type = genomic DNA
atcattagctggcaggtgccatcattacaccggtaacatgagagg

SEQ ID NO: 24870 - DNA, 154 bp, Homo sapiens; identical to SEQ ID NO: 15587
  misc_feature 1..154: note = chr11:68111091-68111245
  misc_feature 1..154: note = hypo
  source 1..154: mol_type = genomic DNA

SEQ ID NO: 24871 - DNA, 142 bp, Homo sapiens; identical to SEQ ID NO: 15588
  misc_feature 1..142: note = chr11:68133031-68133173
  misc_feature 1..142: note = hypo
  source 1..142: mol_type = genomic DNA

SEQ ID NO: 24872 - DNA, 30 bp, Homo sapiens; identical to SEQ ID NO: 15591
  misc_feature 1..30: note = chr11:69339953-69339983
  misc_feature 1..30: note = hypo
  source 1..30: mol_type = genomic DNA

SEQ ID NO: 24873 - DNA, 30 bp, Homo sapiens; identical to SEQ ID NO: 15592
  misc_feature 1..30: note = chr11:69970448-69970478
  misc_feature 1..30: note = hypo
  source 1..30: mol_type = genomic DNA

SEQ ID NO: 24874 - DNA, 30 bp, Homo sapiens; identical to SEQ ID NO: 15593
  misc_feature 1..30: note = chr11:70051066-70051096
  misc_feature 1..30: note = hypo
  source 1..30: mol_type = genomic DNA

SEQ ID NO: 24875 - DNA, 34 bp, Homo sapiens; identical to SEQ ID NO: 15594
  misc_feature 1..34: note = chr11:71117681-71117715
  misc_feature 1..34: note = hypo
  source 1..34: mol_type = genomic DNA

SEQ ID NO: 24876 - DNA, 30 bp, Homo sapiens; identical to SEQ ID NO: 15596
  misc_feature 1..30: note = chr11:72532300-72532330
  misc_feature 1..30: note = hypo
  source 1..30: mol_type = genomic DNA

SEQ ID NO: 24877 - DNA, 30 bp, Homo sapiens; identical to SEQ ID NO: 15597
  misc_feature 1..30: note = chr11:72905832-72905862
  misc_feature 1..30: note = hypo
  source 1..30: mol_type = genomic DNA

SEQ ID NO: 24878 - DNA, 62 bp, Homo sapiens; identical to SEQ ID NO: 15598
  misc_feature 1..62: note = chr11:73073174-73073236
  misc_feature 1..62: note = hypo
  source 1..62: mol_type = genomic DNA

SEQ ID NO: 24879 - DNA, 16 bp, Homo sapiens
  misc_feature 1..16: note = chr11:73310441-73310457
  misc_feature 1..16: note = hypo
  source 1..16: mol_type = genomic DNA
cctctgcctcccgggt

SEQ ID NO: 24880 - DNA, 24 bp, Homo sapiens
  misc_feature 1..24: note = chr11:74246632-74246656
  misc_feature 1..24: note = hypo
  source 1..24: mol_type = genomic DNA
tatgagccacggcacccagcccaa

SEQ ID NO: 24881 - DNA, 13 bp, Homo sapiens
  misc_feature 1..13: note = chr11:75459473-75459486
  misc_feature 1..13: note = hypo
  source 1..13: mol_type = genomic DNA
cagataaacaaaa

SEQ ID NO: 24882 - skipped

SEQ ID NO: 24883 - DNA, 30 bp, Homo sapiens; identical to SEQ ID NO: 15603
  misc_feature 1..30: note = chr11:95488699-95488729
  misc_feature 1..30: note = hypo
  source 1..30: mol_type = genomic DNA

SEQ ID NO: 24884 - DNA, 30 bp, Homo sapiens; identical to SEQ ID NO: 15604
  misc_feature 1..30: note = chr11:95658721-95658751
  misc_feature 1..30: note = hypo
  source 1..30: mol_type = genomic DNA

SEQ ID NO: 24885 - DNA, 185 bp, Homo sapiens; identical to SEQ ID NO: 15606
  misc_feature 1..185: note = chr11:113552799-113552984
  misc_feature 1..185: note = hypo
  source 1..185: mol_type = genomic DNA

SEQ ID NO: 24886 - DNA, 32 bp, Homo sapiens; identical to SEQ ID NO: 15607
  misc_feature 1..32: note = chr11:116890012-116890044
  misc_feature 1..32: note = hypo
  source 1..32: mol_type = genomic DNA

SEQ ID NO: 24887 - DNA, 16 bp, Homo sapiens
  misc_feature 1..16: note = chr11:116952332-116952348
  misc_feature 1..16: note = hypo
  source 1..16: mol_type = genomic DNA
ccgtctcaaaataaat

SEQ ID NO: 24888 - skipped

SEQ ID NO: 24889 - DNA, 30 bp, Homo sapiens; identical to SEQ ID NO: 15610
  misc_feature 1..30: note = chr11:120367603-120367633
  misc_feature 1..30: note = hypo
  source 1..30: mol_type = genomic DNA

SEQ ID NO: 24890 - DNA, 30 bp, Homo sapiens; identical to SEQ ID NO: 15611
  misc_feature 1..30: note = chr11:121023674-121023704
  misc_feature 1..30: note = hypo
  source 1..30: mol_type = genomic DNA

SEQ ID NO: 24891 - DNA, 43 bp, Homo sapiens
  misc_feature 1..43: note = chr11:125755569-125755612
  misc_feature 1..43: note = hypo
  source 1..43: mol_type = genomic DNA
ccaacccccaggccacggacaggcacctaggaaccaggccgca

SEQ ID NO: 24892 - DNA, 22 bp, Homo sapiens
  misc_feature 1..22: note = chr11:126083949-126083971
  misc_feature 1..22: note = hypo
  source 1..22: mol_type = genomic DNA
aagaatttatgtggccgggcgc

SEQ ID NO: 24893 - DNA, 37 bp, Homo sapiens; identical to SEQ ID NO: 15614
  misc_feature 1..37: note = chr11:126273042-126273079
  misc_feature 1..37: note = hypo
  source 1..37: mol_type = genomic DNA

SEQ ID NO: 24894 - DNA, 30 bp, Homo sapiens; identical to SEQ ID NO: 15615
  misc_feature 1..30: note = chr11:129867029-129867059
  misc_feature 1..30: note = hypo
  source 1..30: mol_type = genomic DNA

SEQ ID NO: 24895 - DNA, 30 bp, Homo sapiens; identical to SEQ ID NO: 15616
  misc_feature 1..30: note = chr11:130717573-130717603
  misc_feature 1..30: note = hypo
  source 1..30: mol_type = genomic DNA

SEQ ID NO: 24896 - DNA, 11 bp, Homo sapiens
  misc_feature 1..11: note = chr11:133231728-133231739
  misc_feature 1..11: note = hypo
  source 1..11: mol_type = genomic DNA
aatgagctcag

SEQ ID NO: 24897 - DNA, 125 bp, Homo sapiens; identical to SEQ ID NO: 15620
  misc_feature 1..125: note = chr11:134011075-134011200
  misc_feature 1..125: note = hypo
  source 1..125: mol_type = genomic DNA

SEQ ID NO: 24898 - DNA, 30 bp, Homo sapiens; identical to SEQ ID NO: 15621
  misc_feature 1..30: note = chr12:1948142-1948172
  misc_feature 1..30: note = hypo
  source 1..30: mol_type = genomic DNA

SEQ ID NO: 24899 - DNA, 52 bp, Homo sapiens; identical to SEQ ID NO: 15622
  misc_feature 1..52: note = chr12:1948496-1948548
  misc_feature 1..52: note = hypo
  source 1..52: mol_type = genomic DNA

SEQ ID NO: 24900 - DNA, 30 bp, Homo sapiens; identical to SEQ ID NO: 15624
  misc_feature 1..30: note = chr12:2590465-2590495
  misc_feature 1..30: note = hypo
  source 1..30: mol_type = genomic DNA

SEQ ID NO: 24901 - DNA, 217 bp, Homo sapiens
  misc_feature 1..217: note = chr12:2964577-2964794
  misc_feature 1..217: note = hypo
  source 1..217: mol_type = genomic DNA
tgggagggtgggagggactcgctggcctggaccatctagggagagacaaaagggagcctggggaaggttgtgcagacaggggtgcagaaaggtgggtgaggcactccgctctccttcccaggcacgacctctgccagcccaggattctcatgaggacgcagaagtcctggcagggccgcatctccatccctctccttcccggcggaagttatggctg

SEQ ID NO: 24902 - DNA, 55 bp, Homo sapiens; identical to SEQ ID NO: 15626
  misc_feature 1..55: note = chr12:4405652-4405707
  misc_feature 1..55: note = hypo
  source 1..55: mol_type = genomic DNA

SEQ ID NO: 24903 - DNA, 103 bp, Homo sapiens; identical to SEQ ID NO: 15628
  misc_feature 1..103: note = chr12:5335946-5336049
  misc_feature 1..103: note = hypo
  source 1..103: mol_type = genomic DNA

SEQ ID NO: 24904 - DNA, 47 bp, Homo sapiens
  misc_feature 1..47: note = chr12:6483568-6483615
  misc_feature 1..47: note = hypo
  source 1..47: mol_type = genomic DNA
gaagacgagcttgtccgagttgaggttgatgttgaggctgacggggt

SEQ ID NO: 24905 - DNA, 30 bp, Homo sapiens; identical to SEQ ID NO: 15630
  misc_feature 1..30: note = chr12:8060661-8060691
  misc_feature 1..30: note = hypo
  source 1..30: mol_type = genomic DNA

SEQ ID NO: 24906 - DNA, 30 bp, Homo sapiens; identical to SEQ ID NO: 15631
  misc_feature 1..30: note = chr12:8117682-8117712
  misc_feature 1..30: note = hypo
  source 1..30: mol_type = genomic DNA

SEQ ID NO: 24907 - DNA, 118 bp, Homo sapiens; identical to SEQ ID NO: 15633
  misc_feature 1..118: note = chr12:8790007-8790125
  misc_feature 1..118: note = hypo
  source 1..118: mol_type = genomic DNA

SEQ ID NO: 24908 - DNA, 30 bp, Homo sapiens; identical to SEQ ID NO: 15634
  misc_feature 1..30: note = chr12:8799975-8800005
  misc_feature 1..30: note = hypo
  source 1..30: mol_type = genomic DNA

SEQ ID NO: 24909 - DNA, 40 bp, Homo sapiens
  misc_feature 1..40: note = chr12:8808559-8808599
  misc_feature 1..40: note = hypo
  source 1..40: mol_type = genomic DNA
tacaataatgacaaacgattgatgacttctttgcaatact

SEQ ID NO: 24910 - DNA, 181 bp, Homo sapiens; identical to SEQ ID NO: 15638
  misc_feature 1..181: note = chr12:13079830-13080011
  misc_feature 1..181: note = hypo
  source 1..181: mol_type = genomic DNA

SEQ ID NO: 24911 - DNA, 94 bp, Homo sapiens; identical to SEQ ID NO: 15639
  misc_feature 1..94: note = chr12:13215216-13215310
  misc_feature 1..94: note = hypo
  source 1..94: mol_type = genomic DNA

SEQ ID NO: 24912 - DNA, 65 bp, Homo sapiens; identical to SEQ ID NO: 15640
  misc_feature 1..65: note = chr12:17629461-17629526
  misc_feature 1..65: note = hypo
  source 1..65: mol_type = genomic DNA

SEQ ID NO: 24913 - DNA, 83 bp, Homo sapiens; identical to SEQ ID NO: 15642
  misc_feature 1..83: note = chr12:22698113-22698196
  misc_feature 1..83: note = hypo
  source 1..83: mol_type = genomic DNA

SEQ ID NO: 24914 - DNA, 77 bp, Homo sapiens; identical to SEQ ID NO: 15643
  misc_feature 1..77: note = chr12:25081492-25081569
  misc_feature 1..77: note = hypo
  source 1..77: mol_type = genomic DNA

SEQ ID NO: 24915 - DNA, 16 bp, Homo sapiens
  misc_feature 1..16: note = chr12:27489593-27489609
  misc_feature 1..16: note = hypo
  source 1..16: mol_type = genomic DNA
ttaaacctggctgggc

SEQ ID NO: 24916 - DNA, 20 bp, Homo sapiens
  misc_feature 1..20: note = chr12:30859424-30859444
  misc_feature 1..20: note = hypo
  source 1..20: mol_type = genomic DNA
acaagcgtaagccactgtac

SEQ ID NO: 24917 - DNA, 151 bp, Homo sapiens; identical to SEQ ID NO: 15647
  misc_feature 1..151: note = chr12:32597645-32597796
  misc_feature 1..151: note = hypo
  source 1..151: mol_type = genomic DNA

SEQ ID NO: 24918 - DNA, 33 bp, Homo sapiens; identical to SEQ ID NO: 15648
  misc_feature 1..33: note = chr12:32831140-32831173
  misc_feature 1..33: note = hypo
  source 1..33: mol_type = genomic DNA

SEQ ID NO: 24919 - DNA, 92 bp, Homo sapiens; identical to SEQ ID NO: 15649
  misc_feature 1..92: note = chr12:32831293-32831385
  misc_feature 1..92: note = hypo
  source 1..92: mol_type = genomic DNA

SEQ ID NO: 24920 - DNA, 38 bp, Homo sapiens
  misc_feature 1..38: note = chr12:34494918-34494956
  misc_feature 1..38: note = hypo
  source 1..38: mol_type = genomic DNA
gtcccgggtttgcactccccgagcggctggacactgcg

SEQ ID NO: 24921 - DNA, 60 bp, Homo sapiens
  misc_feature 1..60: note = chr12:34502803-34502863
  misc_feature 1..60: note = hypo
  source 1..60: mol_type = genomic DNA
gcggctgtgggcggctaccccaggggaccagctgctccgagggcgcgagcctaggaccct

SEQ ID NO: 24922 - DNA, 40 bp, Homo sapiens; identical to SEQ ID NO: 15652
  misc_feature 1..40: note = chr12:34520176-34520216
  misc_feature 1..40: note = hypo
  source 1..40: mol_type = genomic DNA

SEQ ID NO: 24923 - DNA, 94 bp, Homo sapiens; identical to SEQ ID NO: 15653
  misc_feature 1..94: note = chr12:38550728-38550822
  misc_feature 1..94: note = hypo
  source 1..94: mol_type = genomic DNA

SEQ ID NO: 24924 - DNA, 98 bp, Homo sapiens
  misc_feature 1..98: note = chr12:49657607-49657705
  misc_feature 1..98: note = hypo
  source 1..98: mol_type = genomic DNA
aagggtttaattcctcggagctctactttcctcatctgtaaactagggataataattcatagagtttgtcatatggatgaaatgtgatcatgtgatat

SEQ ID NO: 24925 - DNA, 205 bp, Homo sapiens
  misc_feature 1..205: note = chr12:51421351-51421556
  misc_feature 1..205: note = hypo
  source 1..205: mol_type = genomic DNA
gcaatcccactctatcgccagtttcagcctcacaccgtatcttttgctctgaagatgagactgccaaactggtgaagagggaataaatggcctaacaaattaccgtaattttctgcaatgtcgtttacagccaccaaaaacattagatcctcccgccaccctcactccccgacccctcgcactgcttacagcattaaaggtaatt

SEQ ID NO: 24926 - DNA, 144 bp, Homo sapiens; identical to SEQ ID NO: 15658
  misc_feature 1..144: note = chr12:53189513-53189657
  misc_feature 1..144: note = hypo
  source 1..144: mol_type = genomic DNA

SEQ ID NO: 24927 - DNA, 198 bp, Homo sapiens; identical to SEQ ID NO: 15659
  misc_feature 1..198: note = chr12:53663026-53663224
  misc_feature 1..198: note = hypo
  source 1..198: mol_type = genomic DNA

SEQ ID NO: 24928 - DNA, 71 bp, Homo sapiens
  misc_feature 1..71: note = chr12:54720232-54720303
  misc_feature 1..71: note = hypo
  source 1..71: mol_type = genomic DNA
tattgtatgatctaggatgctaatttctccctctctggttacatgagaattgtggtcgctaaagggctgta

SEQ ID NO: 24929 - DNA, 43 bp, Homo sapiens; identical to SEQ ID NO: 15661
  misc_feature 1..43: note = chr12:56441277-56441320
  misc_feature 1..43: note = hypo
  source 1..43: mol_type = genomic DNA

SEQ ID NO: 24930 - DNA, 30 bp, Homo sapiens; identical to SEQ ID NO: 15662
  misc_feature 1..30: note = chr12:57559766-57559796
  misc_feature 1..30: note = hypo
  source 1..30: mol_type = genomic DNA

SEQ ID NO: 24931 - DNA, 15 bp, Homo sapiens
  misc_feature 1..15: note = chr12:57881112-57881127
  misc_feature 1..15: note = hypo
  source 1..15: mol_type = genomic DNA
ctttgtcactaattc

SEQ ID NO: 24932 - DNA, 75 bp, Homo sapiens; identical to SEQ ID NO: 5137
  misc_feature 1..75: note = chr12:58241524-58241599
  misc_feature 1..75: note = hypo
  source 1..75: mol_type = genomic DNA

SEQ ID NO: 24933 - DNA, 19 bp, Homo sapiens
  misc_feature 1..19: note = chr12:62539074-62539093
  misc_feature 1..19: note = hypo
  source 1..19: mol_type = genomic DNA
cctcctgtcagttggcggt

SEQ ID NO: 24934 - DNA, 22 bp, Homo sapiens
  misc_feature 1..22: note = chr12:62563354-62563376
  misc_feature 1..22: note = hypo
  source 1..22: mol_type = genomic DNA
gggcacagtggctcacgcctgt

SEQ ID NO: 24935 - DNA, 26 bp, Homo sapiens
  misc_feature 1..26: note = chr12:64783308-64783334
  misc_feature 1..26: note = hypo
  source 1..26: mol_type = genomic DNA
tctgtagctcaggctggagtgcaggt

SEQ ID NO: 24936 - DNA, 23 bp, Homo sapiens
  misc_feature 1..23: note = chr12:64797450-64797473
  misc_feature 1..23: note = hypo
  source 1..23: mol_type = genomic DNA
aaataaattttggaccggacacc

SEQ ID NO: 24937 - DNA, 75 bp, Homo sapiens
  misc_feature 1..75: note = chr12:65516455-65516530
  misc_feature 1..75: note = hypo
  source 1..75: mol_type = genomic DNA
gcataacctatccacctggcccagcagaaagaactgatttttgcctcctgcctaattcctcggatgcacaaagaa

SEQ ID NO: 24938 - DNA, 38 bp, Homo sapiens; identical to SEQ ID NO: 15671
  misc_feature 1..38: note = chr12:66208320-66208358
  misc_feature 1..38: note = hypo
  source 1..38: mol_type = genomic DNA

SEQ ID NO: 24939 - DNA, 29 bp, Homo sapiens
  misc_feature 1..29: note = chr12:68978592-68978621
  misc_feature 1..29: note = hypo
  source 1..29: mol_type = genomic DNA
aaaagctttttttccgttttcactagaaa

SEQ ID NO: 24940 - DNA, 26 bp, Homo sapiens
  misc_feature 1..26: note = chr12:69964264-69964290
  misc_feature 1..26: note = hypo
  source 1..26: mol_type = genomic DNA
ttgaaagtggtcgaaggtgtcaaact

SEQ ID NO: 24941 - DNA, 106 bp, Homo sapiens
  misc_feature 1..106: note = chr12:70087568-70087674
  misc_feature 1..106: note = hypo
  source 1..106: mol_type = genomic DNA
gcgcccgtgctcgtcgcttccgtgaacactgctagagatgaggaacattagcctgtctggccagggcaaattcacaaactggttccaccatcggttcactaccaga

SEQ ID NO: 24942 - DNA, 25 bp, Homo sapiens
  misc_feature 1..25: note = chr12:74930406-74930431
  misc_feature 1..25: note = hypo
  source 1..25: mol_type = genomic DNA
catgtaaggcactgtcgcaagattt

SEQ ID NO: 24943 - DNA, 30 bp, Homo sapiens; identical to SEQ ID NO: 15677
  misc_feature 1..30: note = chr12:77150018-77150048
  misc_feature 1..30: note = hypo
  source 1..30: mol_type = genomic DNA

SEQ ID NO: 24944 - DNA, 30 bp, Homo sapiens; identical to SEQ ID NO: 15678
  misc_feature 1..30: note = chr12:94641622-94641652
  misc_feature 1..30: note = hypo
  source 1..30: mol_type = genomic DNA

SEQ ID NO: 24945 - DNA, 81 bp, Homo sapiens; identical to SEQ ID NO: 15679
  misc_feature 1..81: note = chr12:95465839-95465920
  misc_feature 1..81: note = hypo
  source 1..81: mol_type = genomic DNA

SEQ ID NO: 24946 - skipped

SEQ ID NO: 24947 - DNA, 42 bp, Homo sapiens; identical to SEQ ID NO: 15681
  misc_feature 1..42: note = chr12:98948376-98948418
  misc_feature 1..42: note = hypo
  source 1..42: mol_type = genomic DNA

SEQ ID NO: 24948 - DNA, 30 bp, Homo sapiens; identical to SEQ ID NO: 15682
  misc_feature 1..30: note = chr12:104690709-104690739
  misc_feature 1..30: note = hypo
  source 1..30: mol_type = genomic DNA

SEQ ID NO: 24949 - DNA, 36 bp, Homo sapiens
  misc_feature 1..36: note = chr12:110717710-110717746
  misc_feature 1..36: note = hypo
  source 1..36: mol_type = genomic DNA
taattttttgtttgtttgtttcgtgtagggttttgt

SEQ ID NO: 24950 - DNA, 30 bp, Homo sapiens; identical to SEQ ID NO: 15684
  misc_feature 1..30: note = chr12:110782730-110782760
  misc_feature 1..30: note = hypo
  source 1..30: mol_type = genomic DNA

SEQ ID NO: 24951 - DNA, 41 bp, Homo sapiens; identical to SEQ ID NO: 15685
  misc_feature 1..41: note = chr12:110908130-110908171
  misc_feature 1..41: note = hypo
  source 1..41: mol_type = genomic DNA

SEQ ID NO: 24952 - DNA, 30 bp, Homo sapiens; identical to SEQ ID NO: 15686
  misc_feature 1..30: note = chr12:111296630-111296660
  misc_feature 1..30: note = hypo
  source 1..30: mol_type = genomic DNA

SEQ ID NO: 24953 - DNA, 30 bp, Homo sapiens; identical to SEQ ID NO: 15687
  misc_feature 1..30: note = chr12:111369069-111369099
  misc_feature 1..30: note = hypo
  source 1..30: mol_type = genomic DNA

SEQ ID NO: 24954 - DNA, 30 bp, Homo sapiens; identical to SEQ ID NO: 15688
  misc_feature 1..30: note = chr12:112628549-112628579
  misc_feature 1..30: note = hypo
  source 1..30: mol_type = genomic DNA

SEQ ID NO: 24955 - DNA, 16 bp, Homo sapiens
  misc_feature 1..16: note = chr12:112826001-112826017
  misc_feature 1..16: note = hypo
  source 1..16: mol_type = genomic DNA
acgagtccatctcaaa

SEQ ID NO: 24956 - DNA, 30 bp, Homo sapiens; identical to SEQ ID NO: 15690
  misc_feature 1..30: note = chr12:112919571-112919601
  misc_feature 1..30: note = hypo
  source 1..30: mol_type = genomic DNA

SEQ ID NO: 24957 - DNA, 30 bp, Homo sapiens; identical to SEQ ID NO: 15691
  misc_feature 1..30: note = chr12:114240315-114240345
  misc_feature 1..30: note = hypo
  source 1..30: mol_type = genomic DNA

SEQ ID NO: 24958 - DNA, 30 bp, Homo sapiens; identical to SEQ ID NO: 15692
  misc_feature 1..30: note = chr12:117474645-117474675
  misc_feature 1..30: note = hypo
  source 1..30: mol_type = genomic DNA

SEQ ID NO: 24959 - DNA, 108 bp, Homo sapiens; identical to SEQ ID NO: 15693
  misc_feature 1..108: note = chr12:117530039-117530147
  misc_feature 1..108: note = hypo
  source 1..108: mol_type = genomic DNA

SEQ ID NO: 24960 - DNA, 39 bp, Homo sapiens; identical to SEQ ID NO: 15694
  misc_feature 1..39: note = chr12:117531034-117531073
  misc_feature 1..39: note = hypo
  source 1..39: mol_type = genomic DNA

SEQ ID NO: 24961 - DNA, 25 bp, Homo sapiens
  misc_feature 1..25: note = chr12:117532499-117532524
  misc_feature 1..25: note = hypo
  source 1..25: mol_type = genomic DNA
acaataatgagcattcgtttcataa

SEQ ID NO: 24962 - DNA, 30 bp, Homo sapiens; identical to SEQ ID NO: 15696
  misc_feature 1..30: note = chr12:118198752-118198782
  misc_feature 1..30: note = hypo
  source 1..30: mol_type = genomic DNA

SEQ ID NO: 24963 - DNA, 30 bp, Homo sapiens; identical to SEQ ID NO: 15698
  misc_feature 1..30: note = chr12:120148366-120148396
  misc_feature 1..30: note = hypo
  source 1..30: mol_type = genomic DNA

SEQ ID NO: 24964 - DNA, 30 bp, Homo sapiens; identical to SEQ ID NO: 15699
  misc_feature 1..30: note = chr12:120574326-120574356
  misc_feature 1..30: note = hypo
  source 1..30: mol_type = genomic DNA

SEQ ID NO: 24965 - DNA, 46 bp, Homo sapiens; identical to SEQ ID NO: 15700
  misc_feature 1..46: note = chr12:122141060-122141106
  misc_feature 1..46: note = hypo
  source 1..46: mol_type = genomic DNA

SEQ ID NO: 24966 - DNA, 40 bp, Homo sapiens
  misc_feature 1..40: note = chr12:122285027-122285067
  misc_feature 1..40: note = hypo
  source 1..40: mol_type = genomic DNA
gccaccacaatggatcgcagagagctatattccgtgtgca

SEQ ID NO: 24967 - DNA, 30 bp, Homo sapiens; identical to SEQ ID NO: 15703
  misc_feature 1..30: note = chr12:122292767-122292797
  misc_feature 1..30: note = hypo
  source 1..30: mol_type = genomic DNA

SEQ ID NO: 24968 - DNA, 45 bp, Homo sapiens; identical to SEQ ID NO: 15704
  misc_feature 1..45: note = chr12:122439448-122439493
  misc_feature 1..45: note = hypo
  source 1..45: mol_type = genomic DNA

SEQ ID NO: 24969 - DNA, 30 bp, Homo sapiens; identical to SEQ ID NO: 15705
  misc_feature 1..30: note = chr12:122458643-122458673
  misc_feature 1..30: note = hypo
  source 1..30: mol_type = genomic DNA

SEQ ID NO: 24970 - DNA, 30 bp, Homo sapiens; identical to SEQ ID NO: 15706
  misc_feature 1..30: note = chr12:122602863-122602893
  misc_feature 1..30: note = hypo
  source 1..30: mol_type = genomic DNA

SEQ ID NO: 24971 - DNA, 30 bp, Homo sapiens; identical to SEQ ID NO: 15707
  misc_feature 1..30: note = chr12:122622042-122622072
  misc_feature 1..30: note = hypo
  source 1..30: mol_type = genomic DNA

SEQ ID NO: 24972 - DNA, 30 bp, Homo sapiens; identical to SEQ ID NO: 15708
  misc_feature 1..30: note = chr12:122622344-122622374
  misc_feature 1..30: note = hypo
  source 1..30: mol_type = genomic DNA

SEQ ID NO: 24973 - DNA, 30 bp, Homo sapiens; identical to SEQ ID NO: 15710
  misc_feature 1..30: note = chr12:124404180-124404210
  misc_feature 1..30: note = hypo
  source 1..30: mol_type = genomic DNA

SEQ ID NO: 24974 - DNA, 173 bp, Homo sapiens; identical to SEQ ID NO: 15711
  misc_feature 1..173: note = chr12:124778198-124778371
  misc_feature 1..173: note = hypo
  source 1..173: mol_type = genomic DNA

SEQ ID NO: 24975 - DNA, 30 bp, Homo sapiens; identical to SEQ ID NO: 15712
  misc_feature 1..30: note = chr12:124843833-124843863
  misc_feature 1..30: note = hypo
  source 1..30: mol_type = genomic DNA

SEQ ID NO: 24976 - DNA, 46 bp, Homo sapiens; identical to SEQ ID NO: 15713
  misc_feature 1..46: note = chr12:124893479-124893525
  misc_feature 1..46: note = hypo
  source 1..46: mol_type = genomic DNA

SEQ ID NO: 24977 - DNA, 54 bp, Homo sapiens; identical to SEQ ID NO: 15714
  misc_feature 1..54: note = chr12:125009346-125009400
  misc_feature 1..54: note = hypo
  source 1..54: mol_type = genomic DNA

SEQ ID NO: 24978 - DNA, 41 bp, Homo sapiens; identical to SEQ ID NO: 15715
  misc_feature 1..41: note = chr12:125092426-125092467
  misc_feature 1..41: note = hypo
  source 1..41: mol_type = genomic DNA

SEQ ID NO: 24979 - DNA, 33 bp, Homo sapiens; identical to SEQ ID NO: 15716
  misc_feature 1..33: note = chr12:125102143-125102176
  misc_feature 1..33: note = hypo
  source 1..33: mol_type = genomic DNA

SEQ ID NO: 24980 - DNA, 30 bp, Homo sapiens; identical to SEQ ID NO: 15717
  misc_feature 1..30: note = chr12:125119323-125119353
  misc_feature 1..30: note = hypo
  source 1..30: mol_type = genomic DNA

SEQ ID NO: 24981 - DNA, 59 bp, Homo sapiens; identical to SEQ ID NO: 15718
  misc_feature 1..59: note = chr12:125152108-125152167
  misc_feature 1..59: note = hypo
  source 1..59: mol_type = genomic DNA

SEQ ID NO: 24982 - DNA, 30 bp, Homo sapiens; identical to SEQ ID NO: 15719
  misc_feature 1..30: note = chr12:125167715-125167745
  misc_feature 1..30: note = hypo
  source 1..30: mol_type = genomic DNA

SEQ ID NO: 24983 - DNA, 27 bp, Homo sapiens
  misc_feature 1..27: note = chr12:126243097-126243124
  misc_feature 1..27: note = hypo
  source 1..27: mol_type = genomic DNA
catgagccaccgcgcccggctgatgat

SEQ ID NO: 24984 - DNA, 35 bp, Homo sapiens; identical to SEQ ID NO: 15721
  misc_feature 1..35: note = chr12:128311016-128311051
  misc_feature 1..35: note = hypo
  source 1..35: mol_type = genomic DNA

SEQ ID NO: 24985 - DNA, 122 bp, Homo sapiens; identical to SEQ ID NO: 15722
  misc_feature 1..122: note = chr12:128899719-128899841
  misc_feature 1..122: note = hypo
  source 1..122: mol_type = genomic DNA

SEQ ID NO: 24986 - DNA, 51 bp, Homo sapiens
  misc_feature 1..51: note = chr12:130821621-130821672
  misc_feature 1..51: note = hypo
  source 1..51: mol_type = genomic DNA
aaggcacaagtcattgaaagctaaatttccaggtaacggcctcctggcacc

SEQ ID NO: 24987 - DNA, 30 bp, Homo sapiens; identical to SEQ ID NO: 15724
  misc_feature 1..30: note = chr12:130920621-130920651
  misc_feature 1..30: note = hypo
  source 1..30: mol_type = genomic DNA

SEQ ID NO: 24988 - DNA, 36 bp, Homo sapiens; identical to SEQ ID NO: 15725
  misc_feature 1..36: note = chr12:131268446-131268482
  misc_feature 1..36: note = hypo
  source 1..36: mol_type = genomic DNA

SEQ ID NO: 24989 - DNA, 30 bp, Homo sapiens; identical to SEQ ID NO: 15726
  misc_feature 1..30: note = chr12:131433415-131433445
  misc_feature 1..30: note = hypo
  source 1..30: mol_type = genomic DNA

SEQ ID NO: 24990 - DNA, 27 bp, Homo sapiens
  misc_feature 1..27: note = chr12:131547329-131547356
  misc_feature 1..27: note = hypo
  source 1..27: mol_type = genomic DNA
atacaagggtcacgtggtaaatatatt

SEQ ID NO: 24991 - DNA, 177 bp, Homo sapiens; identical to SEQ ID NO: 15728
  misc_feature 1..177: note = chr12:132044061-132044238
  misc_feature 1..177: note = hypo
  source 1..177: mol_type = genomic DNA

SEQ ID NO: 24992 - DNA, 30 bp, Homo sapiens; identical to SEQ ID NO: 15729
  misc_feature 1..30: note = chr12:132168275-132168305
  misc_feature 1..30: note = hypo
  source 1..30: mol_type = genomic DNA

SEQ ID NO: 24993 - DNA, 87 bp, Homo sapiens
  misc_feature 1..87: note = chr12:132221602-132221689
  misc_feature 1..87: note = hypo
  source 1..87: mol_type = genomic DNA
agcaaaagactgaggcgacgcacatcctcggtggaggactaatggagtccctctggtgtgctctcgcggtgggctgcagagctctgg

SEQ ID NO: 24994 - DNA, 48 bp, Homo sapiens
  misc_feature 1..48: note = chr12:132222076-132222124
  misc_feature 1..48: note = hypo
  source 1..48: mol_type = genomic DNA
ttgtttcatcagctcagtgtgtttttgtttaggcggaagtggcccccg

SEQ ID NO: 24995 - DNA, 30 bp, Homo sapiens; identical to SEQ ID NO: 15731
  misc_feature 1..30: note = chr12:132240239-132240269
  misc_feature 1..30: note = hypo
  source 1..30: mol_type = genomic DNA

SEQ ID NO: 24996 - DNA, 133 bp, Homo sapiens; identical to SEQ ID NO: 15732
  misc_feature 1..133: note = chr12:132280877-132281010
  misc_feature 1..133: note = hypo
  source 1..133: mol_type = genomic DNA

SEQ ID NO: 24997 - DNA, 30 bp, Homo sapiens; identical to SEQ ID NO: 15733
  misc_feature 1..30: note = chr12:132284463-132284493
  misc_feature 1..30: note = hypo
  source 1..30: mol_type = genomic DNA

SEQ ID NO: 24998 - DNA, 118 bp, Homo sapiens; identical to SEQ ID NO: 15734
  misc_feature 1..118: note = chr12:132329877-132329995
  misc_feature 1..118: note = hypo
  source 1..118: mol_type = genomic DNA

SEQ ID NO: 24999 - DNA, 22 bp, Homo sapiens
  misc_feature 1..22: note = chr12:132333412-132333434
  misc_feature 1..22: note = hypo
  source 1..22: mol_type = genomic DNA
gcgtgagtgtgcaaacgtctct

SEQ ID NO: 25000 - DNA, 52 bp, Homo sapiens; identical to SEQ ID NO: 15736
  misc_feature 1..52: note = chr12:132377978-132378030
  misc_feature 1..52: note = hypo
  source 1..52: mol_type = genomic DNA

SEQ ID NO: 25001 - DNA, 130 bp, Homo sapiens; identical to SEQ ID NO: 15738
  misc_feature 1..130: note = chr12:132617233-132617363
  misc_feature 1..130: note = hypo
  source 1..130: mol_type = genomic DNA

SEQ ID NO: 25002 - DNA, 67 bp, Homo sapiens; identical to SEQ ID NO: 15739
  misc_feature 1..67: note = chr12:132643941-132644008
  misc_feature 1..67: note = hypo
  source 1..67: mol_type = genomic DNA

SEQ ID NO: 25003 - DNA, 48 bp, Homo sapiens; identical to SEQ ID NO: 15740
  misc_feature 1..48: note = chr12:132682618-132682666
  misc_feature 1..48: note = hypo
  source 1..48: mol_type = genomic DNA

SEQ ID NO: 25004 - DNA, 30 bp, Homo sapiens; identical to SEQ ID NO: 15741
  misc_feature 1..30: note = chr12:132688204-132688234
  misc_feature 1..30: note = hypo
  source 1..30: mol_type = genomic DNA

SEQ ID NO: 25005 - DNA, 30 bp, Homo sapiens
  misc_feature 1..30: note = chr12:132986465-132986495
  misc_feature 1..30: note = hypo
  source 1..30: mol_type = genomic DNA
ccgtcctgtgggtgacggcagaacatctgg

SEQ ID NO: 25006 - DNA, 58 bp, Homo sapiens
  misc_feature 1..58: note = chr12:132986581-132986639
  misc_feature 1..58: note = hypo
  source 1..58: mol_type = genomic DNA
agggagcggagccgggaaggccacggacatctgtgtggtgtcacgaacaaggtccggc

SEQ ID NO: 25007 - DNA, 30 bp, Homo sapiens; identical to SEQ ID NO: 15744
  misc_feature 1..30: note = chr12:133100990-133101020
  misc_feature 1..30: note = hypo
  source 1..30: mol_type = genomic DNA

SEQ ID NO: 25008 - DNA, 30 bp, Homo sapiens; identical to SEQ ID NO: 15745
  misc_feature 1..30: note = chr12:133122176-133122206
  misc_feature 1..30: note = hypo
  source 1..30: mol_type = genomic DNA

SEQ ID NO: 25009 - DNA, 30 bp, Homo sapiens; identical to SEQ ID NO: 15746
  misc_feature 1..30: note = chr12:133169847-133169877
  misc_feature 1..30: note = hypo
  source 1..30: mol_type = genomic DNA

SEQ ID NO: 25010 - DNA, 102 bp, Homo sapiens; identical to SEQ ID NO: 15747
  misc_feature 1..102: note = chr12:133188357-133188459
  misc_feature 1..102: note = hypo
  source 1..102: mol_type = genomic DNA

SEQ ID NO: 25011 - DNA, 30 bp, Homo sapiens; identical to SEQ ID NO: 15748
  misc_feature 1..30: note = chr12:133200007-133200037
  misc_feature 1..30: note = hypo
  source 1..30: mol_type = genomic DNA

SEQ ID NO: 25012 - DNA, 30 bp, Homo sapiens; identical to SEQ ID NO: 15749
  misc_feature 1..30: note = chr12:133705743-133705773
  misc_feature 1..30: note = hypo
  source 1..30: mol_type = genomic DNA

SEQ ID NO: 25013 - DNA, 82 bp, Homo sapiens; identical to SEQ ID NO: 15750
  misc_feature 1..82: note = chr13:19517769-19517851
  misc_feature 1..82: note = hypo
  source 1..82: mol_type = genomic DNA

SEQ ID NO: 25014 - DNA, 81 bp, Homo sapiens; identical to SEQ ID NO: 15751
  misc_feature 1..81: note = chr13:20078191-20078272
  misc_feature 1..81: note = hypo
  source 1..81: mol_type = genomic DNA

SEQ ID NO: 25015 - DNA, 15 bp, Homo sapiens
  misc_feature 1..15: note = chr13:20692250-20692265
  misc_feature 1..15: note = hypo
  source 1..15: mol_type = genomic DNA
cgtgagccactgcgc

SEQ ID NO: 25016 - DNA, 71 bp, Homo sapiens; identical to SEQ ID NO: 15753
  misc_feature 1..71: note = chr13:25670585-25670656
  misc_feature 1..71: note = hypo
  source 1..71: mol_type = genomic DNA

SEQ ID NO: 25017 - DNA, 23 bp, Homo sapiens
  misc_feature 1..23: note = chr13:30149065-30149088
  misc_feature 1..23: note = hypo
  source 1..23: mol_type = genomic DNA
ccaccgtgcgtggccagagcagc

SEQ ID NO: 25018 - DNA, 94 bp, Homo sapiens; identical to SEQ ID NO: 15756
  misc_feature 1..94: note = chr13:30707267-30707361
  misc_feature 1..94: note = hypo
  source 1..94: mol_type = genomic DNA

SEQ ID NO: 25019 - DNA, 30 bp, Homo sapiens; identical to SEQ ID NO: 15757
  misc_feature 1..30: note = chr13:30761001-30761031
  misc_feature 1..30: note = hypo
  source 1..30: mol_type = genomic DNA

SEQ ID NO: 25020 - DNA, 33 bp, Homo sapiens; identical to SEQ ID NO: 15758
  misc_feature 1..33: note = chr13:31742917-31742950
  misc_feature 1..33: note = hypo
  source 1..33: mol_type = genomic DNA

SEQ ID NO: 25021 - DNA, 203 bp, Homo sapiens
  misc_feature 1..203: note = chr13:37643739-37643942
  misc_feature 1..203: note = hypo
  source 1..203: mol_type = genomic DNA
acccgaccctaggcccggagctttcatcactcgggactctggccccacactgctgctctcacccacgcactgctgctgtggggagggcgtggggaggaggcggagctgggcccggggctgtgccacgcttcacgcttcacggaaccagcgggagccaaggacaagcaggagccgccccgcagccccttgggggccgccgctat

SEQ ID NO: 25022 - DNA, 53 bp, Homo sapiens; identical to SEQ ID NO: 15760
  misc_feature 1..53: note = chr13:41681520-41681573
  misc_feature 1..53: note = hypo
  source 1..53: mol_type = genomic DNA

SEQ ID NO: 25023 - DNA, 30 bp, Homo sapiens; identical to SEQ ID NO: 15761
  misc_feature 1..30: note = chr13:45564773-45564803
  misc_feature 1..30: note = hypo
  source 1..30: mol_type = genomic DNA

SEQ ID NO: 25024 - DNA, 30 bp, Homo sapiens; identical to SEQ ID NO: 15763
  misc_feature 1..30: note = chr13:46659310-46659340
  misc_feature 1..30: note = hypo
  source 1..30: mol_type = genomic DNA

SEQ ID NO: 25025 - DNA, 30 bp, Homo sapiens; identical to SEQ ID NO: 15764
  misc_feature 1..30: note = chr13:46661314-46661344
  misc_feature 1..30: note = hypo
  source 1..30: mol_type = genomic DNA

SEQ ID NO: 25026 - DNA, 172 bp, Homo sapiens; identical to SEQ ID NO: 15765
  misc_feature 1..172: note = chr13:46920144-46920316
  misc_feature 1..172: note = hypo
  source 1..172: mol_type = genomic DNA

SEQ ID NO: 25027 - DNA, 35 bp, Homo sapiens; identical to SEQ ID NO: 15767
  misc_feature 1..35: note = chr13:49923030-49923065
  misc_feature 1..35: note = hypo
  source 1..35: mol_type = genomic DNA

SEQ ID NO: 25028 - DNA, 24 bp, Homo sapiens
  misc_feature 1..24: note = chr13:50367862-50367886
  misc_feature 1..24: note = hypo
  source 1..24: mol_type = genomic DNA
gggtgtggtggctcacgcctgtaa

SEQ ID NO: 25029 - DNA, 81 bp, Homo sapiens; identical to SEQ ID NO: 15770
  misc_feature 1..81: note = chr13:100356871-100356952
  misc_feature 1..81: note = hypo
  source 1..81: mol_type = genomic DNA

SEQ ID NO: 25030 - DNA, 23 bp, Homo sapiens
  misc_feature 1..23: note = chr13:103569159-103569182
  misc_feature 1..23: note = hypo
  source 1..23: mol_type = genomic DNA
accgcgcccggccgtcccccgtt

SEQ ID NO: 25031 - DNA, 27 bp, Homo sapiens
  misc_feature 1..27: note = chr13:110434424-110434451
  misc_feature 1..27: note = hypo
  source 1..27: mol_type = genomic DNA
agaagtcaatgctggcgtaggtgttgg

SEQ ID NO: 25032 - DNA, 293 bp, Homo sapiens
  misc_feature 1..293: note = chr13:110434593-110434886
  misc_feature 1..293: note = hypo
  source 1..293: mol_type = genomic DNA
ctgcggctggggtggcagcccgggctcctccctcacgtcgatggcgatgtagttgagaccattctggaagccggcagaggtctctctgcgcatgggcgatccaccgctcccaggacaaccgaccaagcccccgggctgacccggggtccacggccggccctgcggtgccaaagggggcgccggctgcaactgtcgtggggaggtgggcggctcgtcgccccctccagggccgacacccacgccgccctcgctgcttttcctgagagagacattttccacggaggccgagttgt

SEQ ID NO: 25033 - DNA, 251 bp, Homo sapiens; identical to SEQ ID NO: 15773
  misc_feature 1..251: note = chr13:110435933-110436184
  misc_feature 1..251: note = hypo
  source 1..251: mol_type = genomic DNA

SEQ ID NO: 25034 - DNA, 34 bp, Homo sapiens; identical to SEQ ID NO: 15774
  misc_feature 1..34: note = chr13:110436410-110436444
  misc_feature 1..34: note = hypo
  source 1..34: mol_type = genomic DNA

SEQ ID NO: 25035 - DNA, 40 bp, Homo sapiens; identical to SEQ ID NO: 15775
  misc_feature 1..40: note = chr13:111277585-111277625
  misc_feature 1..40: note = hypo
  source 1..40: mol_type = genomic DNA

SEQ ID NO: 25036 - DNA, 56 bp, Homo sapiens; identical to SEQ ID NO: 15777
  misc_feature 1..56: note = chr13:111289222-111289278
  misc_feature 1..56: note = hypo
  source 1..56: mol_type = genomic DNA

SEQ ID NO: 25037 - DNA, 30 bp, Homo sapiens; identical to SEQ ID NO: 15778
  misc_feature 1..30: note = chr13:111978886-111978916
  misc_feature 1..30: note = hypo
  source 1..30: mol_type = genomic DNA

SEQ ID NO: 25038 - DNA, 45 bp, Homo sapiens; identical to SEQ ID NO: 15779
  misc_feature 1..45: note = chr13:113107030-113107075
  misc_feature 1..45: note = hypo
  source 1..45: mol_type = genomic DNA

SEQ ID NO: 25039 - DNA, 30 bp, Homo sapiens; identical to SEQ ID NO: 15780
  misc_feature 1..30: note = chr13:113400400-113400430
  misc_feature 1..30: note = hypo
  source 1..30: mol_type = genomic DNA

SEQ ID NO: 25040 - DNA, 55 bp, Homo sapiens
  misc_feature 1..55: note = chr13:113598563-113598618
  misc_feature 1..55: note = hypo
  source 1..55: mol_type = genomic DNA
atgaagggagggtcccgggtgaagagcaagctcatgaccctcatttactgggaat

SEQ ID NO: 25041 - DNA, 30 bp, Homo sapiens; identical to SEQ ID NO: 15782
  misc_feature 1..30: note = chr13:113776004-113776034
  misc_feature 1..30: note = hypo
  source 1..30: mol_type = genomic DNA

SEQ ID NO: 25042 - DNA, 25 bp, Homo sapiens
  misc_feature 1..25: note = chr13:114055958-114055983
  misc_feature 1..25: note = hypo
  source 1..25: mol_type = genomic DNA
gggagctgtggggaccggcccccca

SEQ ID NO: 25043 - DNA, 194 bp, Homo sapiens
  misc_feature 1..194: note = chr13:114074574-114074768
  misc_feature 1..194: note = hypo
  source 1..194: mol_type = genomic DNA
gccagcttttgtttacgatgcttgtggattttgtgtttgtgtgttttaatctataatcagtttgtaaatagactcactttctgattctcacggaggggtttgatttgcggatggagaccgagtccaccctgtttgaatgcagccgcgccctgctcatgcgagctggccttctcttccatacagcagggtggaga

SEQ ID NO: 25044 - DNA, 296 bp, Homo sapiens
  misc_feature 1..296: note = chr13:114074853-114075149
  misc_feature 1..296: note = hypo
  source 1..296: mol_type = genomic DNA
gggtttcttttcctgaaaggtaattctcagttaatttccccacacccacgggtgctgggaccacactccatggacgtgtgtgacgtgaggcccttcgcccccgtgtgcctgtctctctggttcttctgacttaaagcaccagtagcagcacagttagtccagttattcggaagctcagcacggagccacattgctgcagcatagaaggccacggattcctccatcagcatggactacacttcccacaaaacgaacggggcatctctatggaaaaagcaaagcgtgtccctatccct

SEQ ID NO: 25045 - DNA, 43 bp, Homo sapiens; identical to SEQ ID NO: 15787
  misc_feature 1..43: note = chr13:114122929-114122972
  misc_feature 1..43: note = hypo
  source 1..43: mol_type = genomic DNA

SEQ ID NO: 25046 - DNA, 86 bp, Homo sapiens; identical to SEQ ID NO: 15788
  misc_feature 1..86: note = chr13:114188403-114188489
  misc_feature 1..86: note = hypo
  source 1..86: mol_type = genomic DNA

SEQ ID NO: 25047 - skipped

SEQ ID NO: 25048 - DNA, 30 bp, Homo sapiens; identical to SEQ ID NO: 15790
  misc_feature 1..30: note = chr13:114271940-114271970
  misc_feature 1..30: note = hypo
  source 1..30: mol_type = genomic DNA

SEQ ID NO: 25049 - DNA, 158 bp, Homo sapiens
  misc_feature 1..158: note = chr13:114497859-114498017
  misc_feature 1..158: note = hypo
  source 1..158: mol_type = genomic DNA
cgcgtgccgagggcccggggatggcaacgcccttccgtgcagaaggcgcctgggtgggtcttgcggaatagacgcgtgaggacgacccgcagggtggagtccggcctggccagggctggaagtcataggacgaaaggtagaggtgagaagaggcagtt

SEQ ID NO: 25050 - DNA, 106 bp, Homo sapiens; identical to SEQ ID NO: 15793
  misc_feature 1..106: note = chr13:114526504-114526610
  misc_feature 1..106: note = hypo
  source 1..106: mol_type = genomic DNA

SEQ ID NO: 25051 - DNA, 30 bp, Homo sapiens; identical to SEQ ID NO: 15794
  misc_feature 1..30: note = chr13:114746822-114746852
  misc_feature 1..30: note = hypo
  source 1..30: mol_type = genomic DNA

SEQ ID NO: 25052 - DNA, 26 bp, Homo sapiens
  misc_feature 1..26: note = chr13:114748638-114748664
  misc_feature 1..26: note = hypo
  source 1..26: mol_type = genomic DNA
ggccgggacggcgtgcatctcacttt

SEQ ID NO: 25053 - DNA, 30 bp, Homo sapiens; identical to SEQ ID NO: 15796
  misc_feature 1..30: note = chr13:114749034-114749064
  misc_feature 1..30: note = hypo
  source 1..30: mol_type = genomic DNA

SEQ ID NO: 25054 - DNA, 44 bp, Homo sapiens; identical to SEQ ID NO: 15797
  misc_feature 1..44: note = chr13:114760951-114760995
  misc_feature 1..44: note = hypo
  source 1..44: mol_type = genomic DNA

SEQ ID NO: 25055 - DNA, 38 bp, Homo sapiens; identical to SEQ ID NO: 15798
  misc_feature 1..38: note = chr13:114765164-114765202
  misc_feature 1..38: note = hypo
  source 1..38: mol_type = genomic DNA

SEQ ID NO: 25056 - DNA, 184 bp, Homo sapiens; identical to SEQ ID NO: 15799
  misc_feature 1..184: note = chr13:114769986-114770170
  misc_feature 1..184: note = hypo
  source 1..184: mol_type = genomic DNA

SEQ ID NO: 25057 - DNA, 30 bp, Homo sapiens; identical to SEQ ID NO: 15800
  misc_feature 1..30: note = chr13:114771035-114771065
  misc_feature 1..30: note = hypo
  source 1..30: mol_type = genomic DNA

SEQ ID NO: 25058 - skipped

SEQ ID NO: 25059 - DNA, 22 bp, Homo sapiens
  misc_feature 1..22: note = chr13:114781061-114781083
  misc_feature 1..22: note = hypo
  source 1..22: mol_type = genomic DNA
gaatggacgttcactagaatgt

SEQ ID NO: 25060 - DNA, 32 bp, Homo sapiens
  misc_feature 1..32: note = chr13:114807815-114807847
  misc_feature 1..32: note = hypo
  source 1..32: mol_type = genomic DNA
ctctgttgaccgatgcacgtgaactcctaggg

SEQ ID NO: 25061 - DNA, 18 bp, Homo sapiens
  misc_feature 1..18: note = chr13:114812180-114812198
  misc_feature 1..18: note = hypo
  source 1..18: mol_type = genomic DNA
gtccgagccctgccttca

SEQ ID NO: 25062 - DNA, 152 bp, Homo sapiens
  misc_feature 1..152: note = chr13:114855483-114855635
  misc_feature 1..152: note = hypo
  source 1..152: mol_type = genomic DNA
atgtcacggatggaacgcattctgtgtatttgttaatcactgatggatgtttgggctgttcccagctttcagttgttgtgaatggtgccgctgtgaagtgtgcacaagttcccatgtgaacacggacagctttgggattctcttgattattt

SEQ ID NO: 25063 - DNA, 50 bp, Homo sapiens
  misc_feature 1..50: note = chr13:114961773-114961823
  misc_feature 1..50: note = hypo
  source 1..50: mol_type = genomic DNA
gaatccctggtgccacgaaagaccccagagcagcacaatctgagctcact

SEQ ID NO: 25064 - DNA, 18 bp, Homo sapiens
  misc_feature 1..18: note = chr14:21289138-21289156
  misc_feature 1..18: note = hypo
  source 1..18: mol_type = genomic DNA
agcactttgagaggccga

SEQ ID NO: 25065 - DNA, 121 bp, Homo sapiens; identical to SEQ ID NO: 15807
  misc_feature 1..121: note = chr14:23707517-23707638
  misc_feature 1..121: note = hypo
  source 1..121: mol_type = genomic DNA

SEQ ID NO: 25066 - DNA, 198 bp, Homo sapiens; identical to SEQ ID NO: 5150
  misc_feature 1..198: note = chr14:23776958-23777156
  misc_feature 1..198: note = hypo
  source 1..198: mol_type = genomic DNA

SEQ ID NO: 25067 - DNA, 153 bp, Homo sapiens; identical to SEQ ID NO: 15809
  misc_feature 1..153: note = chr14:24862082-24862235
  misc_feature 1..153: note = hypo
  source 1..153: mol_type = genomic DNA

SEQ ID NO: 25068 - DNA, 37 bp, Homo sapiens; identical to SEQ ID NO: 5151
  misc_feature 1..37: note = chr14:31027390-31027427
  misc_feature 1..37: note = hypo
  source 1..37: mol_type = genomic DNA

SEQ ID NO: 25069 - DNA, 38 bp, Homo sapiens; identical to SEQ ID NO: 15811
  misc_feature 1..38: note = chr14:32597741-32597779
  misc_feature 1..38: note = hypo
  source 1..38: mol_type = genomic DNA

SEQ ID NO: 25070 - DNA, 45 bp, Homo sapiens; identical to SEQ ID NO: 15812
  misc_feature 1..45: note = chr14:34921211-34921256
  misc_feature 1..45: note = hypo
  source 1..45: mol_type = genomic DNA

SEQ ID NO: 25071 - DNA, 35 bp, Homo sapiens; identical to SEQ ID NO: 15814
  misc_feature 1..35: note = chr14:35507705-35507740
  misc_feature 1..35: note = hypo
  source 1..35: mol_type = genomic DNA

SEQ ID NO: 25072 - DNA, 30 bp, Homo sapiens; identical to SEQ ID NO: 15815
  misc_feature 1..30: note = chr14:35866882-35866912
  misc_feature 1..30: note = hypo
  source 1..30: mol_type = genomic DNA

SEQ ID NO: 25073 - DNA, 30 bp, Homo sapiens; identical to SEQ ID NO: 15816
  misc_feature 1..30: note = chr14:50098049-50098079
  misc_feature 1..30: note = hypo
  source 1..30: mol_type = genomic DNA

SEQ ID NO: 25074 - DNA, 93 bp, Homo sapiens
  misc_feature 1..93: note = chr14:50333994-50334087
  misc_feature 1..93: note = hypo
  source 1..93: mol_type = genomic DNA
ttgcttttttaacagtgcaaaaaacaaggccgtgtctggctatatggggctttgcttgttcaaaatgtaacctctatacggccgcgcgcagtg

SEQ ID NO: 25075 - DNA, 37 bp, Homo sapiens; identical to SEQ ID NO: 15819
  misc_feature 1..37: note = chr14:50433979-50434016
  misc_feature 1..37: note = hypo
  source 1..37: mol_type = genomic DNA

SEQ ID NO: 25076 - DNA, 15 bp, Homo sapiens
  misc_feature 1..15: note = chr14:54956536-54956551
  misc_feature 1..15: note = hypo
  source 1..15: mol_type = genomic DNA
cgctgggatcacagg

SEQ ID NO: 25077 - DNA, 30 bp, Homo sapiens; identical to SEQ ID NO: 15822
  misc_feature 1..30: note = chr14:55664068-55664098
  misc_feature 1..30: note = hypo
  source 1..30: mol_type = genomic DNA

SEQ ID NO: 25078 - DNA, 30 bp, Homo sapiens; identical to SEQ ID NO: 15824
  misc_feature 1..30: note = chr14:57045757-57045787
  misc_feature 1..30: note = hypo
  source 1..30: mol_type = genomic DNA

SEQ ID NO: 25079 - DNA, 23 bp, Homo sapiens
  misc_feature 1..23: note = chr14:58599589-58599612
  misc_feature 1..23: note = hypo
  source 1..23: mol_type = genomic DNA
actgcgcccggccaacccttgtc

SEQ ID NO: 25080 - DNA, 24 bp, Homo sapiens
  misc_feature 1..24: note = chr14:58893204-58893228
  misc_feature 1..24: note = hypo
  source 1..24: mol_type = genomic DNA
gagccaccgcgctcagactttaaa

SEQ ID NO: 25081 - DNA, 21 bp, Homo sapiens
  misc_feature 1..21: note = chr14:65233318-65233339
  misc_feature 1..21: note = hypo
  source 1..21: mol_type = genomic DNA
ggggaggatggagggcggggc

SEQ ID NO: 25082 - DNA, 96 bp, Homo sapiens; identical to SEQ ID NO: 15828
  misc_feature 1..96: note = chr14:65239506-65239602
  misc_feature 1..96: note = hypo
  source 1..96: mol_type = genomic DNA

SEQ ID NO: 25083 - DNA, 64 bp, Homo sapiens; identical to SEQ ID NO: 15829
  misc_feature 1..64: note = chr14:65406323-65406387
  misc_feature 1..64: note = hypo
  source 1..64: mol_type = genomic DNA

SEQ ID NO: 25084 - DNA, 39 bp, Homo sapiens
  misc_feature 1..39: note = chr14:67886606-67886645
  misc_feature 1..39: note = hypo
  source 1..39: mol_type = genomic DNA
cagtgggtctgcatctccccagagcgggtgcttttttct

SEQ ID NO: 25085 - DNA, 91 bp, Homo sapiens; identical to SEQ ID NO: 15831
  misc_feature 1..91: note = chr14:68067690-68067781
  misc_feature 1..91: note = hypo
  source 1..91: mol_type = genomic DNA

SEQ ID NO: 25086 - DNA, 30 bp, Homo sapiens; identical to SEQ ID NO: 15833
  misc_feature 1..30: note = chr14:72892242-72892272
  misc_feature 1..30: note = hypo
  source 1..30: mol_type = genomic DNA

SEQ ID NO: 25087 - DNA, 74 bp, Homo sapiens; identical to SEQ ID NO: 15834
  misc_feature 1..74: note = chr14:73140612-73140686
  misc_feature 1..74: note = hypo
  source 1..74: mol_type = genomic DNA

SEQ ID NO: 25088 - DNA, 50 bp, Homo sapiens; identical to SEQ ID NO: 15835
  misc_feature 1..50: note = chr14:73147450-73147500
  misc_feature 1..50: note = hypo
  source 1..50: mol_type = genomic DNA

SEQ ID NO: 25089 - DNA, 30 bp, Homo sapiens; identical to SEQ ID NO: 15837
  misc_feature 1..30: note = chr14:73172944-73172974
  misc_feature 1..30: note = hypo
  source 1..30: mol_type = genomic DNA

SEQ ID NO: 25090 - DNA, 24 bp, Homo sapiens
  misc_feature 1..24: note = chr14:73178865-73178889
  misc_feature 1..24: note = hypo
  source 1..24: mol_type = genomic DNA
aaagcctgccgtcaggcctcccag

SEQ ID NO: 25091 - DNA, 18 bp, Homo sapiens
  misc_feature 1..18: note = chr14:73180190-73180208
  misc_feature 1..18: note = hypo
  source 1..18: mol_type = genomic DNA
acccagagggagacccgt

SEQ ID NO: 25092 - DNA, 166 bp, Homo sapiens; identical to SEQ ID NO: 15840
  misc_feature 1..166: note = chr14:73195193-73195359
  misc_feature 1..166: note = hypo
  source 1..166: mol_type = genomic DNA

SEQ ID NO: 25093 - DNA, 34 bp, Homo sapiens; identical to SEQ ID NO: 15841
  misc_feature 1..34: note = chr14:73195668-73195702
  misc_feature 1..34: note = hypo
  source 1..34: mol_type = genomic DNA

SEQ ID NO: 25094 - DNA, 174 bp, Homo sapiens; identical to SEQ ID NO: 15842
  misc_feature 1..174: note = chr14:73209874-73210048
  misc_feature 1..174: note = hypo
  source 1..174: mol_type = genomic DNA

SEQ ID NO: 25095 - DNA, 23 bp, Homo sapiens
  misc_feature 1..23: note = chr14:73226884-73226907
  misc_feature 1..23: note = hypo
  source 1..23: mol_type = genomic DNA
aaatacaatgatggccgggcgcg

SEQ ID NO: 25096 - DNA, 30 bp, Homo sapiens; identical to SEQ ID NO: 15844
  misc_feature 1..30: note = chr14:73275087-73275117
  misc_feature 1..30: note = hypo
  source 1..30: mol_type = genomic DNA

SEQ ID NO: 25097 - DNA, 32 bp, Homo sapiens; identical to SEQ ID NO: 15845
  misc_feature 1..32: note = chr14:73313912-73313944
  misc_feature 1..32: note = hypo
  source 1..32: mol_type = genomic DNA

SEQ ID NO: 25098 - DNA, 18 bp, Homo sapiens
  misc_feature 1..18: note = chr14:73318453-73318471
  misc_feature 1..18: note = hypo
  source 1..18: mol_type = genomic DNA
tacaaaatgtccactcga

SEQ ID NO: 25099 - DNA, 30 bp, Homo sapiens; identical to SEQ ID NO: 15848
  misc_feature 1..30: note = chr14:73958845-73958875
  misc_feature 1..30: note = hypo
  source 1..30: mol_type = genomic DNA

SEQ ID NO: 25100 - DNA, 30 bp, Homo sapiens; identical to SEQ ID NO: 15849
  misc_feature 1..30: note = chr14:73959199-73959229
  misc_feature 1..30: note = hypo
  source 1..30: mol_type = genomic DNA

SEQ ID NO: 25101 - DNA, 30 bp, Homo sapiens; identical to SEQ ID NO: 15850
  misc_feature 1..30: note = chr14:75389373-75389403
  misc_feature 1..30: note = hypo
  source 1..30: mol_type = genomic DNA

SEQ ID NO: 25102 - DNA, 30 bp, Homo sapiens; identical to SEQ ID NO: 15851
  misc_feature 1..30: note = chr14:78247790-78247820
  misc_feature 1..30: note = hypo
  source 1..30: mol_type = genomic DNA

SEQ ID NO: 25103 - DNA, 30 bp, Homo sapiens; identical to SEQ ID NO: 15852
  misc_feature 1..30: note = chr14:90983280-90983310
  misc_feature 1..30: note = hypo
  source 1..30: mol_type = genomic DNA

SEQ ID NO: 25104 - DNA, 30 bp, Homo sapiens; identical to SEQ ID NO: 15853
  misc_feature 1..30: note = chr14:91849705-91849735
  misc_feature 1..30: note = hypo
  source 1..30: mol_type = genomic DNA

SEQ ID NO: 25105 - DNA, 124 bp, Homo sapiens
  misc_feature 1..124: note = chr14:93154937-93155061
  misc_feature 1..124: note = hypo
  source 1..124: mol_type = genomic DNA
cacccaccccatcctcggtctttgcaaagaagggcccgagcttagtttccccaggactggcctaggaaggagcaccggccacagctgctccccgtgccactcagggtggacccagcatctcagg

SEQ ID NO: 25106 - DNA, 37 bp, Homo sapiens; identical to SEQ ID NO: 15855
  misc_feature 1..37: note = chr14:93697020-93697057
  misc_feature 1..37: note = hypo
  source 1..37: mol_type = genomic DNA

SEQ ID NO: 25107 - DNA, 18 bp, Homo sapiens
  misc_feature 1..18: note = chr14:96967299-96967317
  misc_feature 1..18: note = hypo
  source 1..18: mol_type = genomic DNA
gcccggcttacattttct

SEQ ID NO: 25108 - DNA, 30 bp, Homo sapiens; identical to SEQ ID NO: 15857
  misc_feature 1..30: note = chr14:97188235-97188265
  misc_feature 1..30: note = hypo
  source 1..30: mol_type = genomic DNA

SEQ ID NO: 25109 - DNA, 18 bp, Homo sapiens
  misc_feature 1..18: note = chr14:97262855-97262873
  misc_feature 1..18: note = hypo
  source 1..18: mol_type = genomic DNA
taaacacaatgcggccgg

SEQ ID NO: 25110 - DNA, 144 bp, Homo sapiens; identical to SEQ ID NO: 15859
  misc_feature 1..144: note = chr14:99849909-99850053
  misc_feature 1..144: note = hypo
  source 1..144: mol_type = genomic DNA

SEQ ID NO: 25111 - DNA, 30 bp, Homo sapiens; identical to SEQ ID NO: 15860
  misc_feature 1..30: note = chr14:100611919-100611949
  misc_feature 1..30: note = hypo
  source 1..30: mol_type = genomic DNA

SEQ ID NO: 25112 - DNA, 79 bp, Homo sapiens; identical to SEQ ID NO: 15862
  misc_feature 1..79: note = chr14:100644399-100644478
  misc_feature 1..79: note = hypo
  source 1..79: mol_type = genomic DNA

SEQ ID NO: 25113 - DNA, 30 bp, Homo sapiens; identical to SEQ ID NO: 15863
  misc_feature 1..30: note = chr14:101200688-101200718
  misc_feature 1..30: note = hypo
  source 1..30: mol_type = genomic DNA

SEQ ID NO: 25114 - DNA, 22 bp, Homo sapiens
  misc_feature 1..22: note = chr14:101250272-101250294
  misc_feature 1..22: note = hypo
  source 1..22: mol_type = genomic DNA
ggtgcaccggggctttgttcag

SEQ ID NO: 25115 - DNA, 51 bp, Homo sapiens; identical to SEQ ID NO: 15865
  misc_feature 1..51: note = chr14:102335848-102335899
  misc_feature 1..51: note = hypo
  source 1..51: mol_type = genomic DNA

SEQ ID NO: 25116 - DNA, 67 bp, Homo sapiens
  misc_feature 1..67: note = chr14:102418540-102418607
  misc_feature 1..67: note = hypo
  source 1..67: mol_type = genomic DNA
tcgcatgagccaccacgcccagtgtattcagattttcttcgtgtttcttttctcttccgggatccca

SEQ ID NO: 25117 - DNA, 41 bp, Homo sapiens
  misc_feature 1..41: note = chr14:102418637-102418678
  misc_feature 1..41: note = hypo
  source 1..41: mol_type = genomic DNA
accacggtttttttgtttgtttgtttttttccgagacggag

SEQ ID NO: 25118 - DNA, 21 bp, Homo sapiens
  misc_feature 1..21: note = chr14:102530479-102530500
  misc_feature 1..21: note = hypo
  source 1..21: mol_type = genomic DNA
gctccttctccccagcgtggt

SEQ ID NO: 25119 - DNA, 101 bp, Homo sapiens; identical to SEQ ID NO: 15868
  misc_feature 1..101: note = chr14:103007139-103007240
  misc_feature 1..101: note = hypo
  source 1..101: mol_type = genomic DNA

SEQ ID NO: 25120 - DNA, 89 bp, Homo sapiens; identical to SEQ ID NO: 15869
  misc_feature 1..89: note = chr14:103820833-103820922
  misc_feature 1..89: note = hypo
  source 1..89: mol_type = genomic DNA

SEQ ID NO: 25121 - DNA, 30 bp, Homo sapiens; identical to SEQ ID NO: 15870
  misc_feature 1..30: note = chr14:103996414-103996444
  misc_feature 1..30: note = hypo
  source 1..30: mol_type = genomic DNA

SEQ ID NO: 25122 - DNA, 30 bp, Homo sapiens; identical to SEQ ID NO: 15871
  misc_feature 1..30: note = chr14:104061854-104061884
  misc_feature 1..30: note = hypo
  source 1..30: mol_type = genomic DNA

SEQ ID NO: 25123 - DNA, 30 bp, Homo sapiens; identical to SEQ ID NO: 15872
  misc_feature 1..30: note = chr14:104202811-104202841
  misc_feature 1..30: note = hypo
  source 1..30: mol_type = genomic DNA

SEQ ID NO: 25124 - DNA, 22 bp, Homo sapiens
  misc_feature 1..22: note = chr14:104355166-104355188
  misc_feature 1..22: note = hypo
  source 1..22: mol_type = genomic DNA
tttttttttccatgacggagtc

SEQ ID NO: 25125 - DNA, 414 bp, Homo sapiens; identical to SEQ ID NO: 15874
  misc_feature 1..414: note = chr14:104617714-104618128
  misc_feature 1..414: note = hypo
  source 1..414: mol_type = genomic DNA

SEQ ID NO: 25126 - DNA, 41 bp, Homo sapiens
  misc_feature 1..41: note = chr14:104620554-104620595
  misc_feature 1..41: note = hypo
  source 1..41: mol_type = genomic DNA
caaggcaaacactgatctggggccagcgggtgggacggggg

SEQ ID NO: 25127 - DNA, 34 bp, Homo sapiens; identical to SEQ ID NO: 15876
  misc_feature 1..34: note = chr14:104628653-104628687
  misc_feature 1..34: note = hypo
  source 1..34: mol_type = genomic DNA

SEQ ID NO: 25128 - DNA, 64 bp, Homo sapiens; identical to SEQ ID NO: 15877
  misc_feature 1..64: note = chr14:104630091-104630155
  misc_feature 1..64: note = hypo
  source 1..64: mol_type = genomic DNA

SEQ ID NO: 25129 - DNA, 16 bp, Homo sapiens
  misc_feature 1..16: note = chr14:104631077-104631093
  misc_feature 1..16: note = hypo
  source 1..16: mol_type = genomic DNA
gcgtgtctgtgtgtgt

SEQ ID NO: 25130 - DNA, 617 bp, Homo sapiens; identical to SEQ ID NO: 15879
  misc_feature 1..617: note = chr14:104639155-104639772
  misc_feature 1..617: note = hypo
  source 1..617: mol_type = genomic DNA

SEQ ID NO: 25131 - DNA, 30 bp, Homo sapiens; identical to SEQ ID NO: 15880
  misc_feature 1..30: note = chr14:104641364-104641394
  misc_feature 1..30: note = hypo
  source 1..30: mol_type = genomic DNA

SEQ ID NO: 25132 - DNA, 74 bp, Homo sapiens; identical to SEQ ID NO: 15881
  misc_feature 1..74: note = chr14:104641701-104641775
  misc_feature 1..74: note = hypo
  source 1..74: mol_type = genomic DNA

SEQ ID NO: 25133 - DNA, 88 bp, Homo sapiens; identical to SEQ ID NO: 15883
  misc_feature 1..88: note = chr14:104645975-104646063
  misc_feature 1..88: note = hypo
  source 1..88: mol_type = genomic DNA

SEQ ID NO: 25134 - DNA, 49 bp, Homo sapiens; identical to SEQ ID NO: 15884
  misc_feature 1..49: note = chr14:104647208-104647257
  misc_feature 1..49: note = hypo
  source 1..49: mol_type = genomic DNA

SEQ ID NO: 25135 - DNA, 38 bp, Homo sapiens; identical to SEQ ID NO: 15885
  misc_feature 1..38: note = chr14:104897616-104897654
  misc_feature 1..38: note = hypo
  source 1..38: mol_type = genomic DNA

SEQ ID NO: 25136 - DNA, 112 bp, Homo sapiens; identical to SEQ ID NO: 15886
  misc_feature 1..112: note = chr14:105196425-105196537
  misc_feature 1..112: note = hypo
  source 1..112: mol_type = genomic DNA

SEQ ID NO: 25137 - DNA, 26 bp, Homo sapiens
  misc_feature 1..26: note = chr14:105714232-105714258
  misc_feature 1..26: note = hypo
  source 1..26: mol_type = genomic DNA
ggattagccccaggccgggaggctag

SEQ ID NO: 25138 - DNA, 62 bp, Homo sapiens; identical to SEQ ID NO: 22002
  misc_feature 1..62: note = chr14:105714334-105714396
  misc_feature 1..62: note = hypo
  source 1..62: mol_type = genomic DNA

SEQ ID NO: 25139 - DNA, 21 bp, Homo sapiens
  misc_feature 1..21: note = chr15:20499486-20499507
  misc_feature 1..21: note = hypo
  source 1..21: mol_type = genomic DNA
gagcgcgctgactcacgcctg

SEQ ID NO: 25140 - DNA, 30 bp, Homo sapiens; identical to SEQ ID NO: 15890
  misc_feature 1..30: note = chr15:22515506-22515536
  misc_feature 1..30: note = hypo
  source 1..30: mol_type = genomic DNA

SEQ ID NO: 25141 - DNA, 255 bp, Homo sapiens; identical to SEQ ID NO: 15891
  misc_feature 1..255: note = chr15:29133539-29133794
  misc_feature 1..255: note = hypo
  source 1..255: mol_type = genomic DNA

SEQ ID NO: 25142 - DNA, 30 bp, Homo sapiens; identical to SEQ ID NO: 15892
  misc_feature 1..30: note = chr15:29449033-29449063
  misc_feature 1..30: note = hypo
  source 1..30: mol_type = genomic DNA

SEQ ID NO: 25143 - DNA, 43 bp, Homo sapiens; identical to SEQ ID NO: 15893
  misc_feature 1..43: note = chr15:33632093-33632136
  misc_feature 1..43: note = hypo
  source 1..43: mol_type = genomic DNA

SEQ ID NO: 25144 - DNA, 30 bp, Homo sapiens; identical to SEQ ID NO: 15894
  misc_feature 1..30: note = chr15:40228636-40228666
  misc_feature 1..30: note = hypo
  source 1..30: mol_type = genomic DNA

SEQ ID NO: 25145 - DNA, 40 bp, Homo sapiens; identical to SEQ ID NO: 15896
  misc_feature 1..40: note = chr15:42684673-42684713
  misc_feature 1..40: note = hypo
  source 1..40: mol_type = genomic DNA

SEQ ID NO: 25146 - DNA, 30 bp, Homo sapiens; identical to SEQ ID NO: 15897
  misc_feature 1..30: note = chr15:43020330-43020360
  misc_feature 1..30: note = hypo
  source 1..30: mol_type = genomic DNA

SEQ ID NO: 25147 - DNA, 30 bp, Homo sapiens; identical to SEQ ID NO: 15898
  misc_feature 1..30: note = chr15:44037474-44037504
  misc_feature 1..30: note = hypo
  source 1..30: mol_type = genomic DNA

SEQ ID NO: 25148 - DNA, 20 bp, Homo sapiens
  misc_feature 1..20: note = chr15:52967815-52967835
  misc_feature 1..20: note = hypo
  source 1..20: mol_type = genomic DNA
tagtgttaggccgggcgcgg

SEQ ID NO: 25149 - DNA, 145 bp, Homo sapiens; identical to SEQ ID NO: 15900
  misc_feature 1..145: note = chr15:53976280-53976425
  misc_feature 1..145: note = hypo
  source 1..145: mol_type = genomic DNA

SEQ ID NO: 25150-25151 - skipped (2 entries)

SEQ ID NO: 25152 - DNA, 40 bp, Homo sapiens; identical to SEQ ID NO: 15903
  misc_feature 1..40: note = chr15:62367703-62367743
  misc_feature 1..40: note = hypo
  source 1..40: mol_type = genomic DNA

SEQ ID NO: 25153 - DNA, 45 bp, Homo sapiens; identical to SEQ ID NO: 15904
  misc_feature 1..45: note = chr15:65043594-65043639
  misc_feature 1..45: note = hypo
  source 1..45: mol_type = genomic DNA

SEQ ID NO: 25154 - DNA, 30 bp, Homo sapiens; identical to SEQ ID NO: 15905
  misc_feature 1..30: note = chr15:65622974-65623004
  misc_feature 1..30: note = hypo
  source 1..30: mol_type = genomic DNA

SEQ ID NO: 25155 - DNA, 70 bp, Homo sapiens
  misc_feature 1..70: note = chr15:66649845-66649915
  misc_feature 1..70: note = hypo
  source 1..70: mol_type = genomic DNA
cccagaagttgaaggcggcagtgactaggatcgcactgctggcgatccagctggagatccagtctgggtg

SEQ ID NO: 25156 - DNA, 81 bp, Homo sapiens; identical to SEQ ID NO: 15907
  misc_feature 1..81: note = chr15:67545405-67545486
  misc_feature 1..81: note = hypo
  source 1..81: mol_type = genomic DNA

SEQ ID NO: 25157 - DNA, 30 bp, Homo sapiens; identical to SEQ ID NO: 15908
  misc_feature 1..30: note = chr15:70075720-70075750
  misc_feature 1..30: note = hypo
  source 1..30: mol_type = genomic DNA

SEQ ID NO: 25158 - DNA, 176 bp, Homo sapiens; identical to SEQ ID NO: 15909
  misc_feature 1..176: note = chr15:72102772-72102948
  misc_feature 1..176: note = hypo
  source 1..176: mol_type = genomic DNA

SEQ ID NO: 25159 - DNA, 133 bp, Homo sapiens
  misc_feature 1..133: note = chr15:72412176-72412309
  misc_feature 1..133: note = hypo
  source 1..133: mol_type = genomic DNA
aactggtctgggaaatgggagaaggagccactcttgcctttctcttcagcactgttcattcctcagtgtttatcaggtccaaattagttacttgtctctttgctctcccgttcccttccgtccaggattggtc

SEQ ID NO: 25160 - DNA, 187 bp, Homo sapiens; identical to SEQ ID NO: 15911
  misc_feature 1..187: note = chr15:72581494-72581681
  misc_feature 1..187: note = hypo
  source 1..187: mol_type = genomic DNA

SEQ ID NO: 25161 - DNA, 39 bp, Homo sapiens; identical to SEQ ID NO: 15912
  misc_feature 1..39: note = chr15:76197482-76197521
  misc_feature 1..39: note = hypo
  source 1..39: mol_type = genomic DNA

SEQ ID NO: 25162 - DNA, 30 bp, Homo sapiens; identical to SEQ ID NO: 15913
  misc_feature 1..30: note = chr15:76510088-76510118
  misc_feature 1..30: note = hypo
  source 1..30: mol_type = genomic DNA

SEQ ID NO: 25163 - DNA, 30 bp, Homo sapiens; identical to SEQ ID NO: 15914
  misc_feature 1..30: note = chr15:77906968-77906998
  misc_feature 1..30: note = hypo
  source 1..30: mol_type = genomic DNA

SEQ ID NO: 25164 - DNA, 139 bp, Homo sapiens; identical to SEQ ID NO: 15917
  misc_feature 1..139: note = chr15:78609750-78609889
  misc_feature 1..139: note = hypo
  source 1..139: mol_type = genomic DNA

SEQ ID NO: 25165 - DNA, 95 bp, Homo sapiens; identical to SEQ ID NO: 15918
  misc_feature 1..95: note = chr15:83655934-83656029
  misc_feature 1..95: note = hypo
  source 1..95: mol_type = genomic DNA

SEQ ID NO: 25166 - DNA, 30 bp, Homo sapiens; identical to SEQ ID NO: 15919
  misc_feature 1..30: note = chr15:90630578-90630608
  misc_feature 1..30: note = hypo
  source 1..30: mol_type = genomic DNA

SEQ ID NO: 25167 - DNA, 20 bp, Homo sapiens
  misc_feature 1..20: note = chr15:90703242-90703262
  misc_feature 1..20: note = hypo
  source 1..20: mol_type = genomic DNA
ttgtttgtttttttgcgggg

SEQ ID NO: 25168 - DNA, 104 bp, Homo sapiens; identical to SEQ ID NO: 15921
  misc_feature 1..104: note = chr15:90844295-90844399
  misc_feature 1..104: note = hypo
  source 1..104: mol_type = genomic DNA

SEQ ID NO: 25169 - DNA, 116 bp, Homo sapiens; identical to SEQ ID NO: 15922
  misc_feature 1..116: note = chr15:91189343-91189459
  misc_feature 1..116: note = hypo
  source 1..116: mol_type = genomic DNA

SEQ ID NO: 25170 - DNA, 30 bp, Homo sapiens; identical to SEQ ID NO: 15923
  misc_feature 1..30: note = chr15:91313685-91313715
  misc_feature 1..30: note = hypo
  source 1..30: mol_type = genomic DNA

SEQ ID NO: 25171 - DNA, 30 bp, Homo sapiens; identical to SEQ ID NO: 15924
  misc_feature 1..30: note = chr15:91409404-91409434
  misc_feature 1..30: note = hypo
  source 1..30: mol_type = genomic DNA

SEQ ID NO: 25172 - DNA, 39 bp, Homo sapiens; identical to SEQ ID NO: 15925
  misc_feature 1..39: note = chr15:93364629-93364668
  misc_feature 1..39: note = hypo
  source 1..39: mol_type = genomic DNA

SEQ ID NO: 25173 - DNA, 30 bp, Homo sapiens; identical to SEQ ID NO: 15926
  misc_feature 1..30: note = chr15:93609848-93609878
  misc_feature 1..30: note = hypo
  source 1..30: mol_type = genomic DNA

SEQ ID NO: 25174 - DNA, 24 bp, Homo sapiens
  misc_feature 1..24: note = chr15:94478454-94478478
  misc_feature 1..24: note = hypo
  source 1..24: mol_type = genomic DNA
aaagaaggaggaggccgggcgccg

SEQ ID NO: 25175 - DNA, 13 bp, Homo sapiens
  misc_feature 1..13: note = chr15:97006359-97006372
  misc_feature 1..13: note = hypo
  source 1..13: mol_type = genomic DNA
tgtgacatccgtg

SEQ ID NO: 25176 - DNA, 31 bp, Homo sapiens; identical to SEQ ID NO: 15930
  misc_feature 1..31: note = chr15:98454964-98454995
  misc_feature 1..31: note = hypo
  source 1..31: mol_type = genomic DNA

SEQ ID NO: 25177 - DNA, 20 bp, Homo sapiens
  misc_feature 1..20: note = chr15:99295597-99295617
  misc_feature 1..20: note = hypo
  source 1..20: mol_type = genomic DNA
tagagtgtttattaacgaaa

SEQ ID NO: 25178 - DNA, 30 bp, Homo sapiens; identical to SEQ ID NO: 15932
  misc_feature 1..30: note = chr15:99460238-99460268
  misc_feature 1..30: note = hypo
  source 1..30: mol_type = genomic DNA

SEQ ID NO: 25179 - DNA, 132 bp, Homo sapiens; identical to SEQ ID NO: 15933
  misc_feature 1..132: note = chr15:99484456-99484588
  misc_feature 1..132: note = hypo
  source 1..132: mol_type = genomic DNA

SEQ ID NO: 25180 - DNA, 246 bp, Homo sapiens; identical to SEQ ID NO: 15934
  misc_feature 1..246: note = chr15:102043043-102043289
  misc_feature 1..246: note = hypo
  source 1..246: mol_type = genomic DNA

SEQ ID NO: 25181 - DNA, 23 bp, Homo sapiens
  misc_feature 1..23: note = chr16:142626-142649
  misc_feature 1..23: note = hypo
  source 1..23: mol_type = genomic DNA
ttctgacaaggagaccggcaagg

SEQ ID NO: 25182 - DNA, 30 bp, Homo sapiens; identical to SEQ ID NO: 15936
  misc_feature 1..30: note = chr16:189535-189565
  misc_feature 1..30: note = hypo
  source 1..30: mol_type = genomic DNA

SEQ ID NO: 25183 - DNA, 22 bp, Homo sapiens
  misc_feature 1..22: note = chr16:319924-319946
  misc_feature 1..22: note = hypo
  source 1..22: mol_type = genomic DNA
aaacaaggtaggccacgcatgg

SEQ ID NO: 25184 - DNA, 30 bp, Homo sapiens; identical to SEQ ID NO: 15938
  misc_feature 1..30: note = chr16:337748-337778
  misc_feature 1..30: note = hypo
  source 1..30: mol_type = genomic DNA

SEQ ID NO: 25185 - DNA, 119 bp, Homo sapiens
  misc_feature 1..119: note = chr16:410258-410377
  misc_feature 1..119: note = hypo
  source 1..119: mol_type = genomic DNA
taggaaccctgaggccgcggccaagttctgagcgtgtgactgtgtgtgctgggccccaggcccctttgtcgccgcggcgtctgtcgtggcaaacaaaagtgaaccggattagccacagt

SEQ ID NO: 25186 - DNA, 39 bp, Homo sapiens
  misc_feature 1..39: note = chr16:410407-410446
  misc_feature 1..39: note = hypo
  source 1..39: mol_type = genomic DNA
ctaataacctaacaatcgtgtcaacgggagctttgaacc

SEQ ID NO: 25187 - DNA, 419 bp, Homo sapiens; identical to SEQ ID NO: 15940
  misc_feature 1..419: note = chr16:411085-411504
  misc_feature 1..419: note = hypo
  source 1..419: mol_type = genomic DNA

SEQ ID NO: 25188 - DNA, 30 bp, Homo sapiens; identical to SEQ ID NO: 15941
  misc_feature 1..30: note = chr16:612290-612320
  misc_feature 1..30: note = hypo
  source 1..30: mol_type = genomic DNA

SEQ ID NO: 25189 - DNA, 30 bp, Homo sapiens; identical to SEQ ID NO: 15943
  misc_feature 1..30: note = chr16:613572-613602
  misc_feature 1..30: note = hypo
  source 1..30: mol_type = genomic DNA

SEQ ID NO: 25190 - DNA, 411 bp, Homo sapiens; identical to SEQ ID NO: 15944
  misc_feature 1..411: note = chr16:614790-615201
  misc_feature 1..411: note = hypo
  source 1..411: mol_type = genomic DNA

SEQ ID NO: 25191 - DNA, 63 bp, Homo sapiens
  misc_feature 1..63: note = chr16:667484-667547
  misc_feature 1..63: note = hypo
  source 1..63: mol_type = genomic DNA
cggaaaacctgattccgtggtggctgtgagccccttccctccccttctgtcggcttcacctta

SEQ ID NO: 25192 - DNA, 30 bp, Homo sapiens; identical to SEQ ID NO: 15946
  misc_feature 1..30: note = chr16:677879-677909
  misc_feature 1..30: note = hypo
  source 1..30: mol_type = genomic DNA

SEQ ID NO: 25193 - DNA, 42 bp, Homo sapiens; identical to SEQ ID NO: 15947
  misc_feature 1..42: note = chr16:700572-700614
  misc_feature 1..42: note = hypo
  source 1..42: mol_type = genomic DNA

SEQ ID NO: 25194 - DNA, 22 bp, Homo sapiens
  misc_feature 1..22: note = chr16:726990-727012
  misc_feature 1..22: note = hypo
  source 1..22: mol_type = genomic DNA
cggggcccgcctcaacaagtgg

SEQ ID NO: 25195 - DNA, 76 bp, Homo sapiens
  misc_feature 1..76: note = chr16:731412-731488
  misc_feature 1..76: note = hypo
  source 1..76: mol_type = genomic DNA
gtgacgtgaagcccccgttccccagcttacagcctggccaaggagcagcggctgaacttcggggacgacatcccca

SEQ ID NO: 25196 - DNA, 275 bp, Homo sapiens
  misc_feature 1..275: note = chr16:734930-735205
  misc_feature 1..275: note = hypo
  source 1..275: mol_type = genomic DNA
cagcgggggctgctgcgctgcctgcaggcccctgccccacctcccgaccccactgccccacctgtcgcagacccagccccggctgctcatgggccgcttgcagtggctgcagttgacgtgcagggtggtggaggcctggttgaggcagctgacggcgcggctggtgctcagcttgaccacctcgttggacacgttccagaggcggaagcgctgcagcaggtcgatgtaggaagtgtaccagtgctcctgggggagggagcgcccggcagtcagga

SEQ ID NO: 25197 - DNA, 84 bp, Homo sapiens
  misc_feature 1..84: note = chr16:735594-735678
  misc_feature 1..84: note = hypo
  source 1..84: mol_type = genomic DNA
cggctggaaggcagggaccagcggaggctctgagtctgtcctccatccgcctctgaaccccaccctgcccggacccccactcac

SEQ ID NO: 25198 - DNA, 30 bp, Homo sapiens; identical to SEQ ID NO: 15951
  misc_feature 1..30: note = chr16:735921-735951
  misc_feature 1..30: note = hypo
  source 1..30: mol_type = genomic DNA

SEQ ID NO: 25199 - DNA, 30 bp, Homo sapiens; identical to SEQ ID NO: 15953
  misc_feature 1..30: note = chr16:809500-809530
  misc_feature 1..30: note = hypo
  source 1..30: mol_type = genomic DNA

SEQ ID NO: 25200 - DNA, 180 bp, Homo sapiens; identical to SEQ ID NO: 15954
  misc_feature 1..180: note = chr16:809840-810020
  misc_feature 1..180: note = hypo
  source 1..180: mol_type = genomic DNA

SEQ ID NO: 25201 - DNA, 273 bp, Homo sapiens; identical to SEQ ID NO: 15955
  misc_feature 1..273: note = chr16:824939-825212
  misc_feature 1..273: note = hypo
  source 1..273: mol_type = genomic DNA

SEQ ID NO: 25202 - DNA, 53 bp, Homo sapiens
  misc_feature 1..53: note = chr16:837308-837361
  misc_feature 1..53: note = hypo
  source 1..53: mol_type = genomic DNA
aatcctgagtccccacgccccaccccaggactgaccaggtcttaccaatgcca

SEQ ID NO: 25203 - DNA, 78 bp, Homo sapiens
  misc_feature 1..78: note = chr16:837460-837538
  misc_feature 1..78: note = hypo
  source 1..78: mol_type = genomic DNA
ccagctggtggcagaacctggagtgggacagagtccagagtctgagccactttcctccacagacgccaccgtggggct

SEQ ID NO: 25204 - DNA, 175 bp, Homo sapiens
  misc_feature 1..175: note = chr16:845985-846160
  misc_feature 1..175: note = hypo
  source 1..175: mol_type = genomic DNA
ctggccagcctggtgggcacgatgctcgcttacagcctgacctaccgccaggagcgcacgcccgatggccagtacatctacaggctggagccgtgagtcccccagtgcctggggtgtgctccagggtcatgctccccggctgtgctccatgttcagggcccgcatggggccagga

SEQ ID NO: 25205 - DNA, 66 bp, Homo sapiens; identical to SEQ ID NO: 15958
  misc_feature 1..66: note = chr16:846426-846492
  misc_feature 1..66: note = hypo
  source 1..66: mol_type = genomic DNA

SEQ ID NO: 25206 - DNA, 53 bp, Homo sapiens; identical to SEQ ID NO: 15959
  misc_feature 1..53: note = chr16:858748-858801
  misc_feature 1..53: note = hypo
  source 1..53: mol_type = genomic DNA

SEQ ID NO: 25207 - DNA, 30 bp, Homo sapiens; identical to SEQ ID NO: 15960
  misc_feature 1..30: note = chr16:882403-882433
  misc_feature 1..30: note = hypo
  source 1..30: mol_type = genomic DNA

SEQ ID NO: 25208 - DNA, 65 bp, Homo sapiens; identical to SEQ ID NO: 15961
  misc_feature 1..65: note = chr16:888904-888969
  misc_feature 1..65: note = hypo
  source 1..65: mol_type = genomic DNA

SEQ ID NO: 25209 - DNA, 80 bp, Homo sapiens; identical to SEQ ID NO: 15962
  misc_feature 1..80: note = chr16:924620-924700
  misc_feature 1..80: note = hypo
  source 1..80: mol_type = genomic DNA

SEQ ID NO: 25210 - DNA, 22 bp, Homo sapiens
  misc_feature 1..22: note = chr16:943459-943481
  misc_feature 1..22: note = hypo
  source 1..22: mol_type = genomic DNA
ggatgagcccaaagtcggaggg

SEQ ID NO: 25211 - DNA, 34 bp, Homo sapiens
  misc_feature 1..34: note = chr16:943553-943587
  misc_feature 1..34: note = hypo
  source 1..34: mol_type = genomic DNA
tctcccacacactgcagctcgcctgctgtgagga

SEQ ID NO: 25212 - DNA, 63 bp, Homo sapiens; identical to SEQ ID NO: 15964
  misc_feature 1..63: note = chr16:963320-963383
  misc_feature 1..63: note = hypo
  source 1..63: mol_type = genomic DNA

SEQ ID NO: 25213 - DNA, 30 bp, Homo sapiens; identical to SEQ ID NO: 15965
  misc_feature 1..30: note = chr16:981776-981806
  misc_feature 1..30: note = hypo
  source 1..30: mol_type = genomic DNA

SEQ ID NO: 25214 - DNA, 94 bp, Homo sapiens
  misc_feature 1..94: note = chr16:1052493-1052587
  misc_feature 1..94: note = hypo
  source 1..94: mol_type = genomic DNA
cccgatgtccctccccgggtgaaggaacccacggacgtggctcatccataccgcggaacgtgagccatgaaaaggggcagcctcggctcagcca

SEQ ID NO: 25215 - DNA, 30 bp, Homo sapiens; identical to SEQ ID NO: 15967
  misc_feature 1..30: note = chr16:1077608-1077638
  misc_feature 1..30: note = hypo
  source 1..30: mol_type = genomic DNA

SEQ ID NO: 25216 - DNA, 217 bp, Homo sapiens; identical to SEQ ID NO: 15968
  misc_feature 1..217: note = chr16:1081773-1081990
  misc_feature 1..217: note = hypo
  source 1..217: mol_type = genomic DNA

SEQ ID NO: 25217 - DNA, 27 bp, Homo sapiens
  misc_feature 1..27: note = chr16:1128984-1129011
  misc_feature 1..27: note = hypo
  source 1..27: mol_type = genomic DNA
ggcggtgctggtgcccgtgctgtacct

SEQ ID NO: 25218 - DNA, 30 bp, Homo sapiens; identical to SEQ ID NO: 15970
  misc_feature 1..30: note = chr16:1166711-1166741
  misc_feature 1..30: note = hypo
  source 1..30: mol_type = genomic DNA

SEQ ID NO: 25219 - DNA, 30 bp, Homo sapiens; identical to SEQ ID NO: 15971
  misc_feature 1..30: note = chr16:1171222-1171252
  misc_feature 1..30: note = hypo
  source 1..30: mol_type = genomic DNA

SEQ ID NO: 25220 - DNA, 118 bp, Homo sapiens; identical to SEQ ID NO: 15972
  misc_feature 1..118: note = chr16:1173263-1173381
  misc_feature 1..118: note = hypo
  source 1..118: mol_type = genomic DNA

SEQ ID NO: 25221 - DNA, 95 bp, Homo sapiens; identical to SEQ ID NO: 15973
  misc_feature 1..95: note = chr16:1195687-1195782
  misc_feature 1..95: note = hypo
  source 1..95: mol_type = genomic DNA

SEQ ID NO: 25222 - DNA, 24 bp, Homo sapiens
  misc_feature 1..24: note = chr16:1228780-1228804
  misc_feature 1..24: note = hypo
  source 1..24: mol_type = genomic DNA
ccaagctccagaagtcggggttgg

SEQ ID NO: 25223 - DNA, 15 bp, Homo sapiens
  misc_feature 1..15: note = chr16:1228916-1228931
  misc_feature 1..15: note = hypo
  source 1..15: mol_type = genomic DNA
cggaggaccagatgg

SEQ ID NO: 25224 - DNA, 55 bp, Homo sapiens
  misc_feature 1..55: note = chr16:1230142-1230197
  misc_feature 1..55: note = hypo
  source 1..55: mol_type = genomic DNA
gtgccctggctgggtccctgtccctgcacaccgggtcagccggctcctgggtgca

SEQ ID NO: 25225 - DNA, 54 bp, Homo sapiens; identical to SEQ ID NO: 15977
  misc_feature 1..54: note = chr16:1236842-1236896
  misc_feature 1..54: note = hypo
  source 1..54: mol_type = genomic DNA

SEQ ID NO: 25226 - DNA, 77 bp, Homo sapiens; identical to SEQ ID NO: 15978
  misc_feature 1..77: note = chr16:1251702-1251779
  misc_feature 1..77: note = hypo
  source 1..77: mol_type = genomic DNA

SEQ ID NO: 25227 - DNA, 91 bp, Homo sapiens; identical to SEQ ID NO: 15979
  misc_feature 1..91: note = chr16:1268128-1268219
  misc_feature 1..91: note = hypo
  source 1..91: mol_type = genomic DNA

SEQ ID NO: 25228 - DNA, 50 bp, Homo sapiens
  misc_feature 1..50: note = chr16:1312476-1312526
  misc_feature 1..50: note = hypo
  source 1..50: mol_type = genomic DNA
ccagcactggtccttcggggtgagctccagcgagaccggggagagcttga

SEQ ID NO: 25229 - DNA, 15 bp, Homo sapiens
  misc_feature 1..15: note = chr16:1324061-1324076
  misc_feature 1..15: note = hypo
  source 1..15: mol_type = genomic DNA
cggcagcatatctgc

SEQ ID NO: 25230 - DNA, 144 bp, Homo sapiens; identical to SEQ ID NO: 15982
  misc_feature 1..144: note = chr16:1391751-1391895
  misc_feature 1..144: note = hypo
  source 1..144: mol_type = genomic DNA

SEQ ID NO: 25231 - DNA, 62 bp, Homo sapiens; identical to SEQ ID NO: 15983
  misc_feature 1..62: note = chr16:1397548-1397610
  misc_feature 1..62: note = hypo
  source 1..62: mol_type = genomic DNA

SEQ ID NO: 25232 - DNA, 190 bp, Homo sapiens; identical to SEQ ID NO: 15985
  misc_feature 1..190: note = chr16:1417148-1417338
  misc_feature 1..190: note = hypo
  source 1..190: mol_type = genomic DNA

SEQ ID NO: 25233 - DNA, 243 bp, Homo sapiens; identical to SEQ ID NO: 15986
  misc_feature 1..243: note = chr16:1417675-1417918
  misc_feature 1..243: note = hypo
  source 1..243: mol_type = genomic DNA

SEQ ID NO: 25234 - DNA, 30 bp, Homo sapiens; identical to SEQ ID NO: 15987
  misc_feature 1..30: note = chr16:1425654-1425684
  misc_feature 1..30: note = hypo
  source 1..30: mol_type = genomic DNA

SEQ ID NO: 25235 - DNA, 43 bp, Homo sapiens; identical to SEQ ID NO: 15988
  misc_feature 1..43: note = chr16:1428212-1428255
  misc_feature 1..43: note = hypo
  source 1..43: mol_type = genomic DNA

SEQ ID NO: 25236 - DNA, 30 bp, Homo sapiens; identical to SEQ ID NO: 15990
  misc_feature 1..30: note = chr16:1428877-1428907
  misc_feature 1..30: note = hypo
  source 1..30: mol_type = genomic DNA

SEQ ID NO: 25237 - DNA, 30 bp, Homo sapiens; identical to SEQ ID NO: 15991
  misc_feature 1..30: note = chr16:1486627-1486657
  misc_feature 1..30: note = hypo
  source 1..30: mol_type = genomic DNA

SEQ ID NO: 25238 - DNA, 37 bp, Homo sapiens; identical to SEQ ID NO: 15992
  misc_feature 1..37: note = chr16:1491115-1491152
  misc_feature 1..37: note = hypo
  source 1..37: mol_type = genomic DNA

SEQ ID NO: 25239 - DNA, 77 bp, Homo sapiens; identical to SEQ ID NO: 15993
  misc_feature 1..77: note = chr16:1493574-1493651
  misc_feature 1..77: note = hypo
  source 1..77: mol_type = genomic DNA

SEQ ID NO: 25240 - DNA, 36 bp, Homo sapiens
  misc_feature 1..36: note = chr16:1730597-1730633
  misc_feature 1..36: note = hypo
  source 1..36: mol_type = genomic DNA
acatttagttttgctgtgaagcgagtcaggtggtgg

SEQ ID NO: 25241 - DNA, 92 bp, Homo sapiens
  misc_feature 1..92: note = chr16:1741761-1741853
  misc_feature 1..92: note = hypo
  source 1..92: mol_type = genomic DNA
gtctccaaagcactgcgggggtggggtggggtggggtccggtggacgtctggttgctcagtgttctgtgatcgtttctgcagggggtaaagg

SEQ ID NO: 25242 - DNA, 120 bp, Homo sapiens; identical to SEQ ID NO: 15996
  misc_feature 1..120: note = chr16:1813598-1813718
  misc_feature 1..120: note = hypo
  source 1..120: mol_type = genomic DNA

SEQ ID NO: 25243 - DNA, 30 bp, Homo sapiens; identical to SEQ ID NO: 15997
  misc_feature 1..30: note = chr16:2028658-2028688
  misc_feature 1..30: note = hypo
  source 1..30: mol_type = genomic DNA

SEQ ID NO: 25244 - DNA, 49 bp, Homo sapiens
  misc_feature 1..49: note = chr16:2029023-2029072
  misc_feature 1..49: note = hypo
  source 1..49: mol_type = genomic DNA
ggtccatcccctcatcgggatcctcgcgctcactgctccgtcgtggggt

SEQ ID NO: 25245 - DNA, 33 bp, Homo sapiens
  misc_feature 1..33: note = chr16:2029137-2029170
  misc_feature 1..33: note = hypo
  source 1..33: mol_type = genomic DNA
cgtgtgacggtgcagcagcggctctggatggcg

SEQ ID NO: 25246 - DNA, 30 bp, Homo sapiens; identical to SEQ ID NO: 15999
  misc_feature 1..30: note = chr16:2213693-2213723
  misc_feature 1..30: note = hypo
  source 1..30: mol_type = genomic DNA

SEQ ID NO: 25247 - DNA, 84 bp, Homo sapiens; identical to SEQ ID NO: 16001
  misc_feature 1..84: note = chr16:2233062-2233146
  misc_feature 1..84: note = hypo
  source 1..84: mol_type = genomic DNA

SEQ ID NO: 25248 - DNA, 42 bp, Homo sapiens
  misc_feature 1..42: note = chr16:2234684-2234726
  misc_feature 1..42: note = hypo
  source 1..42: mol_type = genomic DNA
ccaggccaggcaggccgtgtaagcacccatcagcccatcggc

SEQ ID NO: 25249 - DNA, 367 bp, Homo sapiens; identical to SEQ ID NO: 16003
  misc_feature 1..367: note = chr16:2278403-2278770
  misc_feature 1..367: note = hypo
  source 1..367: mol_type = genomic DNA

SEQ ID NO: 25250 - DNA, 34 bp, Homo sapiens; identical to SEQ ID NO: 16004
  misc_feature 1..34: note = chr16:2466336-2466370
  misc_feature 1..34: note = hypo
  source 1..34: mol_type = genomic DNA

SEQ ID NO: 25251 - DNA, 30 bp, Homo sapiens; identical to SEQ ID NO: 16005
  misc_feature 1..30: note = chr16:2531804-2531834
  misc_feature 1..30: note = hypo
  source 1..30: mol_type = genomic DNA

SEQ ID NO: 25252 - DNA, 37 bp, Homo sapiens; identical to SEQ ID NO: 16006
  misc_feature 1..37: note = chr16:2540828-2540865
  misc_feature 1..37: note = hypo
  source 1..37: mol_type = genomic DNA

SEQ ID NO: 25253 - DNA, 18 bp, Homo sapiens
  misc_feature 1..18: note = chr16:2589100-2589118
  misc_feature 1..18: note = hypo
  source 1..18: mol_type = genomic DNA
atggagtctccctctcga

SEQ ID NO: 25254 - DNA, 74 bp, Homo sapiens; identical to SEQ ID NO: 16008
  misc_feature 1..74: note = chr16:2764635-2764709
  misc_feature 1..74: note = hypo
  source 1..74: mol_type = genomic DNA

SEQ ID NO: 25255 - DNA, 30 bp, Homo sapiens; identical to SEQ ID NO: 16011
  misc_feature 1..30: note = chr16:2877506-2877536
  misc_feature 1..30: note = hypo
  source 1..30: mol_type = genomic DNA

SEQ ID NO: 25256 - skipped

SEQ ID NO: 25257 - DNA, 65 bp, Homo sapiens
  misc_feature 1..65: note = chr16:3492675-3492740
  misc_feature 1..65: note = hypo
  source 1..65: mol_type = genomic DNA
aaaaaaaaaaaaaaagaacttttaaaagtagccagacactgtggtatgcgcgcctctcagatact

SEQ ID NO: 25258 - DNA, 37 bp, Homo sapiens; identical to SEQ ID NO: 16016
  misc_feature 1..37: note = chr16:3957870-3957907
  misc_feature 1..37: note = hypo
  source 1..37: mol_type = genomic DNA

SEQ ID NO: 25259 - DNA, 30 bp, Homo sapiens; identical to SEQ ID NO: 16017
  misc_feature 1..30: note = chr16:4410956-4410986
  misc_feature 1..30: note = hypo
  source 1..30: mol_type = genomic DNA

SEQ ID NO: 25260 - DNA, 30 bp, Homo sapiens; identical to SEQ ID NO: 16018
  misc_feature 1..30: note = chr16:4840446-4840476
  misc_feature 1..30: note = hypo
  source 1..30: mol_type = genomic DNA

SEQ ID NO: 25261 - DNA, 30 bp, Homo sapiens; identical to SEQ ID NO: 16020
  misc_feature 1..30: note = chr16:5439313-5439343
  misc_feature 1..30: note = hypo
  source 1..30: mol_type = genomic DNA

SEQ ID NO: 25262 - DNA, 14 bp, Homo sapiens
  misc_feature 1..14: note = chr16:8781018-8781032
  misc_feature 1..14: note = hypo
  source 1..14: mol_type = genomic DNA
acggaaagtgtttg

SEQ ID NO: 25263 - DNA, 76 bp, Homo sapiens; identical to SEQ ID NO: 16023
  misc_feature 1..76: note = chr16:9005728-9005804
  misc_feature 1..76: note = hypo
  source 1..76: mol_type = genomic DNA

SEQ ID NO: 25264 - DNA, 30 bp, Homo sapiens; identical to SEQ ID NO: 16024
  misc_feature 1..30: note = chr16:9010029-9010059
  misc_feature 1..30: note = hypo
  source 1..30: mol_type = genomic DNA

SEQ ID NO: 25265 - DNA, 30 bp, Homo sapiens; identical to SEQ ID NO: 16025
  misc_feature 1..30: note = chr16:10804588-10804618
  misc_feature 1..30: note = hypo
  source 1..30: mol_type = genomic DNA

SEQ ID NO: 25266 - DNA, 71 bp, Homo sapiens
  misc_feature 1..71: note = chr16:14725771-14725842
  misc_feature 1..71: note = hypo
  source 1..71: mol_type = genomic DNA
tgaactgggaagcagcgtattaataaatctgtataaataactgtttaatgggggcctggcgccatgactca

SEQ ID NO: 25267 - DNA, 30 bp, Homo sapiens; identical to SEQ ID NO: 16027
  misc_feature 1..30: note = chr16:15762701-15762731
  misc_feature 1..30: note = hypo
  source 1..30: mol_type = genomic DNA

SEQ ID NO: 25268 - DNA, 28 bp, Homo sapiens
  misc_feature 1..28: note = chr16:15820865-15820893
  misc_feature 1..28: note = hypo
  source 1..28: mol_type = genomic DNA
tctctttctccagcgtctgcttattctt

SEQ ID NO: 25269 - DNA, 30 bp, Homo sapiens; identical to SEQ ID NO: 16031
  misc_feature 1..30: note = chr16:19534836-19534866
  misc_feature 1..30: note = hypo
  source 1..30: mol_type = genomic DNA

SEQ ID NO: 25270 - DNA, 30 bp, Homo sapiens; identical to SEQ ID NO: 16032
  misc_feature 1..30: note = chr16:23303315-23303345
  misc_feature 1..30: note = hypo
  source 1..30: mol_type = genomic DNA

SEQ ID NO: 25271 - DNA, 42 bp, Homo sapiens; identical to SEQ ID NO: 16034
  misc_feature 1..42: note = chr16:28560194-28560236
  misc_feature 1..42: note = hypo
  source 1..42: mol_type = genomic DNA

SEQ ID NO: 25272 - DNA, 78 bp, Homo sapiens; identical to SEQ ID NO: 16035
  misc_feature 1..78: note = chr16:28878714-28878792
  misc_feature 1..78: note = hypo
  source 1..78: mol_type = genomic DNA

SEQ ID NO: 25273 - DNA, 34 bp, Homo sapiens; identical to SEQ ID NO: 16036
  misc_feature 1..34: note = chr16:29139111-29139145
  misc_feature 1..34: note = hypo
  source 1..34: mol_type = genomic DNA

SEQ ID NO: 25274 - DNA, 55 bp, Homo sapiens; identical to SEQ ID NO: 16037
  misc_feature 1..55: note = chr16:29153203-29153258
  misc_feature 1..55: note = hypo
  source 1..55: mol_type = genomic DNA

SEQ ID NO: 25275 - DNA, 45 bp, Homo sapiens
  misc_feature 1..45: note = chr16:29831078-29831123
  misc_feature 1..45: note = hypo
  source 1..45: mol_type = genomic DNA
ccactgctcctgcctctagggtgcagtgtccgtacctgctggagc

SEQ ID NO: 25276 - DNA, 40 bp, Homo sapiens
  misc_feature 1..40: note = chr16:30017290-30017330
  misc_feature 1..40: note = hypo
  source 1..40: mol_type = genomic DNA
atttgcagggactagcgagtcaggcaggaggtttgcatat

SEQ ID NO: 25277 - DNA, 180 bp, Homo sapiens
  misc_feature 1..180: note = chr16:30017447-30017627
  misc_feature 1..180: note = hypo
  source 1..180: mol_type = genomic DNA
tgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgg

SEQ ID NO: 25278 - DNA, 124 bp, Homo sapiens
  misc_feature 1..124: note = chr16:30124567-30124691
  misc_feature 1..124: note = hypo
  source 1..124: mol_type = genomic DNA
tcttggtccctgccccgtttctagcatgcccccttggacctacccctctgtgctgtccactttggcacctgttctcacccctacccggctcacctcctcggtgggcccccaggcggatgcggaa

SEQ ID NO: 25279 - DNA, 123 bp, Homo sapiens
  misc_feature 1..123: note = chr16:30907148-30907271
  misc_feature 1..123: note = hypo
  source 1..123: mol_type = genomic DNA
acgcagacacacgcaagcgcacacacacacgggcctcctcgtcttcattcacaaaccccattagcttctgttgtctatgggcttcctcgacagaccgcgagcccctcgcgggggccagaaacc

SEQ ID NO: 25280 - DNA, 120 bp, Homo sapiens; identical to SEQ ID NO: 16045
  misc_feature 1..120: note = chr16:31138607-31138727
  misc_feature 1..120: note = hypo
  source 1..120: mol_type = genomic DNA

SEQ ID NO: 25281 - DNA, 105 bp, Homo sapiens; identical to SEQ ID NO: 16048
  misc_feature 1..105: note = chr16:33893476-33893581
  misc_feature 1..105: note = hypo
  source 1..105: mol_type = genomic DNA

SEQ ID NO: 25282 - DNA, 19 bp, Homo sapiens
  misc_feature 1..19: note = chr16:46721707-46721726
  misc_feature 1..19: note = hypo
  source 1..19: mol_type = genomic DNA
taagcgagctgcctaaatt

SEQ ID NO: 25283 - DNA, 91 bp, Homo sapiens; identical to SEQ ID NO: 16050
  misc_feature 1..91: note = chr16:48642042-48642133
  misc_feature 1..91: note = hypo
  source 1..91: mol_type = genomic DNA

SEQ ID NO: 25284 - DNA, 34 bp, Homo sapiens; identical to SEQ ID NO: 16051
  misc_feature 1..34: note = chr16:53448517-53448551
  misc_feature 1..34: note = hypo
  source 1..34: mol_type = genomic DNA

SEQ ID NO: 25285 - DNA, 30 bp, Homo sapiens; identical to SEQ ID NO: 16053
  misc_feature 1..30: note = chr16:55203930-55203960
  misc_feature 1..30: note = hypo
  source 1..30: mol_type = genomic DNA

SEQ ID NO: 25286 - DNA, 30 bp, Homo sapiens; identical to SEQ ID NO: 16054
  misc_feature 1..30: note = chr16:57222226-57222256
  misc_feature 1..30: note = hypo
  source 1..30: mol_type = genomic DNA

SEQ ID NO: 25287 - DNA, 30 bp, Homo sapiens; identical to SEQ ID NO: 16055
  misc_feature 1..30: note = chr16:57759922-57759952
  misc_feature 1..30: note = hypo
  source 1..30: mol_type = genomic DNA

SEQ ID NO: 25288 - DNA, 38 bp, Homo sapiens; identical to SEQ ID NO: 16056
  misc_feature 1..38: note = chr16:59046529-59046567
  misc_feature 1..38: note = hypo
  source 1..38: mol_type = genomic DNA

SEQ ID NO: 25289 - DNA, 63 bp, Homo sapiens
  misc_feature 1..63: note = chr16:67313895-67313958
  misc_feature 1..63: note = hypo
  source 1..63: mol_type = genomic DNA
gacccagccctctcccgctggccccgagcaggcccacctttaggagggcgtgatggaaaggcc

SEQ ID NO: 25290 - DNA, 39 bp, Homo sapiens; identical to SEQ ID NO: 16058
  misc_feature 1..39: note = chr16:67578633-67578672
  misc_feature 1..39: note = hypo
  source 1..39: mol_type = genomic DNA

SEQ ID NO: 25291 - DNA, 27 bp, Homo sapiens
  misc_feature 1..27: note = chr16:68770701-68770728
  misc_feature 1..27: note = hypo
  source 1..27: mol_type = genomic DNA
aaaaaattagcctggcgtggtggtgtg

SEQ ID NO: 25292 - DNA, 29 bp, Homo sapiens
  misc_feature 1..29: note = chr16:71919039-71919068
  misc_feature 1..29: note = hypo
  source 1..29: mol_type = genomic DNA
taagccactgtgcccggcctggttggacg

SEQ ID NO: 25293 - DNA, 84 bp, Homo sapiens; identical to SEQ ID NO: 16064
  misc_feature 1..84: note = chr16:72461607-72461691
  misc_feature 1..84: note = hypo
  source 1..84: mol_type = genomic DNA

SEQ ID NO: 25294 - DNA, 19 bp, Homo sapiens
  misc_feature 1..19: note = chr16:72957744-72957763
  misc_feature 1..19: note = hypo
  source 1..19: mol_type = genomic DNA
tactttgaattgcctcgtc

SEQ ID NO: 25295 - DNA, 19 bp, Homo sapiens
  misc_feature 1..19: note = chr16:75019669-75019688
  misc_feature 1..19: note = hypo
  source 1..19: mol_type = genomic DNA
aaaccgaagatacctcttc

SEQ ID NO: 25296 - DNA, 209 bp, Homo sapiens; identical to SEQ ID NO: 16067
  misc_feature 1..209: note = chr16:75148827-75149036
  misc_feature 1..209: note = hypo
  source 1..209: mol_type = genomic DNA

SEQ ID NO: 25297 - DNA, 37 bp, Homo sapiens; identical to SEQ ID NO: 16068
  misc_feature 1..37: note = chr16:75469082-75469119
  misc_feature 1..37: note = hypo
  source 1..37: mol_type = genomic DNA

SEQ ID NO: 25298 - DNA, 30 bp, Homo sapiens; identical to SEQ ID NO: 16069
  misc_feature 1..30: note = chr16:80654771-80654801
  misc_feature 1..30: note = hypo
  source 1..30: mol_type = genomic DNA

SEQ ID NO: 25299 - DNA, 30 bp, Homo sapiens; identical to SEQ ID NO: 16070
  misc_feature 1..30: note = chr16:81533258-81533288
  misc_feature 1..30: note = hypo
  source 1..30: mol_type = genomic DNA

SEQ ID NO: 25300 - DNA, 180 bp, Homo sapiens; identical to SEQ ID NO: 16071
  misc_feature 1..180: note = chr16:81632932-81633112
  misc_feature 1..180: note = hypo
  source 1..180: mol_type = genomic DNA

SEQ ID NO: 25301 - DNA, 30 bp, Homo sapiens; identical to SEQ ID NO: 16072
  misc_feature 1..30: note = chr16:83968795-83968825
  misc_feature 1..30: note = hypo
  source 1..30: mol_type = genomic DNA

SEQ ID NO: 25302 - DNA, 41 bp, Homo sapiens; identical to SEQ ID NO: 16073
  misc_feature 1..41: note = chr16:84075186-84075227
  misc_feature 1..41: note = hypo
  source 1..41: mol_type = genomic DNA

SEQ ID NO: 25303 - DNA, 58 bp, Homo sapiens; identical to SEQ ID NO: 16075
  misc_feature 1..58: note = chr16:85007798-85007856
  misc_feature 1..58: note = hypo
  source 1..58: mol_type = genomic DNA

SEQ ID NO: 25304 - DNA, 173 bp, Homo sapiens; identical to SEQ ID NO: 16076
  misc_feature 1..173: note = chr16:85028164-85028337
  misc_feature 1..173: note = hypo
  source 1..173: mol_type = genomic DNA

SEQ ID NO: 25305 - DNA, 55 bp, Homo sapiens; identical to SEQ ID NO: 16077
  misc_feature 1..55: note = chr16:85033827-85033882
  misc_feature 1..55: note = hypo
  source 1..55: mol_type = genomic DNA

SEQ ID NO: 25306 - DNA, 16 bp, Homo sapiens
  misc_feature 1..16: note = chr16:85043890-85043906
  misc_feature 1..16: note = hypo
  source 1..16: mol_type = genomic DNA
gcgctgggattacagg

SEQ ID NO: 25307 - DNA, 17 bp, Homo sapiens
  misc_feature 1..17: note = chr16:85075553-85075570
  misc_feature 1..17: note = hypo
  source 1..17: mol_type = genomic DNA
tgcgcactcctgtccct

SEQ ID NO: 25308 - DNA, 101 bp, Homo sapiens; identical to SEQ ID NO: 16080
  misc_feature 1..101: note = chr16:85083589-85083690
  misc_feature 1..101: note = hypo
  source 1..101: mol_type = genomic DNA

SEQ ID NO: 25309 - DNA, 197 bp, Homo sapiens; identical to SEQ ID NO: 16081
  misc_feature 1..197: note = chr16:85336384-85336581
  misc_feature 1..197: note = hypo
  source 1..197: mol_type = genomic DNA

SEQ ID NO: 25310 - DNA, 68 bp, Homo sapiens; identical to SEQ ID NO: 16082
  misc_feature 1..68: note = chr16:85455150-85455218
  misc_feature 1..68: note = hypo
  source 1..68: mol_type = genomic DNA

SEQ ID NO: 25311 - DNA, 32 bp, Homo sapiens; identical to SEQ ID NO: 16084
  misc_feature 1..32: note = chr16:85671134-85671166
  misc_feature 1..32: note = hypo
  source 1..32: mol_type = genomic DNA

SEQ ID NO: 25312 - DNA, 34 bp, Homo sapiens; identical to SEQ ID NO: 16085
  misc_feature 1..34: note = chr16:85673852-85673886
  misc_feature 1..34: note = hypo
  source 1..34: mol_type = genomic DNA

SEQ ID NO: 25313 - DNA, 110 bp, Homo sapiens; identical to SEQ ID NO: 16086
  misc_feature 1..110: note = chr16:85674157-85674267
  misc_feature 1..110: note = hypo
  source 1..110: mol_type = genomic DNA

SEQ ID NO: 25314 - DNA, 71 bp, Homo sapiens
  misc_feature 1..71: note = chr16:85684237-85684308
  misc_feature 1..71: note = hypo
  source 1..71: mol_type = genomic DNA
ccagcagtgtaccaccgcggcgcttaatggaacacggtgccgccagggaaggcgcggggccggcagctgga

SEQ ID NO: 25315 - DNA, 84 bp, Homo sapiens
  misc_feature 1..84: note = chr16:85684457-85684541
  misc_feature 1..84: note = hypo
  source 1..84: mol_type = genomic DNA
gttgccgggccggaggcttctcggccccttctcggggtcacccctctctcccaggtgtagtgggagctgcgagaggagaaatga

SEQ ID NO: 25316 - DNA, 30 bp, Homo sapiens; identical to SEQ ID NO: 16088
  misc_feature 1..30: note = chr16:85721581-85721611
  misc_feature 1..30: note = hypo
  source 1..30: mol_type = genomic DNA

SEQ ID NO: 25317 - DNA, 30 bp, Homo sapiens; identical to SEQ ID NO: 16089
  misc_feature 1..30: note = chr16:85731482-85731512
  misc_feature 1..30: note = hypo
  source 1..30: mol_type = genomic DNA

SEQ ID NO: 25318 - DNA, 147 bp, Homo sapiens; identical to SEQ ID NO: 16090
  misc_feature 1..147: note = chr16:87296936-87297083
  misc_feature 1..147: note = hypo
  source 1..147: mol_type = genomic DNA

SEQ ID NO: 25319 - DNA, 22 bp, Homo sapiens
  misc_feature 1..22: note = chr16:87421399-87421421
  misc_feature 1..22: note = hypo
  source 1..22: mol_type = genomic DNA
gcctgggcgacagagagaaaaa

SEQ ID NO: 25320 - DNA, 102 bp, Homo sapiens; identical to SEQ ID NO: 16092
  misc_feature 1..102: note = chr16:87594957-87595059
  misc_feature 1..102: note = hypo
  source 1..102: mol_type = genomic DNA

SEQ ID NO: 25321 - DNA, 90 bp, Homo sapiens; identical to SEQ ID NO: 16093
  misc_feature 1..90: note = chr16:87723156-87723246
  misc_feature 1..90: note = hypo
  source 1..90: mol_type = genomic DNA

SEQ ID NO: 25322 - DNA, 87 bp, Homo sapiens
  misc_feature 1..87: note = chr16:87723648-87723735
  misc_feature 1..87: note = hypo
  source 1..87: mol_type = genomic DNA
gggccgcaagcagcccgggaaccccaagccgcgggagcggcggacggagtcaccccccgtgttcacgtggacttcccaccaccgggc

SEQ ID NO: 25323 - DNA, 15 bp, Homo sapiens
  misc_feature 1..15: note = chr16:87724098-87724113
  misc_feature 1..15: note = hypo
  source 1..15: mol_type = genomic DNA
cgaggagaatgggga

SEQ ID NO: 25324 - DNA, 30 bp, Homo sapiens; identical to SEQ ID NO: 16096
  misc_feature 1..30: note = chr16:88503235-88503265
  misc_feature 1..30: note = hypo
  source 1..30: mol_type = genomic DNA

SEQ ID NO: 25325 - DNA, 41 bp, Homo sapiens
  misc_feature 1..41: note = chr16:88504017-88504058
  misc_feature 1..41: note = hypo
  source 1..41: mol_type = genomic DNA
gctggcacacctgggcggggcgcacgggctgctggagcggc

SEQ ID NO: 25326 - DNA, 15 bp, Homo sapiens
  misc_feature 1..15: note = chr16:88506526-88506541
  misc_feature 1..15: note = hypo
  source 1..15: mol_type = genomic DNA
cgcctatttgcaatg

SEQ ID NO: 25327 - DNA, 56 bp, Homo sapiens; identical to SEQ ID NO: 16099
  misc_feature 1..56: note = chr16:88508016-88508072
  misc_feature 1..56: note = hypo
  source 1..56: mol_type = genomic DNA

SEQ ID NO: 25328 - DNA, 30 bp, Homo sapiens; identical to SEQ ID NO: 16100
  misc_feature 1..30: note = chr16:88551519-88551549
  misc_feature 1..30: note = hypo
  source 1..30: mol_type = genomic DNA

SEQ ID NO: 25329 - DNA, 16 bp, Homo sapiens
  misc_feature 1..16: note = chr16:88603760-88603776
  misc_feature 1..16: note = hypo
  source 1..16: mol_type = genomic DNA
tcgaagcttagggcag

SEQ ID NO: 25330 - DNA, 45 bp, Homo sapiens; identical to SEQ ID NO: 16103
  misc_feature 1..45: note = chr16:88624831-88624876
  misc_feature 1..45: note = hypo
  source 1..45: mol_type = genomic DNA

SEQ ID NO: 25331 - DNA, 30 bp, Homo sapiens; identical to SEQ ID NO: 16104
  misc_feature 1..30: note = chr16:88683871-88683901
  misc_feature 1..30: note = hypo
  source 1..30: mol_type = genomic DNA

SEQ ID NO: 25332 - DNA, 48 bp, Homo sapiens; identical to SEQ ID NO: 16105
  misc_feature 1..48: note = chr16:88757586-88757634
  misc_feature 1..48: note = hypo
  source 1..48: mol_type = genomic DNA

SEQ ID NO: 25333 - DNA, 41 bp, Homo sapiens; identical to SEQ ID NO: 16106
  misc_feature 1..41: note = chr16:88832763-88832804
  misc_feature 1..41: note = hypo
  source 1..41: mol_type = genomic DNA

SEQ ID NO: 25334 - DNA, 77 bp, Homo sapiens
  misc_feature 1..77: note = chr16:88883377-88883454
  misc_feature 1..77: note = hypo
  source 1..77: mol_type = genomic DNA
tgctcggtgggctctgggcacccaggagcgacaccgcagacctgtgtgtggctcgtttttgccgactagagcgaggg

SEQ ID NO: 25335 - DNA, 30 bp, Homo sapiens; identical to SEQ ID NO: 16108
  misc_feature 1..30: note = chr16:88931261-88931291
  misc_feature 1..30: note = hypo
  source 1..30: mol_type = genomic DNA

SEQ ID NO: 25336 - DNA, 30 bp, Homo sapiens; identical to SEQ ID NO: 16109
  misc_feature 1..30: note = chr16:88943136-88943166
  misc_feature 1..30: note = hypo
  source 1..30: mol_type = genomic DNA

SEQ ID NO: 25337 - DNA, 213 bp, Homo sapiens
  misc_feature 1..213: note = chr16:88945602-88945815
  misc_feature 1..213: note = hypo
  source 1..213: mol_type = genomic DNA
tcctcatgggggtggcgtgggaccgcacgggagccgaggcaggggatgggtgtcagcgtggccgggtggccctacctcgctggagtcctcctgctggttgatgaccgtcagggcgtcctcggaggcctgccgcttcgcctcggccagggcccgctccatcttggcacgctccgtggtgatgagctcgtgcgctttgcgctccgcgtccgacac

SEQ ID NO: 25338 - DNA, 84 bp, Homo sapiens
  misc_feature 1..84: note = chr16:88945995-88946079
  misc_feature 1..84: note = hypo
  source 1..84: mol_type = genomic DNA
cacaaaggcacatgttgatggggctgtaggcagctgaacacacgtagcatctgtgcacacacagacacacgttgatggccctca

SEQ ID NO: 25339 - DNA, 138 bp, Homo sapiens; identical to SEQ ID NO: 16112
  misc_feature 1..138: note = chr16:88948551-88948689
  misc_feature 1..138: note = hypo
  source 1..138: mol_type = genomic DNA

SEQ ID NO: 25340 - DNA, 186 bp, Homo sapiens; identical to SEQ ID NO: 16113
  misc_feature 1..186: note = chr16:88952219-88952405
  misc_feature 1..186: note = hypo
  source 1..186: mol_type = genomic DNA

SEQ ID NO: 25341 - DNA, 30 bp, Homo sapiens; identical to SEQ ID NO: 16114
  misc_feature 1..30: note = chr16:88952665-88952695
  misc_feature 1..30: note = hypo
  source 1..30: mol_type = genomic DNA

SEQ ID NO: 25342 - DNA, 41 bp, Homo sapiens
  misc_feature 1..41: note = chr16:88955208-88955249
  misc_feature 1..41: note = hypo
  source 1..41: mol_type = genomic DNA
ccccgggtgggggcacgaggtgggctggccctgagctccag

SEQ ID NO: 25343 - DNA, 89 bp, Homo sapiens
  misc_feature 1..89: note = chr16:88957857-88957946
  misc_feature 1..89: note = hypo
  source 1..89: mol_type = genomic DNA
gggtgctggctccaggagggacctgctgcatgtcctgggccctatccccgagccttgcccccacactggcacgtcgtcagtgctcaaaa

SEQ ID NO: 25344 - DNA, 39 bp, Homo sapiens
  misc_feature 1..39: note = chr16:88958358-88958397
  misc_feature 1..39: note = hypo
  source 1..39: mol_type = genomic DNA
ctcgatcgtcaatgtcgagttctgcaggggagaaaaccc

SEQ ID NO: 25345 - DNA, 18 bp, Homo sapiens
  misc_feature 1..18: note = chr16:88958431-88958449
  misc_feature 1..18: note = hypo
  source 1..18: mol_type = genomic DNA
cgccgacccacccatgcc

SEQ ID NO: 25346 - DNA, 63 bp, Homo sapiens
  misc_feature 1..63: note = chr16:88963214-88963277
  misc_feature 1..63: note = hypo
  source 1..63: mol_type = genomic DNA
gccctcccttaggtgcgcttaccagccttgccccgggtgcctggtccttccggcggcctgctc

SEQ ID NO: 25347 - DNA, 30 bp, Homo sapiens; identical to SEQ ID NO: 16121
  misc_feature 1..30: note = chr16:88976653-88976683
  misc_feature 1..30: note = hypo
  source 1..30: mol_type = genomic DNA

SEQ ID NO: 25348 - DNA, 57 bp, Homo sapiens; identical to SEQ ID NO: 16123
  misc_feature 1..57: note = chr16:88994398-88994455
  misc_feature 1..57: note = hypo
  source 1..57: mol_type = genomic DNA

SEQ ID NO: 25349 - DNA, 19 bp, Homo sapiens
  misc_feature 1..19: note = chr16:89001075-89001094
  misc_feature 1..19: note = hypo
  source 1..19: mol_type = genomic DNA
gaggcagagatgccacgaa

SEQ ID NO: 25350 - DNA, 38 bp, Homo sapiens; identical to SEQ ID NO: 16126
  misc_feature 1..38: note = chr16:89025782-89025820
  misc_feature 1..38: note = hypo
  source 1..38: mol_type = genomic DNA

SEQ ID NO: 25351 - DNA, 30 bp, Homo sapiens; identical to SEQ ID NO: 16127
  misc_feature 1..30: note = chr16:89026022-89026052
  misc_feature 1..30: note = hypo
  source 1..30: mol_type = genomic DNA

SEQ ID NO: 25352 - DNA, 256 bp, Homo sapiens; identical to SEQ ID NO: 16128
  misc_feature 1..256: note = chr16:89055673-89055929
  misc_feature 1..256: note = hypo
  source 1..256: mol_type = genomic DNA

SEQ ID NO: 25353 - DNA, 52 bp, Homo sapiens
  misc_feature 1..52: note = chr16:89107732-89107784
  misc_feature 1..52: note = hypo
  source 1..52: mol_type = genomic DNA
ccctacacctgcaatcccctgagggacgggaggaggccggtagtccatgagc

SEQ ID NO: 25354 - DNA, 30 bp, Homo sapiens; identical to SEQ ID NO: 16131
  misc_feature 1..30: note = chr16:89109506-89109536
  misc_feature 1..30: note = hypo
  source 1..30: mol_type = genomic DNA

SEQ ID NO: 25355 - DNA, 17 bp, Homo sapiens
  misc_feature 1..17: note = chr16:89120319-89120336
  misc_feature 1..17: note = hypo
  source 1..17: mol_type = genomic DNA
ggcgggcaggtgctgga

SEQ ID NO: 25356 - DNA, 115 bp, Homo sapiens; identical to SEQ ID NO: 16135
  misc_feature 1..115: note = chr16:89172217-89172332
  misc_feature 1..115: note = hypo
  source 1..115: mol_type = genomic DNA

SEQ ID NO: 25357 - DNA, 30 bp, Homo sapiens; identical to SEQ ID NO: 16136
  misc_feature 1..30: note = chr16:89189873-89189903
  misc_feature 1..30: note = hypo
  source 1..30: mol_type = genomic DNA

SEQ ID NO: 25358 - DNA, 14 bp, Homo sapiens
  misc_feature 1..14: note = chr16:89220641-89220655
  misc_feature 1..14: note = hypo
  source 1..14: mol_type = genomic DNA
gtggggagcagcag

SEQ ID NO: 25359 - DNA, 104 bp, Homo sapiens
  misc_feature 1..104: note = chr16:89220922-89221026
  misc_feature 1..104: note = hypo
  source 1..104: mol_type = genomic DNA
tgcagttgccaggctctccagggcaggtcccagaggtttcccacaaaaaacaaagactccactggaggaaacaagcccctgtcccacgccgtctgcacgtgcct

SEQ ID NO: 25360 - DNA, 30 bp, Homo sapiens; identical to SEQ ID NO: 16139
  misc_feature 1..30: note = chr16:89225881-89225911
  misc_feature 1..30: note = hypo
  source 1..30: mol_type = genomic DNA

SEQ ID NO: 25361 - DNA, 34 bp, Homo sapiens; identical to SEQ ID NO: 16140
  misc_feature 1..34: note = chr16:89226363-89226397
  misc_feature 1..34: note = hypo
  source 1..34: mol_type = genomic DNA

SEQ ID NO: 25362 - DNA, 126 bp, Homo sapiens; identical to SEQ ID NO: 16141
  misc_feature 1..126: note = chr16:89245316-89245442
  misc_feature 1..126: note = hypo
  source 1..126: mol_type = genomic DNA

SEQ ID NO: 25363 - DNA, 35 bp, Homo sapiens; identical to SEQ ID NO: 16142
  misc_feature 1..35: note = chr16:89245710-89245745
  misc_feature 1..35: note = hypo
  source 1..35: mol_type = genomic DNA

SEQ ID NO: 25364 - DNA, 20 bp, Homo sapiens
  misc_feature 1..20: note = chr16:89254633-89254653
  misc_feature 1..20: note = hypo
  source 1..20: mol_type = genomic DNA
gggcagttcaccatccgcac

SEQ ID NO: 25365 - DNA, 24 bp, Homo sapiens
  misc_feature 1..24: note = chr16:89575654-89575678
  misc_feature 1..24: note = hypo
  source 1..24: mol_type = genomic DNA
aggttgttgttttttcggttattt

SEQ ID NO: 25366 - DNA, 30 bp, Homo sapiens; identical to SEQ ID NO: 16146
  misc_feature 1..30: note = chr16:89576068-89576098
  misc_feature 1..30: note = hypo
  source 1..30: mol_type = genomic DNA

SEQ ID NO: 25367 - DNA, 79 bp, Homo sapiens; identical to SEQ ID NO: 16147
  misc_feature 1..79: note = chr16:89655054-89655133
  misc_feature 1..79: note = hypo
  source 1..79: mol_type = genomic DNA

SEQ ID NO: 25368 - DNA, 30 bp, Homo sapiens; identical to SEQ ID NO: 16148
  misc_feature 1..30: note = chr16:89668379-89668409
  misc_feature 1..30: note = hypo
  source 1..30: mol_type = genomic DNA

SEQ ID NO: 25369 - DNA, 40 bp, Homo sapiens; identical to SEQ ID NO: 16149
  misc_feature 1..40: note = chr16:89702746-89702786
  misc_feature 1..40: note = hypo
  source 1..40: mol_type = genomic DNA

SEQ ID NO: 25370 - DNA, 30 bp, Homo sapiens; identical to SEQ ID NO: 16150
  misc_feature 1..30: note = chr16:89704648-89704678
  misc_feature 1..30: note = hypo
  source 1..30: mol_type = genomic DNA

SEQ ID NO: 25371 - DNA, 20 bp, Homo sapiens
  misc_feature 1..20: note = chr16:89883952-89883972
  misc_feature 1..20: note = hypo
  source 1..20: mol_type = genomic DNA
ccaaacataagaattcgtaa

SEQ ID NO: 25372 - DNA, 165 bp, Homo sapiens; identical to SEQ ID NO: 16152
  misc_feature 1..165: note = chr16:89900625-89900790
  misc_feature 1..165: note = hypo
  source 1..165: mol_type = genomic DNA

SEQ ID NO: 25373 - DNA, 40 bp, Homo sapiens; identical to SEQ ID NO: 16153
  misc_feature 1..40: note = chr16:90066907-90066947
  misc_feature 1..40: note = hypo
  source 1..40: mol_type = genomic DNA

SEQ ID NO: 25374 - DNA, 133 bp, Homo sapiens; identical to SEQ ID NO: 16154
  misc_feature 1..133: note = chr16:90069191-90069324
  misc_feature 1..133: note = hypo
  source 1..133: mol_type = genomic DNA

SEQ ID NO: 25375 - DNA, 32 bp, Homo sapiens; identical to SEQ ID NO: 5187
  misc_feature 1..32: note = chr17:1136665-1136697
  misc_feature 1..32: note = hypo
  source 1..32: mol_type = genomic DNA

SEQ ID NO: 25376 - DNA, 18 bp, Homo sapiens
  misc_feature 1..18: note = chr17:1471448-1471466
  misc_feature 1..18: note = hypo
  source 1..18: mol_type = genomic DNA
acccggccactctttcat

SEQ ID NO: 25377 - skipped

SEQ ID NO: 25378 - DNA, 30 bp, Homo sapiens; identical to SEQ ID NO: 16160
  misc_feature 1..30: note = chr17:2298979-2299009
  misc_feature 1..30: note = hypo
  source 1..30: mol_type = genomic DNA

SEQ ID NO: 25379 - DNA, 170 bp, Homo sapiens; identical to SEQ ID NO: 16162
  misc_feature 1..170: note = chr17:3741605-3741775
  misc_feature 1..170: note = hypo
  source 1..170: mol_type = genomic DNA

SEQ ID NO: 25380 - DNA, 39 bp, Homo sapiens; identical to SEQ ID NO: 16163
  misc_feature 1..39: note = chr17:4236673-4236712
  misc_feature 1..39: note = hypo
  source 1..39: mol_type = genomic DNA

SEQ ID NO: 25381 - DNA, 30 bp, Homo sapiens; identical to SEQ ID NO: 16164
  misc_feature 1..30: note = chr17:4976853-4976883
  misc_feature 1..30: note = hypo
  source 1..30: mol_type = genomic DNA

SEQ ID NO: 25382 - DNA, 69 bp, Homo sapiens; identical to SEQ ID NO: 16165
  misc_feature 1..69: note = chr17:7466711-7466780
  misc_feature 1..69: note = hypo
  source 1..69: mol_type = genomic DNA

SEQ ID NO: 25383 - DNA, 88 bp, Homo sapiens; identical to SEQ ID NO: 16166
  misc_feature 1..88: note = chr17:8104512-8104600
  misc_feature 1..88: note = hypo
  source 1..88: mol_type = genomic DNA

SEQ ID NO: 25384 - DNA, 33 bp, Homo sapiens; identical to SEQ ID NO: 16167
  misc_feature 1..33: note = chr17:8384676-8384709
  misc_feature 1..33: note = hypo
  source 1..33: mol_type = genomic DNA

SEQ ID NO: 25385 - DNA, 30 bp, Homo sapiens; identical to SEQ ID NO: 16168
  misc_feature 1..30: note = chr17:10212959-10212989
  misc_feature 1..30: note = hypo
  source 1..30: mol_type = genomic DNA

SEQ ID NO: 25386 - DNA, 30 bp, Homo sapiens; identical to SEQ ID NO: 16169
  misc_feature 1..30: note = chr17:11572707-11572737
  misc_feature 1..30: note = hypo
  source 1..30: mol_type = genomic DNA

SEQ ID NO: 25387 - DNA, 30 bp, Homo sapiens; identical to SEQ ID NO: 16170
  misc_feature 1..30: note = chr17:11637568-11637598
  misc_feature 1..30: note = hypo
  source 1..30: mol_type = genomic DNA

SEQ ID NO: 25388 - DNA, 30 bp, Homo sapiens; identical to SEQ ID NO: 16171
  misc_feature 1..30: note = chr17:16282207-16282237
  misc_feature 1..30: note = hypo
  source 1..30: mol_type = genomic DNA

SEQ ID NO: 25389 - DNA, 187 bp, Homo sapiens; identical to SEQ ID NO: 16172
  misc_feature 1..187: note = chr17:17579341-17579528
  misc_feature 1..187: note = hypo
  source 1..187: mol_type = genomic DNA

SEQ ID NO: 25390 - DNA, 96 bp, Homo sapiens; identical to SEQ ID NO: 16173
  misc_feature 1..96: note = chr17:17891258-17891354
  misc_feature 1..96: note = hypo
  source 1..96: mol_type = genomic DNA

SEQ ID NO: 25391 - DNA, 29 bp, Homo sapiens
  misc_feature 1..29: note = chr17:18163325-18163354
  misc_feature 1..29: note = hypo
  source 1..29: mol_type = genomic DNA
tgttcaagggggctcgccctggctgacac

SEQ ID NO: 25392 - DNA, 20 bp, Homo sapiens
  misc_feature 1..20: note = chr17:19769860-19769880
  misc_feature 1..20: note = hypo
  source 1..20: mol_type = genomic DNA
tcatccgataagcaacaaag

SEQ ID NO: 25393 - DNA, 37 bp, Homo sapiens; identical to SEQ ID NO: 16176
  misc_feature 1..37: note = chr17:20771887-20771924
  misc_feature 1..37: note = hypo
  source 1..37: mol_type = genomic DNA

SEQ ID NO: 25394 - DNA, 23 bp, Homo sapiens
  misc_feature 1..23: note = chr17:20817586-20817609
  misc_feature 1..23: note = hypo
  source 1..23: mol_type = genomic DNA
aatgtgactcttggccgggcgcg

SEQ ID NO: 25395 - DNA, 30 bp, Homo sapiens; identical to SEQ ID NO: 16178
  misc_feature 1..30: note = chr17:21104001-21104031
  misc_feature 1..30: note = hypo
  source 1..30: mol_type = genomic DNA

SEQ ID NO: 25396 - DNA, 53 bp, Homo sapiens; identical to SEQ ID NO: 16179
  misc_feature 1..53: note = chr17:21147486-21147539
  misc_feature 1..53: note = hypo
  source 1..53: mol_type = genomic DNA

SEQ ID NO: 25397 - DNA, 33 bp, Homo sapiens; identical to SEQ ID NO: 1617
  misc_feature 1..33: note = chr17:26927180-26927213
  misc_feature 1..33: note = hypo
  source 1..33: mol_type = genomic DNA

SEQ ID NO: 25398 - DNA, 24 bp, Homo sapiens
  misc_feature 1..24: note = chr17:27056401-27056425
  misc_feature 1..24: note = hypo
  source 1..24: mol_type = genomic DNA
ctccctctgtcaccccggctggag

SEQ ID NO: 25399 - DNA, 12 bp, Homo sapiens
  misc_feature 1..12: note = chr17:27056857-27056869
  misc_feature 1..12: note = hypo
  source 1..12: mol_type = genomic DNA
caggccagaagt

SEQ ID NO: 25400 - DNA, 30 bp, Homo sapiens; identical to SEQ ID NO: 16185
  misc_feature 1..30: note = chr17:27074858-27074888
  misc_feature 1..30: note = hypo
  source 1..30: mol_type = genomic DNA

SEQ ID NO: 25401 - DNA, 30 bp, Homo sapiens; identical to SEQ ID NO: 16187
  misc_feature 1..30: note = chr17:27411663-27411693
  misc_feature 1..30: note = hypo
  source 1..30: mol_type = genomic DNA

SEQ ID NO: 25402 - DNA, 68 bp, Homo sapiens
  misc_feature 1..68: note = chr17:27716046-27716114
  misc_feature 1..68: note = hypo
  source 1..68: mol_type = genomic DNA
catacactgtatacacggattgcttaggtctgatcaacatgctccttccttggagcacagatctacta

SEQ ID NO: 25403 - DNA, 57 bp, Homo sapiens
  misc_feature 1..57: note = chr17:27716220-27716277
  misc_feature 1..57: note = hypo
  source 1..57: mol_type = genomic DNA
ttttattcatgaaactcatataacaggtttatttatttcagtcgttttgttggttaa

SEQ ID NO: 25404 - DNA, 25 bp, Homo sapiens
  misc_feature 1..25: note = chr17:30243907-30243932
  misc_feature 1..25: note = hypo
  source 1..25: mol_type = genomic DNA
ccctgggctgcgcagccccagccag

SEQ ID NO: 25405 - DNA, 30 bp, Homo sapiens; identical to SEQ ID NO: 16192
  misc_feature 1..30: note = chr17:31214057-31214087
  misc_feature 1..30: note = hypo
  source 1..30: mol_type = genomic DNA

SEQ ID NO: 25406 - DNA, 23 bp, Homo sapiens
  misc_feature 1..23: note = chr17:37011132-37011155
  misc_feature 1..23: note = hypo
  source 1..23: mol_type = genomic DNA
aatataaatagtggccgggcctt

SEQ ID NO: 25407 - DNA, 21 bp, Homo sapiens
  misc_feature 1..21: note = chr17:37369159-37369180
  misc_feature 1..21: note = hypo
  source 1..21: mol_type = genomic DNA
cagagcatttacccccgcacc

SEQ ID NO: 25408 - DNA, 23 bp, Homo sapiens
  misc_feature 1..23: note = chr17:40477866-40477889
  misc_feature 1..23: note = hypo
  source 1..23: mol_type = genomic DNA
accgcgcccggccaatcaatttc

SEQ ID NO: 25409 - DNA, 108 bp, Homo sapiens; identical to SEQ ID NO: 16201
  misc_feature 1..108: note = chr17:41464822-41464930
  misc_feature 1..108: note = hypo
  source 1..108: mol_type = genomic DNA

SEQ ID NO: 25410 - DNA, 39 bp, Homo sapiens; identical to SEQ ID NO: 16202
  misc_feature 1..39: note = chr17:42330587-42330626
  misc_feature 1..39: note = hypo
  source 1..39: mol_type = genomic DNA

SEQ ID NO: 25411 - DNA, 102 bp, Homo sapiens; identical to SEQ ID NO: 1619
  misc_feature 1..102: note = chr17:42331669-42331771
  misc_feature 1..102: note = hypo
  source 1..102: mol_type = genomic DNA

SEQ ID NO: 25412 - DNA, 41 bp, Homo sapiens; identical to SEQ ID NO: 16204
  misc_feature 1..41: note = chr17:42395128-42395169
  misc_feature 1..41: note = hypo
  source 1..41: mol_type = genomic DNA

SEQ ID NO: 25413 - DNA, 24 bp, Homo sapiens
  misc_feature 1..24: note = chr17:46177212-46177236
  misc_feature 1..24: note = hypo
  source 1..24: mol_type = genomic DNA
taaaatatggccaggcgcagtggc

SEQ ID NO: 25414 - DNA, 86 bp, Homo sapiens; identical to SEQ ID NO: 16206
  misc_feature 1..86: note = chr17:47227368-47227454
  misc_feature 1..86: note = hypo
  source 1..86: mol_type = genomic DNA

SEQ ID NO: 25415 - DNA, 11 bp, Homo sapiens
  misc_feature 1..11: note = chr17:47657583-47657594
  misc_feature 1..11: note = hypo
  source 1..11: mol_type = genomic DNA
gagcatgtgct

SEQ ID NO: 25416 - DNA, 32 bp, Homo sapiens; identical to SEQ ID NO: 16208
  misc_feature 1..32: note = chr17:47851118-47851150
  misc_feature 1..32: note = hypo
  source 1..32: mol_type = genomic DNA

SEQ ID NO: 25417 - DNA, 31 bp, Homo sapiens; identical to SEQ ID NO: 16209
  misc_feature 1..31: note = chr17:47851390-47851421
  misc_feature 1..31: note = hypo
  source 1..31: mol_type = genomic DNA

SEQ ID NO: 25418 - DNA, 60 bp, Homo sapiens; identical to SEQ ID NO: 16211
  misc_feature 1..60: note = chr17:48653004-48653064
  misc_feature 1..60: note = hypo
  source 1..60: mol_type = genomic DNA

SEQ ID NO: 25419 - DNA, 54 bp, Homo sapiens; identical to SEQ ID NO: 16212
  misc_feature 1..54: note = chr17:48653279-48653333
  misc_feature 1..54: note = hypo
  source 1..54: mol_type = genomic DNA

SEQ ID NO: 25420 - DNA, 41 bp, Homo sapiens; identical to SEQ ID NO: 16213
  misc_feature 1..41: note = chr17:48687181-48687222
  misc_feature 1..41: note = hypo
  source 1..41: mol_type = genomic DNA

SEQ ID NO: 25421 - DNA, 39 bp, Homo sapiens; identical to SEQ ID NO: 16215
  misc_feature 1..39: note = chr17:53479136-53479175
  misc_feature 1..39: note = hypo
  source 1..39: mol_type = genomic DNA

SEQ ID NO: 25422 - DNA, 30 bp, Homo sapiens; identical to SEQ ID NO: 16216
  misc_feature 1..30: note = chr17:54473510-54473540
  misc_feature 1..30: note = hypo
  source 1..30: mol_type = genomic DNA

SEQ ID NO: 25423 - DNA, 34 bp, Homo sapiens; identical to SEQ ID NO: 5202
  misc_feature 1..34: note = chr17:55037248-55037282
  misc_feature 1..34: note = hypo
  source 1..34: mol_type = genomic DNA

SEQ ID NO: 25424 - DNA, 44 bp, Homo sapiens; identical to SEQ ID NO: 16218
  misc_feature 1..44: note = chr17:55184791-55184835
  misc_feature 1..44: note = hypo
  source 1..44: mol_type = genomic DNA

SEQ ID NO: 25425 - DNA, 102 bp, Homo sapiens; identical to SEQ ID NO: 16219
  misc_feature 1..102: note = chr17:55364127-55364229
  misc_feature 1..102: note = hypo
  source 1..102: mol_type = genomic DNA

SEQ ID NO: 25426 - DNA, 228 bp, Homo sapiens; identical to SEQ ID NO: 16221
  misc_feature 1..228: note = chr17:60856637-60856865
  misc_feature 1..228: note = hypo
  source 1..228: mol_type = genomic DNA

SEQ ID NO: 25427 - DNA, 37 bp, Homo sapiens; identical to SEQ ID NO: 16222
  misc_feature 1..37: note = chr17:61677502-61677539
  misc_feature 1..37: note = hypo
  source 1..37: mol_type = genomic DNA

SEQ ID NO: 25428 - DNA, 30 bp, Homo sapiens; identical to SEQ ID NO: 16224
  misc_feature 1..30: note = chr17:66643303-66643333
  misc_feature 1..30: note = hypo
  source 1..30: mol_type = genomic DNA

SEQ ID NO: 25429 - DNA, 44 bp, Homo sapiens; identical to SEQ ID NO: 16226
  misc_feature 1..44: note = chr17:68268160-68268204
  misc_feature 1..44: note = hypo
  source 1..44: mol_type = genomic DNA

SEQ ID NO: 25430 - DNA, 38 bp, Homo sapiens; identical to SEQ ID NO: 16227
  misc_feature 1..38: note = chr17:70657503-70657541
  misc_feature 1..38: note = hypo
  source 1..38: mol_type = genomic DNA

SEQ ID NO: 25431 - DNA, 30 bp, Homo sapiens; identical to SEQ ID NO: 16228
  misc_feature 1..30: note = chr17:70712704-70712734
  misc_feature 1..30: note = hypo
  source 1..30: mol_type = genomic DNA

SEQ ID NO: 25432 - DNA, 30 bp, Homo sapiens; identical to SEQ ID NO: 16229
  misc_feature 1..30: note = chr17:71391476-71391506
  misc_feature 1..30: note = hypo
  source 1..30: mol_type = genomic DNA

SEQ ID NO: 25433 - DNA, 30 bp, Homo sapiens; identical to SEQ ID NO: 16230
  misc_feature 1..30: note = chr17:71879558-71879588
  misc_feature 1..30: note = hypo
  source 1..30: mol_type = genomic DNA

SEQ ID NO: 25434 - DNA, 47 bp, Homo sapiens; identical to SEQ ID NO: 16231
  misc_feature 1..47: note = chr17:72356264-72356311
  misc_feature 1..47: note = hypo
  source 1..47: mol_type = genomic DNA

SEQ ID NO: 25435 - DNA, 30 bp, Homo sapiens; identical to SEQ ID NO: 16232
  misc_feature 1..30: note = chr17:72370768-72370798
  misc_feature 1..30: note = hypo
  source 1..30: mol_type = genomic DNA

SEQ ID NO: 25436 - DNA, 16 bp, Homo sapiens
  misc_feature 1..16: note = chr17:73031621-73031637
  misc_feature 1..16: note = hypo
  source 1..16: mol_type = genomic DNA
actccagtctctggcc

SEQ ID NO: 25437 - DNA, 26 bp, Homo sapiens
  misc_feature 1..26: note = chr17:73083437-73083463
  misc_feature 1..26: note = hypo
  source 1..26: mol_type = genomic DNA
agcgagactcccggccaactgagtac

SEQ ID NO: 25438 - DNA, 41 bp, Homo sapiens; identical to SEQ ID NO: 16235
  misc_feature 1..41: note = chr17:73089693-73089734
  misc_feature 1..41: note = hypo
  source 1..41: mol_type = genomic DNA

SEQ ID NO: 25439 - DNA, 17 bp, Homo sapiens
  misc_feature 1..17: note = chr17:73135904-73135921
  misc_feature 1..17: note = hypo
  source 1..17: mol_type = genomic DNA
tccgtctcaaaaataaa

SEQ ID NO: 25440 - DNA, 30 bp, Homo sapiens; identical to SEQ ID NO: 16238
  misc_feature 1..30: note = chr17:73606380-73606410
  misc_feature 1..30: note = hypo
  source 1..30: mol_type = genomic DNA

SEQ ID NO: 25441 - DNA, 142 bp, Homo sapiens; identical to SEQ ID NO: 16239
  misc_feature 1..142: note = chr17:73615938-73616080
  misc_feature 1..142: note = hypo
  source 1..142: mol_type = genomic DNA

SEQ ID NO: 25442 - DNA, 37 bp, Homo sapiens; identical to SEQ ID NO: 16241
  misc_feature 1..37: note = chr17:73638388-73638425
  misc_feature 1..37: note = hypo
  source 1..37: mol_type = genomic DNA

SEQ ID NO: 25443 - DNA, 165 bp, Homo sapiens; identical to SEQ ID NO: 16242
  misc_feature 1..165: note = chr17:74128189-74128354
  misc_feature 1..165: note = hypo
  source 1..165: mol_type = genomic DNA

SEQ ID NO: 25444 - DNA, 30 bp, Homo sapiens; identical to SEQ ID NO: 16243
  misc_feature 1..30: note = chr17:74908784-74908814
  misc_feature 1..30: note = hypo
  source 1..30: mol_type = genomic DNA

SEQ ID NO: 25445 - DNA, 44 bp, Homo sapiens; identical to SEQ ID NO: 16244
  misc_feature 1..44: note = chr17:75049830-75049874
  misc_feature 1..44: note = hypo
  source 1..44: mol_type = genomic DNA

SEQ ID NO: 25446 - DNA, 24 bp, Homo sapiens
  misc_feature 1..24: note = chr17:75523118-75523142
  misc_feature 1..24: note = hypo
  source 1..24: mol_type = genomic DNA
cccctcctccctctccgctgctgc

SEQ ID NO: 25447 - skipped

SEQ ID NO: 25448 - DNA, 30 bp, Homo sapiens; identical to SEQ ID NO: 16247
  misc_feature 1..30: note = chr17:76021291-76021321
  misc_feature 1..30: note = hypo
  source 1..30: mol_type = genomic DNA

SEQ ID NO: 25449 - DNA, 53 bp, Homo sapiens
  misc_feature 1..53: note = chr17:76137898-76137951
  misc_feature 1..53: note = hypo
  source 1..53: mol_type = genomic DNA
aacctagcagcctcacgtccacagagctgccttgtgaaactcagcagagccct

SEQ ID NO: 25450 - DNA, 31 bp, Homo sapiens; identical to SEQ ID NO: 1623
  misc_feature 1..31: note = chr17:76211256-76211287
  misc_feature 1..31: note = hypo
  source 1..31: mol_type = genomic DNA

SEQ ID NO: 25451 - DNA, 91 bp, Homo sapiens; identical to SEQ ID NO: 1624
  misc_feature 1..91: note = chr17:76211527-76211618
  misc_feature 1..91: note = hypo
  source 1..91: mol_type = genomic DNA

SEQ ID NO: 25452 - DNA, 30 bp, Homo sapiens; identical to SEQ ID NO: 16251
  misc_feature 1..30: note = chr17:76419409-76419439
  misc_feature 1..30: note = hypo
  source 1..30: mol_type = genomic DNA

SEQ ID NO: 25453 - DNA, 82 bp, Homo sapiens; identical to SEQ ID NO: 16252
  misc_feature 1..82: note = chr17:77002830-77002912
  misc_feature 1..82: note = hypo
  source 1..82: mol_type = genomic DNA

SEQ ID NO: 25454 - DNA, 25 bp, Homo sapiens
  misc_feature 1..25: note = chr17:77105030-77105055
  misc_feature 1..25: note = hypo
  source 1..25: mol_type = genomic DNA
ccctgcgttgaacagcgaggatgca

SEQ ID NO: 25455 - DNA, 30 bp, Homo sapiens; identical to SEQ ID NO: 16254
  misc_feature 1..30: note = chr17:77127147-77127177
  misc_feature 1..30: note = hypo
  source 1..30: mol_type = genomic DNA

SEQ ID NO: 25456 - DNA, 63 bp, Homo sapiens; identical to SEQ ID NO: 16255
  misc_feature 1..63: note = chr17:77135878-77135941
  misc_feature 1..63: note = hypo
  source 1..63: mol_type = genomic DNA

SEQ ID NO: 25457 - DNA, 115 bp, Homo sapiens; identical to SEQ ID NO: 16256
  misc_feature 1..115: note = chr17:77807753-77807868
  misc_feature 1..115: note = hypo
  source 1..115: mol_type = genomic DNA

SEQ ID NO: 25458 - DNA, 78 bp, Homo sapiens; identical to SEQ ID NO: 16257
  misc_feature 1..78: note = chr17:77926480-77926558
  misc_feature 1..78: note = hypo
  source 1..78: mol_type = genomic DNA

SEQ ID NO: 25459 - DNA, 30 bp, Homo sapiens; identical to SEQ ID NO: 16258
  misc_feature 1..30: note = chr17:77948916-77948946
  misc_feature 1..30: note = hypo
  source 1..30: mol_type = genomic DNA

SEQ ID NO: 25460 - DNA, 63 bp, Homo sapiens
  misc_feature 1..63: note = chr17:78122190-78122253
  misc_feature 1..63: note = hypo
  source 1..63: mol_type = genomic DNA
ctttcttatctgacactttaagtgcttcttcgtacccagctcctctaacgccttttgaagcag

SEQ ID NO: 25461 - DNA, 30 bp, Homo sapiens; identical to SEQ ID NO: 16260
  misc_feature 1..30: note = chr17:78447089-78447119
  misc_feature 1..30: note = hypo
  source 1..30: mol_type = genomic DNA

SEQ ID NO: 25462 - DNA, 92 bp, Homo sapiens
  misc_feature 1..92: note = chr17:78667900-78667992
  misc_feature 1..92: note = hypo
  source 1..92: mol_type = genomic DNA
tagagcaaatacaggcggctctgacatctcagcttttgtttgccactgctgcagcctcaggtgcctcatctggggcttcattcagagtgggt

SEQ ID NO: 25463 - DNA, 35 bp, Homo sapiens; identical to SEQ ID NO: 16262
  misc_feature 1..35: note = chr17:79096981-79097016
  misc_feature 1..35: note = hypo
  source 1..35: mol_type = genomic DNA

SEQ ID NO: 25464-25465 - skipped (2 entries)

SEQ ID NO: 25466 - DNA, 48 bp, Homo sapiens; identical to SEQ ID NO: 16264
  misc_feature 1..48: note = chr17:79100184-79100232
  misc_feature 1..48: note = hypo
  source 1..48: mol_type = genomic DNA

SEQ ID NO: 25467 - DNA, 30 bp, Homo sapiens; identical to SEQ ID NO: 16265
  misc_feature 1..30: note = chr17:79107633-79107663
  misc_feature 1..30: note = hypo
  source 1..30: mol_type = genomic DNA

SEQ ID NO: 25468 - DNA, 30 bp, Homo sapiens; identical to SEQ ID NO: 16266
  misc_feature 1..30: note = chr17:79211720-79211750
  misc_feature 1..30: note = hypo
  source 1..30: mol_type = genomic DNA

SEQ ID NO: 25469 - DNA, 48 bp, Homo sapiens; identical to SEQ ID NO: 16267
  misc_feature 1..48: note = chr17:79609256-79609304
  misc_feature 1..48: note = hypo
  source 1..48: mol_type = genomic DNA

SEQ ID NO: 25470 - DNA, 49 bp, Homo sapiens
  misc_feature 1..49: note = chr17:79769384-79769433
  misc_feature 1..49: note = hypo
  source 1..49: mol_type = genomic DNA
cagccagaaaattggcgacgacctcagtgtcagcacctggctcagtgat

SEQ ID NO: 25471 - DNA, 30 bp, Homo sapiens; identical to SEQ ID NO: 16269
  misc_feature 1..30: note = chr17:79774960-79774990
  misc_feature 1..30: note = hypo
  source 1..30: mol_type = genomic DNA

SEQ ID NO: 25472 - DNA, 30 bp, Homo sapiens; identical to SEQ ID NO: 16270
  misc_feature 1..30: note = chr17:79847763-79847793
  misc_feature 1..30: note = hypo
  source 1..30: mol_type = genomic DNA

SEQ ID NO: 25473 - DNA, 30 bp, Homo sapiens; identical to SEQ ID NO: 16271
  misc_feature 1..30: note = chr17:79870492-79870522
  misc_feature 1..30: note = hypo
  source 1..30: mol_type = genomic DNA

SEQ ID NO: 25474 - DNA, 173 bp, Homo sapiens; identical to SEQ ID NO: 16272
  misc_feature 1..173: note = chr17:79874854-79875027
  misc_feature 1..173: note = hypo
  source 1..173: mol_type = genomic DNA

SEQ ID NO: 25475 - DNA, 112 bp, Homo sapiens; identical to SEQ ID NO: 16273
  misc_feature 1..112: note = chr17:79887664-79887776
  misc_feature 1..112: note = hypo
  source 1..112: mol_type = genomic DNA

SEQ ID NO: 25476 - DNA, 17 bp, Homo sapiens
  misc_feature 1..17: note = chr17:79913149-79913166
  misc_feature 1..17: note = hypo
  source 1..17: mol_type = genomic DNA
cccggcctacaagacct

SEQ ID NO: 25477 - DNA, 30 bp, Homo sapiens; identical to SEQ ID NO: 16275
  misc_feature 1..30: note = chr17:80251974-80252004
  misc_feature 1..30: note = hypo
  source 1..30: mol_type = genomic DNA

SEQ ID NO: 25478 - DNA, 21 bp, Homo sapiens
  misc_feature 1..21: note = chr17:80254296-80254317
  misc_feature 1..21: note = hypo
  source 1..21: mol_type = genomic DNA
cgttgacggacacttaggcga

SEQ ID NO: 25479 - DNA, 375 bp, Homo sapiens
  misc_feature 1..375: note = chr17:80798345-80798720
  misc_feature 1..375: note = hypo
  source 1..375: mol_type = genomic DNA
gtccagtgaggcctttgaggatctgtggaccttccaccctctaccctgctcctgagagtctctgtccctggtcctcctcaggagctgagccggcagggagggagcttatcccagagcctggctgcagggacctgccggagcttgcccgacaccaggcaccgcaagagctgcggagcagggtgtgtgggtgcgggggagggggccagctgtgcactcccgcaaaccaccctccccccactttaaattgcagaggcacttaacttgggggccagtttttacctccacacccccccaccaaaactgcttgcttgcttaatcggaggccgcaccccagttgtagcgaaggctggcatgtggtgtcggtttgaggactgg

SEQ ID NO: 25480 - DNA, 171 bp, Homo sapiens
  misc_feature 1..171: note = chr17:80832541-80832712
  misc_feature 1..171: note = hypo
  source 1..171: mol_type = genomic DNA
ctccaggcatccggccgggcgggctgtgagtcaggctgcaccaggtgagcgtgtgggatgctgctggtgcgagcctccctgcccaggagccctgcgcacccgggtatcggttggggtgtgcccttccagatctccctcccttggtttgtcataggtgaccacattttaatt

SEQ ID NO: 25481 - DNA, 30 bp, Homo sapiens; identical to SEQ ID NO: 16282
  misc_feature 1..30: note = chr17:80972340-80972370
  misc_feature 1..30: note = hypo
  source 1..30: mol_type = genomic DNA

SEQ ID NO: 25482 - DNA, 48 bp, Homo sapiens
  misc_feature 1..48: note = chr17:81008826-81008874
  misc_feature 1..48: note = hypo
  source 1..48: mol_type = genomic DNA
tgggcaagtgtgccgggaatgtgtgacggcagacgtgtggggtgcgag

SEQ ID NO: 25483 - DNA, 156 bp, Homo sapiens; identical to SEQ ID NO: 16284
  misc_feature 1..156: note = chr17:81015300-81015456
  misc_feature 1..156: note = hypo
  source 1..156: mol_type = genomic DNA

SEQ ID NO: 25484 - DNA, 58 bp, Homo sapiens; identical to SEQ ID NO: 16285
  misc_feature 1..58: note = chr17:81048783-81048841
  misc_feature 1..58: note = hypo
  source 1..58: mol_type = genomic DNA

SEQ ID NO: 25485 - DNA, 87 bp, Homo sapiens; identical to SEQ ID NO: 16286
  misc_feature 1..87: note = chr17:81050193-81050280
  misc_feature 1..87: note = hypo
  source 1..87: mol_type = genomic DNA

SEQ ID NO: 25486 - DNA, 30 bp, Homo sapiens; identical to SEQ ID NO: 16287
  misc_feature 1..30: note = chr17:81050936-81050966
  misc_feature 1..30: note = hypo
  source 1..30: mol_type = genomic DNA

SEQ ID NO: 25487 - DNA, 30 bp, Homo sapiens; identical to SEQ ID NO: 16288
  misc_feature 1..30: note = chr17:81062138-81062168
  misc_feature 1..30: note = hypo
  source 1..30: mol_type = genomic DNA

SEQ ID NO: 25488 - DNA, 30 bp, Homo sapiens; identical to SEQ ID NO: 16289
  misc_feature 1..30: note = chr17:81076347-81076377
  misc_feature 1..30: note = hypo
  source 1..30: mol_type = genomic DNA

SEQ ID NO: 25489 - DNA, 19 bp, Homo sapiens
  misc_feature 1..19: note = chr17:81081890-81081909
  misc_feature 1..19: note = hypo
  source 1..19: mol_type = genomic DNA
gggcgacgctcagggcggc

SEQ ID NO: 25490 - DNA, 30 bp, Homo sapiens; identical to SEQ ID NO: 16291
  misc_feature 1..30: note = chr18:597381-597411
  misc_feature 1..30: note = hypo
  source 1..30: mol_type = genomic DNA

SEQ ID NO: 25491 - DNA, 19 bp, Homo sapiens
  misc_feature 1..19: note = chr18:5133188-5133207
  misc_feature 1..19: note = hypo
  source 1..19: mol_type = genomic DNA
caccaccaccgaccacgat

SEQ ID NO: 25492 - DNA, 40 bp, Homo sapiens; identical to SEQ ID NO: 16294
  misc_feature 1..40: note = chr18:8845133-8845173
  misc_feature 1..40: note = hypo
  source 1..40: mol_type = genomic DNA

SEQ ID NO: 25493 - DNA, 16 bp, Homo sapiens
  misc_feature 1..16: note = chr18:9364512-9364528
  misc_feature 1..16: note = hypo
  source 1..16: mol_type = genomic DNA
aggtgtggtggctcac

SEQ ID NO: 25494 - DNA, 38 bp, Homo sapiens
  misc_feature 1..38: note = chr18:10589348-10589386
  misc_feature 1..38: note = hypo
  source 1..38: mol_type = genomic DNA
gaaggcaccgccgccgcccgccgcgggaggcttccgcg

SEQ ID NO: 25495 - DNA, 17 bp, Homo sapiens
  misc_feature 1..17: note = chr18:11014809-11014826
  misc_feature 1..17: note = hypo
  source 1..17: mol_type = genomic DNA
tccggggccccctcatt

SEQ ID NO: 25496 - DNA, 30 bp, Homo sapiens; identical to SEQ ID NO: 16298
  misc_feature 1..30: note = chr18:11979044-11979074
  misc_feature 1..30: note = hypo
  source 1..30: mol_type = genomic DNA

SEQ ID NO: 25497 - DNA, 30 bp, Homo sapiens; identical to SEQ ID NO: 16300
  misc_feature 1..30: note = chr18:12701811-12701841
  misc_feature 1..30: note = hypo
  source 1..30: mol_type = genomic DNA

SEQ ID NO: 25498 - DNA, 26 bp, Homo sapiens
  misc_feature 1..26: note = chr18:12949149-12949175
  misc_feature 1..26: note = hypo
  source 1..26: mol_type = genomic DNA
gccaccgcgcccggcctacaagcaga

SEQ ID NO: 25499 - DNA, 39 bp, Homo sapiens; identical to SEQ ID NO: 16302
  misc_feature 1..39: note = chr18:13461328-13461367
  misc_feature 1..39: note = hypo
  source 1..39: mol_type = genomic DNA

SEQ ID NO: 25500 - DNA, 10 bp, Homo sapiens
  misc_feature 1..10: note = chr18:13826383-13826393
  misc_feature 1..10: note = hypo
  source 1..10: mol_type = genomic DNA
acatgttcct

SEQ ID NO: 25501 - DNA, 59 bp, Homo sapiens; identical to SEQ ID NO: 16304
  misc_feature 1..59: note = chr18:13940522-13940581
  misc_feature 1..59: note = hypo
  source 1..59: mol_type = genomic DNA

SEQ ID NO: 25502 - DNA, 30 bp, Homo sapiens; identical to SEQ ID NO: 16305
  misc_feature 1..30: note = chr18:20911344-20911374
  misc_feature 1..30: note = hypo
  source 1..30: mol_type = genomic DNA

SEQ ID NO: 25503 - DNA, 181 bp, Homo sapiens; identical to SEQ ID NO: 16306
  misc_feature 1..181: note = chr18:53968903-53969084
  misc_feature 1..181: note = hypo
  source 1..181: mol_type = genomic DNA

SEQ ID NO: 25504 - DNA, 39 bp, Homo sapiens; identical to SEQ ID NO: 16309
  misc_feature 1..39: note = chr18:68051369-68051408
  misc_feature 1..39: note = hypo
  source 1..39: mol_type = genomic DNA

SEQ ID NO: 25505 - DNA, 30 bp, Homo sapiens; identical to SEQ ID NO: 16310
  misc_feature 1..30: note = chr18:72896219-72896249
  misc_feature 1..30: note = hypo
  source 1..30: mol_type = genomic DNA

SEQ ID NO: 25506 - DNA, 143 bp, Homo sapiens; identical to SEQ ID NO: 16311
  misc_feature 1..143: note = chr18:75229713-75229856
  misc_feature 1..143: note = hypo
  source 1..143: mol_type = genomic DNA

SEQ ID NO: 25507 - DNA, 99 bp, Homo sapiens; identical to SEQ ID NO: 16312
  misc_feature 1..99: note = chr18:75230687-75230786
  misc_feature 1..99: note = hypo
  source 1..99: mol_type = genomic DNA

SEQ ID NO: 25508 - DNA, 378 bp, Homo sapiens; identical to SEQ ID NO: 16313
  misc_feature 1..378: note = chr18:75998610-75998988
  misc_feature 1..378: note = hypo
  source 1..378: mol_type = genomic DNA

SEQ ID NO: 25509 - DNA, 30 bp, Homo sapiens; identical to SEQ ID NO: 16314
  misc_feature 1..30: note = chr18:76073322-76073352
  misc_feature 1..30: note = hypo
  source 1..30: mol_type = genomic DNA

SEQ ID NO: 25510 - DNA, 30 bp, Homo sapiens; identical to SEQ ID NO: 16315
  misc_feature 1..30: note = chr18:76123862-76123892
  misc_feature 1..30: note = hypo
  source 1..30: mol_type = genomic DNA

SEQ ID NO: 25511 - DNA, 63 bp, Homo sapiens; identical to SEQ ID NO: 16316
  misc_feature 1..63: note = chr18:76239475-76239538
  misc_feature 1..63: note = hypo
  source 1..63: mol_type = genomic DNA

SEQ ID NO: 25512 - DNA, 30 bp, Homo sapiens; identical to SEQ ID NO: 16317
  misc_feature 1..30: note = chr18:76412736-76412766
  misc_feature 1..30: note = hypo
  source 1..30: mol_type = genomic DNA

SEQ ID NO: 25513 - DNA, 30 bp, Homo sapiens; identical to SEQ ID NO: 16318
  misc_feature 1..30: note = chr18:76477600-76477630
  misc_feature 1..30: note = hypo
  source 1..30: mol_type = genomic DNA

SEQ ID NO: 25514 - DNA, 30 bp, Homo sapiens; identical to SEQ ID NO: 16320
  misc_feature 1..30: note = chr18:76541560-76541590
  misc_feature 1..30: note = hypo
  source 1..30: mol_type = genomic DNA

SEQ ID NO: 25515 - DNA, 30 bp, Homo sapiens; identical to SEQ ID NO: 16321
  misc_feature 1..30: note = chr18:76686197-76686227
  misc_feature 1..30: note = hypo
  source 1..30: mol_type = genomic DNA

SEQ ID NO: 25516 - DNA, 12 bp, Homo sapiens
  misc_feature 1..12: note = chr18:77167812-77167824
  misc_feature 1..12: note = hypo
  source 1..12: mol_type = genomic DNA
gagggcatttct

SEQ ID NO: 25517 - DNA, 38 bp, Homo sapiens
  misc_feature 1..38: note = chr18:77181317-77181355
  misc_feature 1..38: note = hypo
  source 1..38: mol_type = genomic DNA
acagacctggaatcacgaggaaatgcccgtcctcctcc

SEQ ID NO: 25518 - DNA, 17 bp, Homo sapiens
  misc_feature 1..17: note = chr18:77181409-77181426
  misc_feature 1..17: note = hypo
  source 1..17: mol_type = genomic DNA
agcgcctggatgacgtc

SEQ ID NO: 25519 - DNA, 30 bp, Homo sapiens; identical to SEQ ID NO: 16325
  misc_feature 1..30: note = chr18:77201979-77202009
  misc_feature 1..30: note = hypo
  source 1..30: mol_type = genomic DNA

SEQ ID NO: 25520 - DNA, 64 bp, Homo sapiens; identical to SEQ ID NO: 16326
  misc_feature 1..64: note = chr18:77246511-77246575
  misc_feature 1..64: note = hypo
  source 1..64: mol_type = genomic DNA

SEQ ID NO: 25521 - DNA, 39 bp, Homo sapiens; identical to SEQ ID NO: 16327
  misc_feature 1..39: note = chr18:77272049-77272088
  misc_feature 1..39: note = hypo
  source 1..39: mol_type = genomic DNA

SEQ ID NO: 25522 - DNA, 27 bp, Homo sapiens
  misc_feature 1..27: note = chr18:77285870-77285897
  misc_feature 1..27: note = hypo
  source 1..27: mol_type = genomic DNA
gcaaggctgaaccagcgcagtgggaaa

SEQ ID NO: 25523 - DNA, 42 bp, Homo sapiens
  misc_feature 1..42: note = chr18:77286028-77286070
  misc_feature 1..42: note = hypo
  source 1..42: mol_type = genomic DNA
agcctagggcatttgggtggggacgtgcgacccccacacaga

SEQ ID NO: 25524 - DNA, 30 bp, Homo sapiens; identical to SEQ ID NO: 16329
  misc_feature 1..30: note = chr18:77288262-77288292
  misc_feature 1..30: note = hypo
  source 1..30: mol_type = genomic DNA

SEQ ID NO: 25525 - DNA, 32 bp, Homo sapiens; identical to SEQ ID NO: 16330
  misc_feature 1..32: note = chr18:77313917-77313949
  misc_feature 1..32: note = hypo
  source 1..32: mol_type = genomic DNA

SEQ ID NO: 25526 - DNA, 131 bp, Homo sapiens; identical to SEQ ID NO: 16333
  misc_feature 1..131: note = chr18:77364414-77364545
  misc_feature 1..131: note = hypo
  source 1..131: mol_type = genomic DNA

SEQ ID NO: 25527 - DNA, 30 bp, Homo sapiens; identical to SEQ ID NO: 16334
  misc_feature 1..30: note = chr18:77410108-77410138
  misc_feature 1..30: note = hypo
  source 1..30: mol_type = genomic DNA

SEQ ID NO: 25528 - DNA, 30 bp, Homo sapiens; identical to SEQ ID NO: 16335
  misc_feature 1..30: note = chr18:77542905-77542935
  misc_feature 1..30: note = hypo
  source 1..30: mol_type = genomic DNA

SEQ ID NO: 25529 - DNA, 19 bp, Homo sapiens
  misc_feature 1..19: note = chr18:77543230-77543249
  misc_feature 1..19: note = hypo
  source 1..19: mol_type = genomic DNA
catccccgtgagctccgcc

SEQ ID NO: 25530 - DNA, 10 bp, Homo sapiens
  misc_feature 1..10: note = chr18:77550196-77550206
  misc_feature 1..10: note = hypo
  source 1..10: mol_type = genomic DNA
gacacaagag

SEQ ID NO: 25531 - DNA, 30 bp, Homo sapiens; identical to SEQ ID NO: 16338
  misc_feature 1..30: note = chr18:77636150-77636180
  misc_feature 1..30: note = hypo
  source 1..30: mol_type = genomic DNA

SEQ ID NO: 25532 - DNA, 153 bp, Homo sapiens
  misc_feature 1..153: note = chr18:77636621-77636774
  misc_feature 1..153: note = hypo
  source 1..153: mol_type = genomic DNA
cctgtgtctgtgacgctggtgccctgagggcagggccagccccctctctcggcacagctgggtgaatcatcaacgacacccttggcaccgtgagcacttgcacctgcagaccgcctggtctcgctcttgggcaccagccgtgccaggcccggg

SEQ ID NO: 25533 - DNA, 30 bp, Homo sapiens; identical to SEQ ID NO: 16340
  misc_feature 1..30: note = chr18:77644664-77644694
  misc_feature 1..30: note = hypo
  source 1..30: mol_type = genomic DNA

SEQ ID NO: 25534 - DNA, 30 bp, Homo sapiens; identical to SEQ ID NO: 16341
  misc_feature 1..30: note = chr19:292163-292193
  misc_feature 1..30: note = hypo
  source 1..30: mol_type = genomic DNA

SEQ ID NO: 25535 - DNA, 30 bp, Homo sapiens; identical to SEQ ID NO: 16342
  misc_feature 1..30: note = chr19:349135-349165
  misc_feature 1..30: note = hypo
  source 1..30: mol_type = genomic DNA

SEQ ID NO: 25536 - DNA, 171 bp, Homo sapiens
  misc_feature 1..171: note = chr19:403367-403538
  misc_feature 1..171: note = hypo
  source 1..171: mol_type = genomic DNA
agacctgaggcagggcgagacaccacgcaggcgcagaatccctggatgacgcccacttggaagtggaggggggagggcatgggcagctgcagctcccagacaccagcacacacaaacgcacacacaagtgcacaccagcagcgacacaggcacacacaagcgcacacaggg

SEQ ID NO: 25537 - DNA, 145 bp, Homo sapiens; identical to SEQ ID NO: 16344
  misc_feature 1..145: note = chr19:407470-407615
  misc_feature 1..145: note = hypo
  source 1..145: mol_type = genomic DNA

SEQ ID NO: 25538 - DNA, 92 bp, Homo sapiens; identical to SEQ ID NO: 16346
  misc_feature 1..92: note = chr19:470863-470955
  misc_feature 1..92: note = hypo
  source 1..92: mol_type = genomic DNA

SEQ ID NO: 25539 - DNA, 181 bp, Homo sapiens; identical to SEQ ID NO: 16348
  misc_feature 1..181: note = chr19:491311-491492
  misc_feature 1..181: note = hypo
  source 1..181: mol_type = genomic DNA

SEQ ID NO: 25540 - DNA, 23 bp, Homo sapiens
  misc_feature 1..23: note = chr19:530233-530256
  misc_feature 1..23: note = hypo
  source 1..23: mol_type = genomic DNA
accgtgcccggcctgtatgttga

SEQ ID NO: 25541 - DNA, 30 bp, Homo sapiens; identical to SEQ ID NO: 16350
  misc_feature 1..30: note = chr19:548574-548604
  misc_feature 1..30: note = hypo
  source 1..30: mol_type = genomic DNA

SEQ ID NO: 25542 - DNA, 229 bp, Homo sapiens
  misc_feature 1..229: note = chr19:549451-549680
  misc_feature 1..229: note = hypo
  source 1..229: mol_type = genomic DNA
gagcagggttcacagggccagcgggagatggggaggggacacgcgtgggccgggagcagcccctgtgtctccttgagcctggggataacaggcctggccctgctcccctcggcgggccctgctcccctcgtcccctcagcaggtgcagaggctgagctgcggtgtgtcgtccctgcagggtgactcgggcgggcccctggtgtgtggcaaaggccgggtgttggccaga

SEQ ID NO: 25543 - DNA, 111 bp, Homo sapiens; identical to SEQ ID NO: 16352
  misc_feature 1..111: note = chr19:550388-550499
  misc_feature 1..111: note = hypo
  source 1..111: mol_type = genomic DNA

SEQ ID NO: 25544 - DNA, 140 bp, Homo sapiens
  misc_feature 1..140: note = chr19:593150-593290
  misc_feature 1..140: note = hypo
  source 1..140: mol_type = genomic DNA
agtccaccctgctcccgtgctcggaagtggcctctttcacgccccacgtcccagtcccagtatacagcaggtgccacatatttgctgaattttctgaggggcagagcatgggtcctgggctgacgtgggtccagatttcg

SEQ ID NO: 25545 - DNA, 14 bp, Homo sapiens
  misc_feature 1..14: note = chr19:599200-599214
  misc_feature 1..14: note = hypo
  source 1..14: mol_type = genomic DNA
tttggaccgtttcc

SEQ ID NO: 25546 - DNA, 42 bp, Homo sapiens
  misc_feature 1..42: note = chr19:883582-883624
  misc_feature 1..42: note = hypo
  source 1..42: mol_type = genomic DNA
ggcatgtgtgtgagacgtggctctcgggcgggtaacagctgg

SEQ ID NO: 25547 - DNA, 227 bp, Homo sapiens
  misc_feature 1..227: note = chr19:883791-884018
  misc_feature 1..227: note = hypo
  source 1..227: mol_type = genomic DNA
caggagccagcgcagcccaaactgcctggtgactcaccacgaggcccaggggaaggaatgaggcccaacaaggccctggggaccgggcgaaggaacgagccctgggagaaggaatggcagcagccctcttcacctgcctggtgactcactacaagccctgggggaaggaatggcagtggccctcttcacctttactgcctctgcggccacaatgggcagttgacata

SEQ ID NO: 25548 - DNA, 52 bp, Homo sapiens
  misc_feature 1..52: note = chr19:884162-884214
  misc_feature 1..52: note = hypo
  source 1..52: mol_type = genomic DNA
ctctcatctaccgggaaaacatctcccttctccagagcggaggccagcctaa

SEQ ID NO: 25549 - DNA, 163 bp, Homo sapiens; identical to SEQ ID NO: 16358
  misc_feature 1..163: note = chr19:900851-901014
  misc_feature 1..163: note = hypo
  source 1..163: mol_type = genomic DNA

SEQ ID NO: 25550 - DNA, 38 bp, Homo sapiens
  misc_feature 1..38: note = chr19:955719-955757
  misc_feature 1..38: note = hypo
  source 1..38: mol_type = genomic DNA
aggcagggtagaccccgtaataccgggtcagaatctca

SEQ ID NO: 25551 - DNA, 100 bp, Homo sapiens
  misc_feature 1..100: note = chr19:1003205-1003305
  misc_feature 1..100: note = hypo
  source 1..100: mol_type = genomic DNA
gcacgcctgggaagacgtcggcctggccctgtgccgcactcaggaccccggcggcctggtggccctctggacaagccgggctggccggcccccacagctg

SEQ ID NO: 25552 - DNA, 58 bp, Homo sapiens
  misc_feature 1..58: note = chr19:1003384-1003442
  misc_feature 1..58: note = hypo
  source 1..58: mol_type = genomic DNA
gtgaagcaccggtacccgcggcggtcctcctcggctgtgacatcgcccgtgcccgtcg

SEQ ID NO: 25553 - DNA, 32 bp, Homo sapiens; identical to SEQ ID NO: 16363
  misc_feature 1..32: note = chr19:1030092-1030124
  misc_feature 1..32: note = hypo
  source 1..32: mol_type = genomic DNA

SEQ ID NO: 25554 - DNA, 69 bp, Homo sapiens; identical to SEQ ID NO: 16364
  misc_feature 1..69: note = chr19:1112645-1112714
  misc_feature 1..69: note = hypo
  source 1..69: mol_type = genomic DNA

SEQ ID NO: 25555 - DNA, 17 bp, Homo sapiens
  misc_feature 1..17: note = chr19:1128414-1128431
  misc_feature 1..17: note = hypo
  source 1..17: mol_type = genomic DNA
ggattcttacactgtcg

SEQ ID NO: 25556 - DNA, 30 bp, Homo sapiens; identical to SEQ ID NO: 16366
  misc_feature 1..30: note = chr19:1156568-1156598
  misc_feature 1..30: note = hypo
  source 1..30: mol_type = genomic DNA

SEQ ID NO: 25557 - DNA, 73 bp, Homo sapiens
  misc_feature 1..73: note = chr19:1171324-1171397
  misc_feature 1..73: note = hypo
  source 1..73: mol_type = genomic DNA
aagaatacacacatccatacaacacacaggcacacaacacacatgtgcatgcacatggcgcaacatacagata

SEQ ID NO: 25558 - DNA, 53 bp, Homo sapiens; identical to SEQ ID NO: 16368
  misc_feature 1..53: note = chr19:1227555-1227608
  misc_feature 1..53: note = hypo
  source 1..53: mol_type = genomic DNA

SEQ ID NO: 25559 - DNA, 30 bp, Homo sapiens; identical to SEQ ID NO: 16369
  misc_feature 1..30: note = chr19:1236238-1236268
  misc_feature 1..30: note = hypo
  source 1..30: mol_type = genomic DNA

SEQ ID NO: 25560 - DNA, 53 bp, Homo sapiens; identical to SEQ ID NO: 16371
  misc_feature 1..53: note = chr19:1274693-1274746
  misc_feature 1..53: note = hypo
  source 1..53: mol_type = genomic DNA

SEQ ID NO: 25561 - DNA, 30 bp, Homo sapiens; identical to SEQ ID NO: 16372
  misc_feature 1..30: note = chr19:1308187-1308217
  misc_feature 1..30: note = hypo
  source 1..30: mol_type = genomic DNA

SEQ ID NO: 25562 - DNA, 30 bp, Homo sapiens; identical to SEQ ID NO: 16373
  misc_feature 1..30: note = chr19:1325942-1325972
  misc_feature 1..30: note = hypo
  source 1..30: mol_type = genomic DNA

SEQ ID NO: 25563 - DNA, 43 bp, Homo sapiens; identical to SEQ ID NO: 16374
  misc_feature 1..43: note = chr19:1482018-1482061
  misc_feature 1..43: note = hypo
  source 1..43: mol_type = genomic DNA

SEQ ID NO: 25564 - DNA, 106 bp, Homo sapiens; identical to SEQ ID NO: 16375
  misc_feature 1..106: note = chr19:1482370-1482476
  misc_feature 1..106: note = hypo
  source 1..106: mol_type = genomic DNA

SEQ ID NO: 25565 - DNA, 28 bp, Homo sapiens
  misc_feature 1..28: note = chr19:1496626-1496654
  misc_feature 1..28: note = hypo
  source 1..28: mol_type = genomic DNA
cccggtggctgtggccgggccctccact

SEQ ID NO: 25566 - DNA, 30 bp, Homo sapiens; identical to SEQ ID NO: 16379
  misc_feature 1..30: note = chr19:1533726-1533756
  misc_feature 1..30: note = hypo
  source 1..30: mol_type = genomic DNA

SEQ ID NO: 25567 - DNA, 48 bp, Homo sapiens; identical to SEQ ID NO: 16380
  misc_feature 1..48: note = chr19:1799852-1799900
  misc_feature 1..48: note = hypo
  source 1..48: mol_type = genomic DNA

SEQ ID NO: 25568 - DNA, 377 bp, Homo sapiens; identical to SEQ ID NO: 16382
  misc_feature 1..377: note = chr19:1809512-1809889
  misc_feature 1..377: note = hypo
  source 1..377: mol_type = genomic DNA

SEQ ID NO: 25569 - DNA, 37 bp, Homo sapiens; identical to SEQ ID NO: 16383
  misc_feature 1..37: note = chr19:1912092-1912129
  misc_feature 1..37: note = hypo
  source 1..37: mol_type = genomic DNA

SEQ ID NO: 25570 - DNA, 79 bp, Homo sapiens; identical to SEQ ID NO: 16384
  misc_feature 1..79: note = chr19:1970005-1970084
  misc_feature 1..79: note = hypo
  source 1..79: mol_type = genomic DNA

SEQ ID NO: 25571 - DNA, 35 bp, Homo sapiens; identical to SEQ ID NO: 16385
  misc_feature 1..35: note = chr19:1970474-1970509
  misc_feature 1..35: note = hypo
  source 1..35: mol_type = genomic DNA

SEQ ID NO: 25572 - DNA, 306 bp, Homo sapiens; identical to SEQ ID NO: 16386
  misc_feature 1..306: note = chr19:1978313-1978619
  misc_feature 1..306: note = hypo
  source 1..306: mol_type = genomic DNA

SEQ ID NO: 25573 - DNA, 141 bp, Homo sapiens; identical to SEQ ID NO: 16387
  misc_feature 1..141: note = chr19:1993071-1993212
  misc_feature 1..141: note = hypo
  source 1..141: mol_type = genomic DNA

SEQ ID NO: 25574 - DNA, 55 bp, Homo sapiens; identical to SEQ ID NO: 16388
  misc_feature 1..55: note = chr19:2274600-2274655
  misc_feature 1..55: note = hypo
  source 1..55: mol_type = genomic DNA

SEQ ID NO: 25575 - DNA, 124 bp, Homo sapiens; identical to SEQ ID NO: 16389
  misc_feature 1..124: note = chr19:2359026-2359150
  misc_feature 1..124: note = hypo
  source 1..124: mol_type = genomic DNA

SEQ ID NO: 25576 - DNA, 124 bp, Homo sapiens; identical to SEQ ID NO: 16390
  misc_feature 1..124: note = chr19:2363060-2363184
  misc_feature 1..124: note = hypo
  source 1..124: mol_type = genomic DNA

SEQ ID NO: 25577 - DNA, 29 bp, Homo sapiens
  misc_feature 1..29: note = chr19:2471700-2471729
  misc_feature 1..29: note = hypo
  source 1..29: mol_type = genomic DNA
aaatacggtgactcacgcctgtaattcca

SEQ ID NO: 25578 - DNA, 40 bp, Homo sapiens; identical to SEQ ID NO: 16392
  misc_feature 1..40: note = chr19:2513207-2513247
  misc_feature 1..40: note = hypo
  source 1..40: mol_type = genomic DNA

SEQ ID NO: 25579 - DNA, 39 bp, Homo sapiens; identical to SEQ ID NO: 16393
  misc_feature 1..39: note = chr19:2513455-2513494
  misc_feature 1..39: note = hypo
  source 1..39: mol_type = genomic DNA

SEQ ID NO: 25580 - DNA, 22 bp, Homo sapiens
  misc_feature 1..22: note = chr19:2524913-2524935
  misc_feature 1..22: note = hypo
  source 1..22: mol_type = genomic DNA
gtgcgcacgggagtgcatgtgg

SEQ ID NO: 25581 - DNA, 20 bp, Homo sapiens
  misc_feature 1..20: note = chr19:2683891-2683911
  misc_feature 1..20: note = hypo
  source 1..20: mol_type = genomic DNA
gctggtggacagcatcggcc

SEQ ID NO: 25582 - DNA, 45 bp, Homo sapiens; identical to SEQ ID NO: 16396
  misc_feature 1..45: note = chr19:2899991-2900036
  misc_feature 1..45: note = hypo
  source 1..45: mol_type = genomic DNA

SEQ ID NO: 25583 - DNA, 69 bp, Homo sapiens
  misc_feature 1..69: note = chr19:3219565-3219634
  misc_feature 1..69: note = hypo
  source 1..69: mol_type = genomic DNA
gtaacatccatggcacgggcatcctgcagtgaccgatgcccaccagactgcatccgctaacaagacagg

SEQ ID NO: 25584 - DNA, 107 bp, Homo sapiens; identical to SEQ ID NO: 16402
  misc_feature 1..107: note = chr19:3779159-3779266
  misc_feature 1..107: note = hypo
  source 1..107: mol_type = genomic DNA

SEQ ID NO: 25585 - DNA, 30 bp, Homo sapiens; identical to SEQ ID NO: 16405
  misc_feature 1..30: note = chr19:4131483-4131513
  misc_feature 1..30: note = hypo
  source 1..30: mol_type = genomic DNA

SEQ ID NO: 25586 - DNA, 30 bp, Homo sapiens; identical to SEQ ID NO: 16406
  misc_feature 1..30: note = chr19:4512122-4512152
  misc_feature 1..30: note = hypo
  source 1..30: mol_type = genomic DNA

SEQ ID NO: 25587 - DNA, 100 bp, Homo sapiens
  misc_feature 1..100: note = chr19:4548034-4548134
  misc_feature 1..100: note = hypo
  source 1..100: mol_type = genomic DNA
tcacttcatacaccccgagtactgctggcagcgagccacaggcactcggaccacgcagcgggggaaggcagccagcaggccccccgaagctgcgtccagc

SEQ ID NO: 25588 - DNA, 20 bp, Homo sapiens
  misc_feature 1..20: note = chr19:4548364-4548384
  misc_feature 1..20: note = hypo
  source 1..20: mol_type = genomic DNA
aggaccgtccccgcctcaga

SEQ ID NO: 25589 - DNA, 38 bp, Homo sapiens; identical to SEQ ID NO: 16408
  misc_feature 1..38: note = chr19:4555023-4555061
  misc_feature 1..38: note = hypo
  source 1..38: mol_type = genomic DNA

SEQ ID NO: 25590 - DNA, 65 bp, Homo sapiens
  misc_feature 1..65: note = chr19:4557235-4557300
  misc_feature 1..65: note = hypo
  source 1..65: mol_type = genomic DNA
ctgggggaggggcatagttagtgagaactgggggctccgccaccctctcccgttccatccttccc

SEQ ID NO: 25591 - DNA, 25 bp, Homo sapiens
  misc_feature 1..25: note = chr19:4670740-4670765
  misc_feature 1..25: note = hypo
  source 1..25: mol_type = genomic DNA
cgaacttctcataatcgttgcagcc

SEQ ID NO: 25592 - DNA, 38 bp, Homo sapiens; identical to SEQ ID NO: 16412
  misc_feature 1..38: note = chr19:4789994-4790032
  misc_feature 1..38: note = hypo
  source 1..38: mol_type = genomic DNA

SEQ ID NO: 25593 - DNA, 90 bp, Homo sapiens; identical to SEQ ID NO: 16413
  misc_feature 1..90: note = chr19:4792950-4793040
  misc_feature 1..90: note = hypo
  source 1..90: mol_type = genomic DNA

SEQ ID NO: 25594 - DNA, 30 bp, Homo sapiens; identical to SEQ ID NO: 16414
  misc_feature 1..30: note = chr19:4800545-4800575
  misc_feature 1..30: note = hypo
  source 1..30: mol_type = genomic DNA

SEQ ID NO: 25595 - DNA, 30 bp, Homo sapiens; identical to SEQ ID NO: 16415
  misc_feature 1..30: note = chr19:5676881-5676911
  misc_feature 1..30: note = hypo
  source 1..30: mol_type = genomic DNA

SEQ ID NO: 25596 - skipped

SEQ ID NO: 25597 - DNA, 30 bp, Homo sapiens; identical to SEQ ID NO: 16417
  misc_feature 1..30: note = chr19:5789897-5789927
  misc_feature 1..30: note = hypo
  source 1..30: mol_type = genomic DNA

SEQ ID NO: 25598 - DNA, 37 bp, Homo sapiens; identical to SEQ ID NO: 16418
  misc_feature 1..37: note = chr19:5790176-5790213
  misc_feature 1..37: note = hypo
  source 1..37: mol_type = genomic DNA

SEQ ID NO: 25599 - DNA, 19 bp, Homo sapiens
  misc_feature 1..19: note = chr19:5826127-5826146
  misc_feature 1..19: note = hypo
  source 1..19: mol_type = genomic DNA
agagcgagactccgtctca

SEQ ID NO: 25600 - DNA, 34 bp, Homo sapiens
  misc_feature 1..34: note = chr19:5915060-5915094
  misc_feature 1..34: note = hypo
  source 1..34: mol_type = genomic DNA
ccgtgcccaccccaaggtgcgcagtggggagtgg

SEQ ID NO: 25601 - DNA, 30 bp, Homo sapiens; identical to SEQ ID NO: 16421
  misc_feature 1..30: note = chr19:5915421-5915451
  misc_feature 1..30: note = hypo
  source 1..30: mol_type = genomic DNA

SEQ ID NO: 25602 - DNA, 30 bp, Homo sapiens; identical to SEQ ID NO: 16422
  misc_feature 1..30: note = chr19:5915925-5915955
  misc_feature 1..30: note = hypo
  source 1..30: mol_type = genomic DNA

SEQ ID NO: 25603 - DNA, 188 bp, Homo sapiens; identical to SEQ ID NO: 16423
  misc_feature 1..188: note = chr19:6358262-6358450
  misc_feature 1..188: note = hypo
  source 1..188: mol_type = genomic DNA

SEQ ID NO: 25604 - DNA, 35 bp, Homo sapiens; identical to SEQ ID NO: 16424
  misc_feature 1..35: note = chr19:7727784-7727819
  misc_feature 1..35: note = hypo
  source 1..35: mol_type = genomic DNA

SEQ ID NO: 25605 - DNA, 30 bp, Homo sapiens; identical to SEQ ID NO: 16425
  misc_feature 1..30: note = chr19:8009581-8009611
  misc_feature 1..30: note = hypo
  source 1..30: mol_type = genomic DNA

SEQ ID NO: 25606 - DNA, 99 bp, Homo sapiens; identical to SEQ ID NO: 16426
  misc_feature 1..99: note = chr19:8475426-8475525
  misc_feature 1..99: note = hypo
  source 1..99: mol_type = genomic DNA

SEQ ID NO: 25607 - DNA, 11 bp, Homo sapiens
  misc_feature 1..11: note = chr19:8576903-8576914
  misc_feature 1..11: note = hypo
  source 1..11: mol_type = genomic DNA
ctgtgcaatgc

SEQ ID NO: 25608 - DNA, 30 bp, Homo sapiens; identical to SEQ ID NO: 16430
  misc_feature 1..30: note = chr19:10231504-10231534
  misc_feature 1..30: note = hypo
  source 1..30: mol_type = genomic DNA

SEQ ID NO: 25609 - DNA, 68 bp, Homo sapiens; identical to SEQ ID NO: 16431
  misc_feature 1..68: note = chr19:10370372-10370440
  misc_feature 1..68: note = hypo
  source 1..68: mol_type = genomic DNA

SEQ ID NO: 25610 - DNA, 151 bp, Homo sapiens; identical to SEQ ID NO: 16432
  misc_feature 1..151: note = chr19:10562153-10562304
  misc_feature 1..151: note = hypo
  source 1..151: mol_type = genomic DNA

SEQ ID NO: 25611 - DNA, 30 bp, Homo sapiens; identical to SEQ ID NO: 16433
  misc_feature 1..30: note = chr19:10570365-10570395
  misc_feature 1..30: note = hypo
  source 1..30: mol_type = genomic DNA

SEQ ID NO: 25612 - DNA, 18 bp, Homo sapiens
  misc_feature 1..18: note = chr19:10711942-10711960
  misc_feature 1..18: note = hypo
  source 1..18: mol_type = genomic DNA
acccggcctgttttcacc

SEQ ID NO: 25613 - DNA, 204 bp, Homo sapiens; identical to SEQ ID NO: 16435
  misc_feature 1..204: note = chr19:10875903-10876107
  misc_feature 1..204: note = hypo
  source 1..204: mol_type = genomic DNA

SEQ ID NO: 25614 - DNA, 30 bp, Homo sapiens; identical to SEQ ID NO: 16436
  misc_feature 1..30: note = chr19:10954418-10954448
  misc_feature 1..30: note = hypo
  source 1..30: mol_type = genomic DNA

SEQ ID NO: 25615 - DNA, 30 bp, Homo sapiens; identical to SEQ ID NO: 16437
  misc_feature 1..30: note = chr19:11002992-11003022
  misc_feature 1..30: note = hypo
  source 1..30: mol_type = genomic DNA

SEQ ID NO: 25616 - DNA, 30 bp, Homo sapiens; identical to SEQ ID NO: 16438
  misc_feature 1..30: note = chr19:11005335-11005365
  misc_feature 1..30: note = hypo
  source 1..30: mol_type = genomic DNA

SEQ ID NO: 25617 - DNA, 25 bp, Homo sapiens
  misc_feature 1..25: note = chr19:11008369-11008394
  misc_feature 1..25: note = hypo
  source 1..25: mol_type = genomic DNA
atgctagctctgggccgggcacggt

SEQ ID NO: 25618 - DNA, 30 bp, Homo sapiens; identical to SEQ ID NO: 16440
  misc_feature 1..30: note = chr19:11252737-11252767
  misc_feature 1..30: note = hypo
  source 1..30: mol_type = genomic DNA

SEQ ID NO: 25619 - DNA, 23 bp, Homo sapiens
  misc_feature 1..23: note = chr19:12220425-12220448
  misc_feature 1..23: note = hypo
  source 1..23: mol_type = genomic DNA
cacacaaacgtttttatgtttga

SEQ ID NO: 25620 - DNA, 30 bp, Homo sapiens; identical to SEQ ID NO: 16442
  misc_feature 1..30: note = chr19:12222728-12222758
  misc_feature 1..30: note = hypo
  source 1..30: mol_type = genomic DNA

SEQ ID NO: 25621 - DNA, 51 bp, Homo sapiens
  misc_feature 1..51: note = chr19:12863520-12863571
  misc_feature 1..51: note = hypo
  source 1..51: mol_type = genomic DNA
ttccttgggttctacatggcgctgagtgctgcctaccggtgaggctgccct

SEQ ID NO: 25622 - DNA, 30 bp, Homo sapiens; identical to SEQ ID NO: 16444
  misc_feature 1..30: note = chr19:13335742-13335772
  misc_feature 1..30: note = hypo
  source 1..30: mol_type = genomic DNA

SEQ ID NO: 25623 - DNA, 30 bp, Homo sapiens; identical to SEQ ID NO: 16445
  misc_feature 1..30: note = chr19:13781908-13781938
  misc_feature 1..30: note = hypo
  source 1..30: mol_type = genomic DNA

SEQ ID NO: 25624 - DNA, 20 bp, Homo sapiens
  misc_feature 1..20: note = chr19:13988706-13988726
  misc_feature 1..20: note = hypo
  source 1..20: mol_type = genomic DNA
agttgattttatttacgtat

SEQ ID NO: 25625 - DNA, 40 bp, Homo sapiens; identical to SEQ ID NO: 16448
  misc_feature 1..40: note = chr19:14327052-14327092
  misc_feature 1..40: note = hypo
  source 1..40: mol_type = genomic DNA

SEQ ID NO: 25626 - DNA, 36 bp, Homo sapiens; identical to SEQ ID NO: 16449
  misc_feature 1..36: note = chr19:14630627-14630663
  misc_feature 1..36: note = hypo
  source 1..36: mol_type = genomic DNA

SEQ ID NO: 25627 - DNA, 30 bp, Homo sapiens; identical to SEQ ID NO: 16450
  misc_feature 1..30: note = chr19:15237724-15237754
  misc_feature 1..30: note = hypo
  source 1..30: mol_type = genomic DNA

SEQ ID NO: 25628 - DNA, 30 bp, Homo sapiens; identical to SEQ ID NO: 16451
  misc_feature 1..30: note = chr19:15292289-15292319
  misc_feature 1..30: note = hypo
  source 1..30: mol_type = genomic DNA

SEQ ID NO: 25629 - DNA, 136 bp, Homo sapiens; identical to SEQ ID NO: 16452
  misc_feature 1..136: note = chr19:16275694-16275830
  misc_feature 1..136: note = hypo
  source 1..136: mol_type = genomic DNA

SEQ ID NO: 25630 - DNA, 30 bp, Homo sapiens; identical to SEQ ID NO: 16453
  misc_feature 1..30: note = chr19:16638285-16638315
  misc_feature 1..30: note = hypo
  source 1..30: mol_type = genomic DNA

SEQ ID NO: 25631 - DNA, 30 bp, Homo sapiens; identical to SEQ ID NO: 16454
  misc_feature 1..30: note = chr19:16638706-16638736
  misc_feature 1..30: note = hypo
  source 1..30: mol_type = genomic DNA

SEQ ID NO: 25632 - DNA, 50 bp, Homo sapiens; identical to SEQ ID NO: 16455
  misc_feature 1..50: note = chr19:16939668-16939718
  misc_feature 1..50: note = hypo
  source 1..50: mol_type = genomic DNA

SEQ ID NO: 25633 - DNA, 30 bp, Homo sapiens; identical to SEQ ID NO: 16456
  misc_feature 1..30: note = chr19:17365715-17365745
  misc_feature 1..30: note = hypo
  source 1..30: mol_type = genomic DNA

SEQ ID NO: 25634 - DNA, 25 bp, Homo sapiens
  misc_feature 1..25: note = chr19:17379245-17379270
  misc_feature 1..25: note = hypo
  source 1..25: mol_type = genomic DNA
tttttttttttgagacggagtttcg

SEQ ID NO: 25635 - DNA, 30 bp, Homo sapiens; identical to SEQ ID NO: 16458
  misc_feature 1..30: note = chr19:17404772-17404802
  misc_feature 1..30: note = hypo
  source 1..30: mol_type = genomic DNA

SEQ ID NO: 25636 - DNA, 164 bp, Homo sapiens; identical to SEQ ID NO: 16459
  misc_feature 1..164: note = chr19:17405108-17405272
  misc_feature 1..164: note = hypo
  source 1..164: mol_type = genomic DNA

SEQ ID NO: 25637 - DNA, 30 bp, Homo sapiens; identical to SEQ ID NO: 16461
  misc_feature 1..30: note = chr19:17836551-17836581
  misc_feature 1..30: note = hypo
  source 1..30: mol_type = genomic DNA

SEQ ID NO: 25638 - DNA, 39 bp, Homo sapiens
  misc_feature 1..39: note = chr19:18041203-18041242
  misc_feature 1..39: note = hypo
  source 1..39: mol_type = genomic DNA
ggaattggcgaaaactagcagtcacgccctttggccagg

SEQ ID NO: 25639 - DNA, 144 bp, Homo sapiens; identical to SEQ ID NO: 16463
  misc_feature 1..144: note = chr19:18054338-18054482
  misc_feature 1..144: note = hypo
  source 1..144: mol_type = genomic DNA

SEQ ID NO: 25640 - DNA, 30 bp, Homo sapiens; identical to SEQ ID NO: 16464
  misc_feature 1..30: note = chr19:18054810-18054840
  misc_feature 1..30: note = hypo
  source 1..30: mol_type = genomic DNA

SEQ ID NO: 25641 - DNA, 176 bp, Homo sapiens; identical to SEQ ID NO: 16465
  misc_feature 1..176: note = chr19:18092619-18092795
  misc_feature 1..176: note = hypo
  source 1..176: mol_type = genomic DNA

SEQ ID NO: 25642 - DNA, 11 bp, Homo sapiens
  misc_feature 1..11: note = chr19:18103700-18103711
  misc_feature 1..11: note = hypo
  source 1..11: mol_type = genomic DNA
acctccccaga

SEQ ID NO: 25643 - DNA, 42 bp, Homo sapiens
  misc_feature 1..42: note = chr19:18104430-18104472
  misc_feature 1..42: note = hypo
  source 1..42: mol_type = genomic DNA
gggctcagctcctgccggaggagggcacaaggacccgctgtg

SEQ ID NO: 25644 - DNA, 47 bp, Homo sapiens; identical to SEQ ID NO: 16468
  misc_feature 1..47: note = chr19:18207919-18207966
  misc_feature 1..47: note = hypo
  source 1..47: mol_type = genomic DNA

SEQ ID NO: 25645 - DNA, 18 bp, Homo sapiens
  misc_feature 1..18: note = chr19:18298268-18298286
  misc_feature 1..18: note = hypo
  source 1..18: mol_type = genomic DNA
acaggcataagccaccga

SEQ ID NO: 25646 - DNA, 40 bp, Homo sapiens
  misc_feature 1..40: note = chr19:18330991-18331031
  misc_feature 1..40: note = hypo
  source 1..40: mol_type = genomic DNA
gtactcctaaaatgtcgtccaggcagtgactcaacaaagc

SEQ ID NO: 25647 - DNA, 55 bp, Homo sapiens
  misc_feature 1..55: note = chr19:18331136-18331191
  misc_feature 1..55: note = hypo
  source 1..55: mol_type = genomic DNA
ggagagaaggtgaagaccgtgatgatggggcaccgtgggccgaggcaggtgagct

SEQ ID NO: 25648 - DNA, 42 bp, Homo sapiens; identical to SEQ ID NO: 16472
  misc_feature 1..42: note = chr19:18788397-18788439
  misc_feature 1..42: note = hypo
  source 1..42: mol_type = genomic DNA

SEQ ID NO: 25649 - DNA, 30 bp, Homo sapiens; identical to SEQ ID NO: 16473
  misc_feature 1..30: note = chr19:18883509-18883539
  misc_feature 1..30: note = hypo
  source 1..30: mol_type = genomic DNA

SEQ ID NO: 25650 - DNA, 65 bp, Homo sapiens; identical to SEQ ID NO: 16474
  misc_feature 1..65: note = chr19:18883973-18884038
  misc_feature 1..65: note = hypo
  source 1..65: mol_type = genomic DNA

SEQ ID NO: 25651 - DNA, 83 bp, Homo sapiens; identical to SEQ ID NO: 16475
  misc_feature 1..83: note = chr19:18988902-18988985
  misc_feature 1..83: note = hypo
  source 1..83: mol_type = genomic DNA

SEQ ID NO: 25652 - DNA, 97 bp, Homo sapiens
  misc_feature 1..97: note = chr19:18989724-18989821
  misc_feature 1..97: note = hypo
  source 1..97: mol_type = genomic DNA
ccctccacactcactcggctttgctgggcttcaggctctgggcctcggctgtgtcatactcccgcaggtccttcagctcgtgcacctggcctgtcaa

SEQ ID NO: 25653 - DNA, 37 bp, Homo sapiens
  misc_feature 1..37: note = chr19:18994850-18994887
  misc_feature 1..37: note = hypo
  source 1..37: mol_type = genomic DNA
gtgtgggctgtgcctcggccccctgccacccgatcct

SEQ ID NO: 25654 - DNA, 138 bp, Homo sapiens; identical to SEQ ID NO: 16478
  misc_feature 1..138: note = chr19:19218614-19218752
  misc_feature 1..138: note = hypo
  source 1..138: mol_type = genomic DNA

SEQ ID NO: 25655 - DNA, 30 bp, Homo sapiens; identical to SEQ ID NO: 16479
  misc_feature 1..30: note = chr19:19335195-19335225
  misc_feature 1..30: note = hypo
  source 1..30: mol_type = genomic DNA

SEQ ID NO: 25656 - DNA, 30 bp, Homo sapiens; identical to SEQ ID NO: 16480
  misc_feature 1..30: note = chr19:22017749-22017779
  misc_feature 1..30: note = hypo
  source 1..30: mol_type = genomic DNA

SEQ ID NO: 25657 - DNA, 32 bp, Homo sapiens
  misc_feature 1..32: note = chr19:30555376-30555408
  misc_feature 1..32: note = hypo
  source 1..32: mol_type = genomic DNA
gcggcccactgtgctcccggcagccctcctga

SEQ ID NO: 25658 - DNA, 22 bp, Homo sapiens
  misc_feature 1..22: note = chr19:30637531-30637553
  misc_feature 1..22: note = hypo
  source 1..22: mol_type = genomic DNA
gcaagcacgtgacatccagtac

SEQ ID NO: 25659 - DNA, 30 bp, Homo sapiens; identical to SEQ ID NO: 16483
  misc_feature 1..30: note = chr19:31587530-31587560
  misc_feature 1..30: note = hypo
  source 1..30: mol_type = genomic DNA

SEQ ID NO: 25660 - DNA, 30 bp, Homo sapiens; identical to SEQ ID NO: 16485
  misc_feature 1..30: note = chr19:32672333-32672363
  misc_feature 1..30: note = hypo
  source 1..30: mol_type = genomic DNA

SEQ ID NO: 25661 - DNA, 30 bp, Homo sapiens; identical to SEQ ID NO: 16486
  misc_feature 1..30: note = chr19:32835111-32835141
  misc_feature 1..30: note = hypo
  source 1..30: mol_type = genomic DNA

SEQ ID NO: 25662 - DNA, 30 bp, Homo sapiens; identical to SEQ ID NO: 16487
  misc_feature 1..30: note = chr19:33415273-33415303
  misc_feature 1..30: note = hypo
  source 1..30: mol_type = genomic DNA

SEQ ID NO: 25663 - DNA, 25 bp, Homo sapiens
  misc_feature 1..25: note = chr19:33557305-33557330
  misc_feature 1..25: note = hypo
  source 1..25: mol_type = genomic DNA
cgcacccggccgtggagcacggttc

SEQ ID NO: 25664 - DNA, 30 bp, Homo sapiens; identical to SEQ ID NO: 16489
  misc_feature 1..30: note = chr19:34263853-34263883
  misc_feature 1..30: note = hypo
  source 1..30: mol_type = genomic DNA

SEQ ID NO: 25665 - DNA, 30 bp, Homo sapiens; identical to SEQ ID NO: 16490
  misc_feature 1..30: note = chr19:35615979-35616009
  misc_feature 1..30: note = hypo
  source 1..30: mol_type = genomic DNA

SEQ ID NO: 25666 - DNA, 85 bp, Homo sapiens
  misc_feature 1..85: note = chr19:35616256-35616341
  misc_feature 1..85: note = hypo
  source 1..85: mol_type = genomic DNA
ttgtcaggctcaaggcggaggacctggctgaaggcgaagtcgctgcctaggatggccagctggtccctggcgatgagcagtggct

SEQ ID NO: 25667 - DNA, 21 bp, Homo sapiens
  misc_feature 1..21: note = chr19:35616397-35616418
  misc_feature 1..21: note = hypo
  source 1..21: mol_type = genomic DNA
tcccagcgcatgacctgtggg

SEQ ID NO: 25668 - skipped

SEQ ID NO: 25669 - DNA, 344 bp, Homo sapiens; identical to SEQ ID NO: 16494
  misc_feature 1..344: note = chr19:36221572-36221916
  misc_feature 1..344: note = hypo
  source 1..344: mol_type = genomic DNA

SEQ ID NO: 25670 - DNA, 19 bp, Homo sapiens
  misc_feature 1..19: note = chr19:36250134-36250153
  misc_feature 1..19: note = hypo
  source 1..19: mol_type = genomic DNA
gcaacggtgcttcatggaa

SEQ ID NO: 25671 - DNA, 169 bp, Homo sapiens; identical to SEQ ID NO: 16497
  misc_feature 1..169: note = chr19:36604561-36604730
  misc_feature 1..169: note = hypo
  source 1..169: mol_type = genomic DNA

SEQ ID NO: 25672 - skipped

SEQ ID NO: 25673 - DNA, 20 bp, Homo sapiens
  misc_feature 1..20: note = chr19:38828365-38828385
  misc_feature 1..20: note = hypo
  source 1..20: mol_type = genomic DNA
tttatttttttgagacggag

SEQ ID NO: 25674 - DNA, 20 bp, Homo sapiens
  misc_feature 1..20: note = chr19:38905702-38905722
  misc_feature 1..20: note = hypo
  source 1..20: mol_type = genomic DNA
tgcggcggtagcgggcgtag

SEQ ID NO: 25675 - DNA, 47 bp, Homo sapiens; identical to SEQ ID NO: 16503
  misc_feature 1..47: note = chr19:38998362-38998409
  misc_feature 1..47: note = hypo
  source 1..47: mol_type = genomic DNA

SEQ ID NO: 25676 - DNA, 30 bp, Homo sapiens; identical to SEQ ID NO: 16504
  misc_feature 1..30: note = chr19:39330221-39330251
  misc_feature 1..30: note = hypo
  source 1..30: mol_type = genomic DNA

SEQ ID NO: 25677 - DNA, 26 bp, Homo sapiens
  misc_feature 1..26: note = chr19:39392993-39393019
  misc_feature 1..26: note = hypo
  source 1..26: mol_type = genomic DNA
gccaccgcgcccggcctcattttatt

SEQ ID NO: 25678 - DNA, 39 bp, Homo sapiens; identical to SEQ ID NO: 16506
  misc_feature 1..39: note = chr19:39646149-39646188
  misc_feature 1..39: note = hypo
  source 1..39: mol_type = genomic DNA

SEQ ID NO: 25679 - DNA, 189 bp, Homo sapiens; identical to SEQ ID NO: 16507
  misc_feature 1..189: note = chr19:40218707-40218896
  misc_feature 1..189: note = hypo
  source 1..189: mol_type = genomic DNA

SEQ ID NO: 25680 - DNA, 49 bp, Homo sapiens; identical to SEQ ID NO: 16509
  misc_feature 1..49: note = chr19:41062945-41062994
  misc_feature 1..49: note = hypo
  source 1..49: mol_type = genomic DNA

SEQ ID NO: 25681 - DNA, 59 bp, Homo sapiens
  misc_feature 1..59: note = chr19:41881475-41881534
  misc_feature 1..59: note = hypo
  source 1..59: mol_type = genomic DNA
cccggcccgtgagcccgtttctttatctgcaaaacagggattaaaaacaagccaacacc

SEQ ID NO: 25682 - DNA, 31 bp, Homo sapiens; identical to SEQ ID NO: 16511
  misc_feature 1..31: note = chr19:42202366-42202397
  misc_feature 1..31: note = hypo
  source 1..31: mol_type = genomic DNA

SEQ ID NO: 25683 - DNA, 127 bp, Homo sapiens; identical to SEQ ID NO: 16512
  misc_feature 1..127: note = chr19:42349306-42349433
  misc_feature 1..127: note = hypo
  source 1..127: mol_type = genomic DNA

SEQ ID NO: 25684 - DNA, 30 bp, Homo sapiens; identical to SEQ ID NO: 16513
  misc_feature 1..30: note = chr19:42373877-42373907
  misc_feature 1..30: note = hypo
  source 1..30: mol_type = genomic DNA

SEQ ID NO: 25685 - DNA, 44 bp, Homo sapiens; identical to SEQ ID NO: 16514
  misc_feature 1..44: note = chr19:42408203-42408247
  misc_feature 1..44: note = hypo
  source 1..44: mol_type = genomic DNA

SEQ ID NO: 25686 - DNA, 30 bp, Homo sapiens; identical to SEQ ID NO: 16515
  misc_feature 1..30: note = chr19:42408664-42408694
  misc_feature 1..30: note = hypo
  source 1..30: mol_type = genomic DNA

SEQ ID NO: 25687 - DNA, 19 bp, Homo sapiens
  misc_feature 1..19: note = chr19:42579050-42579069
  misc_feature 1..19: note = hypo
  source 1..19: mol_type = genomic DNA
tttcagatggagtctcgct

SEQ ID NO: 25688 - DNA, 33 bp, Homo sapiens; identical to SEQ ID NO: 16517
  misc_feature 1..33: note = chr19:45381918-45381951
  misc_feature 1..33: note = hypo
  source 1..33: mol_type = genomic DNA

SEQ ID NO: 25689 - DNA, 30 bp, Homo sapiens; identical to SEQ ID NO: 16518
  misc_feature 1..30: note = chr19:45626698-45626728
  misc_feature 1..30: note = hypo
  source 1..30: mol_type = genomic DNA

SEQ ID NO: 25690 - DNA, 30 bp, Homo sapiens; identical to SEQ ID NO: 16519
  misc_feature 1..30: note = chr19:45709152-45709182
  misc_feature 1..30: note = hypo
  source 1..30: mol_type = genomic DNA

SEQ ID NO: 25691 - DNA, 87 bp, Homo sapiens
  misc_feature 1..87: note = chr19:45810015-45810102
  misc_feature 1..87: note = hypo
  source 1..87: mol_type = genomic DNA
gggcggggatcatgtcgtcaatggactggcctttctccaacttcttctccatttccaccatgagcttcacaccatccaccaccagct

SEQ ID NO: 25692 - DNA, 83 bp, Homo sapiens
  misc_feature 1..83: note = chr19:45997445-45997528
  misc_feature 1..83: note = hypo
  source 1..83: mol_type = genomic DNA
gaattctaattggtccgtgctatcgaggcactgtccccttactggctctcgctccagtggcccccactgcttttcttcctctt

SEQ ID NO: 25693 - DNA, 19 bp, Homo sapiens
  misc_feature 1..19: note = chr19:45997584-45997603
  misc_feature 1..19: note = hypo
  source 1..19: mol_type = genomic DNA
gtaccggcctggggtgtcc

SEQ ID NO: 25694 - DNA, 48 bp, Homo sapiens; identical to SEQ ID NO: 16524
  misc_feature 1..48: note = chr19:46321351-46321399
  misc_feature 1..48: note = hypo
  source 1..48: mol_type = genomic DNA

SEQ ID NO: 25695 - DNA, 52 bp, Homo sapiens; identical to SEQ ID NO: 16525
  misc_feature 1..52: note = chr19:46327091-46327143
  misc_feature 1..52: note = hypo
  source 1..52: mol_type = genomic DNA

SEQ ID NO: 25696 - DNA, 13 bp, Homo sapiens
  misc_feature 1..13: note = chr19:46404601-46404614
  misc_feature 1..13: note = hypo
  source 1..13: mol_type = genomic DNA
gctgtgaagaggg

SEQ ID NO: 25697 - DNA, 44 bp, Homo sapiens; identical to SEQ ID NO: 16528
  misc_feature 1..44: note = chr19:47429440-47429484
  misc_feature 1..44: note = hypo
  source 1..44: mol_type = genomic DNA

SEQ ID NO: 25698 - DNA, 42 bp, Homo sapiens; identical to SEQ ID NO: 16529
  misc_feature 1..42: note = chr19:48003498-48003540
  misc_feature 1..42: note = hypo
  source 1..42: mol_type = genomic DNA

SEQ ID NO: 25699 - DNA, 37 bp, Homo sapiens
  misc_feature 1..37: note = chr19:48151337-48151374
  misc_feature 1..37: note = hypo
  source 1..37: mol_type = genomic DNA
cgtctccctgttttcctgttaccgtctccccgtccct

SEQ ID NO: 25700 - DNA, 13 bp, Homo sapiens
  misc_feature 1..13: note = chr19:48614830-48614843
  misc_feature 1..13: note = hypo
  source 1..13: mol_type = genomic DNA
aagcccagcacta

SEQ ID NO: 25701 - DNA, 97 bp, Homo sapiens
  misc_feature 1..97: note = chr19:49119132-49119229
  misc_feature 1..97: note = hypo
  source 1..97: mol_type = genomic DNA
cttggtgtggctgtgcggggttcctggggccttgccgaaatgccggtacacctctcggcccttgcgaggacctagggaaggggaaggagaaccgggt

SEQ ID NO: 25702 - DNA, 91 bp, Homo sapiens
  misc_feature 1..91: note = chr19:49119259-49119350
  misc_feature 1..91: note = hypo
  source 1..91: mol_type = genomic DNA
ctcccagatccaggagggtgaaggctgccagtagccacacagctcagtccaaacccgtcgaccacgtatcactcaccggagagcaggacag

SEQ ID NO: 25703 - DNA, 26 bp, Homo sapiens
  misc_feature 1..26: note = chr19:49402376-49402402
  misc_feature 1..26: note = hypo
  source 1..26: mol_type = genomic DNA
gaggtagacaccgtctcaaaaaaaaa

SEQ ID NO: 25704 - DNA, 30 bp, Homo sapiens; identical to SEQ ID NO: 16535
  misc_feature 1..30: note = chr19:50053089-50053119
  misc_feature 1..30: note = hypo
  source 1..30: mol_type = genomic DNA

SEQ ID NO: 25705 - DNA, 75 bp, Homo sapiens; identical to SEQ ID NO: 16536
  misc_feature 1..75: note = chr19:50166634-50166709
  misc_feature 1..75: note = hypo
  source 1..75: mol_type = genomic DNA

SEQ ID NO: 25706 - DNA, 30 bp, Homo sapiens; identical to SEQ ID NO: 16537
  misc_feature 1..30: note = chr19:50216075-50216105
  misc_feature 1..30: note = hypo
  source 1..30: mol_type = genomic DNA

SEQ ID NO: 25707 - DNA, 136 bp, Homo sapiens; identical to SEQ ID NO: 16538
  misc_feature 1..136: note = chr19:50216693-50216829
  misc_feature 1..136: note = hypo
  source 1..136: mol_type = genomic DNA

SEQ ID NO: 25708 - DNA, 16 bp, Homo sapiens
  misc_feature 1..16: note = chr19:50320037-50320053
  misc_feature 1..16: note = hypo
  source 1..16: mol_type = genomic DNA
ccggccctggtcaggt

SEQ ID NO: 25709 - DNA, 30 bp, Homo sapiens; identical to SEQ ID NO: 16540
  misc_feature 1..30: note = chr19:50353152-50353182
  misc_feature 1..30: note = hypo
  source 1..30: mol_type = genomic DNA

SEQ ID NO: 25710 - DNA, 90 bp, Homo sapiens; identical to SEQ ID NO: 16542
  misc_feature 1..90: note = chr19:50364908-50364998
  misc_feature 1..90: note = hypo
  source 1..90: mol_type = genomic DNA

SEQ ID NO: 25711 - DNA, 35 bp, Homo sapiens; identical to SEQ ID NO: 16544
  misc_feature 1..35: note = chr19:51046474-51046509
  misc_feature 1..35: note = hypo
  source 1..35: mol_type = genomic DNA

SEQ ID NO: 25712 - DNA, 23 bp, Homo sapiens
  misc_feature 1..23: note = chr19:52512149-52512172
  misc_feature 1..23: note = hypo
  source 1..23: mol_type = genomic DNA
ggttgggaaagaggccgggcgcg

SEQ ID NO: 25713 - DNA, 30 bp, Homo sapiens; identical to SEQ ID NO: 16547
  misc_feature 1..30: note = chr19:54033359-54033389
  misc_feature 1..30: note = hypo
  source 1..30: mol_type = genomic DNA

SEQ ID NO: 25714 - DNA, 16 bp, Homo sapiens
  misc_feature 1..16: note = chr19:55727832-55727848
  misc_feature 1..16: note = hypo
  source 1..16: mol_type = genomic DNA
gcgattagatcattga

SEQ ID NO: 25715 - DNA, 151 bp, Homo sapiens; identical to SEQ ID NO: 16549
  misc_feature 1..151: note = chr19:58457421-58457572
  misc_feature 1..151: note = hypo
  source 1..151: mol_type = genomic DNA

SEQ ID NO: 25716 - DNA, 30 bp, Homo sapiens; identical to SEQ ID NO: 16550
  misc_feature 1..30: note = chr19:58891154-58891184
  misc_feature 1..30: note = hypo
  source 1..30: mol_type = genomic DNA

SEQ ID NO: 25717 - DNA, 11 bp, Homo sapiens
  misc_feature 1..11: note = chr20:399996-400007
  misc_feature 1..11: note = hypo
  source 1..11: mol_type = genomic DNA
gcttcaaggac

SEQ ID NO: 25718 - skipped

SEQ ID NO: 25719 - DNA, 237 bp, Homo sapiens
  misc_feature 1..237: note = chr20:401756-401993
  misc_feature 1..237: note = hypo
  source 1..237: mol_type = genomic DNA
gtgctctgatacctcattggacgcccgcgaaaacctacgaggtaggctccgtctccccatgttgcggacgaggaacctgagggaaagagaggcccagcgccttaccccaggcccacggctcatgagagaagcagcctagacgtgagcgcaggcgtggggggagactcccttcccctctacctttcgccgcccgggctcctgcagccacgctgctctcagcctcgctgtgggcatctg

SEQ ID NO: 25720 - DNA, 24 bp, Homo sapiens
  misc_feature 1..24: note = chr20:799706-799730
  misc_feature 1..24: note = hypo
  source 1..24: mol_type = genomic DNA
gagccaccgcgccgggcccagctt

SEQ ID NO: 25721 - DNA, 41 bp, Homo sapiens; identical to SEQ ID NO: 16556
  misc_feature 1..41: note = chr20:1323452-1323493
  misc_feature 1..41: note = hypo
  source 1..41: mol_type = genomic DNA

SEQ ID NO: 25722 - DNA, 30 bp, Homo sapiens; identical to SEQ ID NO: 16557
  misc_feature 1..30: note = chr20:1692274-1692304
  misc_feature 1..30: note = hypo
  source 1..30: mol_type = genomic DNA

SEQ ID NO: 25723 - DNA, 147 bp, Homo sapiens; identical to SEQ ID NO: 5237
  misc_feature 1..147: note = chr20:2113428-2113575
  misc_feature 1..147: note = hypo
  source 1..147: mol_type = genomic DNA

SEQ ID NO: 25724 - DNA, 30 bp, Homo sapiens; identical to SEQ ID NO: 16559
  misc_feature 1..30: note = chr20:2444402-2444432
  misc_feature 1..30: note = hypo
  source 1..30: mol_type = genomic DNA

SEQ ID NO: 25725 - DNA, 32 bp, Homo sapiens; identical to SEQ ID NO: 16560
  misc_feature 1..32: note = chr20:2645508-2645540
  misc_feature 1..32: note = hypo
  source 1..32: mol_type = genomic DNA

SEQ ID NO: 25726 - DNA, 91 bp, Homo sapiens; identical to SEQ ID NO: 16562
  misc_feature 1..91: note = chr20:3202418-3202509
  misc_feature 1..91: note = hypo
  source 1..91: mol_type = genomic DNA

SEQ ID NO: 25727 - DNA, 23 bp, Homo sapiens
  misc_feature 1..23: note = chr20:3204952-3204975
  misc_feature 1..23: note = hypo
  source 1..23: mol_type = genomic DNA
atgccacacgcccttactctgtg

SEQ ID NO: 25728 - DNA, 30 bp, Homo sapiens; identical to SEQ ID NO: 16564
  misc_feature 1..30: note = chr20:3763473-3763503
  misc_feature 1..30: note = hypo
  source 1..30: mol_type = genomic DNA

SEQ ID NO: 25729 - DNA, 105 bp, Homo sapiens; identical to SEQ ID NO: 16565
  misc_feature 1..105: note = chr20:3820924-3821029
  misc_feature 1..105: note = hypo
  source 1..105: mol_type = genomic DNA

SEQ ID NO: 25730 - DNA, 33 bp, Homo sapiens; identical to SEQ ID NO: 16566
  misc_feature 1..33: note = chr20:4690739-4690772
  misc_feature 1..33: note = hypo
  source 1..33: mol_type = genomic DNA

SEQ ID NO: 25731 - DNA, 30 bp, Homo sapiens; identical to SEQ ID NO: 16567
  misc_feature 1..30: note = chr20:5762556-5762586
  misc_feature 1..30: note = hypo
  source 1..30: mol_type = genomic DNA

SEQ ID NO: 25732 - DNA, 20 bp, Homo sapiens
  misc_feature 1..20: note = chr20:16554697-16554717
  misc_feature 1..20: note = hypo
  source 1..20: mol_type = genomic DNA
taagggagttaaaggcgaac

SEQ ID NO: 25733 - DNA, 126 bp, Homo sapiens
  misc_feature 1..126: note = chr20:16555030-16555156
  misc_feature 1..126: note = hypo
  source 1..126: mol_type = genomic DNA
tggtatcttaaggcttagggcctctggtagaagtgagctccacctcccttcctgtgtagaaggtaaatgcattcattcattcagtgaatcgagcatgcatgaaatcgtttgcgcacacccagaagc

SEQ ID NO: 25734 - DNA, 40 bp, Homo sapiens; identical to SEQ ID NO: 16570
  misc_feature 1..40: note = chr20:18233341-18233381
  misc_feature 1..40: note = hypo
  source 1..40: mol_type = genomic DNA

SEQ ID NO: 25735 - DNA, 30 bp, Homo sapiens; identical to SEQ ID NO: 16571
  misc_feature 1..30: note = chr20:19674013-19674043
  misc_feature 1..30: note = hypo
  source 1..30: mol_type = genomic DNA

SEQ ID NO: 25736 - DNA, 120 bp, Homo sapiens; identical to SEQ ID NO: 16572
  misc_feature 1..120: note = chr20:24571035-24571155
  misc_feature 1..120: note = hypo
  source 1..120: mol_type = genomic DNA

SEQ ID NO: 25737 - DNA, 16 bp, Homo sapiens
  misc_feature 1..16: note = chr20:30468303-30468319
  misc_feature 1..16: note = hypo
  source 1..16: mol_type = genomic DNA
tttttttttttgagac

SEQ ID NO: 25738 - DNA, 153 bp, Homo sapiens; identical to SEQ ID NO: 5243
  misc_feature 1..153: note = chr20:30864866-30865019
  misc_feature 1..153: note = hypo
  source 1..153: mol_type = genomic DNA

SEQ ID NO: 25739 - DNA, 31 bp, Homo sapiens
  misc_feature 1..31: note = chr20:31115652-31115683
  misc_feature 1..31: note = hypo
  source 1..31: mol_type = genomic DNA
aatcttccaccacagcgacccgcttcagaga

SEQ ID NO: 25740 - DNA, 18 bp, Homo sapiens
  misc_feature 1..18: note = chr20:31115799-31115817
  misc_feature 1..18: note = hypo
  source 1..18: mol_type = genomic DNA
ggacgggcaatgcctccg

SEQ ID NO: 25741 - DNA, 160 bp, Homo sapiens; identical to SEQ ID NO: 16579
  misc_feature 1..160: note = chr20:32242529-32242689
  misc_feature 1..160: note = hypo
  source 1..160: mol_type = genomic DNA

SEQ ID NO: 25742 - DNA, 91 bp, Homo sapiens
  misc_feature 1..91: note = chr20:32450427-32450518
  misc_feature 1..91: note = hypo
  source 1..91: mol_type = genomic DNA
gacttcaggggcaaatgtacattgggaatctccaagggacatctcccaaactacctgaccagggtgtgggttccgccgaatatcttttggg

SEQ ID NO: 25743 - DNA, 30 bp, Homo sapiens; identical to SEQ ID NO: 16581
  misc_feature 1..30: note = chr20:32524318-32524348
  misc_feature 1..30: note = hypo
  source 1..30: mol_type = genomic DNA

SEQ ID NO: 25744 - DNA, 30 bp, Homo sapiens; identical to SEQ ID NO: 16582
  misc_feature 1..30: note = chr20:33134914-33134944
  misc_feature 1..30: note = hypo
  source 1..30: mol_type = genomic DNA

SEQ ID NO: 25745 - DNA, 30 bp, Homo sapiens; identical to SEQ ID NO: 16583
  misc_feature 1..30: note = chr20:33547626-33547656
  misc_feature 1..30: note = hypo
  source 1..30: mol_type = genomic DNA

SEQ ID NO: 25746 - DNA, 30 bp, Homo sapiens; identical to SEQ ID NO: 16584
  misc_feature 1..30: note = chr20:33866905-33866935
  misc_feature 1..30: note = hypo
  source 1..30: mol_type = genomic DNA

SEQ ID NO: 25747 - DNA, 67 bp, Homo sapiens; identical to SEQ ID NO: 16586
  misc_feature 1..67: note = chr20:35089090-35089157
  misc_feature 1..67: note = hypo
  source 1..67: mol_type = genomic DNA

SEQ ID NO: 25748 - DNA, 34 bp, Homo sapiens; identical to SEQ ID NO: 16587
  misc_feature 1..34: note = chr20:35924375-35924409
  misc_feature 1..34: note = hypo
  source 1..34: mol_type = genomic DNA

SEQ ID NO: 25749 - DNA, 39 bp, Homo sapiens; identical to SEQ ID NO: 16588
  misc_feature 1..39: note = chr20:36151122-36151161
  misc_feature 1..39: note = hypo
  source 1..39: mol_type = genomic DNA

SEQ ID NO: 25750 - DNA, 30 bp, Homo sapiens; identical to SEQ ID NO: 16589
  misc_feature 1..30: note = chr20:36571234-36571264
  misc_feature 1..30: note = hypo
  source 1..30: mol_type = genomic DNA

SEQ ID NO: 25751 - DNA, 30 bp, Homo sapiens
  misc_feature 1..30: note = chr20:42218664-42218694
  misc_feature 1..30: note = hypo
  source 1..30: mol_type = genomic DNA
ttaatatcctagattcgaagacaaacataa

SEQ ID NO: 25752 - DNA, 128 bp, Homo sapiens; identical to SEQ ID NO: 16591
  misc_feature 1..128: note = chr20:43065628-43065756
  misc_feature 1..128: note = hypo
  source 1..128: mol_type = genomic DNA

SEQ ID NO: 25753 - DNA, 24 bp, Homo sapiens
  misc_feature 1..24: note = chr20:43952320-43952344
  misc_feature 1..24: note = hypo
  source 1..24: mol_type = genomic DNA
gagtttcaccgtgttagccaggat

SEQ ID NO: 25754 - DNA, 25 bp, Homo sapiens
  misc_feature 1..25: note = chr20:44601522-44601547
  misc_feature 1..25: note = hypo
  source 1..25: mol_type = genomic DNA
gggcgctgtgagtcacgcctgtaat

SEQ ID NO: 25755 - DNA, 280 bp, Homo sapiens
  misc_feature 1..280: note = chr20:44601794-44602074
  misc_feature 1..280: note = hypo
  source 1..280: mol_type = genomic DNA
gcgagaccctctttcaaaaaataaataaatacaagtcaactacctatcctttaaaagtggagaaagaaaaaaaattttaattaaaagtcagctgcccttaaggtatgtccttcctccggaaatgtcaccttctgttttaagacttttagcagtttgcagtggaagagcacaagagggagtaaggcgctctggtttttgtccctaagtctctgtagttccataggctattttccttaattgaaagatacaaattttgggggaaaaaaatctcaaaaaaact

SEQ ID NO: 25756 - DNA, 90 bp, Homo sapiens
  misc_feature 1..90: note = chr20:44602364-44602454
  misc_feature 1..90: note = hypo
  source 1..90: mol_type = genomic DNA
caaacaaacaaacaaaaagtcctaaggagaagacctattaataaggagaaaaggtccgggctcggtgggtcacacctgtaataaccagca

SEQ ID NO: 25757 - DNA, 30 bp, Homo sapiens; identical to SEQ ID NO: 16596
  misc_feature 1..30: note = chr20:44756572-44756602
  misc_feature 1..30: note = hypo
  source 1..30: mol_type = genomic DNA

SEQ ID NO: 25758 - DNA, 76 bp, Homo sapiens
  misc_feature 1..76: note = chr20:45337945-45338021
  misc_feature 1..76: note = hypo
  source 1..76: mol_type = genomic DNA
acaagtgtggaccagtgattggggcacctcttccctgcaaagaggccaggggaagacagtgcgtgtggggtcttct

SEQ ID NO: 25759 - DNA, 95 bp, Homo sapiens; identical to SEQ ID NO: 16598
  misc_feature 1..95: note = chr20:46013566-46013661
  misc_feature 1..95: note = hypo
  source 1..95: mol_type = genomic DNA

SEQ ID NO: 25760 - DNA, 38 bp, Homo sapiens
  misc_feature 1..38: note = chr20:47247201-47247239
  misc_feature 1..38: note = hypo
  source 1..38: mol_type = genomic DNA
gtcctgactcctgagcgccccaccctgcccaagctccc

SEQ ID NO: 25761 - DNA, 69 bp, Homo sapiens; identical to SEQ ID NO: 16600
  misc_feature 1..69: note = chr20:47274233-47274302
  misc_feature 1..69: note = hypo
  source 1..69: mol_type = genomic DNA

SEQ ID NO: 25762 - DNA, 184 bp, Homo sapiens; identical to SEQ ID NO: 16602
  misc_feature 1..184: note = chr20:47428537-47428721
  misc_feature 1..184: note = hypo
  source 1..184: mol_type = genomic DNA

SEQ ID NO: 25763 - DNA, 30 bp, Homo sapiens; identical to SEQ ID NO: 16604
  misc_feature 1..30: note = chr20:48477511-48477541
  misc_feature 1..30: note = hypo
  source 1..30: mol_type = genomic DNA

SEQ ID NO: 25764 - DNA, 16 bp, Homo sapiens
  misc_feature 1..16: note = chr20:48720810-48720826
  misc_feature 1..16: note = hypo
  source 1..16: mol_type = genomic DNA
ccgtctcaaaaaaaaa

SEQ ID NO: 25765 - DNA, 30 bp, Homo sapiens; identical to SEQ ID NO: 16606
  misc_feature 1..30: note = chr20:48771341-48771371
  misc_feature 1..30: note = hypo
  source 1..30: mol_type = genomic DNA

SEQ ID NO: 25766 - DNA, 30 bp, Homo sapiens; identical to SEQ ID NO: 16607
  misc_feature 1..30: note = chr20:48863456-48863486
  misc_feature 1..30: note = hypo
  source 1..30: mol_type = genomic DNA

SEQ ID NO: 25767 - DNA, 131 bp, Homo sapiens; identical to SEQ ID NO: 16608
  misc_feature 1..131: note = chr20:49047031-49047162
  misc_feature 1..131: note = hypo
  source 1..131: mol_type = genomic DNA

SEQ ID NO: 25768 - DNA, 33 bp, Homo sapiens; identical to SEQ ID NO: 16609
  misc_feature 1..33: note = chr20:49200517-49200550
  misc_feature 1..33: note = hypo
  source 1..33: mol_type = genomic DNA

SEQ ID NO: 25769 - DNA, 60 bp, Homo sapiens; identical to SEQ ID NO: 16611
  misc_feature 1..60: note = chr20:49218718-49218778
  misc_feature 1..60: note = hypo
  source 1..60: mol_type = genomic DNA

SEQ ID NO: 25770 - DNA, 42 bp, Homo sapiens
  misc_feature 1..42: note = chr20:49261761-49261803
  misc_feature 1..42: note = hypo
  source 1..42: mol_type = genomic DNA
gagcccaggcagggacggccaaaagctcgctacccctgccca

SEQ ID NO: 25771 - DNA, 68 bp, Homo sapiens; identical to SEQ ID NO: 5247
  misc_feature 1..68: note = chr20:49286826-49286894
  misc_feature 1..68: note = hypo
  source 1..68: mol_type = genomic DNA

SEQ ID NO: 25772 - DNA, 30 bp, Homo sapiens; identical to SEQ ID NO: 16614
  misc_feature 1..30: note = chr20:49345697-49345727
  misc_feature 1..30: note = hypo
  source 1..30: mol_type = genomic DNA

SEQ ID NO: 25773 - DNA, 212 bp, Homo sapiens; identical to SEQ ID NO: 1639
  misc_feature 1..212: note = chr20:49346547-49346759
  misc_feature 1..212: note = hypo
  source 1..212: mol_type = genomic DNA

SEQ ID NO: 25774 - DNA, 26 bp, Homo sapiens
  misc_feature 1..26: note = chr20:49350870-49350896
  misc_feature 1..26: note = hypo
  source 1..26: mol_type = genomic DNA
aactaggtagtgtgccggtccttttt

SEQ ID NO: 25775 - DNA, 17 bp, Homo sapiens
  misc_feature 1..17: note = chr20:49378043-49378060
  misc_feature 1..17: note = hypo
  source 1..17: mol_type = genomic DNA
ggcggagtttttgcgct

SEQ ID NO: 25776 - DNA, 30 bp, Homo sapiens; identical to SEQ ID NO: 16619
  misc_feature 1..30: note = chr20:49380822-49380852
  misc_feature 1..30: note = hypo
  source 1..30: mol_type = genomic DNA

SEQ ID NO: 25777 - DNA, 36 bp, Homo sapiens; identical to SEQ ID NO: 16620
  misc_feature 1..36: note = chr20:52693155-52693191
  misc_feature 1..36: note = hypo
  source 1..36: mol_type = genomic DNA

SEQ ID NO: 25778 - DNA, 18 bp, Homo sapiens
  misc_feature 1..18: note = chr20:53052060-53052078
  misc_feature 1..18: note = hypo
  source 1..18: mol_type = genomic DNA
aatagctgttaaggccgg

SEQ ID NO: 25779 - DNA, 30 bp, Homo sapiens; identical to SEQ ID NO: 16622
  misc_feature 1..30: note = chr20:55693399-55693429
  misc_feature 1..30: note = hypo
  source 1..30: mol_type = genomic DNA

SEQ ID NO: 25780 - DNA, 30 bp, Homo sapiens; identical to SEQ ID NO: 16624
  misc_feature 1..30: note = chr20:55925381-55925411
  misc_feature 1..30: note = hypo
  source 1..30: mol_type = genomic DNA

SEQ ID NO: 25781 - DNA, 222 bp, Homo sapiens; identical to SEQ ID NO: 16625
  misc_feature 1..222: note = chr20:55958990-55959212
  misc_feature 1..222: note = hypo
  source 1..222: mol_type = genomic DNA

SEQ ID NO: 25782 - DNA, 54 bp, Homo sapiens
  misc_feature 1..54: note = chr20:56766190-56766244
  misc_feature 1..54: note = hypo
  source 1..54: mol_type = genomic DNA
tctggtcagttagaatcctccatcctggccgggcgcggtggctcacgcctgtaa

SEQ ID NO: 25783 - DNA, 30 bp, Homo sapiens; identical to SEQ ID NO: 16627
  misc_feature 1..30: note = chr20:57198958-57198988
  misc_feature 1..30: note = hypo
  source 1..30: mol_type = genomic DNA

SEQ ID NO: 25784 - DNA, 30 bp, Homo sapiens; identical to SEQ ID NO: 16628
  misc_feature 1..30: note = chr20:57699792-57699822
  misc_feature 1..30: note = hypo
  source 1..30: mol_type = genomic DNA

SEQ ID NO: 25785 - DNA, 97 bp, Homo sapiens; identical to SEQ ID NO: 16629
  misc_feature 1..97: note = chr20:58507740-58507837
  misc_feature 1..97: note = hypo
  source 1..97: mol_type = genomic DNA

SEQ ID NO: 25786 - DNA, 236 bp, Homo sapiens; identical to SEQ ID NO: 16630
  misc_feature 1..236: note = chr20:58514132-58514368
  misc_feature 1..236: note = hypo
  source 1..236: mol_type = genomic DNA

SEQ ID NO: 25787 - DNA, 21 bp, Homo sapiens
  misc_feature 1..21: note = chr20:59185811-59185832
  misc_feature 1..21: note = hypo
  source 1..21: mol_type = genomic DNA
cacgcccggccgagtaaaagt

SEQ ID NO: 25788 - skipped

SEQ ID NO: 25789 - DNA, 35 bp, Homo sapiens; identical to SEQ ID NO: 16633
  misc_feature 1..35: note = chr20:60120848-60120883
  misc_feature 1..35: note = hypo
  source 1..35: mol_type = genomic DNA

SEQ ID NO: 25790 - DNA, 30 bp, Homo sapiens; identical to SEQ ID NO: 16634
  misc_feature 1..30: note = chr20:60202364-60202394
  misc_feature 1..30: note = hypo
  source 1..30: mol_type = genomic DNA

SEQ ID NO: 25791 - DNA, 21 bp, Homo sapiens
  misc_feature 1..21: note = chr20:60202624-60202645
  misc_feature 1..21: note = hypo
  source 1..21: mol_type = genomic DNA
ttgtgtcgaccatgactgctt

SEQ ID NO: 25792 - DNA, 90 bp, Homo sapiens
  misc_feature 1..90: note = chr20:60238291-60238381
  misc_feature 1..90: note = hypo
  source 1..90: mol_type = genomic DNA
cagaggagctttcatcgagggcttggcgcccacgacaaatgagtccacgcaggaaaggagtggcacccgcaggaggcctgtgctgcggag

SEQ ID NO: 25793 - DNA, 30 bp, Homo sapiens; identical to SEQ ID NO: 16638
  misc_feature 1..30: note = chr20:60281435-60281465
  misc_feature 1..30: note = hypo
  source 1..30: mol_type = genomic DNA

SEQ ID NO: 25794 - DNA, 150 bp, Homo sapiens; identical to SEQ ID NO: 16641
  misc_feature 1..150: note = chr20:60385207-60385357
  misc_feature 1..150: note = hypo
  source 1..150: mol_type = genomic DNA

SEQ ID NO: 25795 - DNA, 30 bp, Homo sapiens; identical to SEQ ID NO: 16642
  misc_feature 1..30: note = chr20:60428191-60428221
  misc_feature 1..30: note = hypo
  source 1..30: mol_type = genomic DNA

SEQ ID NO: 25796 - DNA, 30 bp, Homo sapiens; identical to SEQ ID NO: 16643
  misc_feature 1..30: note = chr20:60448710-60448740
  misc_feature 1..30: note = hypo
  source 1..30: mol_type = genomic DNA

SEQ ID NO: 25797 - DNA, 30 bp, Homo sapiens; identical to SEQ ID NO: 16645
  misc_feature 1..30: note = chr20:60502281-60502311
  misc_feature 1..30: note = hypo
  source 1..30: mol_type = genomic DNA

SEQ ID NO: 25798 - DNA, 182 bp, Homo sapiens
  misc_feature 1..182: note = chr20:60502848-60503030
  misc_feature 1..182: note = hypo
  source 1..182: mol_type = genomic DNA
gtgaatgccacaccccgctgtgtgcgtgtgtgcaggtgtgggtgtggccgtgtgctctgccgtgtctgttgaggtgccgtgcgcagtggctgtgtgcgtgtgtgcagctgcgggtgtgggtgtggccgtgtgctttgccgtgtctgttgaggtgccgtacgcagtggtgtggctgcccatgg

SEQ ID NO: 25799 - DNA, 155 bp, Homo sapiens; identical to SEQ ID NO: 16648
  misc_feature 1..155: note = chr20:60781351-60781506
  misc_feature 1..155: note = hypo
  source 1..155: mol_type = genomic DNA

SEQ ID NO: 25800 - DNA, 23 bp, Homo sapiens
  misc_feature 1..23: note = chr20:60790124-60790147
  misc_feature 1..23: note = hypo
  source 1..23: mol_type = genomic DNA
tggcgaagcggcccctgcccggg

SEQ ID NO: 25801 - DNA, 40 bp, Homo sapiens; identical to SEQ ID NO: 16650
  misc_feature 1..40: note = chr20:60925501-60925541
  misc_feature 1..40: note = hypo
  source 1..40: mol_type = genomic DNA

SEQ ID NO: 25802 - DNA, 70 bp, Homo sapiens; identical to SEQ ID NO: 16651
  misc_feature 1..70: note = chr20:60925868-60925938
  misc_feature 1..70: note = hypo
  source 1..70: mol_type = genomic DNA

SEQ ID NO: 25803 - DNA, 96 bp, Homo sapiens; identical to SEQ ID NO: 16652
  misc_feature 1..96: note = chr20:60953312-60953408
  misc_feature 1..96: note = hypo
  source 1..96: mol_type = genomic DNA

SEQ ID NO: 25804 - DNA, 20 bp, Homo sapiens
  misc_feature 1..20: note = chr20:60970933-60970953
  misc_feature 1..20: note = hypo
  source 1..20: mol_type = genomic DNA
ctctcagggtgcagccggtg

SEQ ID NO: 25805 - DNA, 30 bp, Homo sapiens; identical to SEQ ID NO: 16655
  misc_feature 1..30: note = chr20:60984485-60984515
  misc_feature 1..30: note = hypo
  source 1..30: mol_type = genomic DNA

SEQ ID NO: 25806 - skipped

SEQ ID NO: 25807 - DNA, 307 bp, Homo sapiens
  misc_feature 1..307: note = chr20:61288156-61288463
  misc_feature 1..307: note = hypo
  source 1..307: mol_type = genomic DNA
gatgactgtgaatggcttcatcaacacagtcatcacctccctggagcgccgctatgacctgcacagctaccagagcgggctcatcgccagctcctacgacattgccgcctgcctctgcctcaccttcgtcagctacttcgggggctcagggcacaagccgcgctggctgggctggggcgtgctgcttatgggcacggggtcgctggtgttcgcgctgccccacttcacggctggccgctatgaggtggagttggacgcgggtgtcaggacgtgccctgccaaccccggcgcggtgtgtgcggacagc

SEQ ID NO: 25808 - DNA, 30 bp, Homo sapiens; identical to SEQ ID NO: 16657
  misc_feature 1..30: note = chr20:61294663-61294693
  misc_feature 1..30: note = hypo
  source 1..30: mol_type = genomic DNA

SEQ ID NO: 25809 - DNA, 30 bp, Homo sapiens; identical to SEQ ID NO: 16658
  misc_feature 1..30: note = chr20:61312730-61312760
  misc_feature 1..30: note = hypo
  source 1..30: mol_type = genomic DNA

SEQ ID NO: 25810 - DNA, 52 bp, Homo sapiens; identical to SEQ ID NO: 16659
  misc_feature 1..52: note = chr20:61393835-61393887
  misc_feature 1..52: note = hypo
  source 1..52: mol_type = genomic DNA

SEQ ID NO: 25811 - DNA, 109 bp, Homo sapiens; identical to SEQ ID NO: 16661
  misc_feature 1..109: note = chr20:61570765-61570874
  misc_feature 1..109: note = hypo
  source 1..109: mol_type = genomic DNA

SEQ ID NO: 25812 - DNA, 30 bp, Homo sapiens; identical to SEQ ID NO: 16662
  misc_feature 1..30: note = chr20:61695664-61695694
  misc_feature 1..30: note = hypo
  source 1..30: mol_type = genomic DNA

SEQ ID NO: 25813 - DNA, 136 bp, Homo sapiens; identical to SEQ ID NO: 16663
  misc_feature 1..136: note = chr20:61725275-61725411
  misc_feature 1..136: note = hypo
  source 1..136: mol_type = genomic DNA

SEQ ID NO: 25814 - DNA, 30 bp, Homo sapiens; identical to SEQ ID NO: 16665
  misc_feature 1..30: note = chr20:61838532-61838562
  misc_feature 1..30: note = hypo
  source 1..30: mol_type = genomic DNA

SEQ ID NO: 25815 - DNA, 297 bp, Homo sapiens
  misc_feature 1..297: note = chr20:61973894-61974191
  misc_feature 1..297: note = hypo
  source 1..297: mol_type = genomic DNA
agcagctcattgagccgaccacgcacccttccttcccacggcagagcgggagctcctgggtcagcctccctgccaaagtctgttcacagcagccccgagctggcgacgggtaaataagatggtggagccacgcggcggagcccgcagcacagtggccgcgcagcgagcaatgacccgggatcgggagccgacagaagggcacgcctggcgcggccacgcacagaacccagggccaggcaacgcggggcagaggtgttgggtgacctcgggcgggtcgtggccggccgggctgggcag

SEQ ID NO: 25816 - skipped

SEQ ID NO: 25817 - DNA, 45 bp, Homo sapiens
  misc_feature 1..45: note = chr20:61980815-61980860
  misc_feature 1..45: note = hypo
  source 1..45: mol_type = genomic DNA
tcagcctgggacctgcggccacatagcaggcttgggaagaggctg

SEQ ID NO: 25818 - DNA, 30 bp, Homo sapiens; identical to SEQ ID NO: 16668
  misc_feature 1..30: note = chr20:61982304-61982334
  misc_feature 1..30: note = hypo
  source 1..30: mol_type = genomic DNA

SEQ ID NO: 25819 - DNA, 35 bp, Homo sapiens; identical to SEQ ID NO: 16669
  misc_feature 1..35: note = chr20:61990913-61990948
  misc_feature 1..35: note = hypo
  source 1..35: mol_type = genomic DNA

SEQ ID NO: 25820 - DNA, 30 bp, Homo sapiens; identical to SEQ ID NO: 16670
  misc_feature 1..30: note = chr20:62011933-62011963
  misc_feature 1..30: note = hypo
  source 1..30: mol_type = genomic DNA

SEQ ID NO: 25821 - DNA, 66 bp, Homo sapiens; identical to SEQ ID NO: 5253
  misc_feature 1..66: note = chr20:62031666-62031732
  misc_feature 1..66: note = hypo
  source 1..66: mol_type = genomic DNA

SEQ ID NO: 25822 - DNA, 82 bp, Homo sapiens
  misc_feature 1..82: note = chr20:62031976-62032058
  misc_feature 1..82: note = hypo
  source 1..82: mol_type = genomic DNA
agccagaggcaacggcgcaaatggggaagctgcagccaccgtcacggccagaggatggcagactgcaatggcgtggggcgcg

SEQ ID NO: 25823 - DNA, 53 bp, Homo sapiens; identical to SEQ ID NO: 16673
  misc_feature 1..53: note = chr20:62033547-62033600
  misc_feature 1..53: note = hypo
  source 1..53: mol_type = genomic DNA

SEQ ID NO: 25824 - DNA, 30 bp, Homo sapiens; identical to SEQ ID NO: 16674
  misc_feature 1..30: note = chr20:62038095-62038125
  misc_feature 1..30: note = hypo
  source 1..30: mol_type = genomic DNA

SEQ ID NO: 25825 - DNA, 41 bp, Homo sapiens; identical to SEQ ID NO: 16675
  misc_feature 1..41: note = chr20:62038570-62038611
  misc_feature 1..41: note = hypo
  source 1..41: mol_type = genomic DNA

SEQ ID NO: 25826 - DNA, 26 bp, Homo sapiens
  misc_feature 1..26: note = chr20:62046201-62046227
  misc_feature 1..26: note = hypo
  source 1..26: mol_type = genomic DNA
caccacatccatccccggagaggatg

SEQ ID NO: 25827 - DNA, 89 bp, Homo sapiens
  misc_feature 1..89: note = chr20:62046421-62046510
  misc_feature 1..89: note = hypo
  source 1..89: mol_type = genomic DNA
cttggcagccacgcctcgggggctggagaagacacgatctttcaaactgaccttctggctgctcccacgggaaccgacagacagacaga

SEQ ID NO: 25828 - DNA, 113 bp, Homo sapiens; identical to SEQ ID NO: 16677
  misc_feature 1..113: note = chr20:62053226-62053339
  misc_feature 1..113: note = hypo
  source 1..113: mol_type = genomic DNA

SEQ ID NO: 25829 - DNA, 38 bp, Homo sapiens; identical to SEQ ID NO: 16678
  misc_feature 1..38: note = chr20:62054264-62054302
  misc_feature 1..38: note = hypo
  source 1..38: mol_type = genomic DNA

SEQ ID NO: 25830 - DNA, 24 bp, Homo sapiens
  misc_feature 1..24: note = chr20:62090500-62090524
  misc_feature 1..24: note = hypo
  source 1..24: mol_type = genomic DNA
acctgagggcaggctcggcaagga

SEQ ID NO: 25831 - DNA, 39 bp, Homo sapiens; identical to SEQ ID NO: 16681
  misc_feature 1..39: note = chr20:62097848-62097887
  misc_feature 1..39: note = hypo
  source 1..39: mol_type = genomic DNA

SEQ ID NO: 25832 - DNA, 37 bp, Homo sapiens
  misc_feature 1..37: note = chr20:62126081-62126118
  misc_feature 1..37: note = hypo
  source 1..37: mol_type = genomic DNA
cacctgccggtgcctcgctctgggccagggggtccag

SEQ ID NO: 25833 - DNA, 40 bp, Homo sapiens; identical to SEQ ID NO: 16684
  misc_feature 1..40: note = chr20:62153405-62153445
  misc_feature 1..40: note = hypo
  source 1..40: mol_type = genomic DNA

SEQ ID NO: 25834 - DNA, 33 bp, Homo sapiens
  misc_feature 1..33: note = chr20:62165598-62165631
  misc_feature 1..33: note = hypo
  source 1..33: mol_type = genomic DNA
tcgttcaggtgcagccggcccccggcacgccgc

SEQ ID NO: 25835 - DNA, 73 bp, Homo sapiens
  misc_feature 1..73: note = chr20:62165762-62165835
  misc_feature 1..73: note = hypo
  source 1..73: mol_type = genomic DNA
tccccacagttgctgttggtgcttcctcagtaccacccctgcctcccctccctcagaacggctccctcctgcc

SEQ ID NO: 25836 - DNA, 30 bp, Homo sapiens; identical to SEQ ID NO: 16686
  misc_feature 1..30: note = chr20:62167765-62167795
  misc_feature 1..30: note = hypo
  source 1..30: mol_type = genomic DNA

SEQ ID NO: 25837 - DNA, 30 bp, Homo sapiens; identical to SEQ ID NO: 16687
  misc_feature 1..30: note = chr20:62168240-62168270
  misc_feature 1..30: note = hypo
  source 1..30: mol_type = genomic DNA

SEQ ID NO: 25838 - DNA, 16 bp, Homo sapiens
  misc_feature 1..16: note = chr20:62170163-62170179
  misc_feature 1..16: note = hypo
  source 1..16: mol_type = genomic DNA
atgtccaggaagcctc

SEQ ID NO: 25839 - DNA, 278 bp, Homo sapiens
  misc_feature 1..278: note = chr20:62172667-62172945
  misc_feature 1..278: note = hypo
  source 1..278: mol_type = genomic DNA
cttggagctgctgctcggggagtagatgtcgtcctgggggcgagggaaggcccctggtagggcaggtggaccggggtcccctcacccaccccctctgggtcaggggcccagagcctccgctgaccttgagcagccgggccaggccgaagtcagccaccttgcaggccaggccgtcgtccacgagcacgttccgggcggccaagtcccggtgcacaacgcgctgctcctccaggtagctcatgccctcagccacctggcaggcaaagcccaggagtggc

SEQ ID NO: 25840 - DNA, 32 bp, Homo sapiens; identical to SEQ ID NO: 16690
  misc_feature 1..32: note = chr20:62221371-62221403
  misc_feature 1..32: note = hypo
  source 1..32: mol_type = genomic DNA

SEQ ID NO: 25841 - DNA, 283 bp, Homo sapiens
  misc_feature 1..283: note = chr20:62320923-62321206
  misc_feature 1..283: note = hypo
  source 1..283: mol_type = genomic DNA
ccacgcatggacccccgggttgtcctcaagatgcagttcctggatgagatgaagggccagggtggggctgggggccaggtgagttacagcagggtggggctggggtaaggcggtctggtgactgagcccccgccccgtggccaagggagcccccgtgaccgagccgcctcgccccacagttcctctctgggcaggagtggtaccggcagcaggcgtccagggctgtgaaccaggccatcgggcgagtgatccggcaccgccaggactacggagctgtcttcct

SEQ ID NO: 25842 - DNA, 52 bp, Homo sapiens
  misc_feature 1..52: note = chr20:62321341-62321393
  misc_feature 1..52: note = hypo
  source 1..52: mol_type = genomic DNA
agcgtggggcccctgcagcagatgagggtcttcacttcggtgaactgaaccc

SEQ ID NO: 25843 - DNA, 30 bp, Homo sapiens; identical to SEQ ID NO: 16693
  misc_feature 1..30: note = chr20:62329526-62329556
  misc_feature 1..30: note = hypo
  source 1..30: mol_type = genomic DNA

SEQ ID NO: 25844 - DNA, 29 bp, Homo sapiens
  misc_feature 1..29: note = chr20:62383189-62383218
  misc_feature 1..29: note = hypo
  source 1..29: mol_type = genomic DNA
tctcccatgaagccccgccccccggtggg

SEQ ID NO: 25845 - DNA, 147 bp, Homo sapiens
  misc_feature 1..147: note = chr20:62383289-62383436
  misc_feature 1..147: note = hypo
  source 1..147: mol_type = genomic DNA
cagcgatgctccagagcctcttccgccccgacagcagccccacctctgcccggagcccggggcgcctccactgcctctcctcacacagctgcccgccgcgagctccccctgcaccctgcgcctcggggtgggcgttccaggactccc

SEQ ID NO: 25846 - DNA, 30 bp, Homo sapiens; identical to SEQ ID NO: 16695
  misc_feature 1..30: note = chr20:62384067-62384097
  misc_feature 1..30: note = hypo
  source 1..30: mol_type = genomic DNA

SEQ ID NO: 25847 - DNA, 71 bp, Homo sapiens; identical to SEQ ID NO: 16696
  misc_feature 1..71: note = chr20:62400829-62400900
  misc_feature 1..71: note = hypo
  source 1..71: mol_type = genomic DNA

SEQ ID NO: 25848 - DNA, 35 bp, Homo sapiens; identical to SEQ ID NO: 16697
  misc_feature 1..35: note = chr20:62481615-62481650
  misc_feature 1..35: note = hypo
  source 1..35: mol_type = genomic DNA

SEQ ID NO: 25849 - DNA, 69 bp, Homo sapiens
  misc_feature 1..69: note = chr20:62488224-62488293
  misc_feature 1..69: note = hypo
  source 1..69: mol_type = genomic DNA
aaaaaaagaaaagaaaagaagaaaagaaaagcccctagaggccagggtccttgaacaaaagtgcgcgat

SEQ ID NO: 25850 - DNA, 80 bp, Homo sapiens
  misc_feature 1..80: note = chr20:62488350-62488430
  misc_feature 1..80: note = hypo
  source 1..80: mol_type = genomic DNA
acacagtggtgccagggcaggaaccctgggggcatttgcaggcctgtgctgcgagactgcagtggcgctcaggacacacc

SEQ ID NO: 25851 - DNA, 144 bp, Homo sapiens; identical to SEQ ID NO: 16699
  misc_feature 1..144: note = chr20:62722776-62722920
  misc_feature 1..144: note = hypo
  source 1..144: mol_type = genomic DNA

SEQ ID NO: 25852 - DNA, 36 bp, Homo sapiens; identical to SEQ ID NO: 16700
  misc_feature 1..36: note = chr20:62762699-62762735
  misc_feature 1..36: note = hypo
  source 1..36: mol_type = genomic DNA

SEQ ID NO: 25853 - DNA, 79 bp, Homo sapiens; identical to SEQ ID NO: 16701
  misc_feature 1..79: note = chr21:15694241-15694320
  misc_feature 1..79: note = hypo
  source 1..79: mol_type = genomic DNA

SEQ ID NO: 25854 - DNA, 30 bp, Homo sapiens; identical to SEQ ID NO: 16702
  misc_feature 1..30: note = chr21:20360095-20360125
  misc_feature 1..30: note = hypo
  source 1..30: mol_type = genomic DNA

SEQ ID NO: 25855 - DNA, 95 bp, Homo sapiens; identical to SEQ ID NO: 16704
  misc_feature 1..95: note = chr21:34459377-34459472
  misc_feature 1..95: note = hypo
  source 1..95: mol_type = genomic DNA

SEQ ID NO: 25856 - DNA, 30 bp, Homo sapiens; identical to SEQ ID NO: 16705
  misc_feature 1..30: note = chr21:37750050-37750080
  misc_feature 1..30: note = hypo
  source 1..30: mol_type = genomic DNA

SEQ ID NO: 25857 - DNA, 78 bp, Homo sapiens
  misc_feature 1..78: note = chr21:37758492-37758570
  misc_feature 1..78: note = hypo
  source 1..78: mol_type = genomic DNA
acttccagcatgggacggctgggaggatccacagactggcgtctgccggcgtggacaccaatgtcagggtaaactggg

SEQ ID NO: 25858 - DNA, 17 bp, Homo sapiens
  misc_feature 1..17: note = chr21:37775141-37775158
  misc_feature 1..17: note = hypo
  source 1..17: mol_type = genomic DNA
cacgccaggtgtgtttc

SEQ ID NO: 25859 - DNA, 63 bp, Homo sapiens; identical to SEQ ID NO: 16709
  misc_feature 1..63: note = chr21:38935380-38935443
  misc_feature 1..63: note = hypo
  source 1..63: mol_type = genomic DNA

SEQ ID NO: 25860 - DNA, 30 bp, Homo sapiens; identical to SEQ ID NO: 16710
  misc_feature 1..30: note = chr21:42613756-42613786
  misc_feature 1..30: note = hypo
  source 1..30: mol_type = genomic DNA

SEQ ID NO: 25861 - DNA, 195 bp, Homo sapiens; identical to SEQ ID NO: 16711
  misc_feature 1..195: note = chr21:43248726-43248921
  misc_feature 1..195: note = hypo
  source 1..195: mol_type = genomic DNA

SEQ ID NO: 25862 - DNA, 125 bp, Homo sapiens
  misc_feature 1..125: note = chr21:43786558-43786683
  misc_feature 1..125: note = hypo
  source 1..125: mol_type = genomic DNA
acaccaggaccagggcgcagatcaccttgttctccatggtggccattgcctcctctctgctccaaaggcgaccccgagtcagggatgagaggccgcccgagccccggattttatagggcaggctc

SEQ ID NO: 25863 - DNA, 28 bp, Homo sapiens
  misc_feature 1..28: note = chr21:43786713-43786741
  misc_feature 1..28: note = hypo
  source 1..28: mol_type = genomic DNA
gcctaaggaggcccggggatcctctgag

SEQ ID NO: 25864 - DNA, 30 bp, Homo sapiens; identical to SEQ ID NO: 16713
  misc_feature 1..30: note = chr21:44338342-44338372
  misc_feature 1..30: note = hypo
  source 1..30: mol_type = genomic DNA

SEQ ID NO: 25865 - DNA, 192 bp, Homo sapiens
  misc_feature 1..192: note = chr21:44866711-44866903
  misc_feature 1..192: note = hypo
  source 1..192: mol_type = genomic DNA
gctcccacgcctcccgccgcgccaccgccccggctttctgcaaatccaccttatggaagccggataaggtgaagtccacatataactaaaagcgagttactgagggttactttctttgcagagtggttcccctaaaggattcctttaaacatgatccggtcagccagtgctcacttacgttcaccaagtcac

SEQ ID NO: 25866 - DNA, 57 bp, Homo sapiens; identical to SEQ ID NO: 16716
  misc_feature 1..57: note = chr21:45170351-45170408
  misc_feature 1..57: note = hypo
  source 1..57: mol_type = genomic DNA

SEQ ID NO: 25867 - skipped

SEQ ID NO: 25868 - DNA, 30 bp, Homo sapiens; identical to SEQ ID NO: 16718
  misc_feature 1..30: note = chr21:45232947-45232977
  misc_feature 1..30: note = hypo
  source 1..30: mol_type = genomic DNA

SEQ ID NO: 25869 - DNA, 30 bp, Homo sapiens; identical to SEQ ID NO: 16719
  misc_feature 1..30: note = chr21:45247147-45247177
  misc_feature 1..30: note = hypo
  source 1..30: mol_type = genomic DNA

SEQ ID NO: 25870 - DNA, 30 bp, Homo sapiens; identical to SEQ ID NO: 16721
  misc_feature 1..30: note = chr21:45365737-45365767
  misc_feature 1..30: note = hypo
  source 1..30: mol_type = genomic DNA

SEQ ID NO: 25871 - DNA, 62 bp, Homo sapiens; identical to SEQ ID NO: 16722
  misc_feature 1..62: note = chr21:45844751-45844813
  misc_feature 1..62: note = hypo
  source 1..62: mol_type = genomic DNA

SEQ ID NO: 25872 - DNA, 132 bp, Homo sapiens; identical to SEQ ID NO: 16723
  misc_feature 1..132: note = chr21:45929217-45929349
  misc_feature 1..132: note = hypo
  source 1..132: mol_type = genomic DNA

SEQ ID NO: 25873 - DNA, 30 bp, Homo sapiens; identical to SEQ ID NO: 16724
  misc_feature 1..30: note = chr21:46015435-46015465
  misc_feature 1..30: note = hypo
  source 1..30: mol_type = genomic DNA

SEQ ID NO: 25874 - DNA, 37 bp, Homo sapiens
  misc_feature 1..37: note = chr21:46036605-46036642
  misc_feature 1..37: note = hypo
  source 1..37: mol_type = genomic DNA
gtgagaatgagacaccgtgacaatgcggctgcgcacc

SEQ ID NO: 25875 - DNA, 60 bp, Homo sapiens
  misc_feature 1..60: note = chr21:46036767-46036827
  misc_feature 1..60: note = hypo
  source 1..60: mol_type = genomic DNA
gtgtattttttgtctgacttttgcttctggggccgaacaacccagcgaattcaacacagc

SEQ ID NO: 25876 - DNA, 30 bp, Homo sapiens; identical to SEQ ID NO: 16726
  misc_feature 1..30: note = chr21:46068645-46068675
  misc_feature 1..30: note = hypo
  source 1..30: mol_type = genomic DNA

SEQ ID NO: 25877 - DNA, 112 bp, Homo sapiens; identical to SEQ ID NO: 16727
  misc_feature 1..112: note = chr21:46256944-46257056
  misc_feature 1..112: note = hypo
  source 1..112: mol_type = genomic DNA

SEQ ID NO: 25878 - DNA, 30 bp, Homo sapiens; identical to SEQ ID NO: 16728
  misc_feature 1..30: note = chr21:46257286-46257316
  misc_feature 1..30: note = hypo
  source 1..30: mol_type = genomic DNA

SEQ ID NO: 25879 - DNA, 196 bp, Homo sapiens; identical to SEQ ID NO: 16729
  misc_feature 1..196: note = chr21:46308621-46308817
  misc_feature 1..196: note = hypo
  source 1..196: mol_type = genomic DNA

SEQ ID NO: 25880 - DNA, 157 bp, Homo sapiens; identical to SEQ ID NO: 16730
  misc_feature 1..157: note = chr21:46310607-46310764
  misc_feature 1..157: note = hypo
  source 1..157: mol_type = genomic DNA

SEQ ID NO: 25881 - DNA, 30 bp, Homo sapiens; identical to SEQ ID NO: 16731
  misc_feature 1..30: note = chr21:46311771-46311801
  misc_feature 1..30: note = hypo
  source 1..30: mol_type = genomic DNA

SEQ ID NO: 25882 - DNA, 46 bp, Homo sapiens
  misc_feature 1..46: note = chr21:46319459-46319505
  misc_feature 1..46: note = hypo
  source 1..46: mol_type = genomic DNA
gagggccgtccctcccgtctgtggctcccggcggaggacctgagtc

SEQ ID NO: 25883 - DNA, 30 bp, Homo sapiens; identical to SEQ ID NO: 16733
  misc_feature 1..30: note = chr21:46321598-46321628
  misc_feature 1..30: note = hypo
  source 1..30: mol_type = genomic DNA

SEQ ID NO: 25884 - DNA, 94 bp, Homo sapiens
  misc_feature 1..94: note = chr21:46452280-46452374
  misc_feature 1..94: note = hypo
  source 1..94: mol_type = genomic DNA
ctggtcttggggaggcgggctccagctcgaaaggaggcacacaaaactgctgggaaacgggccgggcaggcaggggcggggccgggcgggtgag

SEQ ID NO: 25885 - DNA, 32 bp, Homo sapiens; identical to SEQ ID NO: 16735
  misc_feature 1..32: note = chr21:46677808-46677840
  misc_feature 1..32: note = hypo
  source 1..32: mol_type = genomic DNA

SEQ ID NO: 25886 - DNA, 43 bp, Homo sapiens; identical to SEQ ID NO: 16736
  misc_feature 1..43: note = chr21:46844706-46844749
  misc_feature 1..43: note = hypo
  source 1..43: mol_type = genomic DNA

SEQ ID NO: 25887 - DNA, 34 bp, Homo sapiens; identical to SEQ ID NO: 16737
  misc_feature 1..34: note = chr21:46863752-46863786
  misc_feature 1..34: note = hypo
  source 1..34: mol_type = genomic DNA

SEQ ID NO: 25888 - DNA, 50 bp, Homo sapiens; identical to SEQ ID NO: 16738
  misc_feature 1..50: note = chr21:46908931-46908981
  misc_feature 1..50: note = hypo
  source 1..50: mol_type = genomic DNA

SEQ ID NO: 25889 - DNA, 127 bp, Homo sapiens; identical to SEQ ID NO: 16739
  misc_feature 1..127: note = chr21:46912135-46912262
  misc_feature 1..127: note = hypo
  source 1..127: mol_type = genomic DNA

SEQ ID NO: 25890 - DNA, 57 bp, Homo sapiens; identical to SEQ ID NO: 16740
  misc_feature 1..57: note = chr21:46921503-46921560
  misc_feature 1..57: note = hypo
  source 1..57: mol_type = genomic DNA

SEQ ID NO: 25891 - DNA, 26 bp, Homo sapiens
  misc_feature 1..26: note = chr21:46925754-46925780
  misc_feature 1..26: note = hypo
  source 1..26: mol_type = genomic DNA
aggctctgggctacacgccaggccat

SEQ ID NO: 25892 - DNA, 19 bp, Homo sapiens
  misc_feature 1..19: note = chr21:46926565-46926584
  misc_feature 1..19: note = hypo
  source 1..19: mol_type = genomic DNA
catccgtgggagcctccat

SEQ ID NO: 25893 - DNA, 30 bp, Homo sapiens; identical to SEQ ID NO: 16743
  misc_feature 1..30: note = chr21:47013235-47013265
  misc_feature 1..30: note = hypo
  source 1..30: mol_type = genomic DNA

SEQ ID NO: 25894 - DNA, 48 bp, Homo sapiens; identical to SEQ ID NO: 16744
  misc_feature 1..48: note = chr21:47287102-47287150
  misc_feature 1..48: note = hypo
  source 1..48: mol_type = genomic DNA

SEQ ID NO: 25895 - DNA, 39 bp, Homo sapiens
  misc_feature 1..39: note = chr21:47404135-47404174
  misc_feature 1..39: note = hypo
  source 1..39: mol_type = genomic DNA
gcgccaggggccgcccgcctcacgcccgccgtgcctgtt

SEQ ID NO: 25896 - DNA, 30 bp, Homo sapiens; identical to SEQ ID NO: 16746
  misc_feature 1..30: note = chr21:47425521-47425551
  misc_feature 1..30: note = hypo
  source 1..30: mol_type = genomic DNA

SEQ ID NO: 25897 - DNA, 30 bp, Homo sapiens; identical to SEQ ID NO: 16747
  misc_feature 1..30: note = chr21:47501864-47501894
  misc_feature 1..30: note = hypo
  source 1..30: mol_type = genomic DNA

SEQ ID NO: 25898 - DNA, 34 bp, Homo sapiens; identical to SEQ ID NO: 16748
  misc_feature 1..34: note = chr21:47503061-47503095
  misc_feature 1..34: note = hypo
  source 1..34: mol_type = genomic DNA

SEQ ID NO: 25899 - DNA, 37 bp, Homo sapiens; identical to SEQ ID NO: 16749
  misc_feature 1..37: note = chr21:47531922-47531959
  misc_feature 1..37: note = hypo
  source 1..37: mol_type = genomic DNA

SEQ ID NO: 25900 - DNA, 37 bp, Homo sapiens; identical to SEQ ID NO: 16750
  misc_feature 1..37: note = chr21:47737928-47737965
  misc_feature 1..37: note = hypo
  source 1..37: mol_type = genomic DNA

SEQ ID NO: 25901 - DNA, 92 bp, Homo sapiens
  misc_feature 1..92: note = chr21:47746178-47746270
  misc_feature 1..92: note = hypo
  source 1..92: mol_type = genomic DNA
gactgggtcagccctcgggcctcatggtccccaccagtctgttgactttgtggttctgttatttttttctcacttacctttgcctttactac

SEQ ID NO: 25902 - DNA, 16 bp, Homo sapiens
  misc_feature 1..16: note = chr22:18110631-18110647
  misc_feature 1..16: note = hypo
  source 1..16: mol_type = genomic DNA
acgaccttgtcaaaac

SEQ ID NO: 25903 - DNA, 30 bp, Homo sapiens; identical to SEQ ID NO: 16753
  misc_feature 1..30: note = chr22:18553893-18553923
  misc_feature 1..30: note = hypo
  source 1..30: mol_type = genomic DNA

SEQ ID NO: 25904 - DNA, 27 bp, Homo sapiens
  misc_feature 1..27: note = chr22:19117537-19117564
  misc_feature 1..27: note = hypo
  source 1..27: mol_type = genomic DNA
catgcactgcagccccgacccacccat

SEQ ID NO: 25905 - DNA, 26 bp, Homo sapiens
  misc_feature 1..26: note = chr22:21214345-21214371
  misc_feature 1..26: note = hypo
  source 1..26: mol_type = genomic DNA
aacaattattctggccgagcgcagtg

SEQ ID NO: 25906 - DNA, 250 bp, Homo sapiens; identical to SEQ ID NO: 16757
  misc_feature 1..250: note = chr22:22899696-22899946
  misc_feature 1..250: note = hypo
  source 1..250: mol_type = genomic DNA

SEQ ID NO: 25907 - DNA, 42 bp, Homo sapiens; identical to SEQ ID NO: 16758
  misc_feature 1..42: note = chr22:24374229-24374271
  misc_feature 1..42: note = hypo
  source 1..42: mol_type = genomic DNA

SEQ ID NO: 25908 - DNA, 30 bp, Homo sapiens; identical to SEQ ID NO: 16759
  misc_feature 1..30: note = chr22:27045927-27045957
  misc_feature 1..30: note = hypo
  source 1..30: mol_type = genomic DNA

SEQ ID NO: 25909 - DNA, 83 bp, Homo sapiens; identical to SEQ ID NO: 16760
  misc_feature 1..83: note = chr22:29445929-29446012
  misc_feature 1..83: note = hypo
  source 1..83: mol_type = genomic DNA

SEQ ID NO: 25910 - DNA, 30 bp, Homo sapiens; identical to SEQ ID NO: 16761
  misc_feature 1..30: note = chr22:29446295-29446325
  misc_feature 1..30: note = hypo
  source 1..30: mol_type = genomic DNA

SEQ ID NO: 25911 - DNA, 18 bp, Homo sapiens
  misc_feature 1..18: note = chr22:29701031-29701049
  misc_feature 1..18: note = hypo
  source 1..18: mol_type = genomic DNA
gcccggccgggaatgtta

SEQ ID NO: 25912 - DNA, 29 bp, Homo sapiens
  misc_feature 1..29: note = chr22:29977934-29977963
  misc_feature 1..29: note = hypo
  source 1..29: mol_type = genomic DNA
tagggagtggaagccgtcctcttgtgctg

SEQ ID NO: 25913 - DNA, 27 bp, Homo sapiens
  misc_feature 1..27: note = chr22:29998650-29998677
  misc_feature 1..27: note = hypo
  source 1..27: mol_type = genomic DNA
aataataattctaggcggggcgtggtg

SEQ ID NO: 25914 - DNA, 38 bp, Homo sapiens; identical to SEQ ID NO: 16767
  misc_feature 1..38: note = chr22:30783975-30784013
  misc_feature 1..38: note = hypo
  source 1..38: mol_type = genomic DNA

SEQ ID NO: 25915 - DNA, 35 bp, Homo sapiens; identical to SEQ ID NO: 16768
  misc_feature 1..35: note = chr22:32014233-32014268
  misc_feature 1..35: note = hypo
  source 1..35: mol_type = genomic DNA

SEQ ID NO: 25916 - DNA, 29 bp, Homo sapiens
  misc_feature 1..29: note = chr22:32356777-32356806
  misc_feature 1..29: note = hypo
  source 1..29: mol_type = genomic DNA
aaaaactccgtccccgccccccccccccc

SEQ ID NO: 25917 - DNA, 30 bp, Homo sapiens; identical to SEQ ID NO: 16770
  misc_feature 1..30: note = chr22:33255298-33255328
  misc_feature 1..30: note = hypo
  source 1..30: mol_type = genomic DNA

SEQ ID NO: 25918 - DNA, 30 bp, Homo sapiens; identical to SEQ ID NO: 5265
  misc_feature 1..30: note = chr22:35079354-35079384
  misc_feature 1..30: note = hypo
  source 1..30: mol_type = genomic DNA

SEQ ID NO: 25919 - DNA, 30 bp, Homo sapiens; identical to SEQ ID NO: 5266
  misc_feature 1..30: note = chr22:35768487-35768517
  misc_feature 1..30: note = hypo
  source 1..30: mol_type = genomic DNA

SEQ ID NO: 25920 - DNA, 30 bp, Homo sapiens; identical to SEQ ID NO: 16773
  misc_feature 1..30: note = chr22:35822752-35822782
  misc_feature 1..30: note = hypo
  source 1..30: mol_type = genomic DNA

SEQ ID NO: 25921 - DNA, 40 bp, Homo sapiens; identical to SEQ ID NO: 16774
  misc_feature 1..40: note = chr22:36585960-36586000
  misc_feature 1..40: note = hypo
  source 1..40: mol_type = genomic DNA

SEQ ID NO: 25922 - DNA, 58 bp, Homo sapiens; identical to SEQ ID NO: 16775
  misc_feature 1..58: note = chr22:36684241-36684299
  misc_feature 1..58: note = hypo
  source 1..58: mol_type = genomic DNA

SEQ ID NO: 25923 - DNA, 30 bp, Homo sapiens; identical to SEQ ID NO: 16776
  misc_feature 1..30: note = chr22:36878964-36878994
  misc_feature 1..30: note = hypo
  source 1..30: mol_type = genomic DNA

SEQ ID NO: 25924 - DNA, 57 bp, Homo sapiens; identical to SEQ ID NO: 16777
  misc_feature 1..57: note = chr22:36902482-36902539
  misc_feature 1..57: note = hypo
  source 1..57: mol_type = genomic DNA

SEQ ID NO: 25925 - DNA, 26 bp, Homo sapiens
  misc_feature 1..26: note = chr22:38199743-38199769
  misc_feature 1..26: note = hypo
  source 1..26: mol_type = genomic DNA
taagtgaacagtgaccggcctctatg

SEQ ID NO: 25926 - DNA, 30 bp, Homo sapiens; identical to SEQ ID NO: 16779
  misc_feature 1..30: note = chr22:38520276-38520306
  misc_feature 1..30: note = hypo
  source 1..30: mol_type = genomic DNA

SEQ ID NO: 25927 - DNA, 44 bp, Homo sapiens; identical to SEQ ID NO: 16780
  misc_feature 1..44: note = chr22:38578694-38578738
  misc_feature 1..44: note = hypo
  source 1..44: mol_type = genomic DNA

SEQ ID NO: 25928 - DNA, 43 bp, Homo sapiens; identical to SEQ ID NO: 16781
  misc_feature 1..43: note = chr22:38694550-38694593
  misc_feature 1..43: note = hypo
  source 1..43: mol_type = genomic DNA

SEQ ID NO: 25929 - DNA, 30 bp, Homo sapiens; identical to SEQ ID NO: 16782
  misc_feature 1..30: note = chr22:39757008-39757038
  misc_feature 1..30: note = hypo
  source 1..30: mol_type = genomic DNA

SEQ ID NO: 25930 - DNA, 165 bp, Homo sapiens; identical to SEQ ID NO: 16783
  misc_feature 1..165: note = chr22:40018163-40018328
  misc_feature 1..165: note = hypo
  source 1..165: mol_type = genomic DNA

SEQ ID NO: 25931 - DNA, 37 bp, Homo sapiens
  misc_feature 1..37: note = chr22:40042590-40042627
  misc_feature 1..37: note = hypo
  source 1..37: mol_type = genomic DNA
gatcaacctgtgcctcgttgtcatagcgacccagttc

SEQ ID NO: 25932 - DNA, 117 bp, Homo sapiens
  misc_feature 1..117: note = chr22:40042743-40042860
  misc_feature 1..117: note = hypo
  source 1..117: mol_type = genomic DNA
gtatgtctgccacatcctgcgcaaggccaagcgccgcgccctgggcctctaccaggccctgcagagccggcgccaggccctgggcccggaggccccggcccccgccaaacctgggcc

SEQ ID NO: 25933 - DNA, 16 bp, Homo sapiens
  misc_feature 1..16: note = chr22:40991414-40991430
  misc_feature 1..16: note = hypo
  source 1..16: mol_type = genomic DNA
gcgcccggccgagaaa

SEQ ID NO: 25934 - DNA, 30 bp, Homo sapiens; identical to SEQ ID NO: 16787
  misc_feature 1..30: note = chr22:41637166-41637196
  misc_feature 1..30: note = hypo
  source 1..30: mol_type = genomic DNA

SEQ ID NO: 25935 - DNA, 17 bp, Homo sapiens
  misc_feature 1..17: note = chr22:41839926-41839943
  misc_feature 1..17: note = hypo
  source 1..17: mol_type = genomic DNA
gccggaaggtttttcag

SEQ ID NO: 25936 - DNA, 37 bp, Homo sapiens; identical to SEQ ID NO: 16789
  misc_feature 1..37: note = chr22:42109085-42109122
  misc_feature 1..37: note = hypo
  source 1..37: mol_type = genomic DNA

SEQ ID NO: 25937 - DNA, 30 bp, Homo sapiens; identical to SEQ ID NO: 16790
  misc_feature 1..30: note = chr22:42995705-42995735
  misc_feature 1..30: note = hypo
  source 1..30: mol_type = genomic DNA

SEQ ID NO: 25938 - DNA, 30 bp, Homo sapiens; identical to SEQ ID NO: 16792
  misc_feature 1..30: note = chr22:43083005-43083035
  misc_feature 1..30: note = hypo
  source 1..30: mol_type = genomic DNA

SEQ ID NO: 25939 - DNA, 92 bp, Homo sapiens; identical to SEQ ID NO: 16794
  misc_feature 1..92: note = chr22:43524971-43525063
  misc_feature 1..92: note = hypo
  source 1..92: mol_type = genomic DNA

SEQ ID NO: 25940 - DNA, 30 bp, Homo sapiens; identical to SEQ ID NO: 16795
  misc_feature 1..30: note = chr22:43581330-43581360
  misc_feature 1..30: note = hypo
  source 1..30: mol_type = genomic DNA

SEQ ID NO: 25941 - DNA, 197 bp, Homo sapiens; identical to SEQ ID NO: 16796
  misc_feature 1..197: note = chr22:43601102-43601299
  misc_feature 1..197: note = hypo
  source 1..197: mol_type = genomic DNA

SEQ ID NO: 25942 - DNA, 107 bp, Homo sapiens
  misc_feature 1..107: note = chr22:44455600-44455707
  misc_feature 1..107: note = hypo
  source 1..107: mol_type = genomic DNA
aataaagaaagatgccgtacacattttcctttaaaaagtctcacttggcttgtttgacaggcacagaagatgtgttattaaacacttgcaaagcctgctgtcatttg

SEQ ID NO: 25943 - DNA, 39 bp, Homo sapiens; identical to SEQ ID NO: 16798
  misc_feature 1..39: note = chr22:44538737-44538776
  misc_feature 1..39: note = hypo
  source 1..39: mol_type = genomic DNA

SEQ ID NO: 25944 - DNA, 30 bp, Homo sapiens; identical to SEQ ID NO: 16799
  misc_feature 1..30: note = chr22:44580569-44580599
  misc_feature 1..30: note = hypo
  source 1..30: mol_type = genomic DNA

SEQ ID NO: 25945 - DNA, 23 bp, Homo sapiens
  misc_feature 1..23: note = chr22:45088743-45088766
  misc_feature 1..23: note = hypo
  source 1..23: mol_type = genomic DNA
tctcagcacggggccaggcacag

SEQ ID NO: 25946 - DNA, 51 bp, Homo sapiens; identical to SEQ ID NO: 16802
  misc_feature 1..51: note = chr22:46929253-46929304
  misc_feature 1..51: note = hypo
  source 1..51: mol_type = genomic DNA

SEQ ID NO: 25947 - DNA, 41 bp, Homo sapiens; identical to SEQ ID NO: 16803
  misc_feature 1..41: note = chr22:46929668-46929709
  misc_feature 1..41: note = hypo
  source 1..41: mol_type = genomic DNA

SEQ ID NO: 25948 - DNA, 44 bp, Homo sapiens; identical to SEQ ID NO: 16804
  misc_feature 1..44: note = chr22:46931911-46931955
  misc_feature 1..44: note = hypo
  source 1..44: mol_type = genomic DNA

SEQ ID NO: 25949 - DNA, 30 bp, Homo sapiens; identical to SEQ ID NO: 16806
  misc_feature 1..30: note = chr22:47005505-47005535
  misc_feature 1..30: note = hypo
  source 1..30: mol_type = genomic DNA

SEQ ID NO: 25950 - DNA, 30 bp, Homo sapiens; identical to SEQ ID NO: 16807
  misc_feature 1..30: note = chr22:47054582-47054612
  misc_feature 1..30: note = hypo
  source 1..30: mol_type = genomic DNA

SEQ ID NO: 25951 - DNA, 132 bp, Homo sapiens
  misc_feature 1..132: note = chr22:47525714-47525846
  misc_feature 1..132: note = hypo
  source 1..132: mol_type = genomic DNA
tgtcagcgtcactgccgctgagtcaccacgtgcactgtgcctgtcatccctttctgggacagcatgtcactttccttggtgtcaccaatcatctcccttaggagtctgtgaaccacccactccctccctccc

SEQ ID NO: 25952 - DNA, 39 bp, Homo sapiens
  misc_feature 1..39: note = chr22:47525885-47525924
  misc_feature 1..39: note = hypo
  source 1..39: mol_type = genomic DNA
aggcagagcaggtgctgtacacctcgtgtcctctgggac

SEQ ID NO: 25953 - DNA, 46 bp, Homo sapiens
  misc_feature 1..46: note = chr22:48931835-48931881
  misc_feature 1..46: note = hypo
  source 1..46: mol_type = genomic DNA
gagtgcccgtgttgtcgagcccccgccacagagctgcaccgccgct

SEQ ID NO: 25954 - DNA, 41 bp, Homo sapiens
  misc_feature 1..41: note = chr22:48932027-48932068
  misc_feature 1..41: note = hypo
  source 1..41: mol_type = genomic DNA
gcagggacttggaaacctaccgtccccggctcaaggcaaat

SEQ ID NO: 25955 - DNA, 167 bp, Homo sapiens; identical to SEQ ID NO: 16810
  misc_feature 1..167: note = chr22:49115643-49115810
  misc_feature 1..167: note = hypo
  source 1..167: mol_type = genomic DNA

SEQ ID NO: 25956 - DNA, 30 bp, Homo sapiens; identical to SEQ ID NO: 16811
  misc_feature 1..30: note = chr22:49117093-49117123
  misc_feature 1..30: note = hypo
  source 1..30: mol_type = genomic DNA

SEQ ID NO: 25957 - DNA, 30 bp, Homo sapiens; identical to SEQ ID NO: 16812
  misc_feature 1..30: note = chr22:49387651-49387681
  misc_feature 1..30: note = hypo
  source 1..30: mol_type = genomic DNA

SEQ ID NO: 25958 - DNA, 30 bp, Homo sapiens; identical to SEQ ID NO: 16813
  misc_feature 1..30: note = chr22:49831409-49831439
  misc_feature 1..30: note = hypo
  source 1..30: mol_type = genomic DNA

SEQ ID NO: 25959 - DNA, 30 bp, Homo sapiens; identical to SEQ ID NO: 16814
  misc_feature 1..30: note = chr22:49941803-49941833
  misc_feature 1..30: note = hypo
  source 1..30: mol_type = genomic DNA

SEQ ID NO: 25960 - DNA, 33 bp, Homo sapiens
  misc_feature 1..33: note = chr22:49979613-49979646
  misc_feature 1..33: note = hypo
  source 1..33: mol_type = genomic DNA
accccatccctgggccggggctgaccggtcatc

SEQ ID NO: 25961 - DNA, 14 bp, Homo sapiens
  misc_feature 1..14: note = chr22:50001685-50001699
  misc_feature 1..14: note = hypo
  source 1..14: mol_type = genomic DNA
gcctctcctgggtg

SEQ ID NO: 25962 - DNA, 16 bp, Homo sapiens
  misc_feature 1..16: note = chr22:50002771-50002787
  misc_feature 1..16: note = hypo
  source 1..16: mol_type = genomic DNA
ggacagtccctgcttc

SEQ ID NO: 25963 - DNA, 48 bp, Homo sapiens
  misc_feature 1..48: note = chr22:50003234-50003282
  misc_feature 1..48: note = hypo
  source 1..48: mol_type = genomic DNA
agggtctctgaggggtggacacaaaacagggaccgcagtctgtgcctc

SEQ ID NO: 25964 - DNA, 30 bp, Homo sapiens; identical to SEQ ID NO: 16819
  misc_feature 1..30: note = chr22:50007987-50008017
  misc_feature 1..30: note = hypo
  source 1..30: mol_type = genomic DNA

SEQ ID NO: 25965 - DNA, 30 bp, Homo sapiens; identical to SEQ ID NO: 16820
  misc_feature 1..30: note = chr22:50010606-50010636
  misc_feature 1..30: note = hypo
  source 1..30: mol_type = genomic DNA

SEQ ID NO: 25966 - DNA, 30 bp, Homo sapiens; identical to SEQ ID NO: 16821
  misc_feature 1..30: note = chr22:50024083-50024113
  misc_feature 1..30: note = hypo
  source 1..30: mol_type = genomic DNA

SEQ ID NO: 25967 - DNA, 99 bp, Homo sapiens
  misc_feature 1..99: note = chr22:50149332-50149431
  misc_feature 1..99: note = hypo
  source 1..99: mol_type = genomic DNA
ccctttccatggcaacgacccataaggtgccacccctttccatggcaacgccccatacggtgccacccctttccatggcaacgccccatacggtgccac

SEQ ID NO: 25968 - DNA, 36 bp, Homo sapiens; identical to SEQ ID NO: 16823
  misc_feature 1..36: note = chr22:50170666-50170702
  misc_feature 1..36: note = hypo
  source 1..36: mol_type = genomic DNA

SEQ ID NO: 25969 - DNA, 43 bp, Homo sapiens
  misc_feature 1..43: note = chr22:50466962-50467005
  misc_feature 1..43: note = hypo
  source 1..43: mol_type = genomic DNA
tgggaatcagggaggcggcaacacctgcgtgccgtcataaaga

SEQ ID NO: 25970 - skipped

SEQ ID NO: 25971 - DNA, 105 bp, Homo sapiens; identical to SEQ ID NO: 16825
  misc_feature 1..105: note = chr22:50507059-50507164
  misc_feature 1..105: note = hypo
  source 1..105: mol_type = genomic DNA

SEQ ID NO: 25972 - DNA, 30 bp, Homo sapiens; identical to SEQ ID NO: 16826
  misc_feature 1..30: note = chr22:50529568-50529598
  misc_feature 1..30: note = hypo
  source 1..30: mol_type = genomic DNA

SEQ ID NO: 25973 - DNA, 30 bp, Homo sapiens; identical to SEQ ID NO: 16827
  misc_feature 1..30: note = chr22:50686625-50686655
  misc_feature 1..30: note = hypo
  source 1..30: mol_type = genomic DNA

SEQ ID NO: 25974 - DNA, 37 bp, Homo sapiens; identical to SEQ ID NO: 16828
  misc_feature 1..37: note = chr22:50695483-50695520
  misc_feature 1..37: note = hypo
  source 1..37: mol_type = genomic DNA

SEQ ID NO: 25975 - DNA, 14 bp, Homo sapiens
  misc_feature 1..14: note = chr22:50899279-50899293
  misc_feature 1..14: note = hypo
  source 1..14: mol_type = genomic DNA
tcacacgaaggcaa

SEQ ID NO: 25976 - DNA, 17 bp, Homo sapiens
  misc_feature 1..17: note = chr22:50899672-50899689
  misc_feature 1..17: note = hypo
  source 1..17: mol_type = genomic DNA
agcgcagccaccgggaa

SEQ ID NO: 25977 - DNA, 38 bp, Homo sapiens; identical to SEQ ID NO: 16830
  misc_feature 1..38: note = chrX:20160933-20160971
  misc_feature 1..38: note = hypo
  source 1..38: mol_type = genomic DNA

SEQ ID NO: 25978 - DNA, 21 bp, Homo sapiens
  misc_feature 1..21: note = chrX:44755607-44755628
  misc_feature 1..21: note = hypo
  source 1..21: mol_type = genomic DNA
tcaccgcgcccggccaaaaat

SEQ ID NO: 25979 - DNA, 30 bp, Homo sapiens; identical to SEQ ID NO: 16832
  misc_feature 1..30: note = AEKP01139090.1_11256-14570:719-749
  misc_feature 1..30: note = hypo
  source 1..30: mol_type = genomic DNA

SEQ ID NO: 25980 - DNA, 86 bp, Homo sapiens; identical to SEQ ID NO: 16833
  misc_feature 1..86: note = AEKP01153556.1_1-5252:404-490
  misc_feature 1..86: note = hypo
  source 1..86: mol_type = genomic DNA

SEQ ID NO: 25981 - DNA, 126 bp, Homo sapiens; identical to SEQ ID NO: 16834
  misc_feature 1..126: note = AEKP01196136.1_22995-25251:484-610
  misc_feature 1..126: note = hypo
  source 1..126: mol_type = genomic DNA

SEQ ID NO: 25982 - DNA, 34 bp, Homo sapiens; identical to SEQ ID NO: 16835
  misc_feature 1..34: note = NW_001838014.1_249000-295694:4094-4128
  misc_feature 1..34: note = hypo
  source 1..34: mol_type = genomic DNA

SEQ ID NO: 25983 - DNA, 37 bp, Homo sapiens; identical to SEQ ID NO: 16836
  misc_feature 1..37: note = NW_001841145.1_177495-186900:5222-5259
  misc_feature 1..37: note = hypo
  source 1..37: mol_type = genomic DNA

SEQ ID NO: 25984 - DNA, 30 bp, Homo sapiens; identical to SEQ ID NO: 16837
  misc_feature 1..30: note = NW_001841145.1_90215-97412:6862-6892
  misc_feature 1..30: note = hypo
  source 1..30: mol_type = genomic DNA

SEQ ID NO: 25985 - DNA, 282 bp, Homo sapiens
  misc_feature 1..282: note = chr1:840722-841004
  misc_feature 1..282: note = hyper
  source 1..282: mol_type = genomic DNA
cgcgcattgtcggggcgggtgcagccgcggtgcaaaaggaccttcctcagaaagttgagcacgaagttcccacaggcccggaagttcccctcccgggcgctccccagagagctgaagactgggcgcgtgccggcggcaaatgttcacagcaaagggcggcccagtgcgcagctggaacatcagccccaggcggtcgctgcgacagggacgagcctgggaaacgtgaaaatgtccagaacagggaatccacagataaagaaaagacatcgtggttgccagagc

SEQ ID NO: 25986 - DNA, 49 bp, Homo sapiens
  misc_feature 1..49: note = chr1:975817-975866
  misc_feature 1..49: note = hyper
  source 1..49: mol_type = genomic DNA
atccctggagaggcccggggctggcgggaatcctcggcgggcggggtct

SEQ ID NO: 25987 - DNA, 30 bp, Homo sapiens
  misc_feature 1..30: note = chr1:1355593-1355623
  misc_feature 1..30: note = hyper
  source 1..30: mol_type = genomic DNA
cagcagctccagcaccgccagccgcccgcc

SEQ ID NO: 25988 - DNA, 107 bp, Homo sapiens; identical to SEQ ID NO: 1645
  misc_feature 1..107: note = chr1:1475537-1475644
  misc_feature 1..107: note = hyper
  source 1..107: mol_type = genomic DNA

SEQ ID NO: 25989 - DNA, 15 bp, Homo sapiens
  misc_feature 1..15: note = chr1:1476254-1476269
  misc_feature 1..15: note = hyper
  source 1..15: mol_type = genomic DNA
cggtcctggaggggc

SEQ ID NO: 25990 - DNA, 187 bp, Homo sapiens
  misc_feature 1..187: note = chr1:1535001-1535188
  misc_feature 1..187: note = hyper
  source 1..187: mol_type = genomic DNA
cgcggcaggaggccccgaggagcacgcgctcgcacgggaagcgcgtgtaggcgccgcgccacgagcagttgagcgcgaaggcgcgcacgcggcgcgcggcggccggggccaggcgccactgcaggaggacgctgcggttgcgcaggacgctggcgcgcagggagcggccggccggggcgtgcagcac

SEQ ID NO: 25991 - DNA, 135 bp, Homo sapiens
  misc_feature 1..135: note = chr1:1535782-1535917
  misc_feature 1..135: note = hyper
  source 1..135: mol_type = genomic DNA
ctcacgggctgtggccggcttcgtttcgcgtcgtgcagctccgcgaccgcccgtggccacaccagtcggggacttcgtgctttacgatgggggcgcagcggtctggcacgcgcaggaccccgggccttgcacccc

SEQ ID NO: 25992 - DNA, 39 bp, Homo sapiens
  misc_feature 1..39: note = chr1:1567286-1567325
  misc_feature 1..39: note = hyper
  source 1..39: mol_type = genomic DNA
cttcgctcccccctccgaggaccccgcccagcaggccat

SEQ ID NO: 25993 - DNA, 132 bp, Homo sapiens
  misc_feature 1..132: note = chr1:1567781-1567913
  misc_feature 1..132: note = hyper
  source 1..132: mol_type = genomic DNA
gggttgggggggtcctcacgtctgtgggtctggtctatcggggggcccgcaggacgtgtgcggggtgtgcggggtgtttgagggtccggatgtgcgtcccgaggtcggagggttggacgcccctgtgtccag

SEQ ID NO: 25994 - DNA, 169 bp, Homo sapiens
  misc_feature 1..169: note = chr1:1935385-1935554
  misc_feature 1..169: note = hyper
  source 1..169: mol_type = genomic DNA
ggaggtcgcgggccccgaggcgcggctgaagggccaggccacaggccgcggggcggggacgtctccggggtcccagacagccaggcctggcccagggccaaggcttggaggtgacagacagacttggggggcctggaggagctcagcaccggcgcgttggcccagagga

SEQ ID NO: 25995 - DNA, 779 bp, Homo sapiens
  misc_feature 1..779: note = chr1:1950582-1951361
  misc_feature 1..779: note = hyper
  source 1..779: mol_type = genomic DNA
cggagagccagaccccggccagggagagctgcccgcgagggagggggcgcggctggcggaggggggcgggatggggcggggggcggggggaggagaggggagcggcgggcggggccgggctgcagggagcggcgggctggggcgggctcggggcgggctccgcgctccgtccgccccctcgcgcccgcgccgcgctcgctcagctcccgcccgcctgtgccgcctgtgcggccgccgggagccaagtttgcgcggaccccgtcccgagcccgccgcggccatggacgcgcccgcccggctgctggccccgctcctgctcctctgcgcgcagcagctccgcggcaccaggtgagcgggcggggtccgcgcggcgcggggtcgggggcggtggggggcccgcgtcggcccgagatagcggctgggagagcggccggcgcgagccccgggccccggaccccaagtctgagagccccgcgtcctccctccccggggtcttgccccgcgggcccctcgttggactcgcccggacgctgcccttgggctcgggacgcggcgacccccgcgctggccgcccccgcccggtgctgtccgccgtcctggtgctgaacctgggctgggcgagggcgtcggagcctcccggttcccctgctccgcggcgcgcgtggagggtccccgggtccgcggcactcgcgggtccctgcccggcgggtgccttgaggagaggaaagacctgagaactcggtgcggggaggctgctccctttgcgggggagccgttcc

SEQ ID NO: 25996 - DNA, 44 bp, Homo sapiens
  misc_feature 1..44: note = chr1:2136044-2136088
  misc_feature 1..44: note = hyper
  source 1..44: mol_type = genomic DNA
gggagccggagaacccgcaggacgtcagccgggtggattccctc

SEQ ID NO: 25997 - DNA, 146 bp, Homo sapiens
  misc_feature 1..146: note = chr1:2136893-2137039
  misc_feature 1..146: note = hyper
  source 1..146: mol_type = genomic DNA
tccacaggcccagcccggcgcgcgccgctcgttctgcgacctccagggcgagcgcgcttccggggcggccgtgcaagaggcgtgggaagcgcgcggggggttctgagcgtgcagtcgccgcctgcggacggcgaaggggcgggtga

SEQ ID NO: 25998 - DNA, 675 bp, Homo sapiens
  misc_feature 1..675: note = chr1:2374950-2375625
  misc_feature 1..675: note = hyper
  source 1..675: mol_type = genomic DNA
gggaggtgtggggagcggaaggccgcaggagcatctttgcggagaaagtactttggctgcggcgggcgcagggcgggccggctagccccgcgccccacctgttctgtgcgtcgcgctcgcccggttgcgcccgatctgcctccagcccggtgcccgccgcggagcccgcgcccccggccccctcccggcgcggggcgggcagggggtgtggtgcgggcggcacgagtgacagcgcgctcctcgcgcggcgcctccacggggcgcagtgtcaccgcgcacagcccgccgcgggccgcccgagctggcggggcgatgccgcgggagccggagccccagcccgagcccgagcccggccgctgactgcgcctcccggcccgcagcccccgcccccgccgccctcgctgccctcgctgcagccgccacggagacaatggacgcgggagccgccccgcagaagcacagtaggtgccgctcctgccgctgcgccgctgccaaccgggatgcgcgggtggacgcgcgggggcgccgcagccctggtgcgggtcggggctgagccgcctgggcttcagactcgggagcggaggctcggatcgcggtggcacgggcaggggtgcgggcgcgggactgtgggcgggacgggcggagcggtcttgagctctccggatggcctcaggt

SEQ ID NO: 25999 - DNA, 30 bp, Homo sapiens
  misc_feature 1..30: note = chr1:2472253-2472283
  misc_feature 1..30: note = hyper
  source 1..30: mol_type = genomic DNA
tggttaaaaaccccgcggtgtcagagagca

SEQ ID NO: 26000 - DNA, 482 bp, Homo sapiens
  misc_feature 1..482: note = chr1:2560443-2560925
  misc_feature 1..482: note = hyper
  source 1..482: mol_type = genomic DNA
gcgccccccaccctccgggagtccggcggaggcggaggcggaggcggaggcgggcgggtgcggagctgcagaagcagcgcgcgggagtcggggccggggcagagctttctggaagggaccgcgggctccctgcaggtcagtgcccctcccgccgcctctgagtccgcagctcggccccgggagcccctgggtgcccagtgcagacccacctgccccatctgacgggcgggctcgggctgggggcaggcggaccctgcagcaggtgcagcggggcgagcgcggagagcgggcacggggacaggcgggggcggggcacccgcactcacctctgcggtcggcgtagaggacacccaaggccaccagggcagcggtcaccagcagcagcagcagcagcagccccccctccaggaaccccgggcgcttctgccctgcacggccggcgctctccaccatccccactgggccttcggacttccccatca

SEQ ID NO: 26001 - DNA, 28 bp, Homo sapiens
  misc_feature 1..28: note = chr1:2706307-2706335
  misc_feature 1..28: note = hyper
  source 1..28: mol_type = genomic DNA
cgcagcagtccccggccgcacagcgcgc

SEQ ID NO: 26002 - DNA, 70 bp, Homo sapiens
  misc_feature 1..70: note = chr1:2984719-2984789
  misc_feature 1..70: note = hyper
  source 1..70: mol_type = genomic DNA
gtgtccccagtggcccgggtccccgaaggtggcccagctcgggcgctcgcgcagccgggtactcaccttg

SEQ ID NO: 26003 - DNA, 288 bp, Homo sapiens
  misc_feature 1..288: note = chr1:2985115-2985403
  misc_feature 1..288: note = hyper
  source 1..288: mol_type = genomic DNA
ggagccgggttctggcgcgcgagccccgacgccccctccagcgatcgcagggcggggacgggggccgaggggagaatgcaggagaaaagcgggccggggcgacggggaacgcaaagcttttaaattagtaatcaaacgcagtaaaacggagcaaaaccagcccggactcgcgtccgaactatcggcgcgtgtgccccgagatccaaggaagtcgtgtggaaaaccgcagccgccgccccatcttcggccccggctggggcgggagcagcagcgcgacgcgccgcgacg

SEQ ID NO: 26004 - DNA, 82 bp, Homo sapiens
  misc_feature 1..82: note = chr1:2986416-2986498
  misc_feature 1..82: note = hyper
  source 1..82: mol_type = genomic DNA
gggggcgcgggccggcgcccacccggctccgcgggcgcaggggcaggggtggcgacggcgggacagccgcagccacttgggg

SEQ ID NO: 26005 - DNA, 165 bp, Homo sapiens
  misc_feature 1..165: note = chr1:2987055-2987220
  misc_feature 1..165: note = hyper
  source 1..165: mol_type = genomic DNA
cggaatcggcgccgcctgctcccgccgccccctcctctgcaggccgcccgcccgcccacccgcagaagaggcgcccgggccgctcccctcgaggtccccgcccgacccacgccgttccgtccgcgcctccggggccgggtccctccaggccggcctcgcagctcc

SEQ ID NO: 26006 - DNA, 44 bp, Homo sapiens
  misc_feature 1..44: note = chr1:2987457-2987501
  misc_feature 1..44: note = hyper
  source 1..44: mol_type = genomic DNA
gctgccgggtgccctcggcctcggcctcccgtgacctctgaccc

SEQ ID NO: 26007 - DNA, 102 bp, Homo sapiens
  misc_feature 1..102: note = chr1:3087621-3087723
  misc_feature 1..102: note = hyper
  source 1..102: mol_type = genomic DNA
ccccgcacccctcagcgccccacggagacctgcaccttccagactgacagtgctcggggccctctctccctcttgcgatttttatttcggggccacgtttgt

SEQ ID NO: 26008 - DNA, 192 bp, Homo sapiens
  misc_feature 1..192: note = chr1:3310353-3310545
  misc_feature 1..192: note = hyper
  source 1..192: mol_type = genomic DNA
tgcgcggattcccgttcacctctgacccccgaagcagttggaggcaggtcggggacccccgcccccgccccgccccgcctcgggccctgcgatcagcagtaatagcgattaattccgactgtggctccaagtcccatggccaaggcgccctcctcctgcaggtccagggccagggagggggagcccgcggcc

SEQ ID NO: 26009 - DNA, 198 bp, Homo sapiens
  misc_feature 1..198: note = chr1:3567147-3567345
  misc_feature 1..198: note = hyper
  source 1..198: mol_type = genomic DNA
tataagtatttatttcgtttgcttggggttttgtttgcttttgctgagtccgacccctctacctgccgcctggcccttgcctcacgctccagtgccactgagatcaaggagagaacgaatttgccgctgactgggcagagcgagcgcgtggatcgcggccaccgcccgttcatcacccgcgcgcatctgggctggcac

SEQ ID NO: 26010 - DNA, 114 bp, Homo sapiens; identical to SEQ ID NO: 2
  misc_feature 1..114: note = chr1:3567737-3567851
  misc_feature 1..114: note = hyper
  source 1..114: mol_type = genomic DNA

SEQ ID NO: 26011 - DNA, 576 bp, Homo sapiens
  misc_feature 1..576: note = chr1:3567882-3568458
  misc_feature 1..576: note = hyper
  source 1..576: mol_type = genomic DNA
cggccagagaacccagtctgcgccagcccggctcgctcgcgaagccacgggcttcactgacgcgactttccaagacgtgggggtcaccatgggcagaggacatcggttcggagccagatcacgggccccataagcatcagaccataagcagcgccgccactgagagccgctcggaactcgcccagcatgtcgggtcccctagccagggcctggtgtacgtggtcgagggccctggaagccccgatggcctaggaggagcaggcgggcggggcggcgggtgtcgctggccggtagagagcttcggcctgacctagcgcaggtctggtgcgcgcagagaacaactccaagcgcaccgacgcccgcgagctccttccaaacaccgaacgggatccagagcccgagcccacaggcggcggccgggggagggagcagggtgctggccgccgcccgggagtgttcgcgtcctgggtgacccctggaaggacgtggggcccaaactccggctggggttgggagagcagcccccagaggctctccgcgggatcctctgccgggcgggaccgtggctccacagga

SEQ ID NO: 26012 - DNA, 45 bp, Homo sapiens
  misc_feature 1..45: note = chr1:3663242-3663287
  misc_feature 1..45: note = hyper
  source 1..45: mol_type = genomic DNA
gcttcaccaccaggtcggtgaactccgccgcgtagtcgtgtaaag

SEQ ID NO: 26013 - DNA, 389 bp, Homo sapiens
  misc_feature 1..389: note = chr1:3663586-3663975
  misc_feature 1..389: note = hyper
  source 1..389: mol_type = genomic DNA
ggctgggggccaggacgatcccacccggagaagcctcgcgggcgagaagagggtcccttcctgcgggggcagatggaggcgcgggagccttccccgggaggtgaccgaggccagtcagcggccccggggacccaaggccggggactctcggcggccggtggacgggcagggccggcccgcctgggcaggcggcggggtgaaggtgtccagggcctgaggcggcaaagtgccgccgccgtcagccccgactgccacccaccaggcacccggcccatccccggctcccatctagggatccacacccgggcgccgcggcgccgcggtttaaagcctgtgagatcccgcaacaacccggatccggaagcgcggggtcgcggctgggcgagggc

SEQ ID NO: 26014 - DNA, 152 bp, Homo sapiens; identical to SEQ ID NO: 5289
  misc_feature 1..152: note = chr1:4712671-4712823
  misc_feature 1..152: note = hyper
  source 1..152: mol_type = genomic DNA

SEQ ID NO: 26015 - DNA, 51 bp, Homo sapiens
  misc_feature 1..51: note = chr1:4714024-4714075
  misc_feature 1..51: note = hyper
  source 1..51: mol_type = genomic DNA
cataggaccgggcttcgctgggttcggggcagaagcgccgaagctccgacc

SEQ ID NO: 26016 - DNA, 182 bp, Homo sapiens
  misc_feature 1..182: note = chr1:4714163-4714345
  misc_feature 1..182: note = hyper
  source 1..182: mol_type = genomic DNA
cggcccgcgtggctcagctccgccccaggaaacttttcgcgcagcccccgctccatgcgcccccacccagtccttcttcggggccgccccctccccaaagtagctctccgggtccactgggcgcccccgtaaccgggtcggaacctcgaacggcttcgcgtgccatccggttaccctggcaa

SEQ ID NO: 26017 - DNA, 113 bp, Homo sapiens; identical to SEQ ID NO: 4
  misc_feature 1..113: note = chr1:4715427-4715540
  misc_feature 1..113: note = hyper
  source 1..113: mol_type = genomic DNA

SEQ ID NO: 26018 - DNA, 963 bp, Homo sapiens
  misc_feature 1..963: note = chr1:4715574-4716537
  misc_feature 1..963: note = hyper
  source 1..963: mol_type = genomic DNA
cggcgctttcctctatgttgcaaatcaagggacccctcttcgcttcccgcaagcgggcaacggggtgcaccggtagccggaaaggggcgcccgcccggagcctggagcagcaccgcggccctggcggggagcggccgggtctccagggttccgcgcgtccggggtcggggcagcggcgcccgccccagcaacccgggaagtggggccggccaggcgcgcccgcagctctaggagccagcagcgcagtgtcctggccggctgccccggcgcgcctcctccccggggcccggggcgaggcgccggccgctgggcgcggcgggcgcgggggccggggctgccggggaaagctaaagctccgggctcccagcgagagcttcgcaggcggagttggaggaaaccacagccaaacagccactccgctcccccttctcctttctcggggccccggggctgagcaggggcctcccaggctcccagctgccgacccagctgtttgcgggtgacctccgggcccgacgggcgctcacagctggcgggcagctggggcgggagagctggggttcttggggagctccggcggccaccccgctgtaaacacacacgcacatacgcccgccggcgcgcccggggcttgtctgtgtctgggactccagggccagatggaagagggggttcgagcctagagcccgtggtgggggtgtccagaaagacccttctcggcaaactttgccagcccgccggggttctcgggcttctctggcttctgcctggggtggcccagggcccaccagagcacagctgtcgtttttgctgggcaggctgcctctgagccctcgccctcctgccggggcattcaccgagctcgtgcatttgggtcccgggttggaaccgcgagcggggaggacagaggtggaggcggagagcagcgtgcggttctcgagtttgtccactgggatgcactgc

SEQ ID NO: 26019 - DNA, 126 bp, Homo sapiens; identical to SEQ ID NO: 5294
  misc_feature 1..126: note = chr1:4716538-4716664
  misc_feature 1..126: note = hyper
  source 1..126: mol_type = genomic DNA

SEQ ID NO: 26020 - DNA, 184 bp, Homo sapiens
  misc_feature 1..184: note = chr1:6208628-6208812
  misc_feature 1..184: note = hyper
  source 1..184: mol_type = genomic DNA
actgaacagtggtcgcggtgttggcatgatcaccacacctgtctgcctttccctaacactcatgcctcccgtctctaggggagtcagacgcggagaagggcgcgaggaagctattgtggacggggtctcgagcagcgcgggcgaagctttgcgggatcggctaccgaggcggggcaggagccgg

SEQ ID NO: 26021 - DNA, 30 bp, Homo sapiens
  misc_feature 1..30: note = chr1:6221982-6222012
  misc_feature 1..30: note = hyper
  source 1..30: mol_type = genomic DNA
ccacggttaatcctacgtggcctgccagtg

SEQ ID NO: 26022 - DNA, 507 bp, Homo sapiens
  misc_feature 1..507: note = chr1:6239505-6240012
  misc_feature 1..507: note = hyper
  source 1..507: mol_type = genomic DNA
agcaccgccggtcctcgcccctctctgggccccacccagcccgccccgcggccgacatgggccaggggccgggtcccgcctgcccgcagcgaggccagaggcgcacggcggcgggacgcgagcgcggggtgcgccgctccgggagctagcgcgattcccgcccccttcaagggcacgcgggctgaccctgacagcgccgcgccccccagcgcaggccccggcccgcggtcctctggcccgcctggcccgcgtcgccgcccggggggcccggatcgcaccccgcccttagccgccctcacgccggcccgggcgctcacccagccttcgcccttggccgcgcggcgccagcagggcgggagcgcagccccgcaacccgggtgcccctcctgcgaggcgccagcccggccgcgccgcccccgccgcccgcgctccgccctgggcccggcccgtctcggcgcccccgccgctctggccccaggcgcacccgcgccccgctcacctgacatc

SEQ ID NO: 26023 - DNA, 427 bp, Homo sapiens
  misc_feature 1..427: note = chr1:6240281-6240708
  misc_feature 1..427: note = hyper
  source 1..427: mol_type = genomic DNA
gctccccgcaaagcccgggcgctcctcccaccgcgccccgcagcccgagtcccgcagccggccgagggtggcggcggcagcgccagaggcacggcggcacggcgggggggcggcacacatgcccggattgtgacgtccagtctggttgctgtggcaaccccatcccatcgttccggcagcgcgactagttaacagcagagaacaagttgggggactagtcctgagccgccgggtgagggtggggaccggggggcgccccggcagggggagccgtcgaggcgtccgcgcgcccgcggacccgacggccgagcgggcagtcggggcttggcgagcccgggcgcagggggaggcgaggaaacaccgcccccgcgcaccccgggcagagccagccgccgccgctcgcctgcgaaggcgctgggccccgagc

SEQ ID NO: 26024 - DNA, 280 bp, Homo sapiens
  misc_feature 1..280: note = chr1:6240931-6241211
  misc_feature 1..280: note = hyper
  source 1..280: mol_type = genomic DNA
cctcacctgcttccccgctcccaccgcccacgtgcccccttccaaaaagcccctccaggctgggtgcagctgaaacccatgcagacccctaggggtggtgcggatctgcgatgtctgtgcccaaaactcccgctcagaagcgacacctgtcgcagagcaggaaggagccgccgccaccagccctcggtcgttaaaggtgaagatggaggccaaagccctcgggagcaagactggaattttaaatgagcgcctccagtctccgcggcggcaagtcttaaag

SEQ ID NO: 26025 - DNA, 30 bp, Homo sapiens
  misc_feature 1..30: note = chr1:6266556-6266586
  misc_feature 1..30: note = hyper
  source 1..30: mol_type = genomic DNA
cgtgcgtgccccagccgcccgcttgcgctg

SEQ ID NO: 26026 - DNA, 262 bp, Homo sapiens
  misc_feature 1..262: note = chr1:6301710-6301972
  misc_feature 1..262: note = hyper
  source 1..262: mol_type = genomic DNA
gtgtaaggcgagtagcgggccaaggaggctgtttgtgatggaggagccacgggtgggggcgtcagaaagtagggggatcattccaggtggggagaccactgaccgaaaacgggccacaggacagggggcgcggcgggcagtgtcggggttggggtcggggggcaacggaggcggaagtccattcagtggaccagggcggagcgacgcctgagaattccgcccaggccttgaggcgggcctcgcctcccgcagccaaagcaga

SEQ ID NO: 26027 - DNA, 192 bp, Homo sapiens; identical to SEQ ID NO: 5298
  misc_feature 1..192: note = chr1:6304118-6304310
  misc_feature 1..192: note = hyper
  source 1..192: mol_type = genomic DNA

SEQ ID NO: 26028 - DNA, 71 bp, Homo sapiens
  misc_feature 1..71: note = chr1:6304595-6304666
  misc_feature 1..71: note = hyper
  source 1..71: mol_type = genomic DNA
atggtcgggtagatccggaagcgcaaattggagaaggccgacatcctggagttgagcgtgaagtacatgag

SEQ ID NO: 26029 - DNA, 775 bp, Homo sapiens
  misc_feature 1..775: note = chr1:6309246-6310021
  misc_feature 1..775: note = hyper
  source 1..775: mol_type = genomic DNA
gagccggaagacaaacgctgaggccaacgccccctcacccctgggaggggtggcgcatgtctgcgcgcggggcggaggcgggcgtctttggtgctgcggccccggagagcggcctggcctgcctggcgtccgtggggaggcgccggcggtcctaggacgcggagcccagcgagtccgagtgcagcgtggcgtagcccgaggactcggagggggaactcaggaagctgctggtgctgccgccgccgcccgccgcgcgcagccccccgggctcgccccacgacgcgctcaggccggggcgcagagagccggcgtgcgagtgcgcagaggggcgtggccctgggctccgctgggcgctgcttgggggcgtcggggcctctccgggatctgcgccgtcgggggcggcgggcgcagcggggaagggcccgggcgggcggcgcagggcctgtggctcgcactcgaaggcggtcagggcgaaggcgtcgggcagcagcgaggccgaggcggagcgggggccgggcccggggcggcggcgcgggctgccggggggcgagtcgcgggctccccgcgggccgctatccagggccgagggccgcagcgacagcaggctctcggccgagcggcggcgcgcgcgggacggtggtgcgtcctccgcgaaggccaggaggctggcgcggcgccgctcgggcccggcaggcagcaccaggtgcgccagggcggccaggtcctcgccggagccccagcgcggcaggaaggcgggcagcgggacggcggccca

SEQ ID NO: 26030 - DNA, 626 bp, Homo sapiens
  misc_feature 1..626: note = chr1:6480325-6480951
  misc_feature 1..626: note = hyper
  source 1..626: mol_type = genomic DNA
caggctcgggttcagcgtcttctctgagccccgccctgggccgcagcaggggacccagcggttacgggagctcccatgagggacagcagcgggagggacttgcacccccagctgctttatcgggtgaagggctgagctggacgggaaatccgagttccggagaaaggtcgtgacttgctccagtcctcgacgctgggaacaggccgagcctggacaagggccccagtcgctggacgcccggctctaaggagcccgtagaacccttcggcggcttgcctagttaagagtcttttggttaccccactccaggctttgggtggggaaacggaatcctagagaagcagaggcagccctggagccctcggagctcgttttcattcccaccggctaggggtccgggttctcgcccgcaagacagtcagggctcatgtgacgcgcgggcaggacagttttgggtgcgggccccagtggcccgcccaggaccgccttcgcgccgcgtggccgttgctgcggcaaactggctggcgtcccccgcccatctgctccgggctcccctcccccgaccggctggcggggcaacggccacgcccgcgaaccacactgcgaactgccgggcagagagatga

SEQ ID NO: 26031 - DNA, 16 bp, Homo sapiens
  misc_feature 1..16: note = chr1:6484964-6484980
  misc_feature 1..16: note = hyper
  source 1..16: mol_type = genomic DNA
gcgtcctggggaaggc

SEQ ID NO: 26032 - DNA, 288 bp, Homo sapiens
  misc_feature 1..288: note = chr1:6484981-6485269
  misc_feature 1..288: note = hyper
  source 1..288: mol_type = genomic DNA
ctgagtgcggagtcgcggcgccgcacgcggcaccatggccctggagcaggcgctgcaggcggcgcggcagggcgagctggacgtgctgaggtcgctgcacgccgcaggcctcctggggccctcgctgcgcgacccgctggacgcgctgcccgtgcaccacgcggcccgcgctgggaagctgcactgtctgcgcttcctggtggaggaagccgccctccccgccgcggcccgcgcccgcaacggcgccacaccggcccacgacgcctccgccaccggccacctcgcctg

SEQ ID NO: 26033 - DNA, 48 bp, Homo sapiens
  misc_feature 1..48: note = chr1:6500940-6500988
  misc_feature 1..48: note = hyper
  source 1..48: mol_type = genomic DNA
gcgggggtcccagctcgcggccgcggccgggtcctcactgcgtgcccc

SEQ ID NO: 26034 - DNA, 125 bp, Homo sapiens; identical to SEQ ID NO: 8
  misc_feature 1..125: note = chr1:6501054-6501179
  misc_feature 1..125: note = hyper
  source 1..125: mol_type = genomic DNA

SEQ ID NO: 26035 - DNA, 73 bp, Homo sapiens
  misc_feature 1..73: note = chr1:6507490-6507563
  misc_feature 1..73: note = hyper
  source 1..73: mol_type = genomic DNA
ggtgtcgcatttcctgcaacgtgagccaggtcgggcggggtgaagggtctgaggccaccgcagggacgcatgg

SEQ ID NO: 26036 - DNA, 1094 bp, Homo sapiens
  misc_feature 1..1094: note = chr1:6508019-6509113
  misc_feature 1..1094: note = hyper
  source 1..1094: mol_type = genomic DNA
gggattggcgggccccgggtgatgtcaggccgtcggagcccataggctggctgtgcgcgggtggctgtaacctgagaggaagtatcaggtaacgcaggtgtcgggtcctgccgcccccacagccaggtgcacagcgggggccaccagcaccgtggcaggtaggagcagcccccggacgggcaaccggggtccgtggcaagccggagcctccgagagcacaggctctggagggggctccctccggccccggacccccgaaagacagggctccgcggagccctggggacccgcagtccttctgacagccgagagcggagtgcggccgagggcctagtgagggctaagctgggaggtgccccttcgccagctccccctggcgtcggggctgggccaccccgcccctgggcccgcctcttctggcctcagtgggggcccctgtgccccttggccggtgcccagaacccctccctgtaaggcgggcggagcctgcccttccaccgaggcccccatgaccctcgcccgctgcccactgtgagaaccagggggtctaggaagtcagctgctgcacccctcgacggccgctggccgcgagtccccaggaggtgaagagctgggtggggaggcgtggggggcgcctaccgggcaggtgcccgagccccaccggtcactgtcttcccgcagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggtgcgtgcccgccagcccgcgcgcgccggctgcccgcgcctcggccctgccgcccgcggctcactcgaaggcccctccgctcccccgcaggcggcgctgcttcctgggaaccatgttcctaacggctgcgccgcggaccccaaggcgtccagggagctgccaccgccgcccccaccgccgccgccgcccctgccggaggccgcgagttcgccaccgccggccccgcctctgcccctcgagagcgctggccc

SEQ ID NO: 26037 - DNA, 46 bp, Homo sapiens
  misc_feature 1..46: note = chr1:6545397-6545443
  misc_feature 1..46: note = hyper
  source 1..46: mol_type = genomic DNA
cgcgggcacgacccccggcccaggagggctccgagtcccggagggg

SEQ ID NO: 26038 - DNA, 171 bp, Homo sapiens
  misc_feature 1..171: note = chr1:6663729-6663900
  misc_feature 1..171: note = hyper
  source 1..171: mol_type = genomic DNA
cggactccacgagagggtaactgggtataaagagcgagggctcaaagtcagataggagaccgccttgaaactagatgacgccactaagcacagtcccgccgtcacttgtactgcggtggggaatggtgaaagaaggaatcgcccttattttagttccgatagacacagcac

SEQ ID NO: 26039 - DNA, 80 bp, Homo sapiens
  misc_feature 1..80: note = chr1:7023766-7023846
  misc_feature 1..80: note = hyper
  source 1..80: mol_type = genomic DNA
acctggctgggggggcgcgctcccggggcctgggggctgggcgcggctcggggagctgcgctttgcggactggaggtggc

SEQ ID NO: 26040 - DNA, 30 bp, Homo sapiens
  misc_feature 1..30: note = chr1:7130249-7130279
  misc_feature 1..30: note = hyper
  source 1..30: mol_type = genomic DNA
agcatcagatgggggcgggctcaaaagggc

SEQ ID NO: 26041 - DNA, 52 bp, Homo sapiens
  misc_feature 1..52: note = chr1:7764556-7764608
  misc_feature 1..52: note = hyper
  source 1..52: mol_type = genomic DNA
tccgcccgcaacctccggccgggcccccgccgtccagcgcggctcgggcgca

SEQ ID NO: 26042 - DNA, 85 bp, Homo sapiens
  misc_feature 1..85: note = chr1:7765187-7765272
  misc_feature 1..85: note = hyper
  source 1..85: mol_type = genomic DNA
cgcgcgtttctggcgcgagtgggaagtgtggggatccggcgggcccggtgtgaggggcgtgtttctggggcgagagtggggagtg

SEQ ID NO: 26043 - DNA, 329 bp, Homo sapiens
  misc_feature 1..329: note = chr1:8002422-8002751
  misc_feature 1..329: note = hyper
  source 1..329: mol_type = genomic DNA
gccgtcctcctgccccgcggttcccagcacgagctctcccgacagaagaggaaaacgcggcgcgactcggttgggggacagcgctgagatgcggacagatgcggacgttctgccgccgcctgcaggcagagggactcggagatcaggccgcagaagcagaagaaggcagacgggaaggaggaggaaggaaaggagccttgtggcttcgtgtccgaccctcccgcccttggcccgcgtgcctggagccagccccaccgcgcccgcgtttcctcccgcgggacttcccttggccctgggtctgcagcgggtcctgccgagcttccttccct

SEQ ID NO: 26044 - DNA, 30 bp, Homo sapiens; identical to SEQ ID NO: 9
  misc_feature 1..30: note = chr1:8277113-8277143
  misc_feature 1..30: note = hyper
  source 1..30: mol_type = genomic DNA

SEQ ID NO: 26045 - DNA, 60 bp, Homo sapiens
  misc_feature 1..60: note = chr1:8277775-8277835
  misc_feature 1..60: note = hyper
  source 1..60: mol_type = genomic DNA
cgcagggaaaaggaggatgctagtgacccatcctttctcgccgtgcgctttaatttcaac

SEQ ID NO: 26046 - DNA, 94 bp, Homo sapiens
  misc_feature 1..94: note = chr1:9243226-9243320
  misc_feature 1..94: note = hyper
  source 1..94: mol_type = genomic DNA
agggcttggctcagccgaggggccgcggctcagcccccctcaccggccttaaaggttcccagagacgcaaagtcggacgcgggtcctgagcgcg

SEQ ID NO: 26047 - DNA, 879 bp, Homo sapiens
  misc_feature 1..879: note = chr1:9712135-9713014
  misc_feature 1..879: note = hyper
  source 1..879: mol_type = genomic DNA
ccggcgcctgcactgcgcgccttgcccgcctggcccggcagcggggtttcagctgcgctcacagcggcggtgcggcctccggtgcgccggctgaggcgcgaggatactggaagcgctcagcgcgtgcgcccgctccgagcgctgactagaggaccaggggcctcctctgtacggcagcggggtccacagagagcgcgctggtgatgtcgcccgagtgccctggcgcggagagagggctgcgcacagttcgccggcgcccgggtcctgtgcgcccttcccagcctgggcaagtggggagcggggctgcagaggggccggggtggaagttttcggggcttcctcccggctcgtggacccgcgccccgcctcccagtcccgggcctcccgcgttgctcgccgcgtttgctgcagcggcgcaggcgagatcagctccggatctgcggccgagccggggttacgccggcaaaaccgcccccagctttgcatttccggactttttaaaaaaatactcttacccgtaattcagcctgaatgaggctttttaaaaaaatcgagtttcctgtttttatttaggcttcctcatttgcacctcctcctttgaggtagagaagaggggaactgggacgacctttcgtgggcaccaggatgggggcgttgcagggcggggagacgggggtccagagaaccggggaagggccgctgggaggtcccgaaaagtgcgctgtgggtggggcgagggtgaagcaggtaggggcgagatttccggggtcgcgggtggggggcgccctggagcggccaaggtgcagggtcctcgcgtggcacccttgggatctgcccagtttgcggatggagcgcggggctgatcgggcaggtctcact

SEQ ID NO: 26048 - DNA, 201 bp, Homo sapiens
  misc_feature 1..201: note = chr1:10057409-10057610
  misc_feature 1..201: note = hyper
  source 1..201: mol_type = genomic DNA
cggcggcgcgaggctcgccgtgggtctcgggatcaggcgaaggcggccgggccgggcctgtaggtacgtcctctgtccgtgcctccgccctgctgcgcccaccgtcgcccagtcgcccccgagtccgctggtccttggcgcctccgtccatcgggcgcgggaccccagtccttcagtcccccagtccgtcctttcccgcgc

SEQ ID NO: 26049 - DNA, 91 bp, Homo sapiens
  misc_feature 1..91: note = chr1:10948529-10948620
  misc_feature 1..91: note = hyper
  source 1..91: mol_type = genomic DNA
cccgggtctcccaggcgagaggggcgggaggctccagacgcccagagcccacagcttcccgcccggggcggctgagcggtcccggggagag

SEQ ID NO: 26050 - DNA, 30 bp, Homo sapiens
  misc_feature 1..30: note = chr1:10948841-10948871
  misc_feature 1..30: note = hyper
  source 1..30: mol_type = genomic DNA
gcccgggggagggggcgctgtgggggctcc

SEQ ID NO: 26051 - DNA, 1056 bp, Homo sapiens
  misc_feature 1..1056: note = chr1:11538940-11539996
  misc_feature 1..1056: note = hyper
  source 1..1056: mol_type = genomic DNA
gccgggctgaaccaccgcgcggatcggcagggggagcggcggcgaagacagcgccagacagcgggtcccagagaccgcagcgcgcggcgtggcgcagggtctcgccggccactgattcaaggcgcggcggcgcggagcccgagaggcgccagggattgggcggcagcgcggctccggagcctggctcggacacccccgcgacccgtggtaggagcccggacccaaacaaaggcgggcggcgaataaaaggcggcggcggagcggagtgctcgggttgcgagctgaggactgggattcgcgcgcagcttcccgcggtctgcttgccctggagcggagggggagccccagcctcctgcggctccgagaagcttccccctgcgacttccgcgaggagacgagtctgcgcagcgtggtggccgccgccccccgaccctctgcgcactctctcccgcgccggcggctcagcctagccccgttcggccggccgaggtgagtgcacggccgcggggcgccatccgggcttggtctcggggctgggggatgcattgctaggaggagggggaagtcctccgcgccgtccgcaccccgacctgcttggcgccgcgcgcgaagttctctcgctctccagccagcccgggatgcgggcctcggagccccccgggaaagacggtcaggggtggacagaacccaagcttgccctctacgaccgggccccagctccgcaccatctccccgcgggactgcagcattcttggtcggccaaggggagttggatgttggatgtccaggaacggcaaggcttccgacctctggcccctgcttgtcccctctgagggatatctgggtccataaaagttgagcgtcagtctgaagccgcccttggatcgggctctcgcccatgctagagcggagggaggggacagagtaaggctaatgaccccctccacccactccctacctagcgtactcgtgctctcggagggacatttccccgattaacctggctgcaggtccggccggggagggcgcgtgggggcttggggcgggccgggccag

SEQ ID NO: 26052 - DNA, 140 bp, Homo sapiens
  misc_feature 1..140: note = chr1:11540039-11540179
  misc_feature 1..140: note = hyper
  source 1..140: mol_type = genomic DNA
cgcgaacgagggtggaggtggagtgggcagccgggcagtggcggcgctgagggtcgggaaagattcccagcgcaaggggcgccaagtcccgggagccaaccccaccgccgggagaacttttcccaactccctggggaggc

SEQ ID NO: 26053 - DNA, 30 bp, Homo sapiens
  misc_feature 1..30: note = chr1:11611023-11611053
  misc_feature 1..30: note = hyper
  source 1..30: mol_type = genomic DNA
acagcggtcttcccacgatttgctatttac

SEQ ID NO: 26054 - DNA, 61 bp, Homo sapiens
  misc_feature 1..61: note = chr1:11751330-11751391
  misc_feature 1..61: note = hyper
  source 1..61: mol_type = genomic DNA
attgttggggtccaccgaggaccgcccgccgcggccctttgtcgcccgccctgcgcggggc

SEQ ID NO: 26055 - DNA, 172 bp, Homo sapiens
  misc_feature 1..172: note = chr1:11752464-11752636
  misc_feature 1..172: note = hyper
  source 1..172: mol_type = genomic DNA
gcccggaaccagcaccgccggtggccccgcgccgtcccatctgtgcccaggaaggtactcagcctggctcccccgacggcgctggtctttcgcctgtggtctcccgctctgtccctcctgctccccaccgccggcttttggcttttctccgtccgctcgtcaagggtctcag

SEQ ID NO: 26056 - DNA, 109 bp, Homo sapiens
  misc_feature 1..109: note = chr1:11919143-11919252
  misc_feature 1..109: note = hyper
  source 1..109: mol_type = genomic DNA
gtgggaggtggagaccgggcagagccgaccttgtatagaaatgggccgggtcgggccggggggcaggaacgcgctggagacacagacaagtccccgtctcccgcttctt

SEQ ID NO: 26057 - DNA, 164 bp, Homo sapiens
  misc_feature 1..164: note = chr1:11959074-11959238
  misc_feature 1..164: note = hyper
  source 1..164: mol_type = genomic DNA
ggacccacctggatccgaggtcggcccctgtccccggtgctgaaatgcgggcgcccgcggggttcacggccaggactcagccctggagtccctgagaccgctagccccgtagcaatcccctatgtaggatttgtttcaagggctcagaccggcacagagccccc

SEQ ID NO: 26058 - DNA, 432 bp, Homo sapiens
  misc_feature 1..432: note = chr1:12123122-12123554
  misc_feature 1..432: note = hyper
  source 1..432: mol_type = genomic DNA
ctactcacatttcaccgtttcttggggcaggagtggaggtgggggcattggaacccccttggggcctcctaatatcctgtgagtccccacctccagggccagaagctgcctgcctccgctccccgcagcccaggtgcggcgggcagcacactccctagagccaggaccactagttccgtcaaatccggggcgggccattcaaacagctaagggaggcgtctcctagtgtgccttttcctgagtcatctctgcacgtgtttgcccccttttttcttcgctgcttgtagctaagtgttcctggaaccaatttgatacgggagaactaaggctgaaacctcggaggaacaaccacttttgaagtgacttcgcggcgtgcgttgggtgcggactaggtggccgcggcgggagtgtgctggagcctgaagtccacgc

SEQ ID NO: 26059 - DNA, 145 bp, Homo sapiens
  misc_feature 1..145: note = chr1:12123787-12123932
  misc_feature 1..145: note = hyper
  source 1..145: mol_type = genomic DNA
cgcaagggaggacactcctcaccccgttccctgcccagctggagtgagggggcgcgggtgacaagcaggaacaccggaatatgctagcacccacaggtgggaggctggctgaagggctagtggtggggggcgcctccttctcacc

SEQ ID NO: 26060 - DNA, 309 bp, Homo sapiens
  misc_feature 1..309: note = chr1:13839460-13839769
  misc_feature 1..309: note = hyper
  source 1..309: mol_type = genomic DNA
tgggcagtttggatgcgttctcctggatccaggagaagaggtgggcgaagtcacagtcgcacagccaggggttcccgtccagacgcagggagcgcagcgcgggcagcgcggccagggcggccacgctgaggctgcgcaggttgttgtcgttgagctccagcacctgcagcgactccagggtctcgaaggcgtcctcgtgcacgcccaccaggttgttgttagccaggctaagcttcaccagcctcccggccgagcggaaggcgccggcgcccagctgggtcaagttgttgtagctgaggtcgaggaaca

SEQ ID NO: 26061 - DNA, 177 bp, Homo sapiens
  misc_feature 1..177: note = chr1:13840521-13840698
  misc_feature 1..177: note = hyper
  source 1..177: mol_type = genomic DNA
gcggtttccctaaggcgtgtcccgggcgtgcgccctgccccctcgcgcccgcctggtgccaaagcacgctccctgcacgccaccctatgtcgccaaagggagtgggacctgggtcactctgactctgctccgggggcaatccctgcaggttctcgggtgccgcgccagggtctgctg

SEQ ID NO: 26062 - DNA, 368 bp, Homo sapiens; identical to SEQ ID NO: 1659
  misc_feature 1..368: note = chr1:13910330-13910698
  misc_feature 1..368: note = hyper
  source 1..368: mol_type = genomic DNA

SEQ ID NO: 26063 - DNA, 15 bp, Homo sapiens
  misc_feature 1..15: note = chr1:13910699-13910714
  misc_feature 1..15: note = hyper
  source 1..15: mol_type = genomic DNA
cgggggagctgaggg

SEQ ID NO: 26064 - DNA, 37 bp, Homo sapiens
  misc_feature 1..37: note = chr1:14026539-14026576
  misc_feature 1..37: note = hyper
  source 1..37: mol_type = genomic DNA
atccgcggtgacctacgaggggcggctgggtggtggc

SEQ ID NO: 26065 - DNA, 88 bp, Homo sapiens
  misc_feature 1..88: note = chr1:14027035-14027123
  misc_feature 1..88: note = hyper
  source 1..88: mol_type = genomic DNA
gccgtggggtccctgcggcgaagttcgggattcggtttgtcgccgtgaagagccgcgcgccccgcgggggacgcgtgcgggctgcaga

SEQ ID NO: 26066 - DNA, 30 bp, Homo sapiens
  misc_feature 1..30: note = chr1:14219099-14219129
  misc_feature 1..30: note = hyper
  source 1..30: mol_type = genomic DNA
acagtagggttgggtcggctaagatgaagt

SEQ ID NO: 26067 - DNA, 339 bp, Homo sapiens
  misc_feature 1..339: note = chr1:14219335-14219674
  misc_feature 1..339: note = hyper
  source 1..339: mol_type = genomic DNA
ctgccccctttgcatcgccgcaccggggtggcggcgcgggctgggggccgctgcagcaggtctcagtccctccctgctgccacgcgaggagtggggagcggcagggcctaggcgtcccgagtggaggatgagccggagacgcctgcgggtccggagctgcaccgcgcccgtgcggcccgcgccgcccgcctcccgcgctctccctttggcagcagccggacgcctggcgcgtgcaggacctggggccgcggcgctcgcgcggggacgcgggagcccagggtcggcgctgcaggcagcggggcggcgccagcaaggccagctccccggggaccctggggc

SEQ ID NO: 26068 - DNA, 679 bp, Homo sapiens
  misc_feature 1..679: note = chr1:14924519-14925198
  misc_feature 1..679: note = hyper
  source 1..679: mol_type = genomic DNA
cgccaatattcagcccggctaagaagcttaggagctggctaaggctgctcctccacctggatgcacacacagggctagggctgtggagaggcgggagcaccagcggcccacgccgaggaagataggcgctccctcctggggtgggcagcgcaggtctggcctgcgggtggggggtggagagtgagaggcacgcggggcaccagctcagctcccctctggggatttcgtactcgcagtttaaggaaccggtggagcacgaactccactcctgagctggcgcaagcgtctcccttccatggagatccaccccggctcccctctgaggccccctttccaagcaccctctcttccgagcacccagcacctccccaaccttagcacggctcggggcaccagttctccagggcgggggctgccccaccgctcaagggaggggacagagggccggcctcggtccaggcgacccctgcccctcgccaggggcgccaccttggccccctcccgactgccgtccgccgcctccgcccccccggggggtgtgtctccgaagtacgggggcgcgggaggccaagggtgcccccagcctccgaccgagaccccctcccgagccggcggcgaatggtaggctccatttaaagagtgcctggtggcgcgcggtgtccttcttggagcagctctc

SEQ ID NO: 26069 - DNA, 869 bp, Homo sapiens
  misc_feature 1..869: note = chr1:14925199-14926068
  misc_feature 1..869: note = hyper
  source 1..869: mol_type = genomic DNA
gcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaaggtaggatcgccccggcgcccagggcggaggaaggcgagcagagcacgcccggcctcggaggtggccggggacccggggtcccccacacccggggcgaaatcgctttgcattctggcttgtaaccctttccgcccggcggtggccaccgctgctctccggctgggagttgcaggctgctgtcattcacgaaaacccgagcgcagtgtgcacggggtcacacggtcacaccggccccggccagcctgagcgaggcgcagccggcgggtcccttccggcatcagaaagtgccctttccgtggcaccagccccctagctccgtgcaaacttttcatgccggggccttttcccc

SEQ ID NO: 26070 - DNA, 35 bp, Homo sapiens
  misc_feature 1..35: note = chr1:15251220-15251255
  misc_feature 1..35: note = hyper
  source 1..35: mol_type = genomic DNA
gcagcgggaggcgtgcgggacgcagagtgagttcc

SEQ ID NO: 26071 - DNA, 81 bp, Homo sapiens
  misc_feature 1..81: note = chr1:15251499-15251580
  misc_feature 1..81: note = hyper
  source 1..81: mol_type = genomic DNA
gcgaaattgatgcctcgcatttgctaggagcggagagattgctgcgtttctcatacacttgaactccgagtaatgcagaaa

SEQ ID NO: 26072 - DNA, 48 bp, Homo sapiens
  misc_feature 1..48: note = chr1:15479729-15479777
  misc_feature 1..48: note = hyper
  source 1..48: mol_type = genomic DNA
gagaggtgagtatcccgccaggtaaaggcggggcggctggcggagctg

SEQ ID NO: 26073 - DNA, 156 bp, Homo sapiens
  misc_feature 1..156: note = chr1:15573605-15573761
  misc_feature 1..156: note = hyper
  source 1..156: mol_type = genomic DNA
ggagcattcagcaggcggtaacccagtgggcgttccctgcacggtgccacgccccctctgccgcgcaggccacgccctcatctattaggctggaccccgcggcgcctggcggcgttgccatggcaacgcgcgtacacaggccggccgggcgggcgg

SEQ ID NO: 26074 - DNA, 336 bp, Homo sapiens
  misc_feature 1..336: note = chr1:15930022-15930358
  misc_feature 1..336: note = hyper
  source 1..336: mol_type = genomic DNA
cgcttgagctgagtccgaaactcgcacagcaacctcgggaggataaactccagcaaccagaatcgggttggcgtcgcctagcaaccaggagccaaatgcgcggacgccaggcattggcctgcacgtgtcacgtgagccagcgccgctgcccagtgggagattacgccgcaggcacgtgatgcggcgcaaccgccctttggcagagcttttcgcgaaggcagttgtggctctgagcgcataggcgaggcattcctggggtttgcgccgtatccttttacaaagtcctggctttggctggtgcgaccaaagaaaggaaaccggcgcttgagacttgtc

SEQ ID NO: 26075 - DNA, 30 bp, Homo sapiens
  misc_feature 1..30: note = chr1:16375412-16375442
  misc_feature 1..30: note = hyper
  source 1..30: mol_type = genomic DNA
gcattccaggctggacgggtctctgggcag

SEQ ID NO: 26076 - DNA, 34 bp, Homo sapiens
  misc_feature 1..34: note = chr1:16533298-16533332
  misc_feature 1..34: note = hyper
  source 1..34: mol_type = genomic DNA
ctagagccaaccttccgcgcggacagtcgcgcca

SEQ ID NO: 26077 - DNA, 51 bp, Homo sapiens
  misc_feature 1..51: note = chr1:16542965-16543016
  misc_feature 1..51: note = hyper
  source 1..51: mol_type = genomic DNA
tgctgactgaaacagcgtctcccggttgtctgccaccgcctgcttggccag

SEQ ID NO: 26078 - DNA, 88 bp, Homo sapiens
  misc_feature 1..88: note = chr1:16553585-16553673
  misc_feature 1..88: note = hyper
  source 1..88: mol_type = genomic DNA
gcaggctcagttcctcggcgtagcacagcggctcccaggcgcgctcagctcggcgaagggtgcggcgctatgccggggtactctcctg

SEQ ID NO: 26079 - DNA, 274 bp, Homo sapiens
  misc_feature 1..274: note = chr1:16861468-16861742
  misc_feature 1..274: note = hyper
  source 1..274: mol_type = genomic DNA
tctccggggtggcgacgggaaagaaggtgggcttattgggtgcagctccacgggggctggcatctctgccgggctgtgtacacctgagcgagaagctcagtcgctctctaaagctgctcccgcggatgacggacacggagacaaataggaacggtgtgtcgtgagaggtggtccacaagcacttgccctccttcgcccggctttaaccccgctgcggagactgttctgcttctggcccttggagcaggccggctgacagcgtagtgaaggaaga

SEQ ID NO: 26080 - DNA, 30 bp, Homo sapiens
  misc_feature 1..30: note = chr1:17033955-17033985
  misc_feature 1..30: note = hyper
  source 1..30: mol_type = genomic DNA
tgggacccccgcgcccgggcagggccgtgc

SEQ ID NO: 26081 - DNA, 138 bp, Homo sapiens
  misc_feature 1..138: note = chr1:18152717-18152855
  misc_feature 1..138: note = hyper
  source 1..138: mol_type = genomic DNA
gggcccagcatcccacgggccattgtggaatccgtggagtcctgcgagatctccctgcgccccctgctggtctcccacgtgatggcctgcgggggcaacaccctctatcccgggttcacaaagcgcctgttcagggag

SEQ ID NO: 26082 - DNA, 65 bp, Homo sapiens
  misc_feature 1..65: note = chr1:18434751-18434816
  misc_feature 1..65: note = hyper
  source 1..65: mol_type = genomic DNA
gggggagggcgctggccggggtcgctccgagaggctcgggctacgagcaccggtcctgcccgggg

SEQ ID NO: 26083 - DNA, 33 bp, Homo sapiens
  misc_feature 1..33: note = chr1:18435496-18435529
  misc_feature 1..33: note = hyper
  source 1..33: mol_type = genomic DNA
tgtgtgtgtgtgtcccgccgtgtggacttgctc

SEQ ID NO: 26084 - DNA, 507 bp, Homo sapiens
  misc_feature 1..507: note = chr1:18436492-18436999
  misc_feature 1..507: note = hyper
  source 1..507: mol_type = genomic DNA
gctctccctggaacccgggagcagggttcttctggctgcccggctgcagagagctgacccggcatcctgacgcctcaaatccctttgcccgcctctgcgggctgcgggaggcgggggttggcgtgcctgagggtgagcgcatctgggccggtgcagccagcgcggcctcggagctccgctgctcaggatgaaggaagagcgcagacgcggatcgcgaatgggaaactttccgcgtctggggcgcagagggagatccgaggcagccgggagccctctcttctccgcagaggagagcacacgagggtggggtccctccttcctccttccaagtctgtgcccagaatggggggcggggtgcgagaagagtccgtgagagacgcaagaggcgggctgtgccggaggagggcgcccttcctggaggtggccgagagaggtgcacctggcagcggctttgcagggccacctgcctccgagggcgcagagaggagcaacccgcgccggccttca

SEQ ID NO: 26085 - DNA, 388 bp, Homo sapiens
  misc_feature 1..388: note = chr1:18437043-18437431
  misc_feature 1..388: note = hyper
  source 1..388: mol_type = genomic DNA
cgccctcgccggttctgcccctttgggtggcagagcaagggtgcccgacgctagagagtcgggtctggcaggaggaaggaggccgctgcccctcgcactggctgggccggaagtccttgccctggctccccacttcccagaatcagaccctccaaaggagaaacccacatttctcgggactcctgggcgtgtcctggggcgttttcaactcctccagcccccgtgaaccgtgcctgggcacttctgggaagtcctgcactggagcctgtgcagtggcgccgggctggggatggaggagtggtccttagccgctgttcagccctgggaaacgttccgctgagagcagggtgggggcagccccagttaggggtagcccacggccccagcc

SEQ ID NO: 26086 - DNA, 385 bp, Homo sapiens
  misc_feature 1..385: note = chr1:18437432-18437817
  misc_feature 1..385: note = hyper
  source 1..385: mol_type = genomic DNA
ggggtctccgggattgcgcgggcggaggtgggcggccctgcgggttctcgggttctcgggttctctgtctccgcagccgcgtgtcagcaggtggatgggatggaggggctgtctccgctaggccgccgcaaccgcaacgccgagactgcgggggctgtgcgcgcgcgagcgggtgtgacgactttatatatttatcctcccttcacacgcccccttcccactgggcggggcctctggcgcggcagggtttcttctccagccccaactgggggagttaagggccctaatcccttgcaggctgcctcgcccatgcccctccagcgtggccccgcccctagccataaactccacccctcttccaccccataaccgctctgcaaatggg

SEQ ID NO: 26087 - DNA, 30 bp, Homo sapiens
  misc_feature 1..30: note = chr1:18956225-18956255
  misc_feature 1..30: note = hyper
  source 1..30: mol_type = genomic DNA
gcgtggggccagagacgctctttcccccgg

SEQ ID NO: 26088 - DNA, 141 bp, Homo sapiens
  misc_feature 1..141: note = chr1:18956470-18956611
  misc_feature 1..141: note = hyper
  source 1..141: mol_type = genomic DNA
tgtatcaagtcttgacgggctccctccctcccatttcccacctctttgggcccccagatcctcacaccagcaccaactccctgtaaacccaactacctgctggaaaggagttataggcccggcctgggggcctgaggagga

SEQ ID NO: 26089 - DNA, 849 bp, Homo sapiens
  misc_feature 1..849: note = chr1:18956738-18957587
  misc_feature 1..849: note = hyper
  source 1..849: mol_type = genomic DNA
cggcaggaaggtagagtaagaaccggacaccggggctctgacattacacagaaaaggtcagaattcctcccttcaagtcaccctaggccggttcccggggagcctcactggaggaatttcagagggtgtaagacgagggagaagatgagaaatagggcggactctggccctcggaggccagagaaaaggcgagactccagagaggcgccggacccgaggcagacattcccatacagccgggactccgagagcagccgtgggcgacctgggggccggggactcggcggatccggcccattcatcaaaggaaggcactgggacaaagttggccccctccccttctcccccagcccccaactcgccgggatcggctccctctcttttcacggcggttcaaattctcccccaaaacgaggtcgagccggggattagaaaagagggaaaaaaatattcgttggcgatttcttttcgttattggtcctccgctcccttgcgccctggcccccttccctcctcatgaataaaagaaaagtccgaacctatcagatcgcgctcactgcctcctcctcctcctcctcctcctcctcctcgtacttcggtgaacacttttgcacaacttacccagctgatcactcgcgccccctcgcttttccatttctctttccccaaccccgtcaccccctgtctcctccgtccagccctgaaacccgaggaggctccttcttccgtctgtccccgggtctcctaggggacggggctgtgaaagctggtgtggagggagaagcgagtgtggtccggagaaagaaggcgtggagaagagggagggagcgagagcgagagaataaatat

SEQ ID NO: 26090 - DNA, 244 bp, Homo sapiens
  misc_feature 1..244: note = chr1:18957985-18958229
  misc_feature 1..244: note = hyper
  source 1..244: mol_type = genomic DNA
ttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaaggtaagaacgcccaggctggcctcgccgcgactccgccgcccggaact

SEQ ID NO: 26091 - DNA, 61 bp, Homo sapiens
  misc_feature 1..61: note = chr1:18958358-18958419
  misc_feature 1..61: note = hyper
  source 1..61: mol_type = genomic DNA
cgcttctgcgtgggtttcactgcccggcggccttcgtttcgcaggtcgctagctgccggtc

SEQ ID NO: 26092 - DNA, 58 bp, Homo sapiens; identical to SEQ ID NO: 5338
  misc_feature 1..58: note = chr1:18958829-18958887
  misc_feature 1..58: note = hyper
  source 1..58: mol_type = genomic DNA

SEQ ID NO: 26093 - DNA, 48 bp, Homo sapiens
  misc_feature 1..48: note = chr1:18959220-18959268
  misc_feature 1..48: note = hyper
  source 1..48: mol_type = genomic DNA
tgggctggcagcctgcgatccgggaggagctcccttgggcagcgagac

SEQ ID NO: 26094 - DNA, 121 bp, Homo sapiens
  misc_feature 1..121: note = chr1:18959269-18959390
  misc_feature 1..121: note = hyper
  source 1..121: mol_type = genomic DNA
gcgccgggtccctgaattagacagaggcgaagagagcggctccgtgatcaagtgcgcgccggcagccacgcaggcgggagagcgcgcaaacccggggatttgcagtggcactctcctgtag

SEQ ID NO: 26095 - DNA, 450 bp, Homo sapiens
  misc_feature 1..450: note = chr1:18959455-18959905
  misc_feature 1..450: note = hyper
  source 1..450: mol_type = genomic DNA
cgcagaatactgaggagagccgagtgccggtcgctaaagaggctcttgaatataaagttgggcgctcgagagctcttgagcgctaatggcatatcccgccacggagaccgagtgactccgactttgcgacgcacgatttctgattaaatccgagagtggcttcagacaccgacttttacaaagagaggtggggggaccgggagagcgagggagggggcggtaggaacggcccagcagcggagcctcttctcgcctcctccctttcaattacagtcagctccctccactcccgcggctgtgaaatcgttctaatcttccagatctccgcagccgctgagtccccaaattggggggatcgaggccggattagtgcgctgggtgtccccccaatcttctgtgaggaaattgtgtagactttgcattaaggcaaccaggcgttctcccctcccc

SEQ ID NO: 26096 - DNA, 107 bp, Homo sapiens
  misc_feature 1..107: note = chr1:18960897-18961004
  misc_feature 1..107: note = hyper
  source 1..107: mol_type = genomic DNA
gcccaccatggcatccggccctgtgtcatctcccgacagctgcgtgtctcccacggctgcgtctccaagattctttgccgctaccaggagaccgggtccatccggcc

SEQ ID NO: 26097 - DNA, 547 bp, Homo sapiens
  misc_feature 1..547: note = chr1:18962727-18963274
  misc_feature 1..547: note = hyper
  source 1..547: mol_type = genomic DNA
gaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaaggtagggaacttccctgggctgcgaggccccagcccgggttttcccacgctccggtgtgcgggccagtggttcgctcccgccgccggagcaggcgaccagaactccagcggagaaactctcatgctgcggggcagctgggagccgctcaggctttgccgacagcgccccctcggtgcgcaccccggatgccggctagatgcgaagcccgcgccttctttgcgctatggaggccgggcacggacggcctgtgagtcccgggagagcccggctgcggggctgcgcgcctggtctaccccaatactgcggggagtgcgtcctcccgggctggcgttttggctgctactctcggcgtcgatcaattatttataggaaacttgggcaagggggcgggggacgggagggagggaga

SEQ ID NO: 26098 - DNA, 182 bp, Homo sapiens
  misc_feature 1..182: note = chr1:18963662-18963844
  misc_feature 1..182: note = hyper
  source 1..182: mol_type = genomic DNA
aagcgcccggaagcccgggaaaggggattgtgcttttgtttcttgacgggaggaagtttcgagagaaggaagggaaagtttttcctcattaccccctccccttcctcattgccctcataattcccctcctaagtctctttgagacttggtaagtgcacgttaaggggcgacagggagagaaa

SEQ ID NO: 26099 - DNA, 129 bp, Homo sapiens
  misc_feature 1..129: note = chr1:18964285-18964414
  misc_feature 1..129: note = hyper
  source 1..129: mol_type = genomic DNA
ggcccctagtgatgccgcagtcccgcccgggacaaaagggcgagggaagaaagggagccagctgtgccgggcgccccgctgtgcccggcctgccgaggggccacgggtctgcggcgggaggcagccctg

SEQ ID NO: 26100 - DNA, 41 bp, Homo sapiens
  misc_feature 1..41: note = chr1:18966656-18966697
  misc_feature 1..41: note = hyper
  source 1..41: mol_type = genomic DNA
tggagtgggaaatgacggggaaggatcggaaaggaggggag

SEQ ID NO: 26101 - DNA, 129 bp, Homo sapiens
  misc_feature 1..129: note = chr1:18968003-18968132
  misc_feature 1..129: note = hyper
  source 1..129: mol_type = genomic DNA
tggggtcccccgctgcgagggcgtgcgggttttgtgttcccctcggggcacgcaccgccacacttgggctgtttcaaggcgtttgtacctaaaagactagtgtgcacggcgcagcggttaaaggaatta

SEQ ID NO: 26102 - DNA, 1308 bp, Homo sapiens
  misc_feature 1..1308: note = chr1:18969493-18970801
  misc_feature 1..1308: note = hyper
  source 1..1308: mol_type = genomic DNA
gcgaagggagggggtcggctgcacttggaacttcaacctcctgggagaggaaaagcgtctgcgggtcgctacagcctcgggaggggtgaagggaagttgtgtgcgccccaagtccagctcaaaagaggccccgagggcattctagggcgccttgggcacgcgtgccaggcccccggtttggcagccgagctgagcgagggtggattgcgaggggcactggggccgccgcggagctctgcgtgtcggctgccagtgaattggccgatttccccagtctgagggtcagcgaacggacctttccatggcttggtcgccctggtcctggaggtgcgctgggcccgagctccggtggagaccaagggaggggtggggagaggcagcggagacagagagccacagaggaggagagagctagaaaattcagagtgagaaagtctgagcgcagcagaagagaatcttgcgcacagtttgaggacgctggaaaatgcggaggcgccgagggaggcgccgagcagcaggaagaaagacaaagagatgcagaatcaccgagagactggccctgggacaggcggatcaggagagccagcgggacctagagacagcccgcgggagagcacgggccgagagggcgagtgctcaaagccgggcagcggctaggggaagataggaggcgggcgagccgcggccgcccttttgatccttcgtggcttcgccttatcagaagcgctttcggtgacatccgcacaaaggcagttcatcatattacagcacgtcccggcggctcgctgcgatcctgccgcttaattagaggcgagcgagctgggccggcagggcgggagggaggccgaccccgaggcgggaggccgggttctgcgctccaacccggggcgctgggcaggggccagcccgcgtgcctggcggtgttgggacgtggagagagggagaggccgggaactgcattcagagcgttgctaaattaacaggccggcccgggcttcactgcccggagagtgaagctcgccgccttccaatttagccgccgccccttctaagttcttgggaagggatggcgctccggccactttcccctcttccaggctgcgaacgctgcggactggagggcgagtaatggggaggcaacccagggcgagctgaaggcttagtgcaactccgggtccaggtcgcacccaccagccccccgcggctgtgttccatcccctcctccgaccgccttgctctccatccgaacccaggtgtgccaggctggagcaatctgagaggggcaaagtgcatcgtggtcgaggttct

SEQ ID NO: 26103 - DNA, 190 bp, Homo sapiens
  misc_feature 1..190: note = chr1:18971739-18971929
  misc_feature 1..190: note = hyper
  source 1..190: mol_type = genomic DNA
ggctgggccttgcttcgccacgggttcgagggagaggcggagggaggagcggctgggctgcggagcctcttgccttcactgcactctttgtctgacaccacgaaaagaccgaagatcaaagaggcccccgagcgggacagaaaaaggggtggggcggcgggcgcgataagtagctcggaaaactccaccc

SEQ ID NO: 26104 - DNA, 38 bp, Homo sapiens
  misc_feature 1..38: note = chr1:18972986-18973024
  misc_feature 1..38: note = hyper
  source 1..38: mol_type = genomic DNA
gcaggaaattagggccgggaaagcggtttggaaactgg

SEQ ID NO: 26105 - DNA, 73 bp, Homo sapiens
  misc_feature 1..73: note = chr1:18973661-18973734
  misc_feature 1..73: note = hyper
  source 1..73: mol_type = genomic DNA
gctgggtcagctgcccgcgccggccagcggaggggaggggggcaaaggacctgggctccgccgccactgccgc

SEQ ID NO: 26106 - DNA, 13 bp, Homo sapiens
  misc_feature 1..13: note = chr1:19043054-19043067
  misc_feature 1..13: note = hyper
  source 1..13: mol_type = genomic DNA
tcttttctccctt

SEQ ID NO: 26107 - DNA, 29 bp, Homo sapiens
  misc_feature 1..29: note = chr1:19043114-19043143
  misc_feature 1..29: note = hyper
  source 1..29: mol_type = genomic DNA
cgtctccctgatcgcgtcataaccctgag

SEQ ID NO: 26108 - DNA, 391 bp, Homo sapiens
  misc_feature 1..391: note = chr1:19043352-19043743
  misc_feature 1..391: note = hyper
  source 1..391: mol_type = genomic DNA
cctctcccccacccccgtgtcccctttccgaattcctccgctgctggtgggctccgaggcagggaccgggcgcgggctcccgaggccgggcggacccaagtccagggcgggggttggggcggcggccggagcggggatcgggtctggggggatccgcgcggccgcccctccccgcgctccgccgccgccgccgtcgccgccgcgcctttgatccatggcccgaggccgcctgacagtggaaaatgcggggagacaaaaccactcagtcaaagtgattcccaacaactgtctccccgagataaggacgccctcgggctcggcggcctgcttaattcccgctgcccgggcctgggatcccgagcagccgcgcgcctggccgccccccggactg

SEQ ID NO: 26109 - DNA, 151 bp, Homo sapiens; identical to SEQ ID NO: 5351
  misc_feature 1..151: note = chr1:19043756-19043907
  misc_feature 1..151: note = hyper
  source 1..151: mol_type = genomic DNA

SEQ ID NO: 26110 - DNA, 74 bp, Homo sapiens
  misc_feature 1..74: note = chr1:20512379-20512453
  misc_feature 1..74: note = hyper
  source 1..74: mol_type = genomic DNA
aggagagaaggaggccgcgggtccctgtcgcctccaggccaggcaatccactccaggctcgcaatccaccgacc

SEQ ID NO: 26111 - DNA, 413 bp, Homo sapiens
  misc_feature 1..413: note = chr1:20618140-20618553
  misc_feature 1..413: note = hyper
  source 1..413: mol_type = genomic DNA
gcagggtgcccaccccggcagccgggctcatgcctgctgcccttcggatgccccgcagcttgtgaccatccccagagccaccggccaagggcacaccctttcctgagccccgtgtctcctgcaaggtaagaggggaaggagaaaaggtcctcgggcagaaggaggcggctagtggagaggaactcagcagcgggtgcagtgtggcgcctgctaacgcatcaagcctccgctggaagttccaccataacgtctgcggcagccccaacagttccaccccatgctcccgccgccggcaccacagcagcagaaggaggcctgtggggcgggggccagaacctttccctcctcccttctgaagagcaacaggcgtcacaccatcctgcctctcccactaaccccgttccttcttttgc

SEQ ID NO: 26112 - DNA, 150 bp, Homo sapiens
  misc_feature 1..150: note = chr1:20669698-20669848
  misc_feature 1..150: note = hyper
  source 1..150: mol_type = genomic DNA
ggtcaaaggcctgcacgacagccaacgcctgcagtgggaggtgagcttcgagctggggacccctggaccggagcggggcggcgcgcaggatgccgacctatggagcgagaccttccaccacctggcggcccgcgccatcatccgcgactt

SEQ ID NO: 26113 - DNA, 38 bp, Homo sapiens
  misc_feature 1..38: note = chr1:20669896-20669934
  misc_feature 1..38: note = hyper
  source 1..38: mol_type = genomic DNA
cggaactgcgcccctcccgcggacggcctccggaggac

SEQ ID NO: 26114 - DNA, 40 bp, Homo sapiens; identical to SEQ ID NO: 5354
  misc_feature 1..40: note = chr1:20692819-20692859
  misc_feature 1..40: note = hyper
  source 1..40: mol_type = genomic DNA

SEQ ID NO: 26115 - DNA, 203 bp, Homo sapiens
  misc_feature 1..203: note = chr1:20810635-20810838
  misc_feature 1..203: note = hyper
  source 1..203: mol_type = genomic DNA
aggtgcggagatgagcggaaccaggaggggacgccaaaaccggttcccacgacgcgcagcgggtgggggttagggcctggcctgggcgggcgccccctcctgcgcgccctctcccagccgctggccgactgactcggccgccccgcgctccccgctgccgcagaggtcagagcctcccttcgctgcctgccagggacacatgc

SEQ ID NO: 26116 - DNA, 47 bp, Homo sapiens
  misc_feature 1..47: note = chr1:20810864-20810911
  misc_feature 1..47: note = hyper
  source 1..47: mol_type = genomic DNA
cgacttagcctcgcctttctcagtccctccatcgtccctcggcgcga

SEQ ID NO: 26117 - DNA, 148 bp, Homo sapiens
  misc_feature 1..148: note = chr1:20878512-20878660
  misc_feature 1..148: note = hyper
  source 1..148: mol_type = genomic DNA
tcagctcaggcccagcggtctggcccacgaccttggaagaacctgggagaaagcttcaccaagcgacagtacttttccactgcactgctcggccacctcggctggctttgtgctgtgcagacgaggcaaagtgcgccaggccagcccc

SEQ ID NO: 26118 - DNA, 124 bp, Homo sapiens; identical to SEQ ID NO: 5357
  misc_feature 1..124: note = chr1:20878905-20879029
  misc_feature 1..124: note = hyper
  source 1..124: mol_type = genomic DNA

SEQ ID NO: 26119 - DNA, 199 bp, Homo sapiens; identical to SEQ ID NO: 5358
  misc_feature 1..199: note = chr1:20879030-20879229
  misc_feature 1..199: note = hyper
  source 1..199: mol_type = genomic DNA

SEQ ID NO: 26120 - DNA, 182 bp, Homo sapiens; identical to SEQ ID NO: 5359
  misc_feature 1..182: note = chr1:20879255-20879437
  misc_feature 1..182: note = hyper
  source 1..182: mol_type = genomic DNA

SEQ ID NO: 26121 - DNA, 1143 bp, Homo sapiens
  misc_feature 1..1143: note = chr1:20879462-20880605
  misc_feature 1..1143: note = hyper
  source 1..1143: mol_type = genomic DNA
cgcgatgctgccctggagacgtaacaaattcgtgctggtggaggacgaggccaagtgcaaggcgaagagcctgagtccggggctcgcctacacgtcgctgctctccagcttcctgcgctcctgcccggacctgctgcccgactggccgctggagcgcttgggccgtgtgttccgcagccggcgccagaaagtggagctcaacaaggaggacccgacctacaccgtgtggtacctgggcaacgccgtcaccctgcacgccaagggcgacggctgcaccgacgacgccgtgggcaagatctgggctcgctgcgggcctggcgggggcactaagatgaagctgacgctggggccgcacggcatccgcatgcagccgtgcgagcgcagcgccgccgggggttcggggggccgcaggccggcgcacgcctacctgctgccgcgcatcacctactgcacggcggacgggcgccacccgcgcgtcttcgcctgggtctaccgccaccaggcgcgccacaaggccgtggtgctgcgctgccacgctgtgctgctggcgcgggcgcacaaggcgcgcgccctggcccgcctgctccgccagaccgcgctggcggccttcagcgacttcaagcgcctgcagcgccagagcgacgcgcgccacgtgcgccagcagcatctccgcgctgggggcgccgccgcctcggtgccccgcgccccactgcgccgcctgctcaatgccaagtgcgcctaccggccgccgccgagcgagcgcagccgcggggcgccgcgcctcagcagcatccaggaggaggacgaggaggaggaggaggacgacgcggaggagcaagagggaggagtcccccagcgcgagcggccggaggtgctcagcctggcccgggagctgaggacgtgcagcctgcggggcgccccggcgcccccgccgcccgcgcagccccgccgctggaaggccggccccagggagcgggcgggccaggcgcgctgagagccgaaggacaggactcgcagccccaggcccgacccgccagactcacagcctccaaccccggccctgcccgcttcggctgccccggcccccggcccgtgtctcccccgtggtctccgtgttgtccgccccgccgcctcattttggct

SEQ ID NO: 26122 - DNA, 57 bp, Homo sapiens
  misc_feature 1..57: note = chr1:20916163-20916220
  misc_feature 1..57: note = hyper
  source 1..57: mol_type = genomic DNA
ctaagtgttaatgctcgtctttagatgaaactacggaggtctcgagaggtgacatga

SEQ ID NO: 26123 - DNA, 140 bp, Homo sapiens
  misc_feature 1..140: note = chr1:21044081-21044221
  misc_feature 1..140: note = hyper
  source 1..140: mol_type = genomic DNA
ggatgcagcactgggcgcgcgcgcagtccacagtcaccacgggctggcagcgcagctctcgctcccgctggttcatgggacggcagcgcacgacaaccttcaccgcctcggaggccatggcgccgcgcccaggaccaacg

SEQ ID NO: 26124 - DNA, 66 bp, Homo sapiens
  misc_feature 1..66: note = chr1:21058309-21058375
  misc_feature 1..66: note = hyper
  source 1..66: mol_type = genomic DNA
ccccggcagagtccccggacccaggagcgtgctgggctccgctgcaggggacggaggaggctacag

SEQ ID NO: 26125 - DNA, 127 bp, Homo sapiens
  misc_feature 1..127: note = chr1:21754473-21754600
  misc_feature 1..127: note = hyper
  source 1..127: mol_type = genomic DNA
ataagccagggggggcgttctcggcgcggagtggagtggagcggagcgggctggtgctgggggcgcggagagcgcagtgctggccggggccgggagcggggccgagcgggagcggagtcgggcgtcg

SEQ ID NO: 26126 - DNA, 174 bp, Homo sapiens
  misc_feature 1..174: note = chr1:21835408-21835582
  misc_feature 1..174: note = hyper
  source 1..174: mol_type = genomic DNA
agagagacagggacacgtgggcagagacggataaagacagagacccagagaaagccagatatgttgacagacacagagacagacgccagagaggaaggcagacaaagagacgggtggagacaaagactcccaccaagagacgcagaaggaagatgccgacggtaaagacaaaac

SEQ ID NO: 26127 - DNA, 317 bp, Homo sapiens
  misc_feature 1..317: note = chr1:21836071-21836388
  misc_feature 1..317: note = hyper
  source 1..317: mol_type = genomic DNA
cccttctgcatcctccgctggccccgtggttgaactttaatggcagggccggggtctccagcgccacgccgcccacagcagcccattcgggacgccctgcaattggtcctgcccctgtcctcccgcgcatcccaagctcccggcgcgcgctctgggcgggacaggagattggacgtggcgcccgcggagccggcgaactcaggggaccgcgctcgggaccgccctgcagtcccagggtctcctacctcccgagccgctgcctgggaccctgcgctctgtctgggcacctgcccttggtgccccgtgactgagcccct

SEQ ID NO: 26128 - DNA, 351 bp, Homo sapiens
  misc_feature 1..351: note = chr1:22140663-22141014
  misc_feature 1..351: note = hyper
  source 1..351: mol_type = genomic DNA
cgcatcttagggtttcgaataagggattgtagatttgaattaaattaaattaaatcatttaatccttacaatcattctgagattgattaatcatccccattttaccgatgaggaaaatgaggctcagagagggcgagtaactcgcttgggatcacacagcgggcaggggacagagtagagttcggggtcgcgccgcgcggctccagtttccgtgccttccgctgcagccgacctggcggaactgtgcgggcagacgtggcagggggacgggctgctgctgcgctcgcacgccgcatcgcgcaggttctacttcgtggctccggacaccgactgcgggctctgggtgcaggc

SEQ ID NO: 26129 - DNA, 293 bp, Homo sapiens
  misc_feature 1..293: note = chr1:22141015-22141308
  misc_feature 1..293: note = hyper
  source 1..293: mol_type = genomic DNA
gcagcccccggcgaccggatccgcttccagttccgcttcttcctggtctacagcctgacccccgcgcccccggcgctcaacacctcctccccggccccggccgacccgtgcgcccccggctcctacctgcagttctacgagggcccgccgggggcgccccggcccctggggtccccactgtgcggcctgaacatcccggtgcctgtggcatcctccggaccctttctaggcctgcgcctggtcacgagaggccgccagccccgcgtggacttcgtgggcgaagtcacctcttt

SEQ ID NO: 26130 - DNA, 140 bp, Homo sapiens
  misc_feature 1..140: note = chr1:22889622-22889762
  misc_feature 1..140: note = hyper
  source 1..140: mol_type = genomic DNA
ggtgttggggtcatgcgggcaggagcgagcatgcggtggatgtgcggcccgcgcgtgtgtccacagagggaatccctgggtgggtctggtcctggtgtcgccgggacgtcccgatggtggcttcgcgcactggggccctg

SEQ ID NO: 26131 - DNA, 30 bp, Homo sapiens
  misc_feature 1..30: note = chr1:22890079-22890109
  misc_feature 1..30: note = hyper
  source 1..30: mol_type = genomic DNA
ccaagcccgagggtgcgtggcgcccccgcc

SEQ ID NO: 26132 - DNA, 48 bp, Homo sapiens
  misc_feature 1..48: note = chr1:22933907-22933955
  misc_feature 1..48: note = hyper
  source 1..48: mol_type = genomic DNA
ttctgctgccacctccgcttccctcagcgactgcggaagcctcatcag

SEQ ID NO: 26133 - DNA, 73 bp, Homo sapiens
  misc_feature 1..73: note = chr1:23038177-23038250
  misc_feature 1..73: note = hyper
  source 1..73: mol_type = genomic DNA
gccgcgcaaggtctccgggcacccccgccggccaccgccccgcggccgcggcgctcagcgtggcggctggagc

SEQ ID NO: 26134 - DNA, 287 bp, Homo sapiens
  misc_feature 1..287: note = chr1:23748862-23749149
  misc_feature 1..287: note = hyper
  source 1..287: mol_type = genomic DNA
gtatgtagctgtgaccgtaggcacttggttgcatgtttgaagttgcttctgttagtgcatgctcagaggatgtgacaaagccttaagtggctgagacttcagcaaccggcagtaaaccccgggcctgagctgcaacgtggaggatccgtcttattacaggaagtatgtcctcctctgcctaaccactgctgggcgggtccactttcactcccagagcaggccccacctttctcggccagacgcccagagctccatgcccacccagacactgccgagagcccaggcgc

SEQ ID NO: 26135 - DNA, 69 bp, Homo sapiens
  misc_feature 1..69: note = chr1:23884932-23885001
  misc_feature 1..69: note = hyper
  source 1..69: mol_type = genomic DNA
ggagcagtcagtttccgccgagcgtgccgaggcgggggccgtccgcagactggccggcgccagggagga

SEQ ID NO: 26136 - DNA, 80 bp, Homo sapiens
  misc_feature 1..80: note = chr1:24648262-24648342
  misc_feature 1..80: note = hyper
  source 1..80: mol_type = genomic DNA
gaagcatggaggccccggcggtgtagttagaaaccagctggaggtggctggcgggtgctgagcgccgggcctttcatgtg

SEQ ID NO: 26137 - DNA, 812 bp, Homo sapiens; identical to SEQ ID NO: 5370
  misc_feature 1..812: note = chr1:25256012-25256824
  misc_feature 1..812: note = hyper
  source 1..812: mol_type = genomic DNA

SEQ ID NO: 26138 - DNA, 186 bp, Homo sapiens
  misc_feature 1..186: note = chr1:25257156-25257342
  misc_feature 1..186: note = hyper
  source 1..186: mol_type = genomic DNA
gggcctgtgacttctgcaaccccgggctgggggccgcggggtctcagggccggtgacgccgcactgggagccgccccaaagaggttactcacctccctcgtcccgcacattattctgacccaagagcctccaccccacacgggattttgcgcgtcgtccacgcccggccggcggcctttgctgctc

SEQ ID NO: 26139 - DNA, 117 bp, Homo sapiens
  misc_feature 1..117: note = chr1:25259018-25259135
  misc_feature 1..117: note = hyper
  source 1..117: mol_type = genomic DNA
tccttgccatccatgcggccaggtctcagacaaaccgatggctttgtgtcaaaccaaggccgccttcctcacctctgataagatggacgccttctgtcttcgcgttttcaggcaccc

SEQ ID NO: 26140 - DNA, 103 bp, Homo sapiens
  misc_feature 1..103: note = chr1:26249061-26249164
  misc_feature 1..103: note = hyper
  source 1..103: mol_type = genomic DNA
ctcccaccccacctgcggcttgcacagcgacacacaagcgttgtgattggctcttccttggctgagacaagggtggggaccgaaatggcgtctctaacagctg

SEQ ID NO: 26141 - DNA, 196 bp, Homo sapiens
  misc_feature 1..196: note = chr1:26249400-26249596
  misc_feature 1..196: note = hyper
  source 1..196: mol_type = genomic DNA
agaagcccagacccccgggcgcacgcggccgcgcccacccaggtcgctgggaggtgcccgcccgggaggcgccgcggccagtgcctgccgttagcttcaggaagaactaggattgagtaagaaacgactagggatggaagcacttggcactccgggtctcggagcaggctggggacgcccgcggcaggaacctggt

SEQ ID NO: 26142 - DNA, 113 bp, Homo sapiens
  misc_feature 1..113: note = chr1:26372988-26373101
  misc_feature 1..113: note = hyper
  source 1..113: mol_type = genomic DNA
agaggctactggggccgcgtctgccccctccgactggcggctgccctgggcttgatcatgttcccctctcaggccggagaccccccgaggtcggcttgcgttcctgtcctcct

SEQ ID NO: 26143 - DNA, 479 bp, Homo sapiens
  misc_feature 1..479: note = chr1:26551728-26552207
  misc_feature 1..479: note = hyper
  source 1..479: mol_type = genomic DNA
cgcgggcaagacgcccatgccaaccagtgagtgggcagccccgggacctcctgcgcagccgccgcagccttgcctgcaaagcagttcctgccgggcaggctgggtagccggactcccagctgcgccgtcttcacggaagcggtgctgatgcgggacctgggggactgcggtgctggggactggccagtcctaccgggggcggggcttgtggaagactgggcgggattttgaagacctaggtcttgtggatggtgaactcacttggggcggggagggaggtggggctaccctggggtcttgggcaaagtcctcgcctggccggcttcgctacccttgtgcttgcgttgcccacaagcttgtagtcagaagaactcgcctgggagggatcgctcctgggagatccgaacgcgggagggcctggagcgcggcggcagctggatagcattcgggcccatccgaataagcggtaaatggatcat

SEQ ID NO: 26144 - DNA, 121 bp, Homo sapiens
  misc_feature 1..121: note = chr1:26735162-26735283
  misc_feature 1..121: note = hyper
  source 1..121: mol_type = genomic DNA
tgggaatcaagacagcgtgactcaattcagcaccgtggacagagctgctggagccctcaggaccctggacagagaagcaggccgcgcattcccggggaaccgaattcgcatcacttgagaa

SEQ ID NO: 26145 - DNA, 309 bp, Homo sapiens; identical to SEQ ID NO: 5374
  misc_feature 1..309: note = chr1:26735645-26735954
  misc_feature 1..309: note = hyper
  source 1..309: mol_type = genomic DNA

SEQ ID NO: 26146 - DNA, 702 bp, Homo sapiens
  misc_feature 1..702: note = chr1:26737181-26737883
  misc_feature 1..702: note = hyper
  source 1..702: mol_type = genomic DNA
ggggagggggctgcccgcggggggttgggtcattgtcttttagaatttgggagcctttgaaaagccgtgggccctcccaccgctattgtgcgggggaagatgtagcagcttcttctccgaaccaaccctttgccttcggacttctccggggccagcagccgcccgaccaggggcccggggccacgggctcagccgacgaccatgggctccgtgtccaaccagcagtttgcaggttcgagctcgggacttagcggggacactttaggattcaggggcggccaggagccacgtagaagggaggtggggaactgagtcctaggctgcccaaaggaccccaagacggtgcggccttctgcttcatagggccgtctctggggccaggaaccttggtgtcccagtggcgtgcgcgccagactacgtgggtggatggagaggagaggcttgtcccgccgtgagtctctgggaaacgcgttgtgggaagaggagcaaaactttcggggcactactgtcccggtgtacgctaggggaacgcgggaggcgaccgggataggtttcttctcttctgttgcttggtagctgccccctcctggctgtccacttgtggggctggatactcgggtctccctgcctggggcccgagacggccctccgattccgtgccccccagctaagtgcccggccctccctctctccaggtggctg

SEQ ID NO: 26147 - DNA, 417 bp, Homo sapiens
  misc_feature 1..417: note = chr1:26737907-26738324
  misc_feature 1..417: note = hyper
  source 1..417: mol_type = genomic DNA
cgaggaggcgccggaggacgcggcccgggcggcggacgagcctcagctgctgcacggtgcgggcatctgtaagtggttcaacgtgcgcatggggttcggcttcctgtccatgaccgcccgcgccggggtcgcgctcgaccccccagtggatgtctttgtgcaccaggtgagactgattccggtaactttgcccagggaagggcgtctaggcgcccatatccacgggtgggctccgggctcgcagttgaattgagggccatcgggagccctcattatgcatccctgtctttgcttcggcaccccaattctgagtccctgttaactatctcgtgggggagtagtgggaggcagcaccaattatcagcacccccgcccccttccgggaacccctccggcttaccacgtgtctattacctc

SEQ ID NO: 26148 - DNA, 442 bp, Homo sapiens
  misc_feature 1..442: note = chr1:27960654-27961096
  misc_feature 1..442: note = hyper
  source 1..442: mol_type = genomic DNA
ggggctgcgcccacccggagccccgcggcggcccagcgcggcccgccctctcgttgccttggaggcagcccctgcgggcactcgcggtcaaaggcaggatttccgtcggggcggcagcaattcccggatccagcggggagcgcgggccgagaccgccgcgggcgcggagggggcgcccggagaggcctgtccctgccgagggcggggacttccccaggaagcggggacccacgcctcgcgcgcccggcaggagtcccctgcagcccggaacctaccgcaagggcgggccgagagggtcgcggggccgcggtcgcggccgctaacgttaccctgcgggctgtgggcttcaccccgacttcggccggctcggaagaggggaacttcctggacccgcaattgcaccccaggttctccgtcctccagaagtcgttctcctcaaccc

SEQ ID NO: 26149 - DNA, 328 bp, Homo sapiens
  misc_feature 1..328: note = chr1:28199304-28199632
  misc_feature 1..328: note = hyper
  source 1..328: mol_type = genomic DNA
tgtgtgatttggggccgcactcaacctctttggacctcggcttttgctttcgtggaacggggaccgctgacctgccccgcagggtagtgatgaaaagtcagtgggttgaggcgcgggaggtggatgcagccgggccactcctaggtggccccgcggtgcgcatgggacagagctccgaccgcgccgggacgcagcattaggccgctggtggtcgtggctgcgtcttgattctgaagtgcagggtcagtcttcccgtctgtgtcctcccactcctcccccggccctcctctacactgccttccttcagtccctgcgtccaccttggcct

SEQ ID NO: 26150 - DNA, 405 bp, Homo sapiens
  misc_feature 1..405: note = chr1:29138552-29138957
  misc_feature 1..405: note = hyper
  source 1..405: mol_type = genomic DNA
tcccctgcccagctccgagccggtggtgcagcgtccgcccccggtcgcgggcgcagactggcggccgcctccgggccacgtggtgcgcgcggcgggcgcgtccgaggagcctgcggctgctcctggctcacagcgctccgggcgaggagagcgggcggacgccgggggctgggccggtgcgggcggcgaggcaggcggacgaggcgcagagacagcggggcggccggggcgcggcagccggcggcgtcggggccgcggcctctgccttgccgctcccctcgcgtcggatccccgcgcccagggcgcacggtggagagggacgcggcggagccggccggcagccatggaaccggccccctccgccggcgccgagctgcagcccccgctcttcgccaacgcctcgga

SEQ ID NO: 26151 - DNA, 237 bp, Homo sapiens
  misc_feature 1..237: note = chr1:29448530-29448767
  misc_feature 1..237: note = hyper
  source 1..237: mol_type = genomic DNA
cgcgctcgggttttccgcagcggagctccgagccaggcacgcgcggcagaagccggagttggcccggccagcgggcggagaggagggaggggggcgcaggctgttccctggcgcatcccgggctgcaaatctgccgcctgcgtccggtccgcaagcccgcgggtcttgggcctcgggaaacgtgcggcccccagctgccgcgtctccagggtaagtacctcccgggctcgaccccac

SEQ ID NO: 26152 - DNA, 112 bp, Homo sapiens
  misc_feature 1..112: note = chr1:29449783-29449895
  misc_feature 1..112: note = hyper
  source 1..112: mol_type = genomic DNA
gccggggagactgcccgaccccgcactaggcgggggctctgccaggtccgacgccgggctccggggccccagccctagacccctctcaggacagccacgggagtatccagga

SEQ ID NO: 26153 - DNA, 816 bp, Homo sapiens
  misc_feature 1..816: note = chr1:29586042-29586858
  misc_feature 1..816: note = hyper
  source 1..816: mol_type = genomic DNA
cagagcggccgaggccgaacgcttcctcttgcaagtgagcgggagcggtgatcttggctgggggcggggtgggagggggttggtggctgcttctggccctgactccccccagattgctgagtccctgcttcatactccagcactgcgcacagcgtcccggccctcccctagctctgctctgcgctttcttgggtcccccattcccccaggttagagcgcggctccaggaacctatgtccgcgcggtgtagtagggacggctaaatggggcccgggtcagagcgagatcgggacccctcgctccgaggcgcccctgaccccctcactctcttccctgcagcggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaagggtcagctggtggacgccggggagcgccgggacctcaccctcgaggggcggggccggcgacgggggcgggctctgcccgggggcgtggccgtggggggtggggccggcagggtgtcgctggggcgctatctgaagatgggcctgtggaaatggcagtggcccagccgggatgagatctgatctaggggtcggggctggcttcgagggggacggacagggtcaaggtgagagcctaaagaggggtggggttctggctgtgtgacttctgtgttgatcctagctggcctgcggtccgctccagga

SEQ ID NO: 26154 - DNA, 140 bp, Homo sapiens
  misc_feature 1..140: note = chr1:29804985-29805125
  misc_feature 1..140: note = hyper
  source 1..140: mol_type = genomic DNA
ggccatctcagggaccgtgtcggggggtgctgactctgcccatcaaggggagccggacatttatccgccaaagcccgtccctcgcggtgagggtcgctcctgggtgtgggacccctggcttcccgcgctgccctgcccgg

SEQ ID NO: 26155 - DNA, 30 bp, Homo sapiens
  misc_feature 1..30: note = chr1:29805353-29805383
  misc_feature 1..30: note = hyper
  source 1..30: mol_type = genomic DNA
gcacccccaacttcacgctaaatgcataat

SEQ ID NO: 26156 - DNA, 166 bp, Homo sapiens
  misc_feature 1..166: note = chr1:30559014-30559180
  misc_feature 1..166: note = hyper
  source 1..166: mol_type = genomic DNA
accaggaggaggtggcggaggtcccgggggccgccccgcctcgcagcctgggctctgcctgctctgcgtccacgccagcataagccccagccggctccgtctcccctaacgactctaattaccagccaagctcggctccccaaggcccaggcgccagaactgatga

SEQ ID NO: 26157 - DNA, 388 bp, Homo sapiens
  misc_feature 1..388: note = chr1:30815454-30815842
  misc_feature 1..388: note = hyper
  source 1..388: mol_type = genomic DNA
cggcaggtccttgcagaggaggggctcttcccaggagggcgctccagccgaggcccctctgccttcacctgcgccatgaccacttccctcggccctctcccctcctccacgcctcctggggccgctctccagggtcctgggacgagaccagccccgggcagggcagcgcggggagccaggggtcccacacccaggagggcccctcaccgcaagggacgggcttaggcggataaatgtccggctcccctcgaggggcagagtcagcaccccccacacggtccctgagatggccctgggaccgagccgccgcccccgacttgtgattcagcctcttcctgcctggctttcccctccccactgtgcctcctgggatcgcctcccaaatcag

SEQ ID NO: 26158 - DNA, 223 bp, Homo sapiens
  misc_feature 1..223: note = chr1:31157994-31158217
  misc_feature 1..223: note = hyper
  source 1..223: mol_type = genomic DNA
cagtgggaacaaggacgaccgtcgaggaacccgacaaatgaattaaaccagcaccagcgtgatgagcaaagcggagaaggaaagagggcgctgtgaggagagcgaggctcctccgggaaagctccttctgctccaggtgacagcggagagagatgccaccgcgcggcgaccggcagggccgcgtcccctctgcgtcctagcacagcgacgccccgcccgccac

SEQ ID NO: 26159 - DNA, 34 bp, Homo sapiens
  misc_feature 1..34: note = chr1:31712624-31712658
  misc_feature 1..34: note = hyper
  source 1..34: mol_type = genomic DNA
ctttgtctagcgggccgtccgtcaggcgcgcctc

SEQ ID NO: 26160 - DNA, 287 bp, Homo sapiens
  misc_feature 1..287: note = chr1:31846347-31846634
  misc_feature 1..287: note = hyper
  source 1..287: mol_type = genomic DNA
ggttgacttctggcacgggcatctgtcctcgttttacaagtgaggagtccgaggctcacaggggaactgacaaggtctcaagaaataggagggggtgaatggagctcagattgcaagcttagtctagcgggcttcagagctcgcgctctcccttcactctcactgcctggtggcggagacagtcaccagcggctcggtctgcggctgagctgaccttgtcctctgcctgttttgagcaaaagcctgacccttcgcgccccgcccgcctcacacgtgcttgcccctcc

SEQ ID NO: 26161 - DNA, 230 bp, Homo sapiens; identical to SEQ ID NO: 5384
  misc_feature 1..230: note = chr1:32180184-32180414
  misc_feature 1..230: note = hyper
  source 1..230: mol_type = genomic DNA

SEQ ID NO: 26162 - DNA, 133 bp, Homo sapiens
  misc_feature 1..133: note = chr1:32180688-32180821
  misc_feature 1..133: note = hyper
  source 1..133: mol_type = genomic DNA
gagcctcccgatggtcgctgtgtctgcccattggaccaggggccagggcgggcggggctttgggcgacagaactggctagggtgggagaggagaggaagctgccaggttctggggatcccgaccccaccccgc

SEQ ID NO: 26163 - DNA, 228 bp, Homo sapiens; identical to SEQ ID NO: 5385
  misc_feature 1..228: note = chr1:32180905-32181133
  misc_feature 1..228: note = hyper
  source 1..228: mol_type = genomic DNA

SEQ ID NO: 26164 - DNA, 99 bp, Homo sapiens
  misc_feature 1..99: note = chr1:32181358-32181457
  misc_feature 1..99: note = hyper
  source 1..99: mol_type = genomic DNA
ttctgggatgaggggcggaggatgggaggcggagcccggtctccagggcaccagccctccacctagcgggaagcttgggaatcgcggagtgcagaggtg

SEQ ID NO: 26165 - DNA, 20 bp, Homo sapiens
  misc_feature 1..20: note = chr1:32226308-32226328
  misc_feature 1..20: note = hyper
  source 1..20: mol_type = genomic DNA
ccgacctgcccaggccgcca

SEQ ID NO: 26166 - DNA, 25 bp, Homo sapiens
  misc_feature 1..25: note = chr1:32237521-32237546
  misc_feature 1..25: note = hyper
  source 1..25: mol_type = genomic DNA
cacaaagggccccaccgccggaagc

SEQ ID NO: 26167 - DNA, 1036 bp, Homo sapiens
  misc_feature 1..1036: note = chr1:32237638-32238674
  misc_feature 1..1036: note = hyper
  source 1..1036: mol_type = genomic DNA
cggcggcggcggcgcgggtgtggggccgcgcggccgggagcgggcggaagagagcgcgaatttgaatttcaaaggcatctggaacccaagtgcttctgcgttgcccgattgtgtgtgtggcgcttttgtgtgtccgcgaatgcgcgcgtgcgtgtgtggcgtgtgtctgggtgttttatgactgtcctccgtgaggccgtgtgtgagcccttgcgtgggccgtgagtgcggcagggagcgcggtgtccgggggccgcctgtcggtgtgtctgtgcgtgcttgtgcgctagcctttgcctctgcgagtgcgtatttttaggaccgagtctgtctatatgagcctgtgtctgtgtgtgtgcgctcccggccctgcgtgtgtctgtgagcgtctgccggggcgcgtgtgtgctcggaaccccgcggtggtgtgcgggtgtgtccgtgtgtctgtgcacgtgcaggcgagcgttcccatctgtgtgtgtgcatctgagtctgggctatgtgtgactcagggaccagtctatgagcctgcctgtgcctttgagccgatacctgtgtgtgactcagggacgagtctatgagccgatacctgtgtgtgcttgggtgtctgtgtcgtggtgtgtccctgcaagcgtttgtgcctgcaggtgctggagtgtgtagctgtgggaatgagtgcgtgtgagtgtgcggaaggggcaccgcgcgagggagcgccggtgcggaaggctaagcgagcccgcgccctccacggacggtgccgccaccccctccctccgccccgcgctatgtgcccctgtgtgcccgcgccgccggggccgtctctgggctccgggagggggctgagcgagcggccctttcctcccagggaccccgggcccgccgccagccctgggcacacccgccccttcctccagcggccccgctcgctgacccacgggcactcgatgggcactcgggaggcaatggccggagaggatgggcagttagcgggagggactgagtggcgccggcttcacgctcattctgctga

SEQ ID NO: 26168 - DNA, 130 bp, Homo sapiens; identical to SEQ ID NO: 5388
  misc_feature 1..130: note = chr1:32410234-32410364
  misc_feature 1..130: note = hyper
  source 1..130: mol_type = genomic DNA

SEQ ID NO: 26169 - DNA, 84 bp, Homo sapiens
  misc_feature 1..84: note = chr1:32827740-32827824
  misc_feature 1..84: note = hyper
  source 1..84: mol_type = genomic DNA
ctggagaacccccaacggtgccccctgccgcccctggcactcagcgcgggccagaatcggggactggaggcctctggccatggc

SEQ ID NO: 26170 - DNA, 408 bp, Homo sapiens
  misc_feature 1..408: note = chr1:32930619-32931027
  misc_feature 1..408: note = hyper
  source 1..408: mol_type = genomic DNA
cctctcatcggagggcgccaggtgaatgaaaggggggcgtgtcggtgcgcggtgctccgtggctgcgctgctggaacccgctggaaggtgagcgcgaagaagcgggttggcgctgccgctttcgttggtttggggaggattcctagcacccgggaggctggctggagattggggttagcgggcagggttgcccccactcagtcatcctccttcggaccgcttggccctggcaactcctgggacctccgccccgcgagcccttctagcgtggggaggggcaggcgcggccgtggggccccagcttccctgtcattgggtgtcctccgcgtcgtccagccgggggtcgcggcgccgactacttccacggtgaatggtgcccaggcgtggggggctcggccacactggaga

SEQ ID NO: 26171 - DNA, 35 bp, Homo sapiens; identical to SEQ ID NO: 5391
  misc_feature 1..35: note = chr1:33351678-33351713
  misc_feature 1..35: note = hyper
  source 1..35: mol_type = genomic DNA

SEQ ID NO: 26172 - DNA, 98 bp, Homo sapiens
  misc_feature 1..98: note = chr1:33358896-33358994
  misc_feature 1..98: note = hyper
  source 1..98: mol_type = genomic DNA
agccctccaagggagcgcggcagggcccgcccgatagccctctcttctgggaggccttcccggacacgccttcccgaagccctcggctccccacgcct

SEQ ID NO: 26173 - DNA, 75 bp, Homo sapiens
  misc_feature 1..75: note = chr1:33390730-33390805
  misc_feature 1..75: note = hyper
  source 1..75: mol_type = genomic DNA
ggggagggggtcctgcgccgtcccctcccactcctcgcctgcaggtcggggagcctctgccgagggaaaggaggc

SEQ ID NO: 26174 - DNA, 71 bp, Homo sapiens
  misc_feature 1..71: note = chr1:33438729-33438800
  misc_feature 1..71: note = hyper
  source 1..71: mol_type = genomic DNA
ccgcccctcgcgtgccgcatccgcgcgggagagcgcccggcgaggggccgggattccgccgcggtccgcta

SEQ ID NO: 26175 - DNA, 140 bp, Homo sapiens
  misc_feature 1..140: note = chr1:33772445-33772585
  misc_feature 1..140: note = hyper
  source 1..140: mol_type = genomic DNA
gggctccagcagaactcgggcgacagcaccttggcgggcttgtgcagccagaagaacttgttgaggtggctctcgtcgtgccagcgcgcctccaggccgcgcgcgcggtcccagtccaggccccccgcacagtgcgccgt

SEQ ID NO: 26176 - DNA, 33 bp, Homo sapiens
  misc_feature 1..33: note = chr1:33772904-33772937
  misc_feature 1..33: note = hyper
  source 1..33: mol_type = genomic DNA
cgctccacgggcagccggcgtcccgggcccagc

SEQ ID NO: 26177 - DNA, 1323 bp, Homo sapiens
  misc_feature 1..1323: note = chr1:34628590-34629913
  misc_feature 1..1323: note = hyper
  source 1..1323: mol_type = genomic DNA
ctgagcaaggagctgcgagcaaatggatctctatagggcaggattccagcaccgctgagcggtgcaagcgccggtgagtcggcctttttctctcccctaggggcaggatatgcccaaggggcagggacaaatctagccagaaaaacaattcagtccgatgccgagacattctccaatcagctaagccagagaccggcctcgcctcaacgtacgtccgggaggcctggcgggaggtagcagcgattcccccaccgcccatgtggcaagtctgggtgaccagcagcgtcggtatgcacagcctcccagtgggtgtgggtgtgcgagaggccagagctcccaggcgcgcgcaccgcgggcgcccctctctgggtgtcggtggctatgactcttagcagaacctaagaaagtcccgtcagctaggaatgagagagccagagctggctcggggcgccctccctgaccaagaaccccaacatgccgcggttaagcggtgggcgacacggtctgcgaggacagactcacaagacgctgaaggccagagtgggccagagagctcgccactcactgacctgccagaggagaggcgcactttcccaagaaggggaactggggtggtccaggccaagccttcagaggttcaatcggtggtttcaaaacaaaacaaaacaaaacaaaaacaaaaacaaaaaagaaaacacggctccaggtcgaaggtgccctaggtctaggcctggccagcaggtgtttcggtttctcccccagtgggtgtcagcctcgcgggctaaatgaaaatgcggttccaggcatcccggtttggacccgtctccacccgggcacacggaactttctagcttgtagctagaactgagcttcggaggggtgctgtgggtaaagcgggagggcaccagtcgcggccagtagcctccacaggggaccgggttccctcgaaggttcgcgtacctcccccgcgcgctgcaagctgcagccagacacccgcgaagttccgggactctccgcacccgctagatctgccccttcccggactcggtcgtcgggagctggtcccgccgcccgcgccgccgctgccgctgccgcagccgaggcgctcggctgcagcagggcgcgggaaagggcactttggcgcggagtgagcaccgaggggaatgtggcagcgcgaagcctggcggcggcactccctcccccgcctcgggctacaacccccaccccctccttcccatccctcaacaccctccagcccccacctgcaccctcctgcaaggaatgcgcgggacccccaccgtgggcacgcgtccacctgaaccc

SEQ ID NO: 26178 - DNA, 825 bp, Homo sapiens
  misc_feature 1..825: note = chr1:34630215-34631040
  misc_feature 1..825: note = hyper
  source 1..825: mol_type = genomic DNA
ccccgcaaccccgggcggggatgtctgtctcccaggcccccacaccggccgcatccgtccaagttgcggctggggttggggcagcagtgagggtgagggtggaggtgaggacgtggctgagggtggggtgggagacggaggcagggatgagaatgagagtaggcaactgggagggtgggagattcaggcagggatagaggcggggggagggactgggaccgggtcgaggatgggtgggctcggggctcgggtggggcgcgcggcggccgctggctcctcggcgcggctggactcacccgcggcggccgagacgctgagcaacccacagcccagcaacagcagcagaggcggcggcgttggcggcggcgggcggccccagcggctcccggcgcccggcacaagcgccgaaatcccggtttcgccgcgagccctccccgcggggcagccgcagcgccccagctcccgtccccgcgagcgcggcatggcgcggccggcagcgccgagggagaggctccgctcgccgccgaggagaaaggaggtcaggagagctctggagcttttttctgctcggaaaaaatcccggtacgcgggagccctgagcttctgcggctggaatgaaccaagtgtccgcccggccggggagaggcgcgctgcgctctcggaaatgactcgctccaatcccgcttcgcggggttcgcgccggggggcgggagggggtgaattatccccggattaatcactccggagccgcttctccgccgctccaaatgctgggggtggaggcgcagctaaggataaaatattggggggcgggggttcctcttc

SEQ ID NO: 26179 - DNA, 293 bp, Homo sapiens
  misc_feature 1..293: note = chr1:34631516-34631809
  misc_feature 1..293: note = hyper
  source 1..293: mol_type = genomic DNA
gggaggggggggaaccggttcatttgacccagtgcggtcccactcctaccctaagacaaaaatctcagggtggcagaggcggtccctgtgtgcacgcgagttgggggtggggagtgaggttggtggaaggacggtgcaagagttactagtacaatttatccccaaatttaaataatcggatcctacttcttcttctccccttcctcctcccagccaaggccccaaaccaagagagttcttcccaaggacgtgagctgctccccacctctccccagtagcggctgcctctaggc

SEQ ID NO: 26180 - DNA, 361 bp, Homo sapiens
  misc_feature 1..361: note = chr1:34632140-34632501
  misc_feature 1..361: note = hyper
  source 1..361: mol_type = genomic DNA
caagggggcagtggccggcgggcggtggggcctgagaatttccggggaagggtgtggagagggactgtagggatggcgagccaggctgggggtggctggcgacccaggttggccggctgtcagcgtggccaggaatttccatccaaggaagggtgtgaagaggggctgtggagttgacgatatgaattggggggcgggggcagggctggaggagtggaggcttgtccctactccccatgaaaaacttcctccccagagccacgctttcgcagcctcctagatgccactcttcctccctccccccaccccaagttgttccggtttccctgcatgagctcatcccacagctggggagccagcc

SEQ ID NO: 26181 - DNA, 102 bp, Homo sapiens
  misc_feature 1..102: note = chr1:34642388-34642490
  misc_feature 1..102: note = hyper
  source 1..102: mol_type = genomic DNA
agtggggcggcggcgcgtttggctttgacttctgatcccccgaagcgctctggggtcctttgggccccacccccacccaccccaccggcgggtcttgggctc

SEQ ID NO: 26182 - DNA, 276 bp, Homo sapiens
  misc_feature 1..276: note = chr1:34642862-34643138
  misc_feature 1..276: note = hyper
  source 1..276: mol_type = genomic DNA
gctctgcgaggggctccctgggaacgcccaggcgagcgcctcctgcggggccccgccccccgagtgcctacaatggtgccaggcccgcacccagtcctccgcgtggcttagcgggacagcatgggctgagcccaggcgccgaaagttgtcacggcggcgtcgcaagggggcagtgccagggactgtggggagagccagccctccccttccagctgttcccagatgtcattctgcccgcccaggcgcctggttcctgagctccgcagcattccactg

SEQ ID NO: 26183 - DNA, 77 bp, Homo sapiens
  misc_feature 1..77: note = chr1:35247068-35247145
  misc_feature 1..77: note = hyper
  source 1..77: mol_type = genomic DNA
ttgcagagtgcttcccgcccctgatctcattggagccttcggacagcccagcccatggccaccgatgcccccatttc

SEQ ID NO: 26184 - DNA, 243 bp, Homo sapiens
  misc_feature 1..243: note = chr1:35258561-35258804
  misc_feature 1..243: note = hyper
  source 1..243: mol_type = genomic DNA
ctgcgctatttaaggcgcccccgccgctcgtgcggtccagcagggctcccgcgggcgtcactccggccatcgtccccacctccacctgggccgcccggcaggcaggcggtgagtcgggggctaggaagggaccaggggcgccacctgctcgcgggaggccgggaggagtcttgggtcctccgatgccgggacgggggttgctgcggaacgcccgccgcgacagagccgcgctcacccaggtgg

SEQ ID NO: 26185 - DNA, 817 bp, Homo sapiens
  misc_feature 1..817: note = chr1:35351039-35351856
  misc_feature 1..817: note = hyper
  source 1..817: mol_type = genomic DNA
cagggtcagagccctcgtgggcgcctccccgttccatacctgcaccccaatggacggccgccacttccgctgccgcgccaggctccgcagctcctccctgccagggatggtcttgatgatgagtgtggggggcttggggctggcccggggcggcaccggcgccaactccagtgtgcgcgcacccatggcggggccgtccagcccgtcggcggagctgcagcgccgggcggggccctcggccgccgtgaagctctcgtgcgcggagtcggtgctgctctgggcggtgatggagatgcggggcggggcctggcttcccggcgggatggggggcggggcctttctgaagttgaaggctgtggccggcgagcgcagagacgcagtgggtgaggctcgcggccctgcctgggtcctgggcccgcgcccgactcccaccctcaagaggccctacgggaccctgcagcggcgcgcactccacatgctgctgcacacacgccaacggacgctctccccgtcatccgaccccgggagcgagcgatctgcgcgggtcacagcacagtcgagggggaggccagaacccggacccagggcgctctcctgcctagggccgggccaggggcaggaaggtgtactcacaggagccgggcctccctgagacagcggcaggggtagcgaggaggggcaggcagtcgtcgtcttgagagcagccggcctggatggcccggaggtagctgtggctccgcatgcggaaacagccgggcaggtccagggcgtccacggcctgggactccagctccccaaacaccgacccgcacacggc

SEQ ID NO: 26186 - DNA, 60 bp, Homo sapiens; identical to SEQ ID NO: 5400
  misc_feature 1..60: note = chr1:35390613-35390673
  misc_feature 1..60: note = hyper
  source 1..60: mol_type = genomic DNA

SEQ ID NO: 26187 - DNA, 166 bp, Homo sapiens
  misc_feature 1..166: note = chr1:35395375-35395541
  misc_feature 1..166: note = hyper
  source 1..166: mol_type = genomic DNA
cgagctccccgcccccgcgcggacccaggagggccgaggtcgccgcccgcgggcggccgccggggtcccggaggagcgcccacctcgctgagcgacggtgctgggggcgcccagcgtaggggcaggaatgagatccccctccccggggacccaggaacaggcaccc

SEQ ID NO: 26188 - DNA, 507 bp, Homo sapiens
  misc_feature 1..507: note = chr1:35395542-35396049
  misc_feature 1..507: note = hyper
  source 1..507: mol_type = genomic DNA
aagtgtcacggccacgcacagccgacctgggtacagggacccaagcccggcggcgggcgggcggtcggggaccagctcagcctcacggaccgggtctcgccccccgccgaggggcagtcacgccctgaatgtcacacacagcccccaggcccgtccgcttaggagactctccttcgggctttcccggtcggccgcctgacctcagctcctggcttggggtcagggagcccccctcttcggccccagcccctgccaggatggggcgctgtgcccggcctcggagccgctggcaggcgtcccccacccacagtccgcacagccgaggcatccccagtgtggagggagagccccgctgtacctgccgcctgtgctgggcccccgcccgtgcccactgtgcccgcccgcctctgggccctgagcctgggattgtgccatggcggggtcggggtggggggaaagggactgtccgaagcacagctggaggctgcggagcccggacacaggctg

SEQ ID NO: 26189 - DNA, 24 bp, Homo sapiens
  misc_feature 1..24: note = chr1:35396107-35396131
  misc_feature 1..24: note = hyper
  source 1..24: mol_type = genomic DNA
cgcccagagcgatgctgtaatggg

SEQ ID NO: 26190 - DNA, 940 bp, Homo sapiens; identical to SEQ ID NO: 21
  misc_feature 1..940: note = chr1:36042549-36043489
  misc_feature 1..940: note = hyper
  source 1..940: mol_type = genomic DNA

SEQ ID NO: 26191 - DNA, 30 bp, Homo sapiens; identical to SEQ ID NO: 5405
  misc_feature 1..30: note = chr1:36549840-36549870
  misc_feature 1..30: note = hyper
  source 1..30: mol_type = genomic DNA

SEQ ID NO: 26192 - DNA, 164 bp, Homo sapiens
  misc_feature 1..164: note = chr1:37498362-37498526
  misc_feature 1..164: note = hyper
  source 1..164: mol_type = genomic DNA
gtgttcaagagggtccggctcccgggcggccgcccaggaggagacccacccgctgggtttctgaccgcctcctaggaaaatctcaagtacggaaaccaagcccgacaccggttccggcacctctttcacgccgctggcagcccaaggtccgccctgaagaagag

SEQ ID NO: 26193 - DNA, 92 bp, Homo sapiens; identical to SEQ ID NO: 1674
  misc_feature 1..92: note = chr1:37498753-37498845
  misc_feature 1..92: note = hyper
  source 1..92: mol_type = genomic DNA

SEQ ID NO: 26194 - DNA, 795 bp, Homo sapiens
  misc_feature 1..795: note = chr1:37498888-37499683
  misc_feature 1..795: note = hyper
  source 1..795: mol_type = genomic DNA
cgtccctgggccgcctgcccgggccgcactgggcggcctccatcgtcccttccctctacctgcactgccccaggcgggagagaggccttggccccgagggaccagctgcagcgggcagcggggtcctgctcccccaacccccgccccatggcacggggctgaaccggtaccaccgaggccaagggcgaccaccaggagagaagaccggctgccctcgtcatgcgaatctgtgccctgcgacctcgctgcggctgctcgagctatgccagaggtggggacgaagggcccgcggggagtgaggtgggcagaggagagaagttggcgccttccccagggtccccactctgcggagaagcccgatcgcagaactcggtcggctgcggttcatgctggcagtcaccgcgaaatgcgccctcgactcgggatcgcactggaaaccttcgccacactgtgccaggtctgacctcccaggagcgcgccaagggcccctcgcccactgcggcccggcggcctcctccccaataagtaaggcccgtgaccccgactctggaactttgtcctcacagggaggagctcctggtggtcaccgatcggctcagcagctcggagagaggttaggaaaatctctccggaacgcgttgggaggccccctcattcccgccccctcccgggcgcacggagacccccggctccagggagcgcttaccgatccggatgacgtggggcatcccgcgcgagtccgggatccagaaggcgcacacgaggagcccggcccagtattcccaaaccagactc

SEQ ID NO: 26195 - DNA, 428 bp, Homo sapiens
  misc_feature 1..428: note = chr1:37500013-37500441
  misc_feature 1..428: note = hyper
  source 1..428: mol_type = genomic DNA
gggctcccacctgccccggctgccgggctctggcgggcgggctgcacgcgtctccggccgctcctcctccagccgccgccgatgctatcgcccgggctcgcacaaagccccggagtggagttgcacgcgcgcacactctccctcccagccccctcccctgcgccctgcctcccgcctcccgcgccgcccgccgcccgcgctccctccgcgcactcccccgcgcacacacacttcacactcacacttgccgaggcgcacactcgcgcgctcacacctgcgcggggggcggggaaggggaccctggccccattgtagggggacgcccggagaacgaggactctcctcgcttcccagacgtccccacccgccccgccggccccagtcccttctactgcgagggcacggagcccgggagccaggcgtggagc

SEQ ID NO: 26196 - DNA, 133 bp, Homo sapiens
  misc_feature 1..133: note = chr1:37500442-37500575
  misc_feature 1..133: note = hyper
  source 1..133: mol_type = genomic DNA
cgagagctggcaccgcgagctgggagacggcggcagcccagcggccggaccagctggaggagacgcgcccgccgggagcagcgagaccgggagcccgccgtctgcggagcctggcctcgcggctcccacgcgg

SEQ ID NO: 26197 - DNA, 372 bp, Homo sapiens
  misc_feature 1..372: note = chr1:37500602-37500974
  misc_feature 1..372: note = hyper
  source 1..372: mol_type = genomic DNA
cgggagactgacccgggaaccggcttccctccccaaccccattcctcctggcagcagagttggggctgggggttcggagaggcagaattcaaagcgaattgtctacgctgggccaggggagctgagggagttggtagaggtgggagagcccaagtcagaccccctgctgtgggaagctggacttgaccgcgcacaggtcctggggctgcggaggaggaagaccgctcacgccttagatgtaggggggcgtgggcgccgggcccgctccctctcagccctctcccgtaactgtgcaggaagggctggtgccccctccctcattctcctgagaaagaataaagagaaactgtaatttgtcgtgggatggagtag

SEQ ID NO: 26198 - DNA, 33 bp, Homo sapiens
  misc_feature 1..33: note = chr1:38100650-38100683
  misc_feature 1..33: note = hyper
  source 1..33: mol_type = genomic DNA
aaaaatggactggagcgccggcccgggagtcca

SEQ ID NO: 26199 - DNA, 435 bp, Homo sapiens
  misc_feature 1..435: note = chr1:38219523-38219958
  misc_feature 1..435: note = hyper
  source 1..435: mol_type = genomic DNA
tggcagcatggggaccgaaccgatggtgcgaaggtcgggagcccccctttcggctggagggtaggcagggtgaggagagggcagcggaggggcgctctcctcagtgatctgccaggcatcctaaccccatcctccgtctggactctcgcagttgtcctggttcttctcatcaaaggccccggcccccagggcgcgtccaggctccgctcccccgtacgccgccttccggggcgctggcccccatatccgcccacgtgcgccccagtgcggagaccctgccctcaccaccacctggatcaggccttccttcttggccactcccaccccccaccctccgcagtgcagcctggaggggggactcacgggtgcaggaagccgagggcgggtcggtgggtgagcgcgcatagctgtcctggcacacgcagaaggtggagg

SEQ ID NO: 26200 - DNA, 237 bp, Homo sapiens
  misc_feature 1..237: note = chr1:38230006-38230243
  misc_feature 1..237: note = hyper
  source 1..237: mol_type = genomic DNA
ctggattcaactgagcgtatagctcccctaaatgcacaatcagaggcaagacgcgggctccagtatcgccgacagcctcaaacccggcaacgcggagcgcgcccggcagactacgctcagaattcagcactgcggacagttccatgatcagcacgtcgggcagcgcccggatccagccccctcgaccagcattccaccttctgttggccacactgtggtctcctagcccctgtagtc

SEQ ID NO: 26201 - skipped

SEQ ID NO: 26202 - DNA, 218 bp, Homo sapiens; identical to SEQ ID NO: 5415
  misc_feature 1..218: note = chr1:38230623-38230841
  misc_feature 1..218: note = hyper
  source 1..218: mol_type = genomic DNA

SEQ ID NO: 26203 - DNA, 163 bp, Homo sapiens
  misc_feature 1..163: note = chr1:38510087-38510250
  misc_feature 1..163: note = hyper
  source 1..163: mol_type = genomic DNA
aggagggcagggccccgcggggagcaggggccgcgctatgcggcggtcggtctgcagcagggcagaagccccttcccgtctgggtgtgtgggagcgcagacccctccggcgtggccgggaaccaagccggggctcggatgaaacgaaacgaaaaatgaacact

SEQ ID NO: 26204 - DNA, 424 bp, Homo sapiens
  misc_feature 1..424: note = chr1:38510310-38510734
  misc_feature 1..424: note = hyper
  source 1..424: mol_type = genomic DNA
tagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggagagaagaggcgtgtagcgaataaagtgacagccccccaccctggacccgcaggctcaggagtccacgcggggagaggggatggagaactctcctcgcttcgtcctctctcccggggaatccctaaccccgcactgcgttacctgtcgctttggggaggccgctgccgggatc

SEQ ID NO: 26205 - DNA, 160 bp, Homo sapiens; identical to SEQ ID NO: 24
  misc_feature 1..160: note = chr1:38510773-38510933
  misc_feature 1..160: note = hyper
  source 1..160: mol_type = genomic DNA

SEQ ID NO: 26206 - DNA, 866 bp, Homo sapiens; identical to SEQ ID NO: 25
  misc_feature 1..866: note = chr1:38510934-38511800
  misc_feature 1..866: note = hyper
  source 1..866: mol_type = genomic DNA

SEQ ID NO: 26207 - DNA, 293 bp, Homo sapiens
  misc_feature 1..293: note = chr1:38511821-38512114
  misc_feature 1..293: note = hyper
  source 1..293: mol_type = genomic DNA
cgcctcgtggccatcctcgtgcagcgcgtggtgcaggcccggccccgcgccgccaccgcccgccgccagcatcccggccaggccgccgccgccgccccccgggtaggccgcctgcgcgtacagcccgagcggctggggctggtggcccccgctggccccgggcgagggcgacatggccgggcccaagtggtgcgctgtgctgccctgcgcccatgccgcgcccgcgtgggccgccccctggtgcaccaggcgcgcgtggaaacctccgccgccgccgccgtcgtcggctcggc

SEQ ID NO: 26208 - DNA, 27 bp, Homo sapiens
  misc_feature 1..27: note = chr1:38512126-38512153
  misc_feature 1..27: note = hyper
  source 1..27: mol_type = genomic DNA
cgcctgccttgccgtgttctaggtgcg

SEQ ID NO: 26209 - DNA, 39 bp, Homo sapiens
  misc_feature 1..39: note = chr1:38513064-38513103
  misc_feature 1..39: note = hyper
  source 1..39: mol_type = genomic DNA
tcaccgcgcccgcctcgcctcccgcggctgccagcgtgc

SEQ ID NO: 26210 - DNA, 32 bp, Homo sapiens
  misc_feature 1..32: note = chr1:38599724-38599756
  misc_feature 1..32: note = hyper
  source 1..32: mol_type = genomic DNA
ccggggtgggggcctcgcggggttggggggac

SEQ ID NO: 26211 - DNA, 20 bp, Homo sapiens
  misc_feature 1..20: note = chr1:39025499-39025519
  misc_feature 1..20: note = hyper
  source 1..20: mol_type = genomic DNA
cggggcggggcggggggcga

SEQ ID NO: 26212 - DNA, 74 bp, Homo sapiens
  misc_feature 1..74: note = chr1:39044122-39044196
  misc_feature 1..74: note = hyper
  source 1..74: mol_type = genomic DNA
acggggaccgggagacgcgatccggagagcggtgggaagtattcgcctccgttcctcaaacacaggatgcgagc

SEQ ID NO: 26213 - DNA, 109 bp, Homo sapiens
  misc_feature 1..109: note = chr1:39044197-39044306
  misc_feature 1..109: note = hyper
  source 1..109: mol_type = genomic DNA
ccctttggagaagtcgcgctcggcggaaacgctaactccccggccaagtgcaaatgtaaagaggccctgagagcactttgtgcaaatatcaggccgggaagtgctgcgc

SEQ ID NO: 26214 - DNA, 520 bp, Homo sapiens
  misc_feature 1..520: note = chr1:39269643-39270163
  misc_feature 1..520: note = hyper
  source 1..520: mol_type = genomic DNA
ccgactagcattgatcgctttttgatcttaaaagaaatactttttaattcgaaagttaatagaaatgcggagtcaggggcaggcctcggcggcgtccgggctgggggcgaggcgcccacgccccaccctcccgctgtggccgctggcgccggcccgagcgcgcgcagcccggtgcgcttcggcgcccgctgagcccgcgaacctctccgccgcgccatcagcgcagccatcagccgcgccgcgtgctgtcccgcgccccgctgctcgcggccgcgggccaccggcggtaataatgaggcacagcgccatgaccgcggccctcggctgcgccgccggcagcagcgcgggcgccgcattagcatctccgaagccttcctgtgtgttcttttgtgctcattttccagcccgaatgctcggcacatcccggaccgcggacggagccgcaggagccaccgcggccgaacgtagctgccctggttttagaaagagctgcgggctgcgggcccggctgtccccgaga

SEQ ID NO: 26215 - DNA, 33 bp, Homo sapiens
  misc_feature 1..33: note = chr1:39284513-39284546
  misc_feature 1..33: note = hyper
  source 1..33: mol_type = genomic DNA
aggcaggcctccccgcggcgccttccagggctc

SEQ ID NO: 26216 - DNA, 614 bp, Homo sapiens
  misc_feature 1..614: note = chr1:40105079-40105693
  misc_feature 1..614: note = hyper
  source 1..614: mol_type = genomic DNA
gacacctgtggcccccgcgctcacctgcctctgcccaggcggtgctggagggctggcccgcctgctcggcgagcccgtcgggccgacccccaccccgctcgccctccgcctgctcggtccccgcatcccggcccttacctcagctggccctcttggcccacgtcgatgggtccgtcggactccccgtcggagccgctcggctccttgggtcgcttcatggcgaacgcaggctgcctggtctcagccccgcggctaaggctcccagtcgggaagtcaggccccgccccggccccgccccggccccgcctcgggggcgccgccaccgccctttcccagggccctttcctgcgccgcagctccgggcgcccaggcgccccctcgcccccgcggtgacgcgccgccgagccgtgggaaggccctaggcggtcgccgccttcatcgacggctgggaggtccggctctgctccgctgtctcggctgccgcgcgctgggtggccttgggcaggtgccctgggaggccccgcggggaagccaggagtccccgtctgtccctgggtcgcctgggcgctgctggcctgtagaggcgccgcttcgatgcccgggattccgcaagg

SEQ ID NO: 26217 - DNA, 26 bp, Homo sapiens
  misc_feature 1..26: note = chr1:40137581-40137607
  misc_feature 1..26: note = hyper
  source 1..26: mol_type = genomic DNA
gggtttcttcttgggcgcgaggttgt

SEQ ID NO: 26218 - DNA, 83 bp, Homo sapiens
  misc_feature 1..83: note = chr1:40137646-40137729
  misc_feature 1..83: note = hyper
  source 1..83: mol_type = genomic DNA
cggtctccgctcctggcccgggctcgcggggctcctggggctcccggggctgcccaggttccatgctccggctctgacccggc

SEQ ID NO: 26219 - DNA, 169 bp, Homo sapiens
  misc_feature 1..169: note = chr1:40157762-40157931
  misc_feature 1..169: note = hyper
  source 1..169: mol_type = genomic DNA
tctggcccttcattccggtccctccccagacgggccctcctcctttctcatggacccccaagaggcctctcgcgttctcccccgaaggacccctatgcctagccatggatcctccattccccaccctcccgttttcccgtcccgcagacggagccggtccccagccgcc

SEQ ID NO: 26220 - DNA, 30 bp, Homo sapiens
  misc_feature 1..30: note = chr1:40204397-40204427
  misc_feature 1..30: note = hyper
  source 1..30: mol_type = genomic DNA
cttggtttaccactgcgcacctcacaaggc

SEQ ID NO: 26221 - DNA, 144 bp, Homo sapiens
  misc_feature 1..144: note = chr1:40237059-40237203
  misc_feature 1..144: note = hyper
  source 1..144: mol_type = genomic DNA
gctctaggctaggcccgcgacccgcaacagggagggggccggctccgccctgggctgggggcccccgagtcagtcctccgtgtccagcgcacaggcccgggcgcaggacagagctgaggtcaggctccgcgagaagggcacagg

SEQ ID NO: 26222 - DNA, 488 bp, Homo sapiens
  misc_feature 1..488: note = chr1:40781403-40781891
  misc_feature 1..488: note = hyper
  source 1..488: mol_type = genomic DNA
aagcgaccctgggagcggggtcctaggggcgcagctcttccgcgaactcccacgtattgagaatcttctgtatagcaggcactgtgtgccattacatgcattcattatcttacagaatactcagaaccgggaggcgggcgctattacgggccccagtttgcagtcgaagaaactggctcagaacgtgaagggtccatggtcactgagagtgggcggcggcgccaggagtccgccctggatctgcccgactccttccactgtgccagtttgcccttgcgcggtcgcggtggggaatagatggagacgtggacagctcaaataaatcacagatggaatgtaaggttgtgcctagcaggctgccggccctcagtgagcggtggctcgggttgttgttcttacgtgaacgacaggcagagacagcgcctcctcctctccccatggtgcgggaaaacccgacgggaaagtgggggaggcgcagagaaaggagg

SEQ ID NO: 26223 - DNA, 150 bp, Homo sapiens
  misc_feature 1..150: note = chr1:40782758-40782908
  misc_feature 1..150: note = hyper
  source 1..150: mol_type = genomic DNA
cctggaccctggcagcggaggggctgcgaaacttacaatctgcgccagagcgagcactaccacctggaggagaacaaggaggctgcggggggaggccgtagcggcggccatggctggcggcgagaccaagggggacgggtgcgtgtccgc

SEQ ID NO: 26224 - DNA, 142 bp, Homo sapiens
  misc_feature 1..142: note = chr1:41267904-41268046
  misc_feature 1..142: note = hyper
  source 1..142: mol_type = genomic DNA
tgtgaggtggaagggcgaggccgaggcggcggtggcgtcgcgtcccccctctccgcccctggcctcggggacgcggcggcaccttcacactttccgcttggcccgctgctcgcctttcaggccgccgcgttttcaattgtta

SEQ ID NO: 26225 - DNA, 503 bp, Homo sapiens
  misc_feature 1..503: note = chr1:41284150-41284653
  misc_feature 1..503: note = hyper
  source 1..503: mol_type = genomic DNA
tgatctcgccgcccccgcccctgcagacttcatcgtgttcgtggcctcggtggccgtcatcgccgcgggtacccagggcaacatcttcgccacgtccgcgctgcgcagcatgcgcttcctgcagatcctgcgcatggtgcgcatggaccgccgcggcggcacctggaagctgctgggctcagtggtctacgcgcatagcaaggtgaggcctgcaagccgcgcgcggagacccgagggcgtgtctggggcacgaccagagcgggcagggcggagagggcgaggtcagaggggctgtctccgtgctgggaaggggtgtggcctgcgggggttggagccctagcaggaggcgaggtctaagcgggtggggcgaagtggattctgaattaggtaggggcgggcctaggagtccggaccggatcagggggcggggccggagaggcggggcttgagggtttcccctggatgcttctgggtttgaagggaccactcgtaccacaaagtgg

SEQ ID NO: 26226 - DNA, 73 bp, Homo sapiens
  misc_feature 1..73: note = chr1:41327007-41327080
  misc_feature 1..73: note = hyper
  source 1..73: mol_type = genomic DNA
gtctctttcactttacggccgaggctggggtcagagaagtgaagccaaactgtcctcccgcaggaggcaaggc

SEQ ID NO: 26227 - DNA, 39 bp, Homo sapiens
  misc_feature 1..39: note = chr1:41350136-41350175
  misc_feature 1..39: note = hyper
  source 1..39: mol_type = genomic DNA
cgcgctcaccaccaccgcggaggccgggctgtaattagg

SEQ ID NO: 26228 - DNA, 92 bp, Homo sapiens
  misc_feature 1..92: note = chr1:41444864-41444956
  misc_feature 1..92: note = hyper
  source 1..92: mol_type = genomic DNA
tgaaaccgtacttttcgggatcctagtccatccaaagcagccgccttcggggcaggtgtggggaggagggaggccgacgaggagccaacgcc

SEQ ID NO: 26229 - DNA, 657 bp, Homo sapiens
  misc_feature 1..657: note = chr1:41847296-41847953
  misc_feature 1..657: note = hyper
  source 1..657: mol_type = genomic DNA
cggcacaacctgtcgctgcacacccgtttcatccgcgtgcagaacgagggcaccggcaagagttcgtggtggatgctgaaccccgagggcggaaagacagggaagaccccgcggcgcagggccgtgtccatggacaacggggccaagttcctgcgcatcaagggcaaggcgagcaagaagaagcagctgcaggcgcccgagcgaagcccggacgacagctccccgagtgcgcccgccccggggccggtgcctgccgcagccaagtgggccgccagccccgcctcgcacgccagcgacgactacgaggcttgggccgacttccgcggcggcgggagacccctgctcggggaggcggccgagctggaggacgacgaggccctggaggccctggcgccatcatcgccgctcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgcccaggcccggcccggtgctgggtgcgccgggggagctggcgctggcgggcgcagccgccgcctaccccggcaa

SEQ ID NO: 26230 - DNA, 56 bp, Homo sapiens
  misc_feature 1..56: note = chr1:41848262-41848318
  misc_feature 1..56: note = hyper
  source 1..56: mol_type = genomic DNA
aatggacttcaacttcgattcggccctgcctccgccgccgccgggcctggccgggg

SEQ ID NO: 26231 - DNA, 33 bp, Homo sapiens
  misc_feature 1..33: note = chr1:41848943-41848976
  misc_feature 1..33: note = hyper
  source 1..33: mol_type = genomic DNA
gcttctcccctcccccgtcggagtcagtccctc

SEQ ID NO: 26232 - DNA, 57 bp, Homo sapiens
  misc_feature 1..57: note = chr1:42128290-42128347
  misc_feature 1..57: note = hyper
  source 1..57: mol_type = genomic DNA
ggaatccctggctgccggcggccgcggggagggtctgcgcgccggcctcctcggtga

SEQ ID NO: 26233 - DNA, 11 bp, Homo sapiens
  misc_feature 1..11: note = chr1:43533901-43533912
  misc_feature 1..11: note = hyper
  source 1..11: mol_type = genomic DNA
ggtgtgcgccc

SEQ ID NO: 26234 - DNA, 131 bp, Homo sapiens
  misc_feature 1..131: note = chr1:43534114-43534245
  misc_feature 1..131: note = hyper
  source 1..131: mol_type = genomic DNA
cgcccgctgagcaacgtgactgcgcgggctcgggtccccaccaggacaaggcggcctctgtgccgacccagctgattcctctcgggctgcaaatcccttccggctgacagccctgccggctggggccaggc

SEQ ID NO: 26235 - DNA, 124 bp, Homo sapiens
  misc_feature 1..124: note = chr1:43613496-43613620
  misc_feature 1..124: note = hyper
  source 1..124: mol_type = genomic DNA
ccgggcagcactacccgagcgctgttgcctggagaccacgggacgccgttgcctggagacagcggggacgcgttgcctggagactgtggaaggcccaggcaagagggcgcgtggcagcccaagg

SEQ ID NO: 26236 - DNA, 156 bp, Homo sapiens
  misc_feature 1..156: note = chr1:44402104-44402260
  misc_feature 1..156: note = hyper
  source 1..156: mol_type = genomic DNA
ccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgac

SEQ ID NO: 26237 - DNA, 265 bp, Homo sapiens
  misc_feature 1..265: note = chr1:44872458-44872723
  misc_feature 1..265: note = hyper
  source 1..265: mol_type = genomic DNA
tgggcggagagcttccgtgtggccccccgggcgaggccgcccacggtggtgaggccatccgaggggatgcccggttcatcccccagtccaggagcctctccgagagctcgcggcccaggtcgaccccagctggcgagggcgcgcaggagtcccgaagtagcggggactagggcagccaggaggcagggggaaagctctcgcttcccgttaagcacaccctgcattctcgggtcgtggatgcagctccagcggagagcccgtgttc

SEQ ID NO: 26238 - DNA, 141 bp, Homo sapiens; identical to SEQ ID NO: 28
  misc_feature 1..141: note = chr1:44872923-44873064
  misc_feature 1..141: note = hyper
  source 1..141: mol_type = genomic DNA

SEQ ID NO: 26239 - DNA, 108 bp, Homo sapiens; identical to SEQ ID NO: 29
  misc_feature 1..108: note = chr1:44873065-44873173
  misc_feature 1..108: note = hyper
  source 1..108: mol_type = genomic DNA

SEQ ID NO: 26240 - DNA, 315 bp, Homo sapiens
  misc_feature 1..315: note = chr1:44873509-44873824
  misc_feature 1..315: note = hyper
  source 1..315: mol_type = genomic DNA
gggtgacccccggggcggggctgctcgggggctggaggtccttggactttggtcgaaggctggcagctctgagcccctgccccgcgggccccgcgcggctgcggaccaggggcccttgcacgtgtcggttcttcctggactggcgctttggttgcccaaagttgggcgcagattgtttcgtgcggaggttgttgggacccagagtattctatatacaaaggcaaccgagagccggagggagaggtcgggccaaagagtagtgggctcggctccgcgttgggcccaagtttatgtaggtttcgccttcacctcttc

SEQ ID NO: 26241 - DNA, 146 bp, Homo sapiens
  misc_feature 1..146: note = chr1:44883069-44883215
  misc_feature 1..146: note = hyper
  source 1..146: mol_type = genomic DNA
tggggccaggctggacgggagcagtccctgatggctgcagagccatctggcctggcttggcttggctcggcgcgccgctcgcctggcggctgggctcgctgtagttgtgctcccgctcttcccctgccctcgctccacgccgcgcc

SEQ ID NO: 26242 - DNA, 372 bp, Homo sapiens
  misc_feature 1..372: note = chr1:44883751-44884123
  misc_feature 1..372: note = hyper
  source 1..372: mol_type = genomic DNA
cgccgtctgagcagaagagagtgggaaccggggtgacggataaggggggggcgcccacgcgacgtcggggtgcatgggagcgcgcgggaggcgctagtgggtgcacggggcgtgagggggacacagcgcgggcgtggggatggccactgcgcggggagggttctgcctggagaaggagggatgggaggaggttgggggagcagggcgcgtggaggagggaggttggacgtgtgtacagcgcctggggacctcgctggccccttggtgcccccaggactctgaggcttctcctttcggcttgaaatgtttttcccttcctgcttttcaaatctgtaaaaatgttccggggaatgtttccgaagtccagggctc

SEQ ID NO: 26243 - DNA, 154 bp, Homo sapiens
  misc_feature 1..154: note = chr1:45250008-45250162
  misc_feature 1..154: note = hyper
  source 1..154: mol_type = genomic DNA
cggccgaagttccggaggctgatggccggggagggcgcccctacgcccaggaagcggccgagcaacggggtctgcgcggcgggcgcgggccgaccagatccgggggacgcctccacctgcaggctctgctcagggtcgtcgctcatgctgcggg

SEQ ID NO: 26244 - DNA, 173 bp, Homo sapiens
  misc_feature 1..173: note = chr1:45250192-45250365
  misc_feature 1..173: note = hyper
  source 1..173: mol_type = genomic DNA
cgggagcggggacgcgggatcggctctcggggaaggaccgaggcatcggtgccccagaggctgagcgaggacccgcgtgccgggtcaggcccagtgcaagccactcaccgcaggttgaaggtggagcccaggaatgagggccgcagagactcggccgccgtggccacagtgta

SEQ ID NO: 26245 - DNA, 330 bp, Homo sapiens
  misc_feature 1..330: note = chr1:45251926-45252256
  misc_feature 1..330: note = hyper
  source 1..330: mol_type = genomic DNA
agttgcaccctctgccgccaggggaggctgctgttccgccgtctggctcccctccctcgcgtccaccggctgtcccaggactcgcggttccgcgttcctgtcgcagtccagacccttccctggaggcccctgctcccaggactctcccaggcgccacctgcatccggctgtgggccggacccccagaggctcccggcgggcggcgcacctgcgtccaccacgtgctccatggtggggaagcgcttaagcacgcgggtgctgaccgagcgcagcaccagcacggacgccaggttcgcgtagcggatgagggtgcggcgcagcaggcggccc

SEQ ID NO: 26246 - DNA, 251 bp, Homo sapiens
  misc_feature 1..251: note = chr1:46632721-46632972
  misc_feature 1..251: note = hyper
  source 1..251: mol_type = genomic DNA
cgcgactacctgcttcgctcccacccgcgcgcccaggaccctagctgcgggactctagcggggaaggcacccccaattctgggccctggcgaccttgggtcagggccaggaaaggcacttccagccaagcgctggcgccgggtgcgcctcgctttacggaaagaacgccccgcgaataaatccggagcggatttgcatcacagcagccgcgagaaggctagctgctgccaaagctccgaagctctggatgt

SEQ ID NO: 26247 - DNA, 42 bp, Homo sapiens
  misc_feature 1..42: note = chr1:46859934-46859976
  misc_feature 1..42: note = hyper
  source 1..42: mol_type = genomic DNA
ccagtccgggttttgcggcggagcgggcgggctgcgcgtgcg

SEQ ID NO: 26248 - DNA, 91 bp, Homo sapiens
  misc_feature 1..91: note = chr1:46913786-46913877
  misc_feature 1..91: note = hyper
  source 1..91: mol_type = genomic DNA
cgcccgcattcagttcgaaggaccagccagtaggccctgcgccgcccagggaccgcccggcctttgcgtccggcccagctcaagccccttc

SEQ ID NO: 26249 - DNA, 360 bp, Homo sapiens; identical to SEQ ID NO: 1693
  misc_feature 1..360: note = chr1:46913886-46914246
  misc_feature 1..360: note = hyper
  source 1..360: mol_type = genomic DNA

SEQ ID NO: 26250 - DNA, 148 bp, Homo sapiens
  misc_feature 1..148: note = chr1:46914285-46914433
  misc_feature 1..148: note = hyper
  source 1..148: mol_type = genomic DNA
cgcggagggccggacgggagccaaggcggctcagttcctcttctcccccgagcaggcgaggagaggtggggtctcaggacctccaaggccctgttccccttccattggcatttgtgtaaggacgcaggccctccgcactgctgactgt

SEQ ID NO: 26251 - DNA, 132 bp, Homo sapiens
  misc_feature 1..132: note = chr1:46951186-46951318
  misc_feature 1..132: note = hyper
  source 1..132: mol_type = genomic DNA
gtgaaggggagtagccgtcggagggcggggacagagcggtagctgccttgcgctgggattgggggtgggggtgggagtggggagggctctttaagcggcggccgcgctaataacctgtccaggagatggctc

SEQ ID NO: 26252 - DNA, 118 bp, Homo sapiens
  misc_feature 1..118: note = chr1:46951644-46951762
  misc_feature 1..118: note = hyper
  source 1..118: mol_type = genomic DNA
cgcccggaaggggcggggaggggccccggccctcaagccgcacagccaggtgttcccgctcttcgaggacatcccctgcccgcctggaggttgagagggcggccgcatggggcattcg

SEQ ID NO: 26253 - DNA, 356 bp, Homo sapiens
  misc_feature 1..356: note = chr1:46956260-46956616
  misc_feature 1..356: note = hyper
  source 1..356: mol_type = genomic DNA
aaccccgcagtgctccgggcattgcccgggtctggctttggtctcgcccgcgcagatcccgttcaaactcagctgccaccaagtgcgccttttctctctggattgcgattctgcacgaattttccagttgagggtggttcggcgctcagccagcctctgccctcgaagacgcggccttggtctaggaaccttcaggtgggtgtttggggcgcagtggccctagttccctagaattcgttttgcctcccgcggcctcagccggcgtgggtcaggcgagctccggcgaggaacggcaggctggggccagtccccggagcggctctcggggcgcttctaggggagcagtcaaagggttg

SEQ ID NO: 26254 - DNA, 155 bp, Homo sapiens; identical to SEQ ID NO: 34
  misc_feature 1..155: note = chr1:46956684-46956839
  misc_feature 1..155: note = hyper
  source 1..155: mol_type = genomic DNA

SEQ ID NO: 26255 - DNA, 314 bp, Homo sapiens; identical to SEQ ID NO: 35
  misc_feature 1..314: note = chr1:46956840-46957154
  misc_feature 1..314: note = hyper
  source 1..314: mol_type = genomic DNA

SEQ ID NO: 26256 - DNA, 437 bp, Homo sapiens
  misc_feature 1..437: note = chr1:47009449-47009886
  misc_feature 1..437: note = hyper
  source 1..437: mol_type = genomic DNA
ccctcagccccctcccgccagcgtcccccagctccttcacttgcctgagcccgtccgtggacactcccctgcgggtccgaccaggctgacccttgagcaccctgggtcagcaggaaggaaagaccccgagagcgcaggaccaccaagagaggccgggccacctcctccgccgtccgctgacttctaggggctgggccggcgcacagcaagggggttggaggtggggtcgccctctcccacgcggctgggtttccaggcggtgtcctgggccgagccgcttggagatcctagatcagcatgtgggtgggaaagggcgccccgtcctgggcccccccgcccctgcgcgcagagcagagacgcgcagacccgctcccactccgcttggctcccttggagcagccccggcggcggcagcgatgggctgggaggggccggca

SEQ ID NO: 26257 - DNA, 126 bp, Homo sapiens; identical to SEQ ID NO: 37
  misc_feature 1..126: note = chr1:47009910-47010036
  misc_feature 1..126: note = hyper
  source 1..126: mol_type = genomic DNA

SEQ ID NO: 26258 - DNA, 28 bp, Homo sapiens
  misc_feature 1..28: note = chr1:47010104-47010132
  misc_feature 1..28: note = hyper
  source 1..28: mol_type = genomic DNA
cgtccgcactttccgagagccaggcacg

SEQ ID NO: 26259 - DNA, 35 bp, Homo sapiens
  misc_feature 1..35: note = chr1:47691684-47691719
  misc_feature 1..35: note = hyper
  source 1..35: mol_type = genomic DNA
ggcagacaaagttagcgccacgtggggctagggcg

SEQ ID NO: 26260 - DNA, 101 bp, Homo sapiens
  misc_feature 1..101: note = chr1:47694827-47694928
  misc_feature 1..101: note = hyper
  source 1..101: mol_type = genomic DNA
agacaccgtttccaccggcaccattcccctgaaaactcacctggggcatatttagagagaccggcccctctgaataggatctccactccgccggaaagggg

SEQ ID NO: 26261 - DNA, 607 bp, Homo sapiens
  misc_feature 1..607: note = chr1:47694979-47695586
  misc_feature 1..607: note = hyper
  source 1..607: mol_type = genomic DNA
cgctgagaggcctgcagttacgctgcggtgtggtcctgggcgatctgccgcgcccaaagcgagtttccaggaaagataggggtggagagaaagaggcagggcaagagggagggagagagagaaatgggggtcaatggctgggaattacctcctgtccccgaccaaccagtccagggaatcgcaaacagctttccgcccccaacctgcaggtgtttggagcctttcctctaccccctcctccccccacccgccttaaaaaaccctatacatgaccaatcaggaatagctatttagtccaacagcaacaacaacccctcccgacaggctgtctggaacattttcgaaccctccaactgggatcggtctggttcagtgtttgttttctaagcagggaggtgtctacgcggttgcctcctcagccaggtctccggctgccgctacaccgcgaagggatagtcccgggcctggatgggcggaggtccgtgttgggaaaggcgaatagtcttcagactctggtcggtgggacagaaccttgaagtcccccccacctcattctctctctgacccccatccacccacctccagcccaaagcgaaaccagaaccca

SEQ ID NO: 26262 - DNA, 625 bp, Homo sapiens
  misc_feature 1..625: note = chr1:47695896-47696521
  misc_feature 1..625: note = hyper
  source 1..625: mol_type = genomic DNA
aggtaaaaacaaacccgacactactttcaaggatgtagcaggattgagcttgcttttattttttcctagtggattttgtttaatttgttttgcctaaatcgtcaggcttatgatcacacatcgaagtcttggattaactgcgaaggcctccttctatttgccgcggctttggtggacatataggaataattcttccctggattgcaatacaatgcggaagattttctttctcctcttctaatccaaaagaggggaggggaggaaagaagaggggaatccatccattcccggcgtgttcgcggggggttaatgttgcgtgttcgctgggggttaatgtttgccttatgaccaagtctctgtgtccgtgcctctctccattttctcttcctacctcaaacccagcaacttagaaaacggctgtagcggaaaaaaacccgctgctttgttctcccgccaaaggagccaaaagggacaaactgctgcgctctgggatgattattttaattaaaatagatgttaatgatgacgattgtgatggtgatggcattagcaattacaataattgacaaaacaaaattctttcaacccgagctagggccccactaacccggtccctcccagagcc

SEQ ID NO: 26263 - DNA, 345 bp, Homo sapiens; identical to SEQ ID NO: 40
  misc_feature 1..345: note = chr1:47696620-47696965
  misc_feature 1..345: note = hyper
  source 1..345: mol_type = genomic DNA

SEQ ID NO: 26264 - DNA, 70 bp, Homo sapiens
  misc_feature 1..70: note = chr1:47696986-47697056
  misc_feature 1..70: note = hyper
  source 1..70: mol_type = genomic DNA
cgcccccaccagcgcctcgatctctcgctcgccctccccccactcccgcccccagcgatttgcaaacgca

SEQ ID NO: 26265 - DNA, 606 bp, Homo sapiens; identical to SEQ ID NO: 42
  misc_feature 1..606: note = chr1:47697341-47697947
  misc_feature 1..606: note = hyper
  source 1..606: mol_type = genomic DNA

SEQ ID NO: 26266 - DNA, 188 bp, Homo sapiens
  misc_feature 1..188: note = chr1:47698006-47698194
  misc_feature 1..188: note = hyper
  source 1..188: mol_type = genomic DNA
cgaggcgcgccggggccgtgtgcgccgcagagataaggcactgccgcgggtccgcccgcccccgataagcgcctcggccattatgggccaaatgattcattttaatttggcaatttcaccggagggagtggggactggttgagcggcgctaggaccggctccggaacgcgctgcggggagcgttggac

SEQ ID NO: 26267 - DNA, 232 bp, Homo sapiens
  misc_feature 1..232: note = chr1:47882033-47882265
  misc_feature 1..232: note = hyper
  source 1..232: mol_type = genomic DNA
tccctgccctgccagcggtcgcgccgtcggggccgccgccgtcgccgctcgcaggagccgagccagggcgggagccagaggaggcggcggctggccgcggagaggcggcccccacgcccgcgcccggcccggggcggcggcggcggcggcccctgcagcgcgggaagccgccctactcgtacatcgcgctcatcgccatggctctggcgcacgccccgggccgccgcctcac

SEQ ID NO: 26268 - DNA, 72 bp, Homo sapiens
  misc_feature 1..72: note = chr1:47882266-47882338
  misc_feature 1..72: note = hyper
  source 1..72: mol_type = genomic DNA
ctggccgccatctaccgcttcatcaccgaacgctttgccttctaccgcgacagcccgcgcaagtggcagaac

SEQ ID NO: 26269 - DNA, 76 bp, Homo sapiens
  misc_feature 1..76: note = chr1:47882759-47882835
  misc_feature 1..76: note = hyper
  source 1..76: mol_type = genomic DNA
ccccgccactctactcgcaggtccccgaccgcctggtactgcccgcgacgcgccccggccccggcccgctgcccgc

SEQ ID NO: 26270 - DNA, 55 bp, Homo sapiens
  misc_feature 1..55: note = chr1:47904617-47904672
  misc_feature 1..55: note = hyper
  source 1..55: mol_type = genomic DNA
gggctggctctcccggcctacggcgcacccccgccggggccggccccgcatccgc

SEQ ID NO: 26271 - DNA, 484 bp, Homo sapiens
  misc_feature 1..484: note = chr1:47909535-47910019
  misc_feature 1..484: note = hyper
  source 1..484: mol_type = genomic DNA
gagttgaggtgggggcggacacttcccctccatatccaatttgctcttgccacagcgggcgcgtcttcgtggttacaaagcgctttttccctgatgacttttttccccttttcaaaaacacttctttctccccccttcaactagcaaccctccccaggcccacccctcctccctctccgctccggtttatttaaacttcgcctcctccagcgccgccgcagcgcgcacttaatgaagttgaaggctcggtgagcccgggtgaagagggtttggaatctgttgaaaggggcgttttgtgacactgattggggcgggggcgggggcagtcgcggaccagacaatgaccgaccaggcgggttttcctgcgcacagggtcaggcgaataaaggcgccgacgctgtttaaacgaaggaccttgtaagagaaagggagaaaagattttgtgtgtggagcgtgcctcgtaaggtttcgtgcttaggagaag

SEQ ID NO: 26272 - DNA, 117 bp, Homo sapiens
  misc_feature 1..117: note = chr1:47910508-47910625
  misc_feature 1..117: note = hyper
  source 1..117: mol_type = genomic DNA
cgcctccttccgtagcggagcgagagctgccgctcgaggctgaggccgctccggaggcctggaggcttcggactgctggactagtggggaaggaaggcggtttcctccgcagcgccc

SEQ ID NO: 26273 - DNA, 127 bp, Homo sapiens; identical to SEQ ID NO: 5466
  misc_feature 1..127: note = chr1:47910748-47910875
  misc_feature 1..127: note = hyper
  source 1..127: mol_type = genomic DNA

SEQ ID NO: 26274 - DNA, 360 bp, Homo sapiens
  misc_feature 1..360: note = chr1:48058946-48059306
  misc_feature 1..360: note = hyper
  source 1..360: mol_type = genomic DNA
cgccgccgccagcccggggctgacctctcagagcagggcggaggattttcacagcacagcttcccgagagagcgggattaagggggaactgctcgggtgggccagagccaggggctagggggaggccgggcggaaacccaaaacctccgcagctgtttccagtttgccgccctggctggaccgcggtggctgcgtgcagagcgagcaaggctgcgcgggcctggagcgcccacggggcgcgggacctctctctgtctccccccgccccgcggggctctctctcgtcctctctgtcttggtggggctcagtctgtctctcgttttctctccctgtttctaagatctcgtggaatcaaagac

SEQ ID NO: 26275 - DNA, 188 bp, Homo sapiens
  misc_feature 1..188: note = chr1:48190874-48191062
  misc_feature 1..188: note = hyper
  source 1..188: mol_type = genomic DNA
gcccagcggccggagcgcgcggcgcagccatcgatcgcggctaatggcctcgtctaaatgcggagccgctgcctccgccccccgggtcagggcgcccccgccctcgccccccgctccgtgcaaaatggtgtttaccaaagtcaatattggccgcggcgcccgcccggggcacccgggagcccctctgg

SEQ ID NO: 26276 - DNA, 310 bp, Homo sapiens
  misc_feature 1..310: note = chr1:48462159-48462469
  misc_feature 1..310: note = hyper
  source 1..310: mol_type = genomic DNA
gggagcgccccttctcgctcctggctgggagctggagccgggacaggcaggagcgaaggaagggcgcccgaggctgcgcccggggggtggaggtggagcgggcgggctaaggtgggtgcggaagcaggacccaaaccatggtcccacgggactagaatacccaggcaggcgggagagtggccgggcaggcgctcgctcaccgatccgggcggccggcactgtcctccgtccgggggctgcgggcgggcgcgagcggtggcgaggagggcggcgagcagcggccccgccagggcggcgtgcatcctgccag

SEQ ID NO: 26277 - DNA, 25 bp, Homo sapiens
  misc_feature 1..25: note = chr1:49242334-49242359
  misc_feature 1..25: note = hyper
  source 1..25: mol_type = genomic DNA
cgcgcggggggctctcgggcccggc

SEQ ID NO: 26278 - DNA, 153 bp, Homo sapiens
  misc_feature 1..153: note = chr1:49242360-49242513
  misc_feature 1..153: note = hyper
  source 1..153: mol_type = genomic DNA
cccaattcctccgggccccggtacacggcgtacaccttctggttgtcaaaatccagccgcgagcgggggctgaagtcgcgcacgcacgacacgggcagcgcgtagcagacgttgtcctccaggaaccgcacaaaggcgtacatggtgggcgcc

SEQ ID NO: 26279 - DNA, 19 bp, Homo sapiens
  misc_feature 1..19: note = chr1:49242514-49242533
  misc_feature 1..19: note = hyper
  source 1..19: mol_type = genomic DNA
ggggcgggccccggtcggg

SEQ ID NO: 26280 - DNA, 64 bp, Homo sapiens; identical to SEQ ID NO: 5472
  misc_feature 1..64: note = chr1:49242884-49242948
  misc_feature 1..64: note = hyper
  source 1..64: mol_type = genomic DNA

SEQ ID NO: 26281 - DNA, 60 bp, Homo sapiens
  misc_feature 1..60: note = chr1:50489576-50489636
  misc_feature 1..60: note = hyper
  source 1..60: mol_type = genomic DNA
cggttgcctgggcaacgggcggcaggcgcgcgggtggccggcgcgcggctgagggcggga

SEQ ID NO: 26282 - DNA, 515 bp, Homo sapiens
  misc_feature 1..515: note = chr1:50513687-50514202
  misc_feature 1..515: note = hyper
  source 1..515: mol_type = genomic DNA
gtgggcagggggtggcggcggcgacggtggcggagccgcagagcgagctagagagcgagagcggtgagactctgcggacgtcttcccgcccgccgcgctccgccccacccagcctccgcagcctcgggccggatcgcccggcggggaagatgcgcctcaagaaccaggtagaagcgcctcggcgcaggccccgcacccccgactctgcccgccctctgttacggacacccgctgggccacgtggtcgcgactggcttctcccagcggccagcctggccaccccgactcccagggagggggagagggcccttgcaagaggatcctgcccccgcgctgcccagacctgagggctcctggcgaccccacccgcagcccatctggcggctctggccccgcaggtcagggtcacacccctgccggcctcctgagacttcccggccccaggggagagagctgaaacttgggttgacgcgcgccccctccccagcgacaggcgaccccgcagcagccccgcg

SEQ ID NO: 26283 - DNA, 665 bp, Homo sapiens; identical to SEQ ID NO: 1710
  misc_feature 1..665: note = chr1:50798652-50799317
  misc_feature 1..665: note = hyper
  source 1..665: mol_type = genomic DNA

SEQ ID NO: 26284 - DNA, 221 bp, Homo sapiens
  misc_feature 1..221: note = chr1:50799393-50799614
  misc_feature 1..221: note = hyper
  source 1..221: mol_type = genomic DNA
cggcggcagccgcggctgccccctactggcggaaggaagagtcgccgctccggggcccttggcggccgccgctcttcgcgcctccttggcctggctgccacccttccaccctcgggggagaccccgcgctctgtgctcactcggggaagagaggctcaatcacggcctggaccagcactagggacctaaacgctcttctcagtgtgcgtgaagccaggtcc

SEQ ID NO: 26285 - DNA, 386 bp, Homo sapiens
  misc_feature 1..386: note = chr1:50880931-50881317
  misc_feature 1..386: note = hyper
  source 1..386: mol_type = genomic DNA
cggcccgggttcgcatcctcccactgctcagaccgagtcggctccagcttgctttgggaagcattcaggaataaacgtggacagtagcggtcaggaaggagattcccgtttccccttctcccaggaggaaaagaggtaacgctgccgccactgccctctctttccagggtgggaacgccgcccgagaccggggtaccccacactcctccctagcgctgatcccagcggagctcaggccgcagtcccctcctgccggctgcggaagctcccagaagcggagactcaatcgcccccctgcccctgctaccaggccagagtctggagtacagatactggctccctggggcctgggtgtgcgaccccaggccggtcattgcaggtctctg

SEQ ID NO: 26286 - DNA, 531 bp, Homo sapiens
  misc_feature 1..531: note = chr1:50881426-50881957
  misc_feature 1..531: note = hyper
  source 1..531: mol_type = genomic DNA
cggggcctgggccatggagacgctccgggcccaggaacgggggacctcgggtgccccactacctcactcctagaacgcccaccgctcacgaagccttcctgagctctacccgaaggtgctgacagcctggagctgaggccaaggcgcttgggggcacgctgcttctccctgggcctcctatgttcacggaaggagagtttccgcaaacctctcactctcggccagcagaccccgcttcatgagaggaggagacccactaggggcggtggagaggcgaagtgatccagggtcccggaaagttggacaattccctggaccagatggctctcagtttcctcctctgtaaaatggggccggtaataagcaactctctggattcaccccggtttgctgcgaggatgaactaatataatagtctttaagtctgtgacgctccagatgttcttgggaatgagtaacgcgggtccacaggccgccccctcgggtccggccagagcatcggcaggaaccgaggagcctcgggggacccag

SEQ ID NO: 26287 - DNA, 409 bp, Homo sapiens
  misc_feature 1..409: note = chr1:50882143-50882552
  misc_feature 1..409: note = hyper
  source 1..409: mol_type = genomic DNA
cgctttctcccgcctgcctcttttctttctaactcttccctctcctgtctcctctcgccctcttttttctccttttttatccccttttcgtccatcgctcttgccggcatctttcttctctgggtccttctcccccactttcatctcatcgcgctcgcacttcatcaccagacagccaaaccccctttccaattaaagtggaattaggcaactcaatcaaattagttccccattaaagcccttctttattaaaccgttttcttgtcctgctattaagtttcactgcctggcggaactcgagccggccccagaagtttaccttgggatgtcgccggacccagccgaggggaggagtcattcttttcctggagcgggggagtcaccctgcggggagcgggagggactggag

SEQ ID NO: 26288 - DNA, 1211 bp, Homo sapiens
  misc_feature 1..1211: note = chr1:50882766-50883977
  misc_feature 1..1211: note = hyper
  source 1..1211: mol_type = genomic DNA
gccaccctgcccagccgtcgccttcgttgcctgtggttccaaatctgagatggggagcgcgcagtgtgtacatccaaatctacacctcggaaagagcagggactgggcccccagccttgcaagatccctgtgaagactggggccgacgatccaaaaactaagagccggggcaaggtgacccctccgcaagggtgcccaagctggggtacacactgtgttccctctgctcagcggtcgcgggtccttcgggagttgtgagccccgcgccactctggtgggataggtcttccgagtaccacaggaagtctcctctcccagtagccccgagggtcggagatcccacgggacctcggacaagcgtctccttagcgccgcggcctgagtgggaaatcacgaccttccccagcgccccacccccaccccctatttctcgaggagcgggacgggattcggcattgttttcttagaaaataacatttatttctagctcatatctatgcaaaggaaagcacaaagtgctgctctgcagcagcgttttccgctgcgggcccttcagtcagggcgtttggcgagtcccgggaggcgaggatgggcccgcgagcgggcggttctggctcagtcacacgtcgctctgttcctgcttcagtgcgcaccttgacggctccttagggacagaccagccgcaggcaagaggggcaggtgggcaggattcatcccgagtttccaatatatttaatctctaaacctgataagtacaatgcgcgcatagtctaatttttttccattttgtccctttttttgcttgttttgaatgtttttcacgttaataccgaggtcacctacagattacaattaataacttagaattccattttataacattatacactggcttgtatatatatatgtatagattatatatagatttatacatatataaaaacacactgcaccaaggaaacccatgcttatcggcataagcaacaaagagagcgacaaataccgcaacgaggaaagtgcaccttaaaacttgtttcctttttttttttttacaattgtatcgatatatatgtgtgtcccaaagactcagtgccaagagatttatacatcctaaatttatatttgttagagcgaatatttaaattttttaaaagtgagggctggggagacacagaaaagactctcggattatcctgccatccactgagagc

SEQ ID NO: 26289 - DNA, 333 bp, Homo sapiens; identical to SEQ ID NO: 46
  misc_feature 1..333: note = chr1:50884020-50884353
  misc_feature 1..333: note = hyper
  source 1..333: mol_type = genomic DNA

SEQ ID NO: 26290 - DNA, 198 bp, Homo sapiens; identical to SEQ ID NO: 47
  misc_feature 1..198: note = chr1:50884690-50884888
  misc_feature 1..198: note = hyper
  source 1..198: mol_type = genomic DNA

SEQ ID NO: 26291 - DNA, 194 bp, Homo sapiens
  misc_feature 1..194: note = chr1:50885248-50885442
  misc_feature 1..194: note = hyper
  source 1..194: mol_type = genomic DNA
cgagcctgagccgggccgcacctctggggacgacgtcccgggccccgagtctgcgccgtcgggtgataagggcttcaccggcggcggcagcgggctgcccgggcggcctgcctgcagcagcgtcttaggaaacaggtcaaacttctgcaacttggcctctgggaggggagaaaacgtgtcgtgaggagcggtta

SEQ ID NO: 26292 - DNA, 1030 bp, Homo sapiens
  misc_feature 1..1030: note = chr1:50886055-50887085
  misc_feature 1..1030: note = hyper
  source 1..1030: mol_type = genomic DNA
gcaggcagtaggaagcgaagaggaaaagacataggaaagcagacctgagaaaccagggagggtgcggaagaaactagaaggagggagggcgcagcaagcggttgtccagagggcgttaggaacgcgagaaggggaaaagaaactagggcgtctcagaacctagggcgtctcaaaacctagggtgtcagttaaagggggggggattccttaagggagttgggaaggagcagagggaaagggcctgtggagaagcgcagagcgaacgaagatgcgcaggtttccacctggggagaagacgaagcaaagaagcagggacctgcctgcgtttgggtagaggcgagtaaaaaaattaaagcgtgtacatttcggcccgatgcaggagaaaggggtaaagtgcaaatgctccagaagcgggagaaaggagagtttctgtacccacgctccatacccgaggctgggcgagcggtgaaccctagcagtcgcggcgactggacacgggggttctactctttctgaaccgagacaagcccctgggccccgtgccccagagctacgatcctgctgcccctacctgcggcctggccgcgctctcacctgagccccctgcgccagctgctccgcctccggtccccgcgggcgctcccgctccaggtcccccgccgtcggcggcgcacactgaaccgaagacctcgtaggcgggcctcggggggatgatgccgttggcggcggccagcgccagcccctcggcagtgccgtagagcagctgcagctcgcgcgcctcgttctcctcctgcgcctgctgcctgcgcagcgccacctgcgccgccatgacacgctggcgctccgcgatgagcgtgcacttggcgcacaggcagtccttccagcgacagtagcgtttgtggcccttgagggccgacaccacgccatggttgcgacagcgcgcgcacttgggggtccgcgggtacttctcggctgcccgcagcaacagtggcggcccccgcagcaagccgcctgccacgctcaccggtag

SEQ ID NO: 26293 - DNA, 60 bp, Homo sapiens; identical to SEQ ID NO: 49
  misc_feature 1..60: note = chr1:50887175-50887235
  misc_feature 1..60: note = hyper
  source 1..60: mol_type = genomic DNA

SEQ ID NO: 26294 - DNA, 30 bp, Homo sapiens
  misc_feature 1..30: note = chr1:50887723-50887753
  misc_feature 1..30: note = hyper
  source 1..30: mol_type = genomic DNA
agagagatgtgaaggcgcagatgtgaaggc

SEQ ID NO: 26295 - DNA, 565 bp, Homo sapiens
  misc_feature 1..565: note = chr1:50888231-50888796
  misc_feature 1..565: note = hyper
  source 1..565: mol_type = genomic DNA
gagtagtagtcggggcggaagacgtatcctgcgaaaagttaggcatttcgggagggggatctttctcgaagaccacctcacactgccctcccctcccctccgggtttagggacagagtcgtcagacacgccctccccgtcttggggtcccaggggacccctctcgagcgcaggctcctgcgttctgatctcagagttggggtcctaggacacggatggcccagcaggccgcaccaagccaggggagtcgccttcgcaactggccataaacggacaccagagtccctcccacgccgcagccccataaggcccaagcaggcccagctccccgcttctgccgcggtctcctctgcttcccgcgttccccgtccctgccagagcccgcgacagagtccttgtgtctccgtccgagagtcccagacctcctctctatgagcgttgcctcctctcccagacccttcgggcgtccctaaggcccacggggcccaggcctcctcaacaggggccgcagaccaggtctccacccactgctctccctgcggccctcaactacctgccttgggctc

SEQ ID NO: 26296 - DNA, 727 bp, Homo sapiens; identical to SEQ ID NO: 1721
  misc_feature 1..727: note = chr1:50889123-50889850
  misc_feature 1..727: note = hyper
  source 1..727: mol_type = genomic DNA

SEQ ID NO: 26297 - DNA, 318 bp, Homo sapiens
  misc_feature 1..318: note = chr1:50890061-50890379
  misc_feature 1..318: note = hyper
  source 1..318: mol_type = genomic DNA
tttttcttttctaaacgaaagtaaaaagtggcctctgtgtctccgcagattctcttaaactcaggacgcgcatcggtctgtccgaccttcccggcaagagacaaagtcactgctgggaggccccctcggacagttttcagttttaactttcgccttattctcgtcttgtcttgatgtcacggccctgaggaacagctcgttctgcagaagaggtaacaggtttcagattttgtttcctttttgaaaggctgttgcctttcaaacatctggaattaatgccgcggccctcgggcgagtcgccctcggtttctgtagctc

SEQ ID NO: 26298 - DNA, 20 bp, Homo sapiens
  misc_feature 1..20: note = chr1:50890629-50890649
  misc_feature 1..20: note = hyper
  source 1..20: mol_type = genomic DNA
cgcgcagactcggcccgggt

SEQ ID NO: 26299 - DNA, 689 bp, Homo sapiens
  misc_feature 1..689: note = chr1:50890795-50891484
  misc_feature 1..689: note = hyper
  source 1..689: mol_type = genomic DNA
cgccccggaagagccctggaagatgcccaccgggaggctgaggctggagggaggagtgggtgggggtgattcgctggaggaccgggcggagagcttccagaaagttcaccaggccccggcgcgagggcgctccgacacggacaaggtctatgatagcgataaaaagctggttactcgctcccagaaaatgccacttgctggagtctgtgaatgggtttaggagagagaagggtgtcagcccccgcgagggtctcccgcgtgaagtgaggataagggagtgcttcagggataatatgtcctctaggagcgcaggacccagaccccaccttccaacacctggaggttccgaggccaagtatgtctagccccggctgcacctgggtaggtgagccatggggtcgggggaagagcgccgacaaccgccggattccgcgcaggggccgccaggcgcctgctcccagagctcctttggacaaagttttcgggaaattctattaaaccgaaaacgaaataaactatacaaatctgcctagcttttgagggggcggtggcccaggtatccttctcgcttgaggccaggtcaccgtgagatttccccactccggaccggggatcccgcagaagccaagggtgtagccacgaggactcgggaacccgaggcggcccagcagatgcgtgaggaacttcat

SEQ ID NO: 26300 - DNA, 131 bp, Homo sapiens; identical to SEQ ID NO: 1725
  misc_feature 1..131: note = chr1:50892153-50892284
  misc_feature 1..131: note = hyper
  source 1..131: mol_type = genomic DNA

SEQ ID NO: 26301 - DNA, 813 bp, Homo sapiens
  misc_feature 1..813: note = chr1:50892336-50893149
  misc_feature 1..813: note = hyper
  source 1..813: mol_type = genomic DNA
cgtactcttagctcagaatcatttgctgacgcctctgctgtgccaggggctgggggcccgggtgagagggcccagccaagaaaatccaccccatccctattcgcccccggccccatcccccacgcccacgcccaggaactggtggcgtccaaagggactgcgttggggtgaggccggggttgagggcctagggcgcagagccggctggagacgcggcgtggggaagggggccgagggtgagtagtgtagctctgagtaaaagagccaggggcgccgatgggggacccgggaggcattgacttttgcgctgtttgcccgcggcctcggagcaagcagacgccatctgtttgccggctgcgacgcgtcccgtttaattaccctcccggcagcctaatagagatgatattaaactaaatctttctgacattaaaagtaattatccccaaaccggtggctccgggacggaatggcccctcccgcacccaccccttccctggccgcgccggattccgttagtttggctgatactctccgcccgggaatggggcgcagaggaaagggggaaagtgcctttgggagaaggaatctccacgggttgccctacacgcgttttcccgcacaaccacagactctcctgttcctatgtgaacacacgcacgtgtacacacagacacgtagcgacattttcctccagatcaactcatgagtcatgctgatgaagaccctcagccgcgcacaccctctgtggacagggagacgcgcagcttggtttcctgtccccgtcctctgacaccgctaaaatggtcattttcc

SEQ ID NO: 26302 - DNA, 273 bp, Homo sapiens; identical to SEQ ID NO: 5498
  misc_feature 1..273: note = chr1:50893150-50893423
  misc_feature 1..273: note = hyper
  source 1..273: mol_type = genomic DNA

SEQ ID NO: 26303 - DNA, 359 bp, Homo sapiens
  misc_feature 1..359: note = chr1:50893518-50893877
  misc_feature 1..359: note = hyper
  source 1..359: mol_type = genomic DNA
cgttggccgggaacccgctggtgctcagcttctatccggaccccggacctaaaggccgggcagaacaaccaactgaaggtggaggagcgagggcactggtgctgattgagcggcaggagcccccgaggcggagtcccagcggctgcagccctcctttggatcaagccctcgcgtcttccgggcaggcggaagggaggcgtctgcccagtgtcgccaggcttctcacgattttctggttgggagcatctaagcctgagacaaacgcatggagagcggtgttcaccgccccactatttgtttctatttgtgagcgtctactgagtacagccactctgataaacactcggtgtgtgctctct

SEQ ID NO: 26304 - DNA, 113 bp, Homo sapiens
  misc_feature 1..113: note = chr1:50896073-50896186
  misc_feature 1..113: note = hyper
  source 1..113: mol_type = genomic DNA
cttcctggggcattgcggatggtgtgcaccggctacgtggtcttctttgggccatccttctcctggtttccatctcccaagaggaccccttgaaatagcgattccgagaatcg

SEQ ID NO: 26305 - DNA, 30 bp, Homo sapiens
  misc_feature 1..30: note = chr1:51442776-51442806
  misc_feature 1..30: note = hyper
  source 1..30: mol_type = genomic DNA
ggagcaagaaaaggtcgtgctcacagcctt

SEQ ID NO: 26306 - DNA, 46 bp, Homo sapiens
  misc_feature 1..46: note = chr1:52456259-52456305
  misc_feature 1..46: note = hyper
  source 1..46: mol_type = genomic DNA
ggacggtcggcgggacggcaggacctggcgtcgggagggcgcggag

SEQ ID NO: 26307 - DNA, 303 bp, Homo sapiens
  misc_feature 1..303: note = chr1:53067878-53068181
  misc_feature 1..303: note = hyper
  source 1..303: mol_type = genomic DNA
tccggggcaggggtgcgctgcctcaggacagacggtgaaactgaggtccagagccggacatccaccgcctgcggagggaacgagaacgcggcgcgtcctgccttgcgggccgagcggcgccagagccgcctcctcccgccccccgcgctagatccccccgccccgtctttgccctcgcgacgccgccacctccggaacaagccatggtggcggcgacggtggcagcggcgtggctgctcctgtgggctgcggcctgcgcgcagcaggagcaggacttctacgacttcaaggcggtcaacatcc

SEQ ID NO: 26308 - DNA, 463 bp, Homo sapiens
  misc_feature 1..463: note = chr1:53068182-53068645
  misc_feature 1..463: note = hyper
  source 1..463: mol_type = genomic DNA
gggcaaactggtgtcgctggagaagtaccgcggatcggtgagtgcgcggggtctggcggcgccgctgggcccggcctcgccctggcggggcctgctggggacgccccgcagcccggtcccccgcgcggtgtggctccgaggacgctccagccgcgcggccgccaaaccccggcccccgccccgctcggccgtgacctctggcgcggcgcccccatcccgcgcccggcccggcccggcccgcggctacgtggcacggccttggcgcggaggaacccgaagcgctcgcagtcggcgcccacttcgctaccggcacctttgggcagcggggtccagaccttcgccgggaggccgggcaccactgcccagcctttgccattcacgggtgaaaaaagtaaccgtagcatcgtgcggcctttccctctcccgtcctcattttctgcatctggaacggggagtggctgat

SEQ ID NO: 26309 - DNA, 370 bp, Homo sapiens
  misc_feature 1..370: note = chr1:53098683-53099053
  misc_feature 1..370: note = hyper
  source 1..370: mol_type = genomic DNA
cgagactcccggcgccggctcggtgcaggtaaggcgcccgcgccctggcctcgaattcccgccccgccactctggccgcgtcgtgctgtcgttgcgcacccagcgccctcgtgcaggcagggggagcgcagtggggagggggcaggaagcgcaggcagagccaggcgagcacgcggctcccggcccagctccccgcgtccgctccggctcctgccgcgttccagcagccgtcactcccgccgccggcccccgccgcccgccccgcctgcccctacccctccgcgcgggccgggcacctggccgccgctcggtcctcggggccccgcgctgctgtctctgtctcggcttctctcggcccctgggtctcttc

SEQ ID NO: 26310 - DNA, 312 bp, Homo sapiens; identical to SEQ ID NO: 5502
  misc_feature 1..312: note = chr1:53099054-53099366
  misc_feature 1..312: note = hyper
  source 1..312: mol_type = genomic DNA

SEQ ID NO: 26311 - DNA, 352 bp, Homo sapiens
  misc_feature 1..352: note = chr1:53168843-53169195
  misc_feature 1..352: note = hyper
  source 1..352: mol_type = genomic DNA
gggggctgcccagctcgccgtcctctgcagatcccctcgggactctcagcattttgtgggttagccgtggagacgccctgcccttcctgctttggccagtcaaccccctcaagcccgtgcccgtagagcctgcagcccttcctcacctcatcactccccatccccccaagatatagaaaggccgtgacagctgccagccctgcacatgctcttgtttcaacagcggcgattgcacatcacgtagtccccacgtgacctgtcgggcctagggcaagcgcaaagctttcggaaacccgaattattgcaaccttgacttcctgcctgtctctgaggctcccgggctgtgctttaa

SEQ ID NO: 26312 - DNA, 276 bp, Homo sapiens
  misc_feature 1..276: note = chr1:53308332-53308608
  misc_feature 1..276: note = hyper
  source 1..276: mol_type = genomic DNA
ggctaggaggccgcccggggggtggggtctgcggcgggccggcccccgcgtgcgcgtcgcctcgccgggcatttcaaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttcttgcacccgggccacacgccccggaacatcgtccctcctga

SEQ ID NO: 26313 - DNA, 368 bp, Homo sapiens; identical to SEQ ID NO: 1728
  misc_feature 1..368: note = chr1:53308907-53309275
  misc_feature 1..368: note = hyper
  source 1..368: mol_type = genomic DNA

SEQ ID NO: 26314 - DNA, 49 bp, Homo sapiens
  misc_feature 1..49: note = chr1:53527557-53527606
  misc_feature 1..49: note = hyper
  source 1..49: mol_type = genomic DNA
ctgggaactaggaagcgtcgcggaccagacagcccgccttcccggtctc

SEQ ID NO: 26315 - DNA, 92 bp, Homo sapiens; identical to SEQ ID NO: 5507
  misc_feature 1..92: note = chr1:53527939-53528031
  misc_feature 1..92: note = hyper
  source 1..92: mol_type = genomic DNA

SEQ ID NO: 26316 - DNA, 184 bp, Homo sapiens; identical to SEQ ID NO: 5508
  misc_feature 1..184: note = chr1:53528255-53528439
  misc_feature 1..184: note = hyper
  source 1..184: mol_type = genomic DNA

SEQ ID NO: 26317 - DNA, 30 bp, Homo sapiens
  misc_feature 1..30: note = chr1:53528728-53528758
  misc_feature 1..30: note = hyper
  source 1..30: mol_type = genomic DNA
caggttccaggtccccgagccacagcccgg

SEQ ID NO: 26318 - DNA, 838 bp, Homo sapiens
  misc_feature 1..838: note = chr1:54203828-54204666
  misc_feature 1..838: note = hyper
  source 1..838: mol_type = genomic DNA
gtattgtcccggggccgagtttgagcaggtcactgccccttcggtggattgcgcgtctttaacataggttagcaccacgacacctagcccaatcagaggtcaaacccacctgattccacgcaaaagccccctcgctcaggagcggttcgcccttccctggtgtggggaggaccccaggcccccgcgccgcggcgcattaccgcgaagtcccacccaaatcctcctccaccgaaaccagcctcctttgcacgaatggtgaaactgaggcctggagcgggtaaggcgcctgttccgcgtcccccagtggaacacggagccggcggcaacgaggattcccagagcagggctcgggcgaagccccggagacggctccgggtaggtcacgggctgcgcgcttcgtcgactctccggggccgagctgcgcgcagaagctggggacccgaacccaaaggcccgagggaaacccccagagactcacccgcgaccacccgaacctggaaaacaggagtcccaagctgggcgctgaatcctgcgacgcgaacccatcacgcgcagccgggacacccacattcctatgcgcagcggaggaatcgagcccgtcgcgcgcgcaaaccggcacagtgggcaatgcccacgcggccgccgccacacacccgcacacccgccgaggcacgcccggggacggacacgccacccacactgccgctggtcagacgctcagcagcgcacaaccacacagtcccacgctctcgccacacgcgcgtgcgatgggggccgcgacagagcctccctcagcccttccatcaggggcccccaaactctccgttcccctccgcgc

SEQ ID NO: 26319 - DNA, 168 bp, Homo sapiens
  misc_feature 1..168: note = chr1:54940331-54940499
  misc_feature 1..168: note = hyper
  source 1..168: mol_type = genomic DNA
gctagaatgtgagatcgcggagggttgagtggcttttgccccacatcctgcggccagcagccggccatggctaggagaggcgcccgacgcctggcgctccccgtccgggtctccggccgctgcggggctgtgagggcccccggcggtaccggccgggggtggcccagc

SEQ ID NO: 26320 - DNA, 254 bp, Homo sapiens
  misc_feature 1..254: note = chr1:55462673-55462927
  misc_feature 1..254: note = hyper
  source 1..254: mol_type = genomic DNA
ctgggaggggaggtgcggtcaccgctcagccgccgactcagccgagggagaccttggccagcccctgccactccgcaggctcggtttcctcgcctgtgaaatgcgggcgatgactcccctccccgccgcgactgctcatcaccgggtccgagcccagccgctgaccccgggggaagcgccttgctcagcgccgggcggcccacgaggccctgcaggaccgcggctgcggagaccgttcccgccacccgcctggg

SEQ ID NO: 26321 - DNA, 89 bp, Homo sapiens
  misc_feature 1..89: note = chr1:55505073-55505162
  misc_feature 1..89: note = hyper
  source 1..89: mol_type = genomic DNA
gctgtttggggagggcgaggccgaaacctgatcctccagtccgggggttccgttaatgtttaatcagataggatcgtccgatggggctc

SEQ ID NO: 26322 - DNA, 30 bp, Homo sapiens
  misc_feature 1..30: note = chr1:55505516-55505546
  misc_feature 1..30: note = hyper
  source 1..30: mol_type = genomic DNA
accgtcagctccaggcggtcctggtggccg

SEQ ID NO: 26323 - DNA, 522 bp, Homo sapiens
  misc_feature 1..522: note = chr1:57110923-57111445
  misc_feature 1..522: note = hyper
  source 1..522: mol_type = genomic DNA
accccgcgcccgccccgcgcccctcgcggctcggggtccgccccctcgcccgcagggcccgctgcactgtgggtaggcggcggcggcggcggctacgcggagcggcaggcggtggagcgaggccgcgcgcgccgaagatggctgagaagcagaagcacgacgggcgggtgaagatcggacactacgtgctgggcgacacgctgggcgtcggcaccttcggcaaagtgaagagttgagtacgcgctccggaccgctgtgcggggctgcctgacttgcgggaggccgaggggagaggcgggagccccgggcctccggcgggcgcggggctcggcggcaggtggagcggtcccgggtcgcgcggagctggggccccgggagggtggcgcgcaccgcctcgcctggcaccggcgcccgggccccacagggtccagggaagagggcgggggtgtgagctgaggatgggcgtcctgggttccaggttccgcgcccatctgcctttctggaggtcggagcaaggcactt

SEQ ID NO: 26324 - DNA, 36 bp, Homo sapiens
  misc_feature 1..36: note = chr1:57888031-57888067
  misc_feature 1..36: note = hyper
  source 1..36: mol_type = genomic DNA
aggagggctcgcccccgggctcgcccccgtccagct

SEQ ID NO: 26325 - DNA, 70 bp, Homo sapiens; identical to SEQ ID NO: 5512
  misc_feature 1..70: note = chr1:57888327-57888397
  misc_feature 1..70: note = hyper
  source 1..70: mol_type = genomic DNA

SEQ ID NO: 26326 - DNA, 255 bp, Homo sapiens; identical to SEQ ID NO: 5513
  misc_feature 1..255: note = chr1:57888780-57889035
  misc_feature 1..255: note = hyper
  source 1..255: mol_type = genomic DNA

SEQ ID NO: 26327 - DNA, 568 bp, Homo sapiens
  misc_feature 1..568: note = chr1:57889036-57889604
  misc_feature 1..568: note = hyper
  source 1..568: mol_type = genomic DNA
gtgcccgcgaaagggctgggattactgggatagagtcggtttttcgagaggtcgaagccgaatctcagcgctacggaggagtagggaagtgagaacggggttcggccgaatgaggaaaagggtctggccaccagcgagggagggagggagtttcgggagcccaggacagcgggagaaggcaggctcgaggtccgatatagccaggaccgcaggaggaaagagggcgcagggggtcttggagagagacgcgtgtcaggggtggacaagtctggagacaggatcgcgcgtggtcggaagtagggagacaggggcgcggggatggggggcaggacagagaaagagaagtcgcccttttcctcccagcaagtggagggagaaggcgaaaaactgctgcagtcgccatcctcccagcacccctagccaaactgctgagtggcgcgtcccaggagccctcctccgcgccccggggctccagcgaagcctcctggctccccggcgccctgtcctcgcggggcacctgcggcgctgaactcaagggttgccgcgcgcccccgccgcgcctcacctc

SEQ ID NO: 26328 - DNA, 427 bp, Homo sapiens
  misc_feature 1..427: note = chr1:57889605-57890032
  misc_feature 1..427: note = hyper
  source 1..427: mol_type = genomic DNA
cctagcccagagcatcctcctccgctgccgcagccgcccaggaagcggctccccatgcccggcgggcggcggcactcaggcgcgctctgcagcccggggaagcccgggcgagcgccgagctgggtccatcctccccgggagccaccggccccgcgtcagagtagggggaggagaccgccacccgcgcggacccgcctcctcccgcggccccccgccccgccgccccccgcgcccgcccggcgccccgcggcaccgctcacctgctagctccccggccgccgccgccgggccgtgagcccctcgccccggcctcgcggctccctccggggcgctctctgcgcagccggagcgcgctccgagagcttagccgagtggcggtggcgacgaggaggtggaagaacgagcgagcgagcgagcgagcgagcgg

SEQ ID NO: 26329 - DNA, 327 bp, Homo sapiens
  misc_feature 1..327: note = chr1:57890258-57890585
  misc_feature 1..327: note = hyper
  source 1..327: mol_type = genomic DNA
cttttatccaagcctcgaaaacatatgcatacccaaatatatggagtgccaggaagggcgaaaccacgaggggagtctccgcgagggcatgttgcccccacgccccttggcaggagggggcgctcgctcccagccgccagtgcaggttcggcggctcctgttttgactgaggtttcccaggcaaagttcggcaagttgggagggagaaggctggcacgtgtcaagtttccgtcagtcctcaggagagacccgtgcccctgagagcacgcagaccacggttaactccggcttactccccgcgactcccctactcggctcttagaatga

SEQ ID NO: 26330 - DNA, 174 bp, Homo sapiens
  misc_feature 1..174: note = chr1:58715153-58715327
  misc_feature 1..174: note = hyper
  source 1..174: mol_type = genomic DNA
cagaaagaaagcatgcgtccggatggcgggagggttaaaattacagtctttgggtaagacccctggccagcttgcctggtttctagatacataagtggacagaaaagaaatgaagagaacgcggactgagcgaggaaatgctcaagaccacaggactgaaccccccggaagtct

SEQ ID NO: 26331 - DNA, 173 bp, Homo sapiens
  misc_feature 1..173: note = chr1:58715359-58715532
  misc_feature 1..173: note = hyper
  source 1..173: mol_type = genomic DNA
cgacgcggatgaagttgtttccccgggacaggaagggttaaatggctgcgcgtcaactcggcctcgactggggtgtcagggagcaagagccgcttgtctcgggggattccgcttggggggttcccaggggtcgccctggcgctccggccacaacttgggcggctctgtgcggc

SEQ ID NO: 26332 - DNA, 322 bp, Homo sapiens; identical to SEQ ID NO: 53
  misc_feature 1..322: note = chr1:58715533-58715855
  misc_feature 1..322: note = hyper
  source 1..322: mol_type = genomic DNA

SEQ ID NO: 26333 - DNA, 268 bp, Homo sapiens
  misc_feature 1..268: note = chr1:58715978-58716246
  misc_feature 1..268: note = hyper
  source 1..268: mol_type = genomic DNA
cgagcgggctccgcttttgttccctggggctggcaggtccgtgtggggccagggcgcgcgggagacgccgcggagctgggtatcccggagaggggatgctcactcctagcggctccgctggcagcagtagtggcggtggcagcagaggcagcggtagcaacagcagcagtagcagcagcagcagcagtagagatagtgccggctctctgcaggccacatctttcataccttatacatcactaccgcattcccccgaataggggagccc

SEQ ID NO: 26334 - DNA, 430 bp, Homo sapiens
  misc_feature 1..430: note = chr1:59042065-59042495
  misc_feature 1..430: note = hyper
  source 1..430: mol_type = genomic DNA
gctccacctgcaggggttctccgcgcacgcgcaagtccaggccgccgcggccctggaatagagactcgcccttgatgtccctctcgaagtagtaggcggcatcgccgatatccacgtcaccggcggccttctgagacgtgttctgccgcagctcgatctggatggtgggctgctcgtagtgcacggccgccacgaacttggggtgcagccgatagcgctcgcggaagagccgcctcagctcggcgtccaggtctgagtggttgaaggcgccggcggtggggcggtggcgcaggtcaatgaggatgtggtgggtgcgcaccagctcatcgcagcgtaggctcaggtcgcccttgtccgtgcggcgcacgcccaccgagttcacgcaccagcacaccgacgtctggttgcactggcgcgccttgaagcggcc

SEQ ID NO: 26335 - DNA, 271 bp, Homo sapiens
  misc_feature 1..271: note = chr1:59612368-59612639
  misc_feature 1..271: note = hyper
  source 1..271: mol_type = genomic DNA
agggcacacagtgggcgcttagtaactgtagaaagaagtcgaacgaaatcggaagggggagaggcagaggccacaatcaagacacggaaacgacagtcagtcgaggcagcagagagggtttcacgcgggccagcggaggcgcagggcagttgagaagggaacttgccacggggcggaggggccgcgctccccaccagcgcggcgcgggggcgctaggccagggaccgccgggccagggaccgccggctgcgagcagcgggaacggacctgc

SEQ ID NO: 26336 - DNA, 259 bp, Homo sapiens
  misc_feature 1..259: note = chr1:61508695-61508954
  misc_feature 1..259: note = hyper
  source 1..259: mol_type = genomic DNA
gagagggcgccgcagcgagtcccgagatccgagcccggcctcgacgccggagcgctcccggagctggtccttgcccgaagcgcattaaaacggcgccctctggtgtcagctcgcggcggccgggtaaaagcagtggcgctgggggtagagttctactcgccaccctgttcgcaaactgaaagatccccgagtttagaaagtgtcttgccgctctgcggacgctgtgtccgcggccccgctgtcgcgcagagctgggctg

SEQ ID NO: 26337 - DNA, 44 bp, Homo sapiens
  misc_feature 1..44: note = chr1:61519551-61519595
  misc_feature 1..44: note = hyper
  source 1..44: mol_type = genomic DNA
cacgaaagtaaggatcggttctgccgcgtcgccccctccttccc

SEQ ID NO: 26338 - DNA, 102 bp, Homo sapiens
  misc_feature 1..102: note = chr1:61549208-61549310
  misc_feature 1..102: note = hyper
  source 1..102: mol_type = genomic DNA
ggacgcgcgttcccccgcgccggccgggtggagcctgcgtcctcgccgcgcgccggtggcccgttggctctcccggagtgaaagtttcggggccgagacgag

SEQ ID NO: 26339 - DNA, 248 bp, Homo sapiens
  misc_feature 1..248: note = chr1:62784355-62784603
  misc_feature 1..248: note = hyper
  source 1..248: mol_type = genomic DNA
ggctgcatcccagaccgcagcgcctagctcggaaaagctgggcgggggctgcaccacctgagtcgcaaggacagcacggcctccccctcctcaccagtgttctccacccccagaattggggcgcggagagccaatctgggctggaaagggagcggcgcccacctttgggcagcccgagcagccccgctccttttctgtcgcagaccccaggctgggaggcgggggcgccaggtcggcccaagctgccg

SEQ ID NO: 26340 - DNA, 276 bp, Homo sapiens
  misc_feature 1..276: note = chr1:62784870-62785146
  misc_feature 1..276: note = hyper
  source 1..276: mol_type = genomic DNA
tccgggtgcactgtccgcgtcccaggcgcgcaccccggggctggcgcaccctggtcgtccgcggcgcgcacaccctccaggcgccctctggccgacggtctcggccctggccccggcgcacccctgcgggcacacccaccgcggcggatgcgggactggccaggcgccgccagccgcggcttcgccccgcgtcgccagctgccaacagcgcccgagtccccgccttcgctaggggagaaaaaaaagactcctgacgcggcgcggactttggtgtgt

SEQ ID NO: 26341 - DNA, 472 bp, Homo sapiens
  misc_feature 1..472: note = chr1:63539509-63539981
  misc_feature 1..472: note = hyper
  source 1..472: mol_type = genomic DNA
aaaaacaaagccaagcgaagtgggcctgccagagttaactatgttcacagagtgcaattaagtgtttggaaggttctgtgccgtgtgctctgatttacggccgcgttcctgggacgcccctttagccgggcgaacgtggagggggccaggcccggccgtgcgcaccctgggagcggagccgggccgctggcgctccgggtcttgggcttggcaccgcggcgcaccgggtggcaagcacagcgcttagcggaggccacacctgcacctcatttgcttctgagcagtgccatgacccgcctgctgatggggcgccttccctttcatcctcgggattatgacaagttattaattgccaccattagccgcagcagcctgcccgagatctctgctgctctctggaggtgagaaaccgcgcatctgaatgccgagggaagaggcgctgagcagccagggcaaacggagcaacaatctg

SEQ ID NO: 26342 - DNA, 168 bp, Homo sapiens
  misc_feature 1..168: note = chr1:63784272-63784440
  misc_feature 1..168: note = hyper
  source 1..168: mol_type = genomic DNA
agactttgattgttgcgggcgcgggggtgttggggagaaaggaggggaatttttctaatagtcccacccacgttttgctccctcttggacaaagagtaactactcttggtgggggacgcgcccttcactccgcggaacctggtcccaactccccgtattgtaagaaaa

SEQ ID NO: 26343 - DNA, 50 bp, Homo sapiens
  misc_feature 1..50: note = chr1:63784732-63784782
  misc_feature 1..50: note = hyper
  source 1..50: mol_type = genomic DNA
cccctcccctggagacgtctcaatttccttcctatcgatccggactccat

SEQ ID NO: 26344 - DNA, 306 bp, Homo sapiens; identical to SEQ ID NO: 56
  misc_feature 1..306: note = chr1:63784987-63785293
  misc_feature 1..306: note = hyper
  source 1..306: mol_type = genomic DNA

SEQ ID NO: 26345 - DNA, 149 bp, Homo sapiens; identical to SEQ ID NO: 57
  misc_feature 1..149: note = chr1:63785618-63785767
  misc_feature 1..149: note = hyper
  source 1..149: mol_type = genomic DNA

SEQ ID NO: 26346 - DNA, 251 bp, Homo sapiens; identical to SEQ ID NO: 58
  misc_feature 1..251: note = chr1:63786078-63786329
  misc_feature 1..251: note = hyper
  source 1..251: mol_type = genomic DNA

SEQ ID NO: 26347 - DNA, 593 bp, Homo sapiens
  misc_feature 1..593: note = chr1:63786656-63787249
  misc_feature 1..593: note = hyper
  source 1..593: mol_type = genomic DNA
gcaccactgtccatccggaattaaatccacatcccagcatcttctgcaaatatttcactaattatttcctctcggaactcctcccctcgtgctccttcctctggtgaggccggcgctcccctcccaggccgcagcggacagacagggattgggttccgtgtgcctgccacaccaggcaggctcttgcggctcccaactaggcggcctaaatgagggaggaaagaggaggcgcatcgctgattcaccgcgtcaagagcactgactttccttggaggtgtgaggtccacgcaccccagccacgcacttgggggtcggtttgcggtgcctccccctccagtcccagtgaaatccccacagtttttcctactatcactgacttgccttgcactccgcgtgcattggccacacatcctcgcctcctccacccgctccgccgccggttttcttggaagttaaatcttggaggatttgtccacaccttaagagaagaaaatccacgttagctggcagcaacggagatcccagcatgctggcatgcccaagtctgcccaggttcccccaaggccatgcccgccgcccgggaagtcactgcc

SEQ ID NO: 26348 - DNA, 328 bp, Homo sapiens
  misc_feature 1..328: note = chr1:63787282-63787610
  misc_feature 1..328: note = hyper
  source 1..328: mol_type = genomic DNA
cgctgcgtctaacctgaagacaccaggcctcttcccggatccactcgacttacccaggccgctgccaatcccagctccttccccagcgcctcatttccgattttttcatatgctaagtcgtttaacaactccaagtagccagttatggcttctttatttataggttccctgctattttacgtcgtttttatttctctcggcaactattctagtagattaatcaatagccattttctgaccttcgggaaccccagctgatgctttttgtggccgcacgaaaaaatacatacaggaaaacacgcccgcatcaagccgggaaagagcaggt

SEQ ID NO: 26349 - DNA, 634 bp, Homo sapiens
  misc_feature 1..634: note = chr1:63788133-63788767
  misc_feature 1..634: note = hyper
  source 1..634: mol_type = genomic DNA
caacttgagtttggccggctcggccgcggccctgacgtcacgcacggtcacgtggccccgcctcccgctggatctttaagtagaaagtaatctatcaggccagtccttaaaacgggactttcgactaccggggcttcggcgtccctgacacccagccccctgcccccccgctactgtccctgcccgcgccctcccgagctgctcggcgcccggcgtcccgcgcccgcctggaccgctcctgcgccccacgccagggccagaggccgaggaaggcgggctaagtgagggggcgcggcgtggagaaccgccggggccgggagcggtagcgagcgcctagtaccgagcgccagggacggcaggagttcgcggagcgcggccgctgggggcggacggcagagcccgcgccacgcgatgcggggccgccgagtgtgagctgagcccagcgggccccaagccacctgcggccccctcccctctccctgccccccatctttcgggggcactcaaaccctcttcccctgagctccgtggcagcccccgaacaccctcatcgcccgctgccccctccccgccgccgctaccaaccccgaggagggatgaccctctccggcggcggcagcgccagcgacatgtc

SEQ ID NO: 26350 - DNA, 578 bp, Homo sapiens
  misc_feature 1..578: note = chr1:63788919-63789497
  misc_feature 1..578: note = hyper
  source 1..578: mol_type = genomic DNA
cggcaccccatcacggacagcctcagccgccccaccagcagcccctgacattgcccaaggaggcggccggagccggggccggaccggggggcgacgtgggcgcgccggaggcggacggctgcaagggcggtgttggcggcgaggagggcggcgcgagcggcggcgggcctggcgcgggcagcggttcggcgggaggcctggccccgagcaagcccaagaacagcctagtgaagccgccttactcgtacatcgcgctcatcaccatggccatcctgcagagcccgcagaagaagctgaccctgagcggcatctgcgagttcatcagcaaccgcttcccctactacagggagaagttccccgcctggcagaacagcatccgccacaacctctcactcaacgactgcttcgtcaagatcccccgcgagccgggcaacccgggcaagggcaactactggaccctggacccgcagtccgaggacatgttcgacaacggcagcttcctgcggcgccggaaacgcttcaagcgccaccagcaggagcacctgcgcgagcagacggcgctcatgatgcagagcttc

SEQ ID NO: 26351 - DNA, 64 bp, Homo sapiens
  misc_feature 1..64: note = chr1:63789728-63789792
  misc_feature 1..64: note = hyper
  source 1..64: mol_type = genomic DNA
ggctcacagctcggcccgggcctgcagctgcagctcaatagcctgggcgccgccgcggccgctg

SEQ ID NO: 26352 - DNA, 64 bp, Homo sapiens
  misc_feature 1..64: note = chr1:63789849-63789913
  misc_feature 1..64: note = hyper
  source 1..64: mol_type = genomic DNA
cgcggccgtcgttcagcatcgagaacatcataggtgggggccccgcggctcctgggggctcggc

SEQ ID NO: 26353 - DNA, 26 bp, Homo sapiens
  misc_feature 1..26: note = chr1:63790252-63790278
  misc_feature 1..26: note = hyper
  source 1..26: mol_type = genomic DNA
ggtcccggtcccgctgcccaatcctg

SEQ ID NO: 26354 - DNA, 100 bp, Homo sapiens
  misc_feature 1..100: note = chr1:63792549-63792649
  misc_feature 1..100: note = hyper
  source 1..100: mol_type = genomic DNA
acttataaaattactcgctcatatttccgcgcatagcagcaataccggccgagcctgcgccagcagcgtgacactcagccacaagccaccgccggagact

SEQ ID NO: 26355 - DNA, 109 bp, Homo sapiens
  misc_feature 1..109: note = chr1:63792797-63792906
  misc_feature 1..109: note = hyper
  source 1..109: mol_type = genomic DNA
cggacccagaccctcaagctgccagcggttgtttaaagtcctggcagatgtcaggaagatgggcccggccgtcgcaccctcaaaagctctttttcgtttaagcttttta

SEQ ID NO: 26356 - DNA, 156 bp, Homo sapiens
  misc_feature 1..156: note = chr1:63793435-63793591
  misc_feature 1..156: note = hyper
  source 1..156: mol_type = genomic DNA
ggggcgacgagcagacggaaaacttcgcggtttgtctggaatggtccagccccagccccggacgcctctccttccctcccaggctctgagcctcctgacatccttgcttattctcaggccccggaagcctaggtcgaatctcgagaagctgatttc

SEQ ID NO: 26357 - DNA, 586 bp, Homo sapiens
  misc_feature 1..586: note = chr1:63795348-63795934
  misc_feature 1..586: note = hyper
  source 1..586: mol_type = genomic DNA
aaagacagacacagacgcgccgggccggtggaactcagctccgggaaggctgtggacctggaccctggggctccccgctgcctgggcgcctctagcccggcgatgagtggttctgcggggaccgacggccccatttccttcttgcctcgtgatgtgggagggaagaaagaaggcggcaactgcaggcccgaagctcccctcgcccagcggcccaaccacagtgctgtcgtgtcggggatcggtccccaagggagcccccaaccccctgcccacgccgagatcacccccgtgccaacctcgagggctcggcctgcgggactccagctgcccctgcctggagggagggaagggagaagagaatacgaattaattacgaaggaaacccaggtgtgaaaggcacccgccgcggagctgggcgtgcagcggggcgcgcggtgggacctctgctcccgtccccgtcccgcggctactcagttgcccgctcatgggaggctcgcgacggaaaataaatcccctcagagtgaacctgggaggccgagaggacccagcctgggatctctgggggaaataggggcaagtttaccac

SEQ ID NO: 26358 - DNA, 565 bp, Homo sapiens
  misc_feature 1..565: note = chr1:63795935-63796500
  misc_feature 1..565: note = hyper
  source 1..565: mol_type = genomic DNA
gtttaattaagccacagccctagcacgaggaccccggcgacccatccgggctgggggatggactggagtgccccccaccccaggccgcgaaccggcagcgagaagcacactctccgccatccccggccccgccgcttccgcctctgcggactccgcgtttgccatgctccttcccggggtccagggaccggagctgcggtgcacgtcttattgaaggggagagctttggttcttttcctccctgcatccctcccactttcctctcaacagatagtaagcaagactcaattttctccaaaaaagcccgttacccctttctgcaaggggcgcatgcctaggttcacagggagctctcttgtcagccccagaacaaccctaaactccaaatgttctgtttgctctcgaggtacccctgggatgcagcgtctcctccgcgaagccttcctgagcctccctgcccagaccagttgctccttcttgaagctcaccgtgccaattaatgagccattgtcattagtgttgccctctgagttcctggtgagttcctgaccgtctagcattgctg

SEQ ID NO: 26359 - DNA, 30 bp, Homo sapiens
  misc_feature 1..30: note = chr1:64240116-64240146
  misc_feature 1..30: note = hyper
  source 1..30: mol_type = genomic DNA
gcccgccgctcctggcgctgctggccgcgc

SEQ ID NO: 26360 - DNA, 26 bp, Homo sapiens
  misc_feature 1..26: note = chr1:64240532-64240558
  misc_feature 1..26: note = hyper
  source 1..26: mol_type = genomic DNA
cgcgccccagccggtgttcaggcaag

SEQ ID NO: 26361 - DNA, 30 bp, Homo sapiens
  misc_feature 1..30: note = chr1:65468348-65468378
  misc_feature 1..30: note = hyper
  source 1..30: mol_type = genomic DNA
caccatccgaaagtgcgagcctggccggcg

SEQ ID NO: 26362 - DNA, 41 bp, Homo sapiens
  misc_feature 1..41: note = chr1:65468581-65468622
  misc_feature 1..41: note = hyper
  source 1..41: mol_type = genomic DNA
gctccttccaggtcccggcggggaagcgatgctttcttggc

SEQ ID NO: 26363 - DNA, 275 bp, Homo sapiens; identical to SEQ ID NO: 5540
  misc_feature 1..275: note = chr1:65731231-65731506
  misc_feature 1..275: note = hyper
  source 1..275: mol_type = genomic DNA

SEQ ID NO: 26364 - DNA, 14 bp, Homo sapiens
  misc_feature 1..14: note = chr1:65731781-65731795
  misc_feature 1..14: note = hyper
  source 1..14: mol_type = genomic DNA
ggagctaagttctt

SEQ ID NO: 26365 - DNA, 64 bp, Homo sapiens
  misc_feature 1..64: note = chr1:65990955-65991019
  misc_feature 1..64: note = hyper
  source 1..64: mol_type = genomic DNA
tgggggtgggagggacgggggaaccccagtgcctatctcaagcctgcggtcaccgacgcgggtc

SEQ ID NO: 26366 - DNA, 442 bp, Homo sapiens
  misc_feature 1..442: note = chr1:65991119-65991561
  misc_feature 1..442: note = hyper
  source 1..442: mol_type = genomic DNA
cgccgggtctctcctcccgcaggcccgcggccacccgcagcggcattccccgccgccgcccccgccacctgcgcgaccgccctagccgctcgagtccgctcctcccgctcaggggcggctgcggagggcgcggggcgcacgcgggcggccacccgactcttccctcccttctccccaccccagcctgctcctgctcagccccacctccccacgcactcggctgccctcctcctctcctgagagttgccccgcaccttgggcgaggagttcggagcggccccatcgcagagcccacggccagccgagcgcgcgcgacgcaggtgcccgagccccggcgccgccgccatctctgccttcggtcgagttggacccccggatcaaggtgggacctgcttccctctccgacaccccctattgccacctcttcccgctctgggtaact

SEQ ID NO: 26367 - DNA, 52 bp, Homo sapiens
  misc_feature 1..52: note = chr1:65991605-65991657
  misc_feature 1..52: note = hyper
  source 1..52: mol_type = genomic DNA
cgggccgcttagggactgggagtccggggcagcttagcgggaccaccagagg

SEQ ID NO: 26368 - DNA, 386 bp, Homo sapiens
  misc_feature 1..386: note = chr1:66258265-66258651
  misc_feature 1..386: note = hyper
  source 1..386: mol_type = genomic DNA
aaactcccctggtaccgtgcccgcggaatattgcaggaggtctgtgaggtaggtgggggaaaaaataacctgggagggcaatcagggagaggccagacgactggggacggcgtgctttgcaccctagaattgacaggtggtggcctcagcagttacaacctactacacagcatctcgtccgtgcgatacggtcacattgttattccccgcacccggctgaggagcgcagcgcggcagaccaagtggcaccggcgagctgtctctcttccggggggcgggggtggacagtagggagagggggtttaaagggccagaggacgagagaagagctgaggggcgcgtcgccagcgcctgtgtctccctggcgcgggttccccaggctagcc

SEQ ID NO: 26369 - DNA, 89 bp, Homo sapiens
  misc_feature 1..89: note = chr1:66258671-66258760
  misc_feature 1..89: note = hyper
  source 1..89: mol_type = genomic DNA
cgcccccggcccgcgcgccccttcccggggctcctggcctcgcctcagcggctgcaggctcttcgtcgcgggccgggctgcacgcgagc

SEQ ID NO: 26370 - DNA, 71 bp, Homo sapiens
  misc_feature 1..71: note = chr1:66258761-66258832
  misc_feature 1..71: note = hyper
  source 1..71: mol_type = genomic DNA
ccctccgggcagactttcgtcccccacccccgggagcgcggaaggctcactcgcagcgcatggtctacccg

SEQ ID NO: 26371 - DNA, 314 bp, Homo sapiens
  misc_feature 1..314: note = chr1:66259117-66259431
  misc_feature 1..314: note = hyper
  source 1..314: mol_type = genomic DNA
cggcccctagcctttcgccctcatcttctctgcttcggcttccgcccttggacctcttgacaagtcactggggaggagaggatggagagaggctaagggagaatggagagaggcagaaggattcagggcttggaagccctggagtaggtgacggatgggcgcgcggtgcccagtgattgactgcaggcagcgggcgcggaagggaacctgaactacccaagagtttgctgggctgaggctccaggatgctcctgcgtgccctggtggctggggcaccaaggaggggcgcactcaagcctcggcatcaccaaggc

SEQ ID NO: 26372 - DNA, 623 bp, Homo sapiens
  misc_feature 1..623: note = chr1:66998790-66999413
  misc_feature 1..623: note = hyper
  source 1..623: mol_type = genomic DNA
agctgcagccccagtcggttgcgagaaaagctccccacctggggaagcgaggccgctcccgtgtgcgctcggcggggaggacgcggtggcggcgggactcgaactcggtcgtcgaagggcgccccgcagggtcccgtctgtagcccggacggcgagcccaggttggagtgggagggagccggcgtgcacagctgtctttggtcgggctcaggcttccgctccctgcctgctcccctttccagcctcccgccccagaaacgatctcgagcgttgccagtttgattccagagccccactcgggtgggttcttttgtttctttgttttaatgacagttcccagcccttcagcatgtcatgcgcaattaattccctggctctcacgaaggcagctggggtgaaatttcttctgcatcatccttttggggatgtttatgatgtgacgtcagtcggattgatttttctctcttgaatgaaggatgggaggggagaaagagagacggagagagagagagacgcacagatgtgcacggaggccacagacactgacatttggaattccttcagggtaaaaggacaccggaatgggagcttagaagtgtgttgctaagatttccggctgcacg

SEQ ID NO: 26373 - DNA, 142 bp, Homo sapiens
  misc_feature 1..142: note = chr1:66999473-66999615
  misc_feature 1..142: note = hyper
  source 1..142: mol_type = genomic DNA
ccccctccgcagcgagccacttaggtgctgctttcacgccagagtcccctgttaaggtggcagcccttgataactaatctcgggcacccagccgcttctgtaagcttaaggagacgacgaggaggggcgggggaagtgcgtc

SEQ ID NO: 26374 - DNA, 378 bp, Homo sapiens; identical to SEQ ID NO: 64
  misc_feature 1..378: note = chr1:67217965-67218343
  misc_feature 1..378: note = hyper
  source 1..378: mol_type = genomic DNA

SEQ ID NO: 26375 - DNA, 646 bp, Homo sapiens
  misc_feature 1..646: note = chr1:67773134-67773780
  misc_feature 1..646: note = hyper
  source 1..646: mol_type = genomic DNA
cacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggtgagtgaccagtgactcggggtcggggacagagagagccccaggatcccggaccagcggggtgtctgcgtgcccgggattccgtgtctcgcgtctcccgagggggcttcggcgacggcttctctcttta

SEQ ID NO: 26376 - DNA, 30 bp, Homo sapiens
  misc_feature 1..30: note = chr1:68696775-68696805
  misc_feature 1..30: note = hyper
  source 1..30: mol_type = genomic DNA
cattgaagtttgtgccgggatgtcccaaat

SEQ ID NO: 26377 - DNA, 128 bp, Homo sapiens
  misc_feature 1..128: note = chr1:70032971-70033099
  misc_feature 1..128: note = hyper
  source 1..128: mol_type = genomic DNA
cgggggaggaaaccccgaggaggcgctcccggccgcctctttgctgagatagcaggagcagcagcctgaggagccacgagctcagcgtcactgagctagtgcgggtgcaggggcgctcaggcaggcgc

SEQ ID NO: 26378 - DNA, 111 bp, Homo sapiens
  misc_feature 1..111: note = chr1:70033503-70033614
  misc_feature 1..111: note = hyper
  source 1..111: mol_type = genomic DNA
agctgcagctggtgtcgtcggaaaagggggtgggaaaaaagagagggggcggggagagcggtgagacacagccaagagccatgagcggcgcctcctcgcctgccaatcctg

SEQ ID NO: 26379 - DNA, 543 bp, Homo sapiens
  misc_feature 1..543: note = chr1:70033948-70034491
  misc_feature 1..543: note = hyper
  source 1..543: mol_type = genomic DNA
ctgcgcctccgccaccgccgccgccgccgccgctgctgctgcggtcgctagcgcggcgcgctgggcaggctgaggctggggagtggacgcgctcctgcctcccccgccggcgcttcgggcttcccctcagccgcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgtgagtaaggcacgctcgctccgtggcggagggtgctgcgggggcccggccgcggcgaccgtaggcgcgcgaggtgtgggaccccagaggccggccgggggcgggggtggcagggcgggaggcttcggcgctcgcggggagctgcttgtgcggtggccgagggaggc

SEQ ID NO: 26380 - DNA, 82 bp, Homo sapiens
  misc_feature 1..82: note = chr1:70034492-70034574
  misc_feature 1..82: note = hyper
  source 1..82: mol_type = genomic DNA
gcgaagatgtggtaggttgcagagcatttggaaatggggtgctaactgggcgggtgcatgggagcaccgagtagcttgagct

SEQ ID NO: 26381 - DNA, 108 bp, Homo sapiens
  misc_feature 1..108: note = chr1:70035100-70035208
  misc_feature 1..108: note = hyper
  source 1..108: mol_type = genomic DNA
ttgcgtcctcctctccgagttattaaggatgcaggacgtgtttcggattcgacgtggaaagagggagggaagcacattagcattaaggtaatcatggcaccctggctc

SEQ ID NO: 26382 - DNA, 203 bp, Homo sapiens
  misc_feature 1..203: note = chr1:70035209-70035412
  misc_feature 1..203: note = hyper
  source 1..203: mol_type = genomic DNA
tggactattagattggctaccagtggtctctaatcttactgtttgcagagtcaagaatgggggcgggggttgggggactgtatagattgccttttaaaatagtgtgacttcataataacggagatggctgaaagattgcttccttacactacttctcggccatcagggctgaataaaggacccgcctccgccctctactccgg

SEQ ID NO: 26383 - DNA, 701 bp, Homo sapiens
  misc_feature 1..701: note = chr1:71513046-71513747
  misc_feature 1..701: note = hyper
  source 1..701: mol_type = genomic DNA
gcagcatggccagtgcgttgcccacgaaaccagtgagcagcatggtgatcgggaaggccacggacaccgatccgcaatcctcgccagaccctggagggcgcgtgaggttgccccgcgcctcggcggaacgctcgggcgcccacatgcctgtgtaggagtggttgaggcgggtgcagaagggggcatcccctccgtagccccgggtctccttcatgttggcttcgaggtgaggaggggatggcgtccagagagccgcagcgggagggggcagacgcggcgcgggcggcggcggaggtcggcgtttaccgcggctggggctgggctgccccccatggtgcggggcgcagccgccgccctactccgctgctgggaccgcggccgcggcggcgccagggctcactggcccgggagggagccacgccttcctctctgggaaacctctggtggcgaggcgcgcggaggtgccgagtcccctttataaggccgagggggcggggcgcccgtgggtgtggacagaaccgaggtgggaggagggtgcaaagcaactgagcgcctctcttggctgttgcctatcctgatcgcctgggttgggaagccccagacggtctcctctgaaacgccctgctcctggccggaccgggagcccactggggtctcctccagttctccgctaaagtgtcggtggacggcaagcagctaat

SEQ ID NO: 26384 - DNA, 76 bp, Homo sapiens; identical to SEQ ID NO: 5555
  misc_feature 1..76: note = chr1:72747951-72748027
  misc_feature 1..76: note = hyper
  source 1..76: mol_type = genomic DNA

SEQ ID NO: 26385 - DNA, 67 bp, Homo sapiens
  misc_feature 1..67: note = chr1:72749731-72749798
  misc_feature 1..67: note = hyper
  source 1..67: mol_type = genomic DNA
cgccgggctgttttcagccctgccctggcccaaggcagaaggagatactaggcgtggggccacccct

SEQ ID NO: 26386 - DNA, 481 bp, Homo sapiens
  misc_feature 1..481: note = chr1:72750097-72750578
  misc_feature 1..481: note = hyper
  source 1..481: mol_type = genomic DNA
aagcaaaacctcacacgtccgtaactcgttttccataatgctagcagggtcatttggcaaagcgcaccgaagcaagactctctgcaggggtcagcatccggctgcctccgcagactgagctctttacgaggcaggcagggagtcgttttgcttggtggtagcagtgttcagagtgatttttatcgccatgcacggggatatatggggaaagggaagggttcccatcacctgtgaccacccagactggcttacagacgaatccttaactagcaacacctccctgctgaactggcactccaaggctgggcagctaacggagacatttgcgtcaggagtcactgatgttagtattctgccttaactctcaaaaccgactcggaaactgagagtgcaatagtttcaaccgcattttgaaacatcaataaaatgttagtcatttgcggatgaatgaaaacattttctttaccgtctggtatgctag

SEQ ID NO: 26387 - DNA, 15 bp, Homo sapiens
  misc_feature 1..15: note = chr1:75594000-75594015
  misc_feature 1..15: note = hyper
  source 1..15: mol_type = genomic DNA
cgtggccgttttatt

SEQ ID NO: 26388 - DNA, 127 bp, Homo sapiens
  misc_feature 1..127: note = chr1:75595334-75595461
  misc_feature 1..127: note = hyper
  source 1..127: mol_type = genomic DNA
cctatccccagaaaccgagaaaaccatctggtttttgcacttagataaagtttaactttcctgccacactggccgagttgggctttcagacatccctggggaagtgggaaaacggggatgtggaagg

SEQ ID NO: 26389 - DNA, 173 bp, Homo sapiens
  misc_feature 1..173: note = chr1:75595818-75595991
  misc_feature 1..173: note = hyper
  source 1..173: mol_type = genomic DNA
cgcgccatagcttttagccgggaagctttccaggctgccctgcttaatttcggcgtggttcctaattttctctctcccatcctctctcttagactggaaacgcttcccctatttcttccgtagcggaccgggagagcttactggcgctctgcgaaccggctggaaagaaacac

SEQ ID NO: 26390 - DNA, 249 bp, Homo sapiens
  misc_feature 1..249: note = chr1:75596135-75596384
  misc_feature 1..249: note = hyper
  source 1..249: mol_type = genomic DNA
cgccagtggattcccgggtgtcccgcgtggagcaggcttgcccagctgggaagcccatcaaacctcagtcttggcccacagtgggagagagaccagtgggtcccagacggaggccctcgcccgcttttggcgacctccactggcgtgaataaaagcacccctctcttaccctcagaaactgtgggtagcaaggtataaaacggagtctgggaccggtaagtcccaaggtgagcccgtatacagctctgc

SEQ ID NO: 26391 - DNA, 172 bp, Homo sapiens
  misc_feature 1..172: note = chr1:75596687-75596859
  misc_feature 1..172: note = hyper
  source 1..172: mol_type = genomic DNA
ccactgtacccttggcgctggagccctggaggtgggcggtgagggccgcgggccagggaaagctcgggtccgcaagagcagggctctgtttctgcgcctgcaggccgcccgggagtcctggatgcgcctcctttgaccacgttttctctcaggctccagctgtgcctcgccc

SEQ ID NO: 26392 - DNA, 444 bp, Homo sapiens
  misc_feature 1..444: note = chr1:75596929-75597373
  misc_feature 1..444: note = hyper
  source 1..444: mol_type = genomic DNA
cgggaatccgagtttccggagattgcctgagcaccgcagaacctccaggttaagttctctcaaacgtgtggttactcaccccgaggagctcagaggcaaagggttcaatagtcaagttggtggggactttccctacttaaagttataatttgctaattcggatctattgcttttaaatatcgagttccagagacctctgtcaatgcaggcttaatttcatcccactgatgaaggatgtttataaacggcgcctgcagtgcgagctgagtgtgaaaatatcagttttatgccttttgataagaattaccgaggcggaaggctcattagacgattacaaatttcgcagctgctcgcagcccaattaggcagctcttcgggtgagtggaagctgtgggggtcagggcgggttgatgttccctctctccagcccggacctccaatcaa

SEQ ID NO: 26393 - DNA, 794 bp, Homo sapiens
  misc_feature 1..794: note = chr1:75597923-75598717
  misc_feature 1..794: note = hyper
  source 1..794: mol_type = genomic DNA
cccagaccgacaggacgatcagccctgggattcatagcaaacacattcccctcttcttgcacactcgacccccagccaaaggcttataccgcccaggacatagaaattgactcaccgcccagaggcttacagctcaaggaggggtgcgcgcagctgcaccccgggacaggtcagcatcccacaaggcgcctggagtaaagcgaggccagaccaatctttcacgtcttctgctcctgtctgacgaccattcttcttccccaagcccagaaacctctaaaaatgaatcattttctccacttatgcagagatagacgctcttagatcaaggttagtattttgaaaacctgactgagagccgcctgattaggcgagggtgggtggaaagaccgcataaatgcccgcacccccgccctgcttccctaacacagctccagctctctctggatctccaaatgacccgcgcgataaattctcctcgatagtagccagacagtaccccagattcactttaaaccctaacacacacacacacacacacacacacacacactgtaattaaatatccaaaccggacctttatgtttaattccactttcaacgaaatcctgctctatacacgacctgatggcgccaatgttctgcacgactctgactttccattcggaagagcggtctccacaacgatgctatttcatggaaaatgcattatgtgaatttctccaccacccccaataccgatttctgcatttgatgaaaaacacaagtctttctggttcccacgcacaagttagctt

SEQ ID NO: 26394 - DNA, 285 bp, Homo sapiens
  misc_feature 1..285: note = chr1:75599387-75599672
  misc_feature 1..285: note = hyper
  source 1..285: mol_type = genomic DNA
cctccgccgcttccccgccccgcagtcagaacttgaggcagaagacaaggctgctcgggcttacattttgtctaggagatgaaagagcaatactcattagcaacatacttttgtctttcttgtagccttgatttcaaatctagtcgcaaatcataagcttttgtgttgctcagatgttccttctttatcttaatgagaaaacttttcggaaagggagcgcgaactgctagataagtcagctcccaggctgccaggagcggtggcattcctcggctacaccggaca

SEQ ID NO: 26395 - DNA, 482 bp, Homo sapiens; identical to SEQ ID NO: 5564
  misc_feature 1..482: note = chr1:75600203-75600685
  misc_feature 1..482: note = hyper
  source 1..482: mol_type = genomic DNA

SEQ ID NO: 26396 - DNA, 433 bp, Homo sapiens; identical to SEQ ID NO: 5565
  misc_feature 1..433: note = chr1:75600686-75601119
  misc_feature 1..433: note = hyper
  source 1..433: mol_type = genomic DNA

SEQ ID NO: 26397 - DNA, 89 bp, Homo sapiens; identical to SEQ ID NO: 5566
  misc_feature 1..89: note = chr1:75601187-75601276
  misc_feature 1..89: note = hyper
  source 1..89: mol_type = genomic DNA

SEQ ID NO: 26398 - DNA, 151 bp, Homo sapiens; identical to SEQ ID NO: 5567
  misc_feature 1..151: note = chr1:75601277-75601428
  misc_feature 1..151: note = hyper
  source 1..151: mol_type = genomic DNA

SEQ ID NO: 26399 - DNA, 536 bp, Homo sapiens
  misc_feature 1..536: note = chr1:75601929-75602465
  misc_feature 1..536: note = hyper
  source 1..536: mol_type = genomic DNA
ctccgctatgattgacgtctggaaagaaagagctttgtgaggggatgattgttattaacttgttatccccggcgggggggcggggaaccgacgtgcccgggtgagcgccggagacccggagcccggggagcgcgggacgagctaccagcgctcgggtggcggccgccagcggccagcgaaggaggctgcgcgccagcccgcccgcggcgcccgggctcaggcgccgtgacggctgcacgcgctgccccgcactctgagggccttcattagctcgctccccgcgccgaggctggggcgggcagcacgctcggaacttctgatctgtttctccatactttctccccctcctactccgcagtgtcaggggctcatgtcagaggagtgcgggcggactacagccctggcggccgggaggactcgcaaaggcgccggggaagagggactggtgagtgcggaggggctcgcgtgctggcaagactggccgtggggaggcggcgcaggacgaagggccgctgtccccgcgctccttccagggc

SEQ ID NO: 26400 - DNA, 440 bp, Homo sapiens
  misc_feature 1..440: note = chr1:75602719-75603159
  misc_feature 1..440: note = hyper
  source 1..440: mol_type = genomic DNA
tgggtaggtgggatgcgaaggggaggaggggtctagaaccgcctgcgcctcgcggtttcctgcaggtgagccccgagggagcgggggacgaggactcgtgctcctcctcggccccgctgtccccgtcgtcctcgccccggtccatggcctcgggctccggctgccctcctggcaagtgtgtgtgcaacagttgcggcctggagatcgtggacaaataccttctcaaggtaggatagggcctcgggtgcgaggcccaaggggagcgggcttagcgtgggagctctgggaaaagagtaatgttcctcccaccaacctttccgttcaagttctgggtgaaggttgtaggcttttgcagaaaatcagcccagtttagggcaactcatgcggtgggataaagtgagaagaaatcccagactcttctatgtcgttgcaaaacagct

SEQ ID NO: 26401 - DNA, 449 bp, Homo sapiens; identical to SEQ ID NO: 5570
  misc_feature 1..449: note = chr1:76080278-76080727
  misc_feature 1..449: note = hyper
  source 1..449: mol_type = genomic DNA

SEQ ID NO: 26402 - DNA, 325 bp, Homo sapiens
  misc_feature 1..325: note = chr1:76080728-76081053
  misc_feature 1..325: note = hyper
  source 1..325: mol_type = genomic DNA
cgccccggaccacgccgcaatgcctcgtcaccccagcaacaagctcttccttgtcctccccgccatcgcttctctccgcgaactttccaactttggaagcccgggttccaaaggagcaacagggagactgcttagccggagccactgcccgtctcgacaggttggggagcaggaagtagcctgcagggactcggccggtagcaagtccccttgaccgcagggaaaaggagaggcagccagctccaatctcctcctgaggatggaggttggggaaatggatgcagaacttgtcaccctagggacgaaggggcggagggagggggga

SEQ ID NO: 26403 - DNA, 59 bp, Homo sapiens
  misc_feature 1..59: note = chr1:76081342-76081401
  misc_feature 1..59: note = hyper
  source 1..59: mol_type = genomic DNA
tcctgtcagtgtccccggaggccaggggaggtgcagcggcgccgcggtttcccccaccc

SEQ ID NO: 26404 - DNA, 70 bp, Homo sapiens
  misc_feature 1..70: note = chr1:76081756-76081826
  misc_feature 1..70: note = hyper
  source 1..70: mol_type = genomic DNA
ccgcccctctgctctcggccgcgccgctggcccccctcttgcgctgctgtggacgcggtggctgctgcgg

SEQ ID NO: 26405 - DNA, 249 bp, Homo sapiens
  misc_feature 1..249: note = chr1:76082129-76082378
  misc_feature 1..249: note = hyper
  source 1..249: mol_type = genomic DNA
cttcctctgggccttcgaagccccctctcaaaaggccaggacgcgctgggcccaagaaagacacccgtcttcacaggccaaccagaactctggccacctgcgggaggacggcactgtcccttgcgacccggcccaggagccgtcctcctccacagcctcctcgaggatagcgagcccgaattccacgcgggcgatgagccccgaagcgcgcggttgcctctgcccctcccgaaccgagaaggaaagagg

SEQ ID NO: 26406 - DNA, 40 bp, Homo sapiens
  misc_feature 1..40: note = chr1:76540210-76540250
  misc_feature 1..40: note = hyper
  source 1..40: mol_type = genomic DNA
agcgcactctgcgcacgtcgagccgcgaaaggttcacaga

SEQ ID NO: 26407 - DNA, 76 bp, Homo sapiens; identical to SEQ ID NO: 5574
  misc_feature 1..76: note = chr1:76540498-76540574
  misc_feature 1..76: note = hyper
  source 1..76: mol_type = genomic DNA

SEQ ID NO: 26408 - DNA, 13 bp, Homo sapiens
  misc_feature 1..13: note = chr1:76540575-76540588
  misc_feature 1..13: note = hyper
  source 1..13: mol_type = genomic DNA
acttggatctgtg

SEQ ID NO: 26409 - DNA, 85 bp, Homo sapiens
  misc_feature 1..85: note = chr1:77333003-77333088
  misc_feature 1..85: note = hyper
  source 1..85: mol_type = genomic DNA
gtgggtacactggctcggttaactctctctccccagaaatttcactactgaaaagattattatttgggggcggggaaggggatgt

SEQ ID NO: 26410 - DNA, 129 bp, Homo sapiens
  misc_feature 1..129: note = chr1:77333305-77333434
  misc_feature 1..129: note = hyper
  source 1..129: mol_type = genomic DNA
aaaagtggccccggacgcgcgagcctgaggattctgcacaaaagaggtgcccaaaatgaagaccctgatggtgagtcagttgtggcaactccaccgggcaaagagggggatccccgggctcagggtcca

SEQ ID NO: 26411 - DNA, 43 bp, Homo sapiens
  misc_feature 1..43: note = chr1:77333881-77333924
  misc_feature 1..43: note = hyper
  source 1..43: mol_type = genomic DNA
acccacccctgtcctcggccccggcgcgctccctccctcagcc

SEQ ID NO: 26412 - DNA, 218 bp, Homo sapiens; identical to SEQ ID NO: 67
  misc_feature 1..218: note = chr1:77334168-77334386
  misc_feature 1..218: note = hyper
  source 1..218: mol_type = genomic DNA

SEQ ID NO: 26413 - DNA, 162 bp, Homo sapiens
  misc_feature 1..162: note = chr1:77334408-77334570
  misc_feature 1..162: note = hyper
  source 1..162: mol_type = genomic DNA
cggagtggcggaccacaaggtgacagcatgcccgccagcccgctcgccactcagcctggggatcccgcacacctgagccttccccctttcccggggctgggaggcgctgtgagtaggtgccgttcgaaggctggaggggagtggacccgctggggtagggtg

SEQ ID NO: 26414 - DNA, 103 bp, Homo sapiens
  misc_feature 1..103: note = chr1:77334811-77334914
  misc_feature 1..103: note = hyper
  source 1..103: mol_type = genomic DNA
agcgttcctctgacccggaaccggagggtgagcgcagccagcccgcggccactgctcgggatccagcgttcccctctgatctctccagcgcattgctttgggc

SEQ ID NO: 26415 - DNA, 83 bp, Homo sapiens
  misc_feature 1..83: note = chr1:77747299-77747382
  misc_feature 1..83: note = hyper
  source 1..83: mol_type = genomic DNA
ttcctgggagttcctcggagacccggaggtaaccgtgtatgtgcgtgcgagtgtgtctgtgtgcgtacaaggtccggagaagc

SEQ ID NO: 26416 - DNA, 785 bp, Homo sapiens
  misc_feature 1..785: note = chr1:77747383-77748168
  misc_feature 1..785: note = hyper
  source 1..785: mol_type = genomic DNA
aaacggtcgcaggttcctacagaccccgaccctgttcccttggccacctggtccccggtagctgcatccctgggcggcgcacgcagtgaagcgtcgcgctctggcgccggtgccgcaccgaggggtatgactacgaccccttgcgcgtgcccgcccccacctccgcacctcgcgccagcccgcgcagcgtgaccggcagccgccgcagacccggctcggggaggcgcggagcgcggcgcgctgaaccggagaggcgggccggctgctgccttgcgttcgccacgctgtcctccctcctccgctccctgcgccccacccctggcggccgcgctgcctggcagcccgggaagccgcggcacagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaaggcacgcgcggcacagccatgaacaccaacgatgccaaggagtatctggcccggagggaaatccctcagctttttgaggtagggctagagctggccgacgggcggtagcatccggggactgcatctcaggggttcgggttgaggcagccgcgccccgtcccaccttccccacacggggcatgtaatga

SEQ ID NO: 26417 - DNA, 423 bp, Homo sapiens
  misc_feature 1..423: note = chr1:77748403-77748826
  misc_feature 1..423: note = hyper
  source 1..423: mol_type = genomic DNA
aggtggctgcactgtcgcccagcagcgagtaaagactcgaaactgagggagccagagccctagtcactctgctggtcgagggtcggaacccctgggggaaagaggaaatgtggacgaaggcagcccttcctggagacagcttggaagagagggatgaagatgcaaaaagcaaaacccaacctatcaagtgccacctccccggtgacaggcccccagccttgctctgcgctttcgctgaatgaactcctgagcacgtttttcccgttgcctaggaagggttgggccgcaggtttcgccagtgctcgacaacccacctggagatagcgggtcggggagggagctgcgaggggggcggactcctgttgctcagtcttcagaccgcagcacagcatcatctgcaccgggacccgggaatggggggac

SEQ ID NO: 26418 - DNA, 380 bp, Homo sapiens
  misc_feature 1..380: note = chr1:78354582-78354962
  misc_feature 1..380: note = hyper
  source 1..380: mol_type = genomic DNA
ccggagggcgccgggcgccatacagctgtggtccgcgctggccccggcccgggcgaaccctgccttggagccgcatcctgcgggctcggcggggtgcctaccaggggctgccccagggtctgaaagtgtcggccggccttgggcttctggttgcaatgtctttgccctgctcccctgcgccttgtcggctgagtttcgggtgcgttccctactgtagggagggagccctctgtgagcggagtgggtgccgatccctcggctgaacccttggggtccttagggaagttcagtgccgtcccccaccacttgccccagccgcggtctccgtctctgccagcagtgccagttaagaaatcctttctgatcggtctctgtggaag

SEQ ID NO: 26419 - DNA, 406 bp, Homo sapiens
  misc_feature 1..406: note = chr1:78511450-78511856
  misc_feature 1..406: note = hyper
  source 1..406: mol_type = genomic DNA
cgtattgttctgtagcgtcggcatcctcaggcgttcacgtaaatagagccattttttacaaggagtagggataaacctggtgataggatgagggactacgtaactttctttctctccagatccatcccgggggaggctgggcgggcgggcggctgctccggtccaggggtggaggtcggggccctgacccgacgcagccaggcggaagcgcggctgccattggaggctgcttttacctgcgcggggcccggggcgcaaagtccgaggcgccggggggaggaggcggcggacggcagcgcaggtgggcccgcgctctcggccctgcaagatgcccctgaagctgcgggggaagaagaaggccaagtccaaggagaccgccgggctggtggagggcgagccgacgggc

SEQ ID NO: 26420 - DNA, 527 bp, Homo sapiens
  misc_feature 1..527: note = chr1:78511857-78512384
  misc_feature 1..527: note = hyper
  source 1..527: mol_type = genomic DNA
cgggcggcgggagcctctcagcgtcccgggctcccgcacgcaggctggtcttccacgcgcagctggcgcacggtagtgccacgggccgagtggagggcttctccagcatccaggagctctacgcccagatcgcgggcgcgtttgaaatctcgccgtcggaggtaaggcgccaggtgctcaggctctcccgcctctccgccgcgccgcgccgcgccgcgcgtatttctgtgggcccaggagggttgagcggcgtttcccggagcgcgaaatccgatgccgtgttgagtccgccgggggcgtcccgggggaaagtgagtgtgccttccctggaagggaaaatttaacttggcaggaccgcagaaagtcacagtcccccttgctccgagatctggcctttgggaagcgggttgagggaggcaacctttcttccgcttgcaaatgtgtttgctccagatgtcccggattccgccggccgttcaaggcgtgagcaccttcccagactcgagatctggcggggcagattaata

SEQ ID NO: 26421 - DNA, 335 bp, Homo sapiens
  misc_feature 1..335: note = chr1:78957218-78957553
  misc_feature 1..335: note = hyper
  source 1..335: mol_type = genomic DNA
ttcctcacccgggcacgtcctcactccccgtgcccgggatgagggagaaaacagccctttggcgtttgagcaattgcagaaagtttcagcgagttcgttagtttggagggaatgttgcgaggccaggccgaagggcgggggggatagtaacgggcgaaagtcgaactgtgagtaagacctggagaaggcgaccgtcctgggggtagcctaggcagttccactcgggctgggcgcaggaaaggctggctccggaattcccagcctccgggaaagctagctgctcgggaaacgccaatcgaattagctcagagaagagtggccgtggccttgtgtat

SEQ ID NO: 26422 - DNA, 35 bp, Homo sapiens
  misc_feature 1..35: note = chr1:82266147-82266182
  misc_feature 1..35: note = hyper
  source 1..35: mol_type = genomic DNA
tcggggcctctggctcggtgcgtggagaaaagaga

SEQ ID NO: 26423 - DNA, 86 bp, Homo sapiens
  misc_feature 1..86: note = chr1:82266769-82266855
  misc_feature 1..86: note = hyper
  source 1..86: mol_type = genomic DNA
gctcctcctccccgccgcttgggcgcacagccgcagcagctgctcaaatggagtggaaaacggccattgggcgacaatgagttata

SEQ ID NO: 26424 - DNA, 30 bp, Homo sapiens; identical to SEQ ID NO: 5588
  misc_feature 1..30: note = chr1:82267630-82267660
  misc_feature 1..30: note = hyper
  source 1..30: mol_type = genomic DNA

SEQ ID NO: 26425 - DNA, 49 bp, Homo sapiens; identical to SEQ ID NO: 5589
  misc_feature 1..49: note = chr1:82267942-82267991
  misc_feature 1..49: note = hyper
  source 1..49: mol_type = genomic DNA

SEQ ID NO: 26426 - DNA, 83 bp, Homo sapiens
  misc_feature 1..83: note = chr1:82268226-82268309
  misc_feature 1..83: note = hyper
  source 1..83: mol_type = genomic DNA
ttaggatgaggctcccgtagccatgcattttttaatttcataaaagcttggggtcgcaaggttccgcccgtcctttcactggg

SEQ ID NO: 26427 - DNA, 140 bp, Homo sapiens
  misc_feature 1..140: note = chr1:82268744-82268884
  misc_feature 1..140: note = hyper
  source 1..140: mol_type = genomic DNA
ctgcgggagaagttacggagtgtatgctgctggagtggctgtggggcagggagcctcgggagcttggtttgtgggatgggggtgccactggggagtggcgacgagagaaaggcgtgggaggagcgcgagggaaggggaga

SEQ ID NO: 26428 - DNA, 30 bp, Homo sapiens
  misc_feature 1..30: note = chr1:84158496-84158526
  misc_feature 1..30: note = hyper
  source 1..30: mol_type = genomic DNA
cactcctgcaaagaacgtctcattggcttc

SEQ ID NO: 26429 - DNA, 33 bp, Homo sapiens
  misc_feature 1..33: note = chr1:84544390-84544423
  misc_feature 1..33: note = hyper
  source 1..33: mol_type = genomic DNA
cctgctttcccccctcgccgactctttgggagc

SEQ ID NO: 26430 - DNA, 132 bp, Homo sapiens; identical to SEQ ID NO: 5591
  misc_feature 1..132: note = chr1:85358461-85358593
  misc_feature 1..132: note = hyper
  source 1..132: mol_type = genomic DNA

SEQ ID NO: 26431 - DNA, 218 bp, Homo sapiens
  misc_feature 1..218: note = chr1:85358751-85358969
  misc_feature 1..218: note = hyper
  source 1..218: mol_type = genomic DNA
cgcatgccctcggggtcgagcgcgacggggcgaccgggcgccgggctccagccgggcgcggagaagcagcggaggacgcggcgggcgggcggagcgcctcctctccagcgacccctgcgacgcgtccagagccaaaggaaagtttggcggtgcgagggagggacctagggacagcggcccctccctgccccgccccgccccgccgggtgcgttcgacg

SEQ ID NO: 26432 - DNA, 122 bp, Homo sapiens
  misc_feature 1..122: note = chr1:85359218-85359340
  misc_feature 1..122: note = hyper
  source 1..122: mol_type = genomic DNA
tgtttgaagtggctgcgggaagtgcagcccacacccaccacccccgtgggaggcaggctctactccaagcccgacctaacgctggaaacctcaaccccaaagctacccgagggtgcggacag

SEQ ID NO: 26433 - DNA, 121 bp, Homo sapiens
  misc_feature 1..121: note = chr1:85463327-85463448
  misc_feature 1..121: note = hyper
  source 1..121: mol_type = genomic DNA
tgtctgccggagaagcgccttacagagggacccgggcggtgggccctgcggcaaagtggcccacgcaccctccacaccgctcccgggcggccgcacctggcactcccggccctctggggtt

SEQ ID NO: 26434 - DNA, 69 bp, Homo sapiens; identical to SEQ ID NO: 5594
  misc_feature 1..69: note = chr1:85463878-85463947
  misc_feature 1..69: note = hyper
  source 1..69: mol_type = genomic DNA

SEQ ID NO: 26435 - DNA, 30 bp, Homo sapiens
  misc_feature 1..30: note = chr1:85527927-85527957
  misc_feature 1..30: note = hyper
  source 1..30: mol_type = genomic DNA
gatactgttagggagcggacactgtattgg

SEQ ID NO: 26436 - DNA, 44 bp, Homo sapiens
  misc_feature 1..44: note = chr1:85774021-85774065
  misc_feature 1..44: note = hyper
  source 1..44: mol_type = genomic DNA
tccgcgctcaaaggccggctgagaaaacgcgagtgactacccga

SEQ ID NO: 26437 - DNA, 610 bp, Homo sapiens
  misc_feature 1..610: note = chr1:86621335-86621945
  misc_feature 1..610: note = hyper
  source 1..610: mol_type = genomic DNA
cccctccccagtccccgccgcgagtgccacttccccagtgacagggcaatgatcagggcgcagcctcggctcggatgggcaacgtttgttggccttctaaccagaggggattgcctctgagcccgtgggtaaaacaaccccccgacgcccgaggttctgcagccacccccttccccccgctggcgacccttcctcacgcctgagtccagtggtccaggctgcgcacactgaccctgggggacctctagcgtcacagcaatcgccaggctggacgccctgagaagcacctcggggaagcaggacctcgacagggccctgcgggaggagaaggggaggagggcgcgagggcggcgggagctggagccagagagatcgtcggagcccagctctggagcttagggagccgctgccctggacctcgggactcgcgccagcgagcttttcctctcgagccaaaagatcgctttagcataaactgtctgagatctgctggcacgaggcatcctttcaaacacggtattttgcaagctgagaagacaaggggaagataccgcgggtactcggccgctcctaaagccaaaaagtgccaaggagccggacttcagatctc

SEQ ID NO: 26438 - DNA, 26 bp, Homo sapiens
  misc_feature 1..26: note = chr1:86622526-86622552
  misc_feature 1..26: note = hyper
  source 1..26: mol_type = genomic DNA
tccttggaaacagcccgcgcccgaac

SEQ ID NO: 26439 - DNA, 64 bp, Homo sapiens
  misc_feature 1..64: note = chr1:87617774-87617838
  misc_feature 1..64: note = hyper
  source 1..64: mol_type = genomic DNA
cttgcagagtggccccgccgccgtcctgaactttctcgggaggggaaggcggctgtgtacagaa

SEQ ID NO: 26440 - DNA, 168 bp, Homo sapiens
  misc_feature 1..168: note = chr1:88928334-88928502
  misc_feature 1..168: note = hyper
  source 1..168: mol_type = genomic DNA
gctgccctttctctgcgtgtctctgggcgcgtcctgcccgctccccgcgccgcccgcgctcctctcgccgcagctgccgctggggctgccgcgggcgccgctcagccggagcgcgcctccgcccggcccgcccgcgccccgcagcagcgcgctcgctccttaaccact

SEQ ID NO: 26441 - DNA, 700 bp, Homo sapiens
  misc_feature 1..700: note = chr1:91172012-91172712
  misc_feature 1..700: note = hyper
  source 1..700: mol_type = genomic DNA
ggccatcccaagtaccgtccttgaaagcgtctggattcccgtcccaggcctatagagcccctgtcctgatgcgcccatgcctccctgaagcgctgtctgtacccgggcgcaggaactcgtggcggccgggcggtcctgaaggtggaggagcgcggggcccagctggggtacgcgccgagcaagaacccgcacggagccggcgcgccgcggctgggcttcaaggccgccgcgccaaatccctggctgcgacgtgtatgcgaatcgttaggaggaggcgggaggacagccacactgagggcctcttcactaaagaatgaagtctgacggcgggaatgggggtgggtgggggcgggaatccatcagctccacaaagtgacagggcccttttatcgtaaatcaagttcaatctcgctctcgcgaaggtcctcttttttcggcggagctcccgcaggggcgactcgctgtcccagaccagatagtagcaagagctgggagagacccaaatctgcagggagagggcgcgggctgagagccgcggtggggagcagggcctgggcccagcgcgacctgcagggctgctgcctcgggagcgcttctgctctgcctgcggtggccgaggcggcggctcgccgagcgcgctccgagctgtgcgaacagaggaagtatgtgccagttagaagggttccgccggccacctcgt

SEQ ID NO: 26442 - DNA, 85 bp, Homo sapiens
  misc_feature 1..85: note = chr1:91172959-91173044
  misc_feature 1..85: note = hyper
  source 1..85: mol_type = genomic DNA
ttgcttacctccccccgggcgccgccgacccttcctagacgcctccgctgcggccgcctaggcttttacccggaacccgccagcc

SEQ ID NO: 26443 - DNA, 198 bp, Homo sapiens
  misc_feature 1..198: note = chr1:91176399-91176597
  misc_feature 1..198: note = hyper
  source 1..198: mol_type = genomic DNA
ggcatcgcagcacaacgaactcactaggacaagcggctccgcatggggctgggggctggacgcccgccgccagggactgagaaggcaacgatcaaagccgccacaagggtttgttagctggccctctccaagtcccccgggggcgtcctaattgctcgtcccacagcctcccgctcacaggctgtccgacctcgccgg

SEQ ID NO: 26444 - DNA, 262 bp, Homo sapiens
  misc_feature 1..262: note = chr1:91176691-91176953
  misc_feature 1..262: note = hyper
  source 1..262: mol_type = genomic DNA
cggaccctcgctgccccaggaagacccctagaagaaggaggaggggaggacagagggatcaccacaccggtgaagctggggcctctatgcaggtcaggacggcagcaaagttggccgccgacttagccagcacccgcagcctgcaagtacagattttctcccacagcctcctgggttgctttgaaaccatccatttaaaaagaaaggaactcatacatatcaaataatggttcggaagaggccagcacgaaaaatggagctg

SEQ ID NO: 26445 - DNA, 101 bp, Homo sapiens
  misc_feature 1..101: note = chr1:91177391-91177492
  misc_feature 1..101: note = hyper
  source 1..101: mol_type = genomic DNA
cagacggaatgtcctcggcaacgccctttgcctcagcacttgaggctgtccatatatagttcactctgcctgtgctgtttccgctccgtgcccttctttct

SEQ ID NO: 26446 - DNA, 417 bp, Homo sapiens; identical to SEQ ID NO: 69
  misc_feature 1..417: note = chr1:91177840-91178257
  misc_feature 1..417: note = hyper
  source 1..417: mol_type = genomic DNA

SEQ ID NO: 26447 - DNA, 34 bp, Homo sapiens
  misc_feature 1..34: note = chr1:91178960-91178994
  misc_feature 1..34: note = hyper
  source 1..34: mol_type = genomic DNA
ctaggaagaagagagcgggcgtttgctcaaatac

SEQ ID NO: 26448 - DNA, 213 bp, Homo sapiens
  misc_feature 1..213: note = chr1:91180075-91180288
  misc_feature 1..213: note = hyper
  source 1..213: mol_type = genomic DNA
tgcctcccttacctgcggttctggtaccaggtcttgacttgggtgtcagtgaggttgagcgctgcagccaggtccatgcgatcctgcacgctcaggtacttctgccgctcaaagctacgctccagttgattgagctggtggtcggaaaaagctgtccttgcttttcgaggcttcttggctctcacagggggactctcacggctactcgtaatc

SEQ ID NO: 26449 - DNA, 1011 bp, Homo sapiens
  misc_feature 1..1011: note = chr1:91181807-91182818
  misc_feature 1..1011: note = hyper
  source 1..1011: mol_type = genomic DNA
catcccttttatcaacgaaaagtatttcctgtcggatgccctccgccgcccctcaacccccagtagattaaaattaaataaaacaaaggaaggagctggatggccgtgaaggttgtggggtagaacaataaacagaacttcgaggagtccccacatcgcacgcccaggcctcccttcagctgcagtcttttgaccgtcgcccagtcgcccgagaagctcctggaatcgctccccagcagagatctgctgaaggctgaaggggagattgggaaccaggaggacaagctagacggccgagagcgccgggtggcgggactcaccgtggcatttgatgtcgctctgggaatcctcccgcttgtcgagtttggtcttgctgtcctcctgctcgagctttggcctgaagctctcgtgcactgcgttgctctcctgcttcggggtgtggtggggagaggatacgctggtgctgtagggtgcacatgccgccagaggtttgctgtcgcccaagatgtccttaattaaaaaagaagacgtggaagtcctgggggccgaggcggccgagcccagctgctgggggggcggcggcggcggctgctgtggcggcagcggctgctgctgttggggcaaaggctgcaaactttgcgtcggggccgcggccggcggcggcggctgctggctgtggtggaggtggtgatgatgctgggtcgcgtctgctaccagatgcggctccgggggctccatggtgactgagataggagaagaaggcgccgtccctacggtatcaatctccgaacagggagatggggtggcctgactcctaaaatccgcggtcctggcctcaccgagcgggcggaaatctccattcatcatgcctgggctgcctgaactggcactggacaaaatcgtgtctattccaaaactcgacccgctggccccttccattgtcattgctacatgaggtccacgccactccgccgttcagcagccgccccgaaccagcgaagaaagctatcg

SEQ ID NO: 26450 - DNA, 247 bp, Homo sapiens
  misc_feature 1..247: note = chr1:91183272-91183519
  misc_feature 1..247: note = hyper
  source 1..247: mol_type = genomic DNA
ctcccccgcggctcccgaggtggcagccgcgcgccactcggcagccccgtagccgagtttctgaactttcttggaaagttgcggggcagacacggccgcagcggttgcggcaacccgaggaggaggaggaagaggaggacgacgagaaggagcaggcacagaaggaggaagcggcggagacgcgatgccgggcgactccggccgctgccgggcgcgttcgcttgtaatccggctgctggcgggcggc

SEQ ID NO: 26451 - DNA, 91 bp, Homo sapiens
  misc_feature 1..91: note = chr1:91183520-91183611
  misc_feature 1..91: note = hyper
  source 1..91: mol_type = genomic DNA
ccgaccccctcccgtgacgtcacggccactaccgccgctccccgcgccgcgccgcgccgggcccgcgcccccgccaccgaggccgcgcgtc

SEQ ID NO: 26452 - DNA, 211 bp, Homo sapiens
  misc_feature 1..211: note = chr1:91183775-91183986
  misc_feature 1..211: note = hyper
  source 1..211: mol_type = genomic DNA
cgagtccagtggtcccggtgtccacaatcacgagtgcgaggcaaagggagagggaggaagagatcagagggagaccagagaaagggaaccaaaggggagaaagaaaaaaaaaagtagcaaggattcgcccgttttcttaagtcagaagagagagagaagaggacgggaagggacttacctttaggctccagcgcggcggccctcgcagcct

SEQ ID NO: 26453 - DNA, 139 bp, Homo sapiens; identical to SEQ ID NO: 1759
  misc_feature 1..139: note = chr1:91184274-91184413
  misc_feature 1..139: note = hyper
  source 1..139: mol_type = genomic DNA

SEQ ID NO: 26454 - DNA, 139 bp, Homo sapiens
  misc_feature 1..139: note = chr1:91184414-91184553
  misc_feature 1..139: note = hyper
  source 1..139: mol_type = genomic DNA
cccctgccgcgccccgcggcagtccgtccacctctgtcccccggcccctttcggcgagcgctcatttggaaaggaaacagtcactgcggatccacttgggacccggagcatgactgtaacgcctcgttggagtgtatca

SEQ ID NO: 26455 - DNA, 129 bp, Homo sapiens
  misc_feature 1..129: note = chr1:91184791-91184920
  misc_feature 1..129: note = hyper
  source 1..129: mol_type = genomic DNA
gtctggaatgatgttcgagtggcctttaatgtctccaaaggctgggccgaaatctggagtttagttgcagttctggaggtcactttctgggccacagcttttatctgttgaggacgaagggaggggtgt

SEQ ID NO: 26456 - DNA, 119 bp, Homo sapiens; identical to SEQ ID NO: 1761
  misc_feature 1..119: note = chr1:91185190-91185309
  misc_feature 1..119: note = hyper
  source 1..119: mol_type = genomic DNA

SEQ ID NO: 26457 - DNA, 280 bp, Homo sapiens
  misc_feature 1..280: note = chr1:91185347-91185627
  misc_feature 1..280: note = hyper
  source 1..280: mol_type = genomic DNA
cgggtgactgggccccgccgggtggggtcgggccactgtaggctggagcggggttggatcaaatgcctttggcgcgggaactgagtgctggcccgggagaccctccggagagctcgcgggctcggcctcggcctcggcctcggccttcggccgcggttaccgaaacacagacggtagacttgtggaggtggcttatccgaggccgcagggcccgacgctgcacagcttcgcagcctaaatatcctgcgcctctgtcacagttgaccgctgtggggaggac

SEQ ID NO: 26458 - DNA, 35 bp, Homo sapiens
  misc_feature 1..35: note = chr1:91185961-91185996
  misc_feature 1..35: note = hyper
  source 1..35: mol_type = genomic DNA
acagcttgtgttgggcggttcgacagggtcttttt

SEQ ID NO: 26459 - DNA, 1444 bp, Homo sapiens
  misc_feature 1..1444: note = chr1:91188983-91190427
  misc_feature 1..1444: note = hyper
  source 1..1444: mol_type = genomic DNA
accaaaacctcagagcgctgagcaaagatgccaatcagagaaagagaaattcatttgcgatgttaattaacaagcggctaattaaaacggcactttgagtgctaatcaatcgccttattaagttacagccatcactggaacaaattgaaacctccccgccccgttttctgcctttggtgcaggcggggccgcgttcccagataccgtgagaggccttggggcgcggaggttgggggcagcctcggtcagctttctcagtctctcccaggtctacagaatacgccactggacaagtgcctaagcagcgacttctggtccagacacaccgcccggggagtaagtagttgcgtcgaagaacaactcattcagcagcagttaacaccgacgtttcctcctagaaagagctcccgcaaagcggggggatgtgacctgtgggcccccagcaggggtaggaggcagttcagcccgagagggggcgctctagggcctggatcctgcatccctatttcctggaacacacccaacgcctcattctgaaaaccctgcttaggccctggccctggtgccgctcagcaaccaggaaagagctggacctgccttcaggcagcaagaacaggactgccagcctcctgtggctctgtctcccgaggctccatgagaaggggatgggggtgcaagaagggaagagtgaggtggtgtgctgggcgtcggggacgaggacgcacgccagccaagacgtgcctcccacccagcccacgcgcgcttccccacccccctggccctccaaaatcggtaagagaattaagatttcgaatccctattttgaggagccttccgcatttcctaattgttaaattcctgcttttcaccaaattcccgggggagaaacatttggcaataagaagggactgtgaatttaaatgctaattgagtgggtcctttttccgcagctccacctgcctggcagcctctgttgaaaccaaacacactcggagcgcccagtgcaacattcttggggtgccgagtagaagcgcagtaaagagagaccctagcggactcctgtctggtttgctttttaccgactcttacagaaaaaaagagaatgccattggaagaagctcttttgcgtggtgggcgatgtgtgggtgggggacttgtggcatggcccacggtgttgtttctgtgcctgcgatgacacacgtatgtcttgagctgtgggctcgccttcctggaggtgcgcccgaccgcatctgctggtgggtctgagcgtgcttggggtgtcccaggagaactgagagaacggctcccacgtgcaaagttccaaagcattaatattttcatcatattatcattattcaatataataatatttgttcggttagcggcactaattaggccacattaaaaccgtagtgtgtccctaatggtgcgtaatgtgctcaca

SEQ ID NO: 26460 - DNA, 320 bp, Homo sapiens
  misc_feature 1..320: note = chr1:91190629-91190949
  misc_feature 1..320: note = hyper
  source 1..320: mol_type = genomic DNA
cctgcagcctcctcccgcgacacggcgctttgaactcggcggattgattttgcttcccttcccccttttgtgtgtgtttgcgttcaattggttaggtttttaagatttgggagggctggtgtgaaagaattaaaatactcttaactggagcccctccgccgagaactggaggtcccgcctcctagttcggcgctttcaggaccctcttcccagagggaatttctttcagaaattccagggtgggcttgtaaaagacgcttccgcagagcaggtcccgtcagggtctttttcctgttcctggtgccagcggtcggcccggg

SEQ ID NO: 26461 - DNA, 17 bp, Homo sapiens
  misc_feature 1..17: note = chr1:91190984-91191001
  misc_feature 1..17: note = hyper
  source 1..17: mol_type = genomic DNA
cggagagtgcccctccc

SEQ ID NO: 26462 - DNA, 233 bp, Homo sapiens; identical to SEQ ID NO: 1767
  misc_feature 1..233: note = chr1:91191002-91191235
  misc_feature 1..233: note = hyper
  source 1..233: mol_type = genomic DNA

SEQ ID NO: 26463 - DNA, 249 bp, Homo sapiens; identical to SEQ ID NO: 1768
  misc_feature 1..249: note = chr1:91191289-91191538
  misc_feature 1..249: note = hyper
  source 1..249: mol_type = genomic DNA

SEQ ID NO: 26464 - DNA, 34 bp, Homo sapiens
  misc_feature 1..34: note = chr1:91191752-91191786
  misc_feature 1..34: note = hyper
  source 1..34: mol_type = genomic DNA
tccagcactgggccgcgcgcgtgattgatcggtg

SEQ ID NO: 26465 - DNA, 233 bp, Homo sapiens; identical to SEQ ID NO: 73
  misc_feature 1..233: note = chr1:91192344-91192577
  misc_feature 1..233: note = hyper
  source 1..233: mol_type = genomic DNA

SEQ ID NO: 26466 - DNA, 136 bp, Homo sapiens
  misc_feature 1..136: note = chr1:91192681-91192817
  misc_feature 1..136: note = hyper
  source 1..136: mol_type = genomic DNA
cgactctgggccaggccccaaggaccgccccggcctctccggctttgcggggagaatctgaggaaccgagtccaagatagccgacctaggctgttttcacccagaccctgcgtccccgacccgctggagtgaatct

SEQ ID NO: 26467 - DNA, 281 bp, Homo sapiens
  misc_feature 1..281: note = chr1:91194539-91194820
  misc_feature 1..281: note = hyper
  source 1..281: mol_type = genomic DNA
aaatgcttaaagttgcggatgtaatttcacatgcgtccgggttgatgtgatatgaccgtatcagggaaacaaagctaagtgcagtcaggatctgttagtacagtggcttttgatggaacagctgaggcacacatcgcccgtggcatggactccggggccgaacgctcacgaccaagacttttgcccttttgaaatgaaatagaaataggggagctgcaggaaaaccgaatcgcgcttagggtcaggagcaagacaggagctttcagcgaagatctgaacat

SEQ ID NO: 26468 - DNA, 272 bp, Homo sapiens
  misc_feature 1..272: note = chr1:91195133-91195405
  misc_feature 1..272: note = hyper
  source 1..272: mol_type = genomic DNA
gggtccccagccaggcgggggactgcgggccgcccgcgctgcagggccgcgggtcaccgcagggggcgccggggcgctacgggtcctcgggcctggtcttttccggtccctgcccgagcccgcgcctttcccgcctttcgggggagaaacctgcctggacactggaactgggagaaagcagcagcctaattgctcttccgatcgtcgcttgggaaaggggggcttcacatttagaaacttctcgcacctttctctctcggtctctgcctttt

SEQ ID NO: 26469 - DNA, 316 bp, Homo sapiens; identical to SEQ ID NO: 5622
  misc_feature 1..316: note = chr1:91195879-91196195
  misc_feature 1..316: note = hyper
  source 1..316: mol_type = genomic DNA

SEQ ID NO: 26470 - DNA, 292 bp, Homo sapiens
  misc_feature 1..292: note = chr1:91196225-91196517
  misc_feature 1..292: note = hyper
  source 1..292: mol_type = genomic DNA
cgcttaaagattttcgcaaaaagtgcactggggccaaaaatcaatcactctccctagcctgacccggtgaaaacagatgcataacatattcatgcgctgagcacgccgagcagcccagcgcggaacttttttttttttcttcttcttcttcttcttttaaataaagcgaggaggacttccgcggctcggcagtcctgctaaagctggcagatgcagcaaaactaatatgtgtaaatgctttaaagcaataatctgcttacagcgacacttccccgaacggcggcaggactga

SEQ ID NO: 26471 - DNA, 1121 bp, Homo sapiens
  misc_feature 1..1121: note = chr1:91316241-91317362
  misc_feature 1..1121: note = hyper
  source 1..1121: mol_type = genomic DNA
ctaagaaccgccgtgcgatggccggctttgggcaccgggggtgggggctacgctacgcgtgaagggcctcagtcctcgggctttagttcaggaagaaaatgaaagctggaggtctcgtgggcgggactggaggcggccagataggcaagaacccgcaacaggagtagggacattttttcttcaaattccaatcccatccagcgatagacaggcgcgtgggtctccctcctccacgaccaccacacaatggcacacacttttgctggaaactgaaatcgaagtctctgaggcaggctggggcccaggccggcagcggggaggggcagggtccagccacctcggcgtggccttggcgagcgctccggggtcagaggccgtcgttctcgccgcgctccacagcgcgtcacccgctgccctagcgacccccgggcgaccccggcatcgcctggctgcgccgtcccggcgggccggccctctccacgccctctcctggggtttgcggtgggcacagctccctccagactgggtctctccactagcctcctccccaactgcaacgtgggaaccagagctatccgagtcacgagccccaagtgcacacaaagcccccaacggggccacggcgcctccacgcctcgctacctccagctccaggagcgcagaacgcagcgccctgggtcaccgcgtctgccctgcggagcagccccactgaggggaagcctcgggcaggaggtgagaccccgcgcacgcaagcacccccgccccaagcagggccctctgcccgagggagactctcacctcaaataaacgggcgctgccgcctccagggggaggacagcgggcggagaatactcacgctgggcccagccgcgcggggacttcgctgggaaccacgcgcgggctcccgccggggagcggagccccagcctgcagtcctgcgcccgccccagcaccgcctcctcggaagggaggcctctaccgtccggcggcggacctgcagccgccgcgggagacgctgccccgccccccggccccgcccttcggcccatccccgccccgctggcctccttttcccctgccccctccctccgctcctcaacgcccgccgggtgcaatctgct

SEQ ID NO: 26472 - DNA, 281 bp, Homo sapiens
  misc_feature 1..281: note = chr1:91870046-91870327
  misc_feature 1..281: note = hyper
  source 1..281: mol_type = genomic DNA
agccgactttaggggcgggccggacgcccagccggtcccacctcgcggggagctgggcccgccctgcgcccgagcgcgccgcaggcctcaccgctttctgactggaaatgcggctgaggcgctggcgcgggccggcggcctggagacgcctggtgaccaacaactcgccgcgcccgtccgctgcctgcccggcagacggctctagagatcgaccgctgcccggacggctcggctgggtccccacttccccgcgggcgtcgggcccccgtccccaccttccc

SEQ ID NO: 26473 - DNA, 128 bp, Homo sapiens
  misc_feature 1..128: note = chr1:92495704-92495832
  misc_feature 1..128: note = hyper
  source 1..128: mol_type = genomic DNA
ggtctactgctactgcgggctctgcgcctccatccacctgctcaaacttttgtggagcctcggcaaggggccggcgcagaccttccggcggcccgcccgggagcaccctcccgcgtgcctgagcgacc

SEQ ID NO: 26474 - DNA, 932 bp, Homo sapiens
  misc_feature 1..932: note = chr1:92948324-92949256
  misc_feature 1..932: note = hyper
  source 1..932: mol_type = genomic DNA
ccgttagcatttctacgcccaaggtcgcgccaattcccccccagcactgccgggtccctgcagctcccgcccaagaggttcccagtgggttcctacctggagacgcggagggtgacgggggcctccagaagtcctcaaactccgagctccgttcgcagacgctgccttcgcagctgtctggggatgcggaggctctgtctggggcttcggtcagctgcgattcgggggacaaacggtcccggggctccgccttcgccccgcctgcatttgaagtgctgtctgcaaagaggaggcaggtgaggggctcaggctgggaccggttgagtctgagggtgctgaaggctcccccaatcccccgaccagggcagccgagcgtcttcccctctccacccagaccccggccgggaaccctctcggatccgagggcaggcgcagagaggccatggcacctaggagacaaacccggaggaaccaggacagtaggaaacaaaaacagcagcaaaagggacgttggggcagcccctcccagctccggactaatggtgtgccgaggtgcagtaggcatccgggggagcagccccgcctggcccgcgcgcgcctcgcacctgctcggctaggcgccggtacattctctaaacggagggaatagtctggtcctggggagcgcggctggtggtagctgtgagccttcttgcttttgacgagaaatgagcgcggcatggtggtccggcactttccccactgcgccccaagagtccctggagccgctgtcacccacggtcactccgagggcttgctcagccccagcccggaggagacctgagagggaaagaaaaccaggtggagacgtgggtcagtactctccggtgcggcggactgggcacccaggcggagggagagcgcgggccagggaggcgcgcagagggcccacg

SEQ ID NO: 26475 - DNA, 394 bp, Homo sapiens
  misc_feature 1..394: note = chr1:92949786-92950180
  misc_feature 1..394: note = hyper
  source 1..394: mol_type = genomic DNA
gaggggaacaacagacgaccaacccccgccccaggagaaactcgcatctgggtgatcccactcgcccctcactagtgccccacgtaggagaaactttgcccttggactcccggctgcggcgggcaccggtcgaggctgcggcgagccatcccagaccatggagacctaacctcgggaatcaggtcccgggaaaaaagcactttccgttctgctcaccaaaaaatcttgtcctagggaggtggagcccgatccacgaacgttgactgggaaatgctaggtgtcccgagtcggtagtgcaccgacaatttagcagacaaaaaagacaggacgccagagcgcgcaggctgcattagcagagagcgggggtcgggcccgggcccgggagggaactagc

SEQ ID NO: 26476 - DNA, 1908 bp, Homo sapiens
  misc_feature 1..1908: note = chr1:92950636-92952544
  misc_feature 1..1908: note = hyper
  source 1..1908: mol_type = genomic DNA
ttgtgtccccttctccggaggaatgggaatagacctgggagaaaagacgcctgggacgtgtcgcggggctcccgcgaagtttcccgctacccaagcgccagaatgcccctaggggtgagagtgccatccgcctccctccggggtggctcctagggctagagctttgtcgcttcctgcacttctcgtccgtacaattagacgccacaaaccccaaacccaattctttaaacagccacgaaactcggaagaaaagaaaaacggagtggcgttgtcccgagggtcccgctgcagcttggacccacgttggctgggagcgggacagatgggggcggggtaactgtcagcgccggagctgggtctgggctggcgccaccagagaccaggcggacgcggaggccgcctccccacccgggctgtaagcccacgcctctctcgcaccccggcccgctttgctggttcctgtggggagcgacagagtttggaggagataggggccccggggcctgggccgagcgcgtgggaaggcaaccccgcgctgcagctggcgcgggaggtggggcggcccctccgcgcgctcaggcctctcctcaccgtccgggcccaggaaggagggagccgagggcgctaagggggcgtcctcccgagcgcagctgccgccgcctccccaccagatgtttccttccctggtggatttggctcccctgccgaaccaccagaccgcctgctgcgcgcccccagctccagatttccagtcacactgcgcgggtcgcgccctaacccagctgccggagctctctgggctcccgcacggcggtccgcagcaggtgggaaaccgcccgcgccctctgatcgcccccgcagtgccagtgctctgcgagtccccgcggccgcccccaccagggcaggaggcgcagaacaggctcggcggacctacctgcggagtcacggcgcgggcaccgcgctaggagagttttcaaacggaatcttgctttcgggagagaccgctctatctctctgacttaaaaaaaaaaaaaattctccttccgagctcagcccccaaaaccacaagcttcacttcctgagcgttactgagtcgctcgcatagccctcccagacctgctcccaacccccgtcgggcggccgggcgcgctcctttgcgcaagtggccaggcggtggggggcctggcctttccagcccgtcccgcgcgccccttagtagtcctcccagttctctccctgtgggtcggcaggggatgggggaaattggaggtccggacacttaggcactagaaatgacttgaaagaaaatgaactattcttggctccagggagacttccgcagcgagagaagccacagattgaggacacagattgactggcgagagaggggtggggggcgccccgctccgaggaccctccccgcccctcaggcctcggtcacccgccccccccacccccgaccccgccgcctcctagggctgcaccacccccgggtcgggaccgtgaatcaccggcccgcggtgccgccggcctggagcccggcgagtggccacggcgtccgcagagcgaaacctgccccgcaggccccgaaatagcttgttgtggaaacacttggggataaatacgcccaacgaggctgaaaataccttgacacccaatccgagaggtttgctcatttcccttcggatttaggtaatggttaaatttggaagaggtgggcgagcgccgagcccccggcggagagggccctggcggcgcgtcccgcgggcgcccggcgggaccggtgggcgcaccctccctgcgcggagctcgccggctctcgaccgggtccgctcagccttcgactaatttccggtggtcggagctgcaaaattaaaggccgcgcgggggcagcgccggcggctgcta

SEQ ID NO: 26477 - DNA, 88 bp, Homo sapiens
  misc_feature 1..88: note = chr1:95392536-95392624
  misc_feature 1..88: note = hyper
  source 1..88: mol_type = genomic DNA
gccgcgggggatgctcgaactccctcctctgggaggcgcaggagacggccgcggggcgcgggcggtgcctgggcgactgggtccaact

SEQ ID NO: 26478 - DNA, 39 bp, Homo sapiens
  misc_feature 1..39: note = chr1:95393028-95393067
  misc_feature 1..39: note = hyper
  source 1..39: mol_type = genomic DNA
ggcccgccgctgacccgccgcctccgtctgcctcctccc

SEQ ID NO: 26479 - DNA, 30 bp, Homo sapiens
  misc_feature 1..30: note = chr1:95428544-95428574
  misc_feature 1..30: note = hyper
  source 1..30: mol_type = genomic DNA
ttcagttcctgttatcgtgctttgaggtgc

SEQ ID NO: 26480 - DNA, 299 bp, Homo sapiens
  misc_feature 1..299: note = chr1:98510732-98511031
  misc_feature 1..299: note = hyper
  source 1..299: mol_type = genomic DNA
tctctcttgctcccacgccttcgcagctgacctgagaggggggacgtgccttgcgtttgttggtgtttgagactcgtcctaaaggcagaggcagggaagacagcgctgaagaggcgtcccaaagagattggacgtctgaacagtcactgcctgccccaacctctttcaggaaggttccaggtctgtgccacactgcaaccaatccggttcccatcctgtttctccaccccttctcggagaatccgaaaagaaaatatgcgttcctgagagacccgccacacttccgatctggaagttcc

SEQ ID NO: 26481 - DNA, 30 bp, Homo sapiens
  misc_feature 1..30: note = chr1:98511032-98511062
  misc_feature 1..30: note = hyper
  source 1..30: mol_type = genomic DNA
cggggacccagcccccgggcccccgccccc

SEQ ID NO: 26482 - DNA, 547 bp, Homo sapiens
  misc_feature 1..547: note = chr1:98511321-98511868
  misc_feature 1..547: note = hyper
  source 1..547: mol_type = genomic DNA
gtctctccctccagccgcaccccaccgtggagaggagaggagcggactgggaacgccgaaccgccccgcaggctcggggaaacggacccccttccgctccccgcccatccccttcacctcgccccccgccccctgcgcgaacccattttccagtcctggtcaccagaggcgcagcgcacagcctttccggtggaaccagtgcgaaaacacccgaggaaatgaaaagaacaagaaagtgctaccttggcaaccacgggcgtttagtggccagctggtgggctggggagggcggccgctgcccccctgccgctggtactctcctcgactacgcgtattcttaagcaataacaacgtaatccgtattatccacccaagaatacccgtcaccgaagagagtcagaggaccaagctgccgctgccgctgctaccgctgccgctgctaccgctgccgctgctactgccgccgccgccgccaccagaactcttgctgctcgctgagcccgcccctgcctggggatgggctgagcttgaccgggaccataaatcc

SEQ ID NO: 26483 - DNA, 315 bp, Homo sapiens
  misc_feature 1..315: note = chr1:98513940-98514255
  misc_feature 1..315: note = hyper
  source 1..315: mol_type = genomic DNA
gcttcagcacctggacgaatggacagctcaacccgggccgactgccggcagcactcgcagcagaactgacgctctgagctctaaccaaagctctctcgtgcttgagcggggcagcctgacttacgagaacaccatttcctacgagaccactgccgctgggtgcatattcaattcaagcctccttaagctgtcggatttcccccacccatccaccctcccccccttctccaccctccacacaaaaacaaaaaagggaaaaagcccaataccatcagggcgtttgttgatcaacttacacttcgcttttgaatattt

SEQ ID NO: 26484 - DNA, 19 bp, Homo sapiens
  misc_feature 1..19: note = chr1:98515068-98515087
  misc_feature 1..19: note = hyper
  source 1..19: mol_type = genomic DNA
cttgggaagggacctcggc

SEQ ID NO: 26485 - DNA, 103 bp, Homo sapiens; identical to SEQ ID NO: 5637
  misc_feature 1..103: note = chr1:98515088-98515191
  misc_feature 1..103: note = hyper
  source 1..103: mol_type = genomic DNA

SEQ ID NO: 26486 - DNA, 297 bp, Homo sapiens
  misc_feature 1..297: note = chr1:98519221-98519518
  misc_feature 1..297: note = hyper
  source 1..297: mol_type = genomic DNA
tctagtttcagcagccgcagcccgccagcgctggctcggaccggggcctcctctgggagagtaggagagcgaaaaaatcaaccaccaccttggatttcagatcgaggaaaggaagccaaagcaaaggtgtggttacacaggacatccatagacaaatcgttgcctctctaagtgggcctgagctttgcggctccagaagcgcgaggcgcggttggtgcggacgcgggggcgtgggagtcatcgctctccccgcagccctggccgagctctctgctgtcctcccgagtttgggccaga

SEQ ID NO: 26487 - DNA, 179 bp, Homo sapiens
  misc_feature 1..179: note = chr1:98519817-98519996
  misc_feature 1..179: note = hyper
  source 1..179: mol_type = genomic DNA
gaggtccgggccgcgcgggctgagcccaatacgcccggagaagagcgccggagccccctgctggccggacgcggcaggcgcggcggcccgctcggtcccctccgccccgcgggctctgcccagcccggacccgcctccaccctccagtgccctggcgctgggggcgtgctaaaagcaac

SEQ ID NO: 26488 - DNA, 133 bp, Homo sapiens
  misc_feature 1..133: note = chr1:99469564-99469697
  misc_feature 1..133: note = hyper
  source 1..133: mol_type = genomic DNA
cccctctctcctcgccggcccgcccgccgctgctcttcttccaggcacaatcgaagaggaggcagtgagcgagtcaaggccacagagtggatggaatcaaggttcacccccaaagctcacctcctttgcaacc

SEQ ID NO: 26489 - DNA, 215 bp, Homo sapiens
  misc_feature 1..215: note = chr1:99469759-99469974
  misc_feature 1..215: note = hyper
  source 1..215: mol_type = genomic DNA
cgctgaagccaccgcggggtgtgggggggtgacgtgtgggaagagctgggggcttccttcgcacccaccctcacgcgccctagaatgtcctctggggaaggggctgcccataacttggaggaacttagaaggcaaaacctactgcgccccaacccttagaggggcctcaaccccgaaggcgaggggcgagatcagggactcggcgacgagggcga

SEQ ID NO: 26490 - DNA, 315 bp, Homo sapiens
  misc_feature 1..315: note = chr1:99470215-99470530
  misc_feature 1..315: note = hyper
  source 1..315: mol_type = genomic DNA
cagcaggggcatgcacgcctcccgggccgggccgagccgagccgagcgggcggtcgacgcggtgggccccctccccggtccgccgaggcagccaccgggggcgcggcggcggaggcggcgggaggacgaggcacgggaggcgggatggagccgctggaggaagaggcggaggcaggtccgggcttcgaggcgccggcaggctgcagaggaggcggctacccccggacgagccccctctcccctgcccgccccctgcccgccgcaagcgccgcccgccccggcgcggggtcgcgagggagggcggggagtcccggg

SEQ ID NO: 26491 - DNA, 36 bp, Homo sapiens; identical to SEQ ID NO: 5642
  misc_feature 1..36: note = chr1:99470582-99470618
  misc_feature 1..36: note = hyper
  source 1..36: mol_type = genomic DNA

SEQ ID NO: 26492 - DNA, 166 bp, Homo sapiens; identical to SEQ ID NO: 5643
  misc_feature 1..166: note = chr1:99470619-99470785
  misc_feature 1..166: note = hyper
  source 1..166: mol_type = genomic DNA

SEQ ID NO: 26493 - DNA, 361 bp, Homo sapiens; identical to SEQ ID NO: 1776
  misc_feature 1..361: note = chr1:101004456-101004817
  misc_feature 1..361: note = hyper
  source 1..361: mol_type = genomic DNA

SEQ ID NO: 26494 - DNA, 92 bp, Homo sapiens
  misc_feature 1..92: note = chr1:101004842-101004934
  misc_feature 1..92: note = hyper
  source 1..92: mol_type = genomic DNA
cgctgggggcagctaccgcctgctacggggtgggctgctgggcctcggactcacggtgtccctcctctcccactgcctcgtggccctgaacc

SEQ ID NO: 26495 - DNA, 850 bp, Homo sapiens
  misc_feature 1..850: note = chr1:101004935-101005785
  misc_feature 1..850: note = hyper
  source 1..850: mol_type = genomic DNA
ctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgagtccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcaggcggccagctggctcctgtgctgcgccctgtccgcgctcaatccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtccttgggcaccgtcgcctccttccctcctagggcatcccctgcctgaacgaagacttccgccg

SEQ ID NO: 26496 - DNA, 78 bp, Homo sapiens; identical to SEQ ID NO: 5646
  misc_feature 1..78: note = chr1:101702524-101702602
  misc_feature 1..78: note = hyper
  source 1..78: mol_type = genomic DNA

SEQ ID NO: 26497 - DNA, 193 bp, Homo sapiens
  misc_feature 1..193: note = chr1:101702603-101702796
  misc_feature 1..193: note = hyper
  source 1..193: mol_type = genomic DNA
agccgtacagatcccgggctctccgaacgcaacttcgccctgcttgagcgaggtagggggcggcgaatggcgggggtcgcgggcgcggggagcccggttgtggtagggcttaggtgtcagaaacgaatttttaagtcgaacgaggcaaacaaaaacttagaaaacatgcatctccgggcgctgaaaatttgca

SEQ ID NO: 26498 - DNA, 30 bp, Homo sapiens; identical to SEQ ID NO: 5648
  misc_feature 1..30: note = chr1:101703188-101703218
  misc_feature 1..30: note = hyper
  source 1..30: mol_type = genomic DNA

SEQ ID NO: 26499 - DNA, 76 bp, Homo sapiens
  misc_feature 1..76: note = chr1:101703566-101703642
  misc_feature 1..76: note = hyper
  source 1..76: mol_type = genomic DNA
gggcgcggggggaggcggggagaataagaagaagaaagaaaaggcagtcgcttcacggaggcgctaagctttcctg

SEQ ID NO: 26500 - DNA, 394 bp, Homo sapiens
  misc_feature 1..394: note = chr1:101775094-101775488
  misc_feature 1..394: note = hyper
  source 1..394: mol_type = genomic DNA
gacttcaaaaggctgcggtatcaaagtggcagttaaagagaaggcaacgctcagagttgcaggtggagcagcggcggctgcatcagcgtctcaaattgcgaaaacattttgggctgaagtatttctttgtagcatttcgtggagcccctttcctttgatatacactagccttccgacttccctttgttcttttttcacacgtcaggttttatcgctgacaagctccaacgcgtcaaaggcgttagatctgagggctgcagcagccttcgcggttccgcattgagctccttcctgcagccctctgcggaggtcacggccacgtgtgggcagggaaggccccctacccacttcctcattcggacccgtcacctttagccggcgaccaccttttgat

SEQ ID NO: 26501 - DNA, 88 bp, Homo sapiens
  misc_feature 1..88: note = chr1:103572677-103572765
  misc_feature 1..88: note = hyper
  source 1..88: mol_type = genomic DNA
gagggagggagaaggcggaggggaggagtgaagtcgctctccctccgtgggtactgacagggttgcagacttccgagcaggtctggcc

SEQ ID NO: 26502 - DNA, 145 bp, Homo sapiens
  misc_feature 1..145: note = chr1:103573555-103573700
  misc_feature 1..145: note = hyper
  source 1..145: mol_type = genomic DNA
aagtggggggaggggcgcagaagcagtaggaccgacggcaatctcccacctccccaaatccattttttcttacctcctctgacctctctagcttggaagaggaaggtcaatgcgagggttgttacggtgaaatcccagagccacc

SEQ ID NO: 26503 - DNA, 467 bp, Homo sapiens
  misc_feature 1..467: note = chr1:103573701-103574168
  misc_feature 1..467: note = hyper
  source 1..467: mol_type = genomic DNA
tttcgttttccacctagaggaccacggctccatctccgagccccgcactcacaactgtgaactcaacccacgaaattgcgactgcagaccaacttcgtcctttccaaggtatcgccagggatgtttgctacacagccattggggagggagagggggaaaaagtcaaagggctttttcttctaaatttgatggtttgcgttcttcgtgtctctagccctttcctctccctctgagttggccccaccggccgggaccctccggccgcgaccctctgatccttcctctgccgggccctgccttcagaatgaaggcagatgaggggcttccaccaacaagctgagagtactgtgtgcccctaaaggcttcatgccgtcagtgggctggacgagtggctccgggcagccccctcctccgcccactcccctccctgctcccagctccccctcccagggcgaaactgacaagca

SEQ ID NO: 26504 - DNA, 1154 bp, Homo sapiens
  misc_feature 1..1154: note = chr1:107682621-107683775
  misc_feature 1..1154: note = hyper
  source 1..1154: mol_type = genomic DNA
gaagtgggaggtacacgaggagttactggaaacggcgcttctgtggaggagccgggggggatggggagtagagggagggggccctgttgcctcagcgccccgaggtcgtggagcggcagcagctgcagccggagcagcaccagcaacagcaacagcgagcgggacggagttaggaccgctcggagcgcacaggtctcgaggtagtataaggtttgctatccttccacttgctggcagttgcagaagaagatctgctttttaagtgaaacgtacatgccacccctccgagggctgcggcttccccgggcttgcttctttgccgctcctctttccggctctcgcgctcactctttaattggcactggcccctaagtttgccaggagctcgctgcccgctcggagcagggtcccggccgggagccgctggtgggggcggggagtccgggagccgcaatccagaagcgtcgtgggccatgtatatttcatcaaacggactttgggtgcgtcgcgtctcactgccatcagtgctatgtgcagtgacatttctgacttgagtggaggaatgcgcgaaggaaacccgggcgaaattggtattagaggatcttcttggcgccaatgctaattgtcctgatttatgccccttctgactaagctcaacgtcttcatctgaaataaaatgaaagcggtgccaagcggcatagaaccgcctggccgctggttctgatccccgggaaccagaaaatcgtcctgcggcttgaaaaaaaaaaaaagaggaaaaaaaaaagaaatagaaatagaaaaaagaaaaaatatccctcagtaaaagtttaaggcgagaagtgtcagaggcagcggagcgaggaggcgcggaggagagccggcgagcaggggactgggctggcacgacctccgaaggctgagatctcattattaatatcactatatttttggagggagaggcacctttctcatcctctcttcctctccgcccacccttactccctccccctcatctacctgtcaaagtcactgatcttttgcatttcggaagaggacgtcaacgggaaggaattccccctctgggtgcgggctccgagagggggcgacttgcaggaggctccccccgggggcggaggcgaaggtaattaagcggc

SEQ ID NO: 26505 - DNA, 719 bp, Homo sapiens
  misc_feature 1..719: note = chr1:107683776-107684495
  misc_feature 1..719: note = hyper
  source 1..719: mol_type = genomic DNA
gggagtggcgggccggcgctgggttctcggtcctcggggtcctctcccgccggcggccgggcgcgatcggaatccccgggctgcggcggtggcggcggctcgggtcctcacgcccacccctcccgctccgcccgctcccgcctggggaggaggctccgcgggagctgccgccctccgcccgtacgccgcccgcgggctccgctgctgcggccgccgcccgaggcggaccaggctggctgcgcagggccgccgccccgcgccgtcggctcggctcccgcccggcgcaagggcaaacgagccacacggtaagtgcctgcggctcgcctctcctactgcgacccgagcctctcgcccgtgcccctctcccccgggtttccccaccccccgccgccccccgccccacccgctgcgatgcacaggcgggagggaaggctccgggtgggcgaggaactttgtaaagcgccccgaggaggcagcgcgcggagccctacgcgcacacacagcggcacacgctcacacccacacacaagtcttcccgggggtgcgccccgggccggtgatgcgtcctcttgttgtgtccggagcccaggcgtggggtctgagcctccatccgccgactgacaggggccccgcgctctccctctctcacgcacacctggccacacacatcgctcaggcggcttgtcgttattttttctttctttcgccaattatatttg

SEQ ID NO: 26506 - DNA, 450 bp, Homo sapiens; identical to SEQ ID NO: 76
  misc_feature 1..450: note = chr1:108506627-108507077
  misc_feature 1..450: note = hyper
  source 1..450: mol_type = genomic DNA

SEQ ID NO: 26507 - DNA, 228 bp, Homo sapiens; identical to SEQ ID NO: 77
  misc_feature 1..228: note = chr1:108507148-108507376
  misc_feature 1..228: note = hyper
  source 1..228: mol_type = genomic DNA

SEQ ID NO: 26508 - DNA, 113 bp, Homo sapiens; identical to SEQ ID NO: 78
  misc_feature 1..113: note = chr1:108507494-108507607
  misc_feature 1..113: note = hyper
  source 1..113: mol_type = genomic DNA

SEQ ID NO: 26509 - DNA, 550 bp, Homo sapiens; identical to SEQ ID NO: 79
  misc_feature 1..550: note = chr1:108507657-108508207
  misc_feature 1..550: note = hyper
  source 1..550: mol_type = genomic DNA

SEQ ID NO: 26510 - DNA, 340 bp, Homo sapiens; identical to SEQ ID NO: 80
  misc_feature 1..340: note = chr1:108508208-108508548
  misc_feature 1..340: note = hyper
  source 1..340: mol_type = genomic DNA

SEQ ID NO: 26511 - DNA, 38 bp, Homo sapiens; identical to SEQ ID NO: 81
  misc_feature 1..38: note = chr1:108508549-108508587
  misc_feature 1..38: note = hyper
  source 1..38: mol_type = genomic DNA

SEQ ID NO: 26512 - DNA, 615 bp, Homo sapiens
  misc_feature 1..615: note = chr1:109203594-109204209
  misc_feature 1..615: note = hyper
  source 1..615: mol_type = genomic DNA
gcttctgtctttgtacgggccgtcgcttccatcatcctgcggtaagcagcatgcccaaccgaaaaaacaaagctcgtcgcggagccgccagcgtcctcaactcagcgccgccctgacgcccgcgcacgcacggcctcgctgcgtgacgctaccgccgcggctacgccggcgcccgcacccgcgcctcggcctccccgcggggctcgccaacctcgtgcgctctcacggtcggccttgggccccgggagcctcatggtgcgccgagctccgtccctctaggctctcagttccaaggcgtcggttttgcgtctcgtaacggccgctgtggcgcatgcccagaagccattttcaaggtcctcttccgaaccttggcgaggacccctgcgcctgccgcgccgttgaccccgctagcgtgcggctgcgacgcggcacggtacggcagctgttggcgaaggcccccaactccgagcgcgtccgcagaccgcgagccggaaggcggcttgggcggctgttgagttcgtggcgctcccgaggcgtggcaaaggcctaaaaacggtcctggccagcggaaggcggcaagaggagcagcaaggctccacgcgaggcggccggcgg

SEQ ID NO: 26513 - DNA, 71 bp, Homo sapiens
  misc_feature 1..71: note = chr1:109656220-109656291
  misc_feature 1..71: note = hyper
  source 1..71: mol_type = genomic DNA
tccaggagtggccttcgtaggagggaacacgtactggggcctcttccaggcgacgacgtctggagggtgat

SEQ ID NO: 26514 - DNA, 179 bp, Homo sapiens
  misc_feature 1..179: note = chr1:109656891-109657070
  misc_feature 1..179: note = hyper
  source 1..179: mol_type = genomic DNA
gctctgggctgggaccgccttccaggtgacccagggaacgggaccggagcttcatgcctgcaaagaggtactgccgcccccctacccgatcccgctttggtcacaaaagtcttggatccaggcggagaccttggggacccaggcgcagagagtttcagacgccacggagtttagatttc

SEQ ID NO: 26515 - DNA, 235 bp, Homo sapiens
  misc_feature 1..235: note = chr1:110009583-110009818
  misc_feature 1..235: note = hyper
  source 1..235: mol_type = genomic DNA
atcccacccctggaccgcgtgtgagtggggcaaggggaccagcgccttcccagggttccccaccgccctgaccccccggccggctgtgtctccgcaggtggaccgcctactcgtggggctgcgctggcggcggctggaggagccgctgggcttcatcaaagttctccagtgggtgagtcgctgccccggccccgggctatttcgggagcctgggctgtgacgctgacctgaagca

SEQ ID NO: 26516 - DNA, 137 bp, Homo sapiens
  misc_feature 1..137: note = chr1:110282667-110282804
  misc_feature 1..137: note = hyper
  source 1..137: mol_type = genomic DNA
cggcgtggtctcctccgcccctccccacagggcccgcgatcccagaggctgggcaggggtcgacatccgtggctcggcagctcgaaaaggctcccgcgtagagctgctcctgctggagatcgcggacccagagaccc

SEQ ID NO: 26517 - DNA, 174 bp, Homo sapiens
  misc_feature 1..174: note = chr1:110283065-110283239
  misc_feature 1..174: note = hyper
  source 1..174: mol_type = genomic DNA
aggcgcgactaatgccggcgttggggttcagggcctggcgaccccgaggcgggacccgggcaggagtgctgcaggagagcaaaggacccgaggttgaggctcctcccttccccgcgggtgggagccagacttcattcattaatggtgccagtgaagacgcgaaaagcaccacta

SEQ ID NO: 26518 - DNA, 363 bp, Homo sapiens
  misc_feature 1..363: note = chr1:110610535-110610898
  misc_feature 1..363: note = hyper
  source 1..363: mol_type = genomic DNA
atcggccgggtcatccggctcagggcctcagcggcagcgggcaaaactctagtaggagtctcttgccgagggcgtgtttcgacgtcagagccaaactcgggacagactagccaagcgcggacggcgcgagagtggctggcagcgccagcacgcagcctgggttcagagcaaggctgggcgctctcagcaaagggcggcctggggctgcgcgggcggcggactgcaggcgggagaagagcgaggtgcgccaggctctggggcgcgcaactgcccagcctcgtgaaagatcgcgccgcagatggggcgcagctgcgcgctcactcgtgtggactggaaacgctccgagccggttattttaaaaac

SEQ ID NO: 26519 - DNA, 232 bp, Homo sapiens; identical to SEQ ID NO: 83
  misc_feature 1..232: note = chr1:110611045-110611277
  misc_feature 1..232: note = hyper
  source 1..232: mol_type = genomic DNA

SEQ ID NO: 26520 - DNA, 80 bp, Homo sapiens; identical to SEQ ID NO: 84
  misc_feature 1..80: note = chr1:110611434-110611514
  misc_feature 1..80: note = hyper
  source 1..80: mol_type = genomic DNA

SEQ ID NO: 26521 - DNA, 141 bp, Homo sapiens; identical to SEQ ID NO: 85
  misc_feature 1..141: note = chr1:110611653-110611794
  misc_feature 1..141: note = hyper
  source 1..141: mol_type = genomic DNA

SEQ ID NO: 26522 - DNA, 97 bp, Homo sapiens
  misc_feature 1..97: note = chr1:110612445-110612542
  misc_feature 1..97: note = hyper
  source 1..97: mol_type = genomic DNA
gggccaagaccaggccgcagtccccagccgaccccgatttgaccactctaggttgaggcccagcctcagggccctcaaagggcgccagacacaaaag

SEQ ID NO: 26523 - DNA, 21 bp, Homo sapiens
  misc_feature 1..21: note = chr1:110613458-110613479
  misc_feature 1..21: note = hyper
  source 1..21: mol_type = genomic DNA
ggagcccgggaaccccctccc

SEQ ID NO: 26524 - DNA, 840 bp, Homo sapiens
  misc_feature 1..840: note = chr1:110626790-110627630
  misc_feature 1..840: note = hyper
  source 1..840: mol_type = genomic DNA
ccctcgcgtggccgggcgcagatccccgtgcacgggtcctccgcacacccttgccagcccgcagggattgttcgccgcgttggtgactccttcccaaaatgggaataaaagatcgaaatagctagtaagcatgcaaagtttattgtcaacctcaagtctctataaaaccagatcaaagggaacaggcgtttggtttcttcccagatcgctggggggcctcggggctcaggaagccccaggagtccagcccgctgccgctcactgcgctcttctctccagccgggtccaagggctcgagcatcgcaacctgcggcctgagttggccccgggcgcacgcgagggaaatggatgcagtgcccgtgaacttggggcctgaataattgataacaacccgctgggtgcccgtcgcgcggccaggcctgcggggagcggagccggaggcagcaagcaaaggaaacgcacgagccgggagcgcgggcgcgcggggccacgaaagaccgaccgactgtccgacgggcggtgggacaagaggacggatgctgtgggggggccccggaacccgccgccacaactcgcggcccacgcgggtcgcagccgccagccgtagggagctgccgagcagcgacgttccgcattccatcgggttcccgcgccctactgggcttgtgcggcgcagtgcctgcgtgtgctttcgttttctcaaggccattctgataaaacatacgtgctggttccctttcttttctcagaatgattcttcaaggcgaatgactcgaaatggagatttcttctaacaccgcgtgatcaccgacaacttttgcaggacgggatgaaactcct

SEQ ID NO: 26525 - DNA, 249 bp, Homo sapiens
  misc_feature 1..249: note = chr1:110672833-110673082
  misc_feature 1..249: note = hyper
  source 1..249: mol_type = genomic DNA
ctgtattttcagcctcggtttgacgtcaggctctcacggtcccaaaggatgggctttgtacatttccaggccgcagaccggagcctcccatccctttgggcctcttgggcggtccctacggccacctcccgcagctccctgggggcgggggaccgctggatgagggaggaggggaggtactggggggaaagggcggttggcgggaaggaagtccaggtgagacaggcccgcgttgggactatcgtgcgc

SEQ ID NO: 26526 - DNA, 269 bp, Homo sapiens
  misc_feature 1..269: note = chr1:110673083-110673352
  misc_feature 1..269: note = hyper
  source 1..269: mol_type = genomic DNA
gtatgtcggccggcaggtggggctggtccgggcgcaggaggcggtagagcaggagcagcagggggagccaggctggccgagctggggggtgagcacgtttgtctcaggcagctcatcgcctgacacccccgggaacgggctctgccccaaggcctaaaatgagggaagatgaggaaatgggggtggggacgatggagaggatggaaggggcggcgggggggtgcggtggtctgcgcggtacagcagcgtccctgcgggttcccctcatt

SEQ ID NO: 26527 - DNA, 613 bp, Homo sapiens
  misc_feature 1..613: note = chr1:110692884-110693497
  misc_feature 1..613: note = hyper
  source 1..613: mol_type = genomic DNA
ggccccattcctctccgagggcagaagccctggcgagggctccagggtctgcatcccctgaccaggggcctcaagaagctaagcccccttgcaactccctctcccgccccacgcccaccctctccgcctacgtcggccatcagagcctcgctcgctgcccgagagcctcgcattgacgccggcccgcgcgtgagtcaagcctgcgtcacggcgccccgccgccagggtggcctttcggaaagcgagggaacagtgcgcgcagcgctccgcccagctccgttctgctccgcagagccggcgctgccagggcgcagggagggcggcactcggccccagtcttcgcaatcccgcgcgctctctccgccgtgggacctgggtccccgcgccgctcccctgagccccgagcgcgcggcgggcgggagccaggttgggactggtggtgaggcagggagtgaggagcgagcggagtcgcgtgcgccggcgcgcagctccgggtcgccccagccccagccgggggcctgtggcccgggggaggagctgtgcgtccgcgacccgtcggggatcgcagctgctcggccggagtgcacgggccgagtctgcgcgactacccacg

SEQ ID NO: 26528 - DNA, 526 bp, Homo sapiens
  misc_feature 1..526: note = chr1:110693736-110694262
  misc_feature 1..526: note = hyper
  source 1..526: mol_type = genomic DNA
cgtacgcacgggttggacaccgggcttcagcttctggtgctcagaagggcccaagaactccggaggaaattgggcttagctgcggaggcaagcgcccgcggagaaccggagggggcctgtccggcccatccgcggcttgaaactgcgcgcccagggcgcagttccactgggagcctcttacgcagctggagaccccagccccagccgctcggcctcaggcctgtgaccttgacagtaacattggcaagcgaagcagaactgtcacgcccgagatgaatatttaattctcagtcctggggctggtcctcgctggattcggagctagcagagagcccttcctccctcgtgggaagcgcatctggggaacggaatggctgagacaggggacgtgcgtgtggtgcccatctggagggggcgccgtcctggcgggtcgagaggcctctgctgcatttatgcctgtgtgcgccgtgctctgaagcgatgctggatgctcgcagtactatgggtgggccgctccccaggggcg

SEQ ID NO: 26529 - DNA, 208 bp, Homo sapiens
  misc_feature 1..208: note = chr1:110754149-110754357
  misc_feature 1..208: note = hyper
  source 1..208: mol_type = genomic DNA
accgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcgg

SEQ ID NO: 26530 - DNA, 622 bp, Homo sapiens
  misc_feature 1..622: note = chr1:111097796-111098418
  misc_feature 1..622: note = hyper
  source 1..622: mol_type = genomic DNA
aggaatcagcattcccgttgtagagatcggtggaccgatgctctcagaggcttccacaagcgtttgtattgtttggggcggtcggaactcagcgctgcggaagccggtgtatctgagtctctccacgtggctctacttttctgcagccctgtagaaataaacctgggtcctcgctccctggcctggggaaggaggtctgcaggggtctgtgggggccctggaggcgccttcccagctgcacaggctcagtcggaccagcagaggtcactgcgtgggaaagagtggggcgccaacccgcgcagagcccagccggcgaccgcccccgcgtccccgcggagctccctgccttctgccgcagtcctccgagggctgggcttctggggcaggtcatggctattgcaaccaaagggaggcccgggtgccagtgggcggccgccgcggtgtggagggcgccagggcggtacggcgcagcgggccgcactcttgggacgccccgcctgctctgcggagcctgcctgggatgccctttcctggtcacggactccgccggcagccggggcgggacggaccagaggctaccaactgggggcttctgctgcctgggacacggggatccacattg

SEQ ID NO: 26531 - DNA, 290 bp, Homo sapiens
  misc_feature 1..290: note = chr1:111149588-111149878
  misc_feature 1..290: note = hyper
  source 1..290: mol_type = genomic DNA
ccaccagctcctctccgtgccctccgccccgcgccacgcaaaccccagagggtcccgagcccattctgtgcactcttcttgagcagggtgcaagttccccttgatctccccggtctgggacctgccgagcagacggcagtggtcggcaagggcttgccgccgcggactcagcccaagcctgctgcgctgcaggctgcgccgccgggtgccccgcagcccctctgggcgccgcagccgggcagggaaggcagcacgcgccgcgcaacgccccgacacggatttacccttcc

SEQ ID NO: 26532 - DNA, 123 bp, Homo sapiens
  misc_feature 1..123: note = chr1:111150355-111150478
  misc_feature 1..123: note = hyper
  source 1..123: mol_type = genomic DNA
accccaggcccacagcgggatccagccccgggagagacgtgttgctattattgtggtgcctccagacaggatctgcagacccctttcttgccctttctcccgccagcgcgaccccttctccag

SEQ ID NO: 26533 - DNA, 266 bp, Homo sapiens
  misc_feature 1..266: note = chr1:111216707-111216973
  misc_feature 1..266: note = hyper
  source 1..266: mol_type = genomic DNA
gcacggacacgatggcgatgccccgggccggcccggagctctcggggtactcgaagagcagccacacctggcgctggaagtcgcggcggggcaagggccgctcctcctcccgcaggaagccctcgtcctcgcggaacttctccatggcctcctcgcccagctggtagaagcggatctcctcggagaaaatgtcgatgggcacgttgaccggccggcggatgcggcccccggactgatagtagtagaggatggcgtcgaagctgggc

SEQ ID NO: 26534 - DNA, 381 bp, Homo sapiens; identical to SEQ ID NO: 89
  misc_feature 1..381: note = chr1:111217194-111217575
  misc_feature 1..381: note = hyper
  source 1..381: mol_type = genomic DNA

SEQ ID NO: 26535 - DNA, 136 bp, Homo sapiens; identical to SEQ ID NO: 90
  misc_feature 1..136: note = chr1:111217576-111217712
  misc_feature 1..136: note = hyper
  source 1..136: mol_type = genomic DNA

SEQ ID NO: 26536 - DNA, 179 bp, Homo sapiens; identical to SEQ ID NO: 91
  misc_feature 1..179: note = chr1:111217713-111217892
  misc_feature 1..179: note = hyper
  source 1..179: mol_type = genomic DNA

SEQ ID NO: 26537 - DNA, 145 bp, Homo sapiens
  misc_feature 1..145: note = chr1:111217923-111218068
  misc_feature 1..145: note = hyper
  source 1..145: mol_type = genomic DNA
cggcccgtgggccgggagagctcccgccgcggccccgcgggcgccggccccctggcctccacacccctaggtacagcccggggagggcaggcgggcccagtgtccagggagggagtgcaggccaggcgggcgccctgggccagag

SEQ ID NO: 26538 - DNA, 521 bp, Homo sapiens
  misc_feature 1..521: note = chr1:111505931-111506452
  misc_feature 1..521: note = hyper
  source 1..521: mol_type = genomic DNA
tgagtcacataagagcgtcggccatcttggttttcatctcccgtggagatctactcggtccgcctattaaacttgagacgctggggtcccgcggagccgctgtgtcaggctctaaagaggttttacatttcccagaggaaagcgctctatgggctttaagcgccgcggagacaagcgcttcccgcctgggtggcgcactctgcgggctccaactcctctcaactacacagcgtccggaaacgacggccgactccacatccctaagacggacagaggggcagccgtggggaggattcgaaaccggtacttaccaacgcgaggcgttgcctgaattttcctctgcgggtttcaggaagaccctccgtaggttatttgacattttagtggggagaaaggggacacctcatccagaaaagtgggaagcgtggggccgagtttcccaatggggcgagaaccagagcgagggaatgttgggctggagttgcccacagcaactgtgaggggttcgaccttaacggagg

SEQ ID NO: 26539 - DNA, 41 bp, Homo sapiens
  misc_feature 1..41: note = chr1:111813546-111813587
  misc_feature 1..41: note = hyper
  source 1..41: mol_type = genomic DNA
cacccacacagcctgcgggaaggatccgacaaggtgagggt

SEQ ID NO: 26540 - DNA, 264 bp, Homo sapiens
  misc_feature 1..264: note = chr1:112283059-112283323
  misc_feature 1..264: note = hyper
  source 1..264: mol_type = genomic DNA
gctgctccctcccagcgcggagacgccgcgcccggccgggacagccggggacggtggcggagagcacggagagtaattaagcaattagcgacgtgttgttaaaaggtaattaacggggaaaagtttgccccaggcaggattagaggtctctgagtgggacaactgtaagaacaccagagaaggcacgaacggtgccggcgccgccatcggtccgtccgtggcagccaaaagtgccagatatgctaactattgaaagatgcgcgg

SEQ ID NO: 26541 - DNA, 256 bp, Homo sapiens
  misc_feature 1..256: note = chr1:112531573-112531829
  misc_feature 1..256: note = hyper
  source 1..256: mol_type = genomic DNA
ttcgatccctctccccggggccgcgacggcccttggcgtcacgtagagacctttcccagagctcgcggggtggaagtggcgtcgggcaggaccagatggactggcccccagcctctggtagacacaccgccggctcgccgagctggagaactttgcgaagcgccccaaaccgctccgggtttccactttcagccatttctctccttgtcccctcaccaagagcggggacggagcaagccttcgccacctgtctctg

SEQ ID NO: 26542 - DNA, 43 bp, Homo sapiens
  misc_feature 1..43: note = chr1:112533373-112533416
  misc_feature 1..43: note = hyper
  source 1..43: mol_type = genomic DNA
cagaaggtcgagattcgccctcctctcccgccacgtctaccca

SEQ ID NO: 26543 - DNA, 67 bp, Homo sapiens
  misc_feature 1..67: note = chr1:113051618-113051685
  misc_feature 1..67: note = hyper
  source 1..67: mol_type = genomic DNA
cagaccccctgacaccgcacccggtcctcaggcagcgcgccccagaccccgggttcggcacgccgtc

SEQ ID NO: 26544 - DNA, 32 bp, Homo sapiens
  misc_feature 1..32: note = chr1:113392524-113392556
  misc_feature 1..32: note = hyper
  source 1..32: mol_type = genomic DNA
ggggcttctcacagccgcgcgcacagactggt

SEQ ID NO: 26545 - DNA, 135 bp, Homo sapiens
  misc_feature 1..135: note = chr1:113497971-113498106
  misc_feature 1..135: note = hyper
  source 1..135: mol_type = genomic DNA
ccatgagtagaagggcgctgcggcggacgctggcagccacaggttgaatgacaaagagcccccgtcagcaccactcccaggagtctgcgggctgccccgtcccctccgcaaagtctactcgaaccctgcagtcac

SEQ ID NO: 26546 - DNA, 41 bp, Homo sapiens
  misc_feature 1..41: note = chr1:113498107-113498148
  misc_feature 1..41: note = hyper
  source 1..41: mol_type = genomic DNA
ccttggctgtggggaatgcggctctccgcaccactctcgca

SEQ ID NO: 26547 - DNA, 383 bp, Homo sapiens
  misc_feature 1..383: note = chr1:114695312-114695695
  misc_feature 1..383: note = hyper
  source 1..383: mol_type = genomic DNA
cctgccgcgactccccggagacgccgcagctgcgcgccagggtccagcccggcggggatcgggctcgggactcacccgctccggcgagctcgactcagctcgggctcccgcctcggctaggcagccgcctggggctgcgtcccgcgcagggtcagcgcggatcgggcaggaggcgccctcttggcaaagtcggctagaggcgccagctcagtcgcgcaccggccccgagtccgagtccgagagggacggagggagcgagttataggggcgagagggggtgggggaaggacgccgcaacaccctcataccctcccccaccccgccccctgtcccccgccccccagcggagacgcggaaaaccactcgcagccggagagacaccc

SEQ ID NO: 26548 - DNA, 41 bp, Homo sapiens; identical to SEQ ID NO: 1801
  misc_feature 1..41: note = chr1:114695696-114695737
  misc_feature 1..41: note = hyper
  source 1..41: mol_type = genomic DNA

SEQ ID NO: 26549 - DNA, 310 bp, Homo sapiens; identical to SEQ ID NO: 1802
  misc_feature 1..310: note = chr1:114695799-114696109
  misc_feature 1..310: note = hyper
  source 1..310: mol_type = genomic DNA

SEQ ID NO: 26550 - DNA, 44 bp, Homo sapiens; identical to SEQ ID NO: 5691
  misc_feature 1..44: note = chr1:114696420-114696464
  misc_feature 1..44: note = hyper
  source 1..44: mol_type = genomic DNA

SEQ ID NO: 26551 - DNA, 239 bp, Homo sapiens
  misc_feature 1..239: note = chr1:114696540-114696779
  misc_feature 1..239: note = hyper
  source 1..239: mol_type = genomic DNA
cgcccctcacgtggcatcccgcggcagctggcgagtctggcgcctcgcggccgccccctctacactcagggactggcctgagtccggggggtgggggtttcgaggcgggaagccgggctgtcccgaatctcggagggtgcaaggccaggaaagagtccgggttcccactccgcattcactgcctggtgtgaccttgggcgtctctgagcctcaattttcctctccgtaaaggaggtgta

SEQ ID NO: 26552 - DNA, 65 bp, Homo sapiens
  misc_feature 1..65: note = chr1:114697062-114697127
  misc_feature 1..65: note = hyper
  source 1..65: mol_type = genomic DNA
cgcatgttgctatggcgacgggaggcagcggccgtctctctccatggcaacgggagggaaaagtt

SEQ ID NO: 26553 - DNA, 30 bp, Homo sapiens
  misc_feature 1..30: note = chr1:114697835-114697865
  misc_feature 1..30: note = hyper
  source 1..30: mol_type = genomic DNA
ccctggctctgtccacggtgctgaagaccc

SEQ ID NO: 26554 - DNA, 26 bp, Homo sapiens
  misc_feature 1..26: note = chr1:115632012-115632038
  misc_feature 1..26: note = hyper
  source 1..26: mol_type = genomic DNA
aggtacttgatgcaccgcaggccccc

SEQ ID NO: 26555 - DNA, 250 bp, Homo sapiens
  misc_feature 1..250: note = chr1:115632104-115632354
  misc_feature 1..250: note = hyper
  source 1..250: mol_type = genomic DNA
ggggagcggcaggctccggcggggagggggcggagcggggaggaccggggcggggcctccggggggcggggcggggcccggcggggaggggcgcgtggaccccaagcggcgtggctggcgacgggtgggggcgccagcgggtggagatcgagcagcccgagggagcacgttcgctcttctcccggacccagggaccaccttccttccctccagtgggcgcaccgccgccggctatcggagcacctgcagg

SEQ ID NO: 26556 - DNA, 83 bp, Homo sapiens
  misc_feature 1..83: note = chr1:115632554-115632637
  misc_feature 1..83: note = hyper
  source 1..83: mol_type = genomic DNA
gagtgtccagggctgcggctccgcggcgcggagcaagcacacaagcagcttctaggggaccctccctccggcccctcccccct

SEQ ID NO: 26557 - DNA, 155 bp, Homo sapiens
  misc_feature 1..155: note = chr1:115880052-115880207
  misc_feature 1..155: note = hyper
  source 1..155: mol_type = genomic DNA
cgccctaaccttccacgcccgcttctcccacacctggcagcagacagctggagatgaagcgtgtgacccaagtggcagggctgaaccttggcgacctctacctgaggttgtccaacgcggctccgtggagggccccggtacgccggacggacccc

SEQ ID NO: 26558 - DNA, 194 bp, Homo sapiens; identical to SEQ ID NO: 5694
  misc_feature 1..194: note = chr1:115880208-115880402
  misc_feature 1..194: note = hyper
  source 1..194: mol_type = genomic DNA

SEQ ID NO: 26559 - DNA, 117 bp, Homo sapiens; identical to SEQ ID NO: 5695
  misc_feature 1..117: note = chr1:115880678-115880795
  misc_feature 1..117: note = hyper
  source 1..117: mol_type = genomic DNA

SEQ ID NO: 26560 - DNA, 15 bp, Homo sapiens
  misc_feature 1..15: note = chr1:115880872-115880887
  misc_feature 1..15: note = hyper
  source 1..15: mol_type = genomic DNA
cgagctgctctcaca

SEQ ID NO: 26561 - DNA, 151 bp, Homo sapiens
  misc_feature 1..151: note = chr1:116371036-116371187
  misc_feature 1..151: note = hyper
  source 1..151: mol_type = genomic DNA
cgcccactggtgtggcgtcctgagagtgcgtgcgtgagcgagcgagcggcttatcctagactgaagacccagggaaacagatctgtgtggaggatgtttctgttttcagcagaacagacgcagcccccgagtcagtgccgtcagaagacac

SEQ ID NO: 26562 - DNA, 341 bp, Homo sapiens
  misc_feature 1..341: note = chr1:116371188-116371529
  misc_feature 1..341: note = hyper
  source 1..341: mol_type = genomic DNA
tcagtcaattcagtggaaaacacttccagtgtgaggcgttcgccggcgccccttagacgcggccgggtctgaggcgcctgccgagcgaggtggcgcggcccgggagctgtggtcgaagcccctgggcctggcgtgtaggctgcgcgggcggcggcgggctgggggcggggctctccgccctccgcgcgggtccgcctggcccctcccccgcccaccccgcgcccgtcccgcctcccccaccttctcccagaggaggtgacagacgggcctgtaatttggttccattcgctcgactggagcaacacctgcccccctcccctgggacgcgagggtctcatccc

SEQ ID NO: 26563 - DNA, 128 bp, Homo sapiens
  misc_feature 1..128: note = chr1:116380300-116380428
  misc_feature 1..128: note = hyper
  source 1..128: mol_type = genomic DNA
agaagtggctcatctcgggtgtctccacgaggttctcctggcctggaaaatcccccctgcgagcccccgggctcgccagacaaccccacctgcctgcgtcggaaaccttccctcgtcgccctgctgac

SEQ ID NO: 26564 - DNA, 251 bp, Homo sapiens
  misc_feature 1..251: note = chr1:116380724-116380975
  misc_feature 1..251: note = hyper
  source 1..251: mol_type = genomic DNA
acgcggatgcgctcgcgggtggcgtgggccgagcggtacttggccgtggcgcgccggcggcggcgcttctcctcgcggctcagctgctgcgggtgcgggtagagcgcggctcggctgccgcccttgccgtcgccctcggcctcctccaccggctccaggtccgacacgctgccgagcaccttggtgtccgtgccgcccagggactccggatccgagtgcgccgagctgggatggtccgaatctgctgcttg

SEQ ID NO: 26565 - DNA, 410 bp, Homo sapiens
  misc_feature 1..410: note = chr1:116381534-116381944
  misc_feature 1..410: note = hyper
  source 1..410: mol_type = genomic DNA
gggctgcgccgggggcgcctggctctggggtgcggccggtcaggaatccccatcctggagcgcaggcggagagccagtggctgggggcgggaaggcttcttggacccctcgcgcttctccgaaatcgtaaagaaatgactaaacaaacgtgggggagcctttaaaaagaaaattgactccgatgccctcgcaggctcccggagcaccatctgtcacgcagacagccacacacataggggacctagggacacggcgacgtgggatcagacaatgcgcccggcagtctggcgaccaccttgcgggaaaatgccggcagccgggccgctgagggaggagaggatgcagagggaagggaagagaagggaagggcccggggcggggcaggcggggactagcgggtgcagcgcgtg

SEQ ID NO: 26566 - DNA, 111 bp, Homo sapiens
  misc_feature 1..111: note = chr1:116382387-116382498
  misc_feature 1..111: note = hyper
  source 1..111: mol_type = genomic DNA
aaggggatgggtgatcggttcccagcaccgcacttgcagaggagcgaattgggccaaaacagctttaatttccctgcgaggaaatcaggtcctctacggcaaaataaaaac

SEQ ID NO: 26567 - DNA, 33 bp, Homo sapiens
  misc_feature 1..33: note = chr1:116710587-116710620
  misc_feature 1..33: note = hyper
  source 1..33: mol_type = genomic DNA
gggtcagccagggcacgccgctgagatgtcttt

SEQ ID NO: 26568 - DNA, 281 bp, Homo sapiens
  misc_feature 1..281: note = chr1:116711011-116711292
  misc_feature 1..281: note = hyper
  source 1..281: mol_type = genomic DNA
agtagaacaaagaggcgggagcaccccgccaggggaccgggaagggtcgaggaaaactgctgccgcgccccactgggttttaacaacgcccgggatgggggaagggctcccacttgcgccccaagcgcatgcggagaaggttcggcagcgcctcctgccggccgcccggagggtccgcggtggcgccagccccgatcgcagccgcgcaggcccgagggcccctacccgcacggtgaattgtcttccacgcactagtattttctcctcgctttcaactgaat

SEQ ID NO: 26569 - DNA, 160 bp, Homo sapiens
  misc_feature 1..160: note = chr1:118727930-118728090
  misc_feature 1..160: note = hyper
  source 1..160: mol_type = genomic DNA
ccgtctccacagcaacggagtttcagagcgcgcggcagcttgggggcggggttcccagtcccccggtcaaattttaggacttttcagcaggaaagctgcacaactggaggagggcaggacgaggctggcctcgcaggtcgggctacgttcttctacggtc

SEQ ID NO: 26570 - DNA, 15 bp, Homo sapiens
  misc_feature 1..15: note = chr1:119521978-119521993
  misc_feature 1..15: note = hyper
  source 1..15: mol_type = genomic DNA
cgtcacgatcccaca

SEQ ID NO: 26571 - DNA, 138 bp, Homo sapiens
  misc_feature 1..138: note = chr1:119522297-119522435
  misc_feature 1..138: note = hyper
  source 1..138: mol_type = genomic DNA
tcaccagggccttcccggttagcccagggtccccacatttctccaggatgtaattagagctaagaacagccgccatccctcagggttccgggtcccgggtttccagggtcccgggtttccaaggccccgcgataaccc

SEQ ID NO: 26572 - DNA, 289 bp, Homo sapiens
  misc_feature 1..289: note = chr1:119522565-119522854
  misc_feature 1..289: note = hyper
  source 1..289: mol_type = genomic DNA
cgttccggccccgcggcgcctccaaggccgggccgaggggccgaggggccgagggcgggcagacgcggccacggcctaattctgacttctgaaggtcaccgaaactgcgctgtttttccagagatgggttgaagagaagagatgcaatcccagttccttctgcggcgaaacgggatctgaaattcttggagagggggaagaattggacgttttcatcgtgcgtggaggaaaattgggggaggggaagtgagtggcaagtaagggggttaactgcttcccggaccctatc

SEQ ID NO: 26573 - DNA, 15 bp, Homo sapiens
  misc_feature 1..15: note = chr1:119522925-119522940
  misc_feature 1..15: note = hyper
  source 1..15: mol_type = genomic DNA
cggttcatccagttg

SEQ ID NO: 26574 - DNA, 159 bp, Homo sapiens
  misc_feature 1..159: note = chr1:119526773-119526932
  misc_feature 1..159: note = hyper
  source 1..159: mol_type = genomic DNA
ttgagctgacgggtgcgtgcgagaatgcgagacctgccacgtgtacacgtgtacgcggagtgtcgatctgcctgcgtgtccttggatgtgcctgtctaggtgcccacccgcgcgcgccaccacatccccaggcctctggaacgcagctgctgtgtggcc

SEQ ID NO: 26575 - DNA, 416 bp, Homo sapiens
  misc_feature 1..416: note = chr1:119527236-119527652
  misc_feature 1..416: note = hyper
  source 1..416: mol_type = genomic DNA
cgagagccaggctcctccgaggctggtcttgaggcacttctctagtagcttctccaaaagactgagagtgccggcgtaggtatgacagtgagggtacctcacagacccttctccaaagtctggcgggccttggggtttttcggggccaccaggctcggtggaatttttgaaacgctttcgaaatacatagtttcctctgtggagtgagtgcctacaacgcgcaggccggactgatcccccgttgctgcaggttggtgccccaagctgcgggtgctcgggcgccaactaaagccagctctgtccagacgcggaaagaaaaatgggctgtgaaaaagcaaaaggcctcgtctttgaatgaaagttaaacattaaaatctgaccctagagttgtctaaagatcgcggaattttgaagct

SEQ ID NO: 26576 - DNA, 140 bp, Homo sapiens
  misc_feature 1..140: note = chr1:119528015-119528155
  misc_feature 1..140: note = hyper
  source 1..140: mol_type = genomic DNA
cgcgcctttcgctaccgcctgagtctggagccgacagctccacctcttctgctccctggaccgccgcgtctccacgccacggcgccctttttactaaaagatcttttctcatcctatcagcaaatcgttaagaaaggctt

SEQ ID NO: 26577 - DNA, 684 bp, Homo sapiens
  misc_feature 1..684: note = chr1:119528653-119529337
  misc_feature 1..684: note = hyper
  source 1..684: mol_type = genomic DNA
aagagaaaacttccccgggacaggacgtctgccacgcgcagctaaacaacttctgttttttccgccgtggggaaaataaaagaaccttacaaattctaaggcgtcataacccctgcaagaacttctaactgtatgaaggcccacgcgagattttgacaatagataaatgagctgaggaaatagggtctggccagcgaagggaaacacacagtagccctgggtgcctttctggaatgcccacgcaggggtccgcgtggacaagcacttgcattcaaatacaggaaaaggcttggacggtcgaaataaatctccttttaattttcttttcatcgactaataaaaataattccccagcactaaactcaaataccgtaacgggccacaaaaacacggagaattcataaaactctatctctgcaggtcacccgctaatcgcattattattagcctcgggagcatggaaattgaactgtcactgcctaaagagaaaatgtaagcgacagctgtccctcctctgagttggacagctttgtggctgagatccccaagctcctgagccccagaccgtctctatcccagtgcaggccgctgccccctccccgggcttgtcagcgtgtgaagcggggtctactccccagctctggctgttcagcaggagcaccttccagcatggttttagaagtc

SEQ ID NO: 26578 - DNA, 51 bp, Homo sapiens
  misc_feature 1..51: note = chr1:119529378-119529429
  misc_feature 1..51: note = hyper
  source 1..51: mol_type = genomic DNA
cgttgtatgtgcgcgcgcgcacactcaagattcttccgacaacagctgttc

SEQ ID NO: 26579 - DNA, 108 bp, Homo sapiens
  misc_feature 1..108: note = chr1:119529804-119529912
  misc_feature 1..108: note = hyper
  source 1..108: mol_type = genomic DNA
tattggattggagaacgccgcgccagtcctcccgagttctcagaagcgagtcctagatctcggctcccgccgttgccttcggcccgcgcccctcccaatcccagggac

SEQ ID NO: 26580 - DNA, 144 bp, Homo sapiens; identical to SEQ ID NO: 1805
  misc_feature 1..144: note = chr1:119530005-119530149
  misc_feature 1..144: note = hyper
  source 1..144: mol_type = genomic DNA

SEQ ID NO: 26581 - DNA, 307 bp, Homo sapiens; identical to SEQ ID NO: 1806
  misc_feature 1..307: note = chr1:119530201-119530508
  misc_feature 1..307: note = hyper
  source 1..307: mol_type = genomic DNA

SEQ ID NO: 26582 - DNA, 47 bp, Homo sapiens; identical to SEQ ID NO: 1807
  misc_feature 1..47: note = chr1:119530553-119530600
  misc_feature 1..47: note = hyper
  source 1..47: mol_type = genomic DNA

SEQ ID NO: 26583 - DNA, 124 bp, Homo sapiens; identical to SEQ ID NO: 1808
  misc_feature 1..124: note = chr1:119530601-119530725
  misc_feature 1..124: note = hyper
  source 1..124: mol_type = genomic DNA

SEQ ID NO: 26584 - DNA, 116 bp, Homo sapiens
  misc_feature 1..116: note = chr1:119530998-119531114
  misc_feature 1..116: note = hyper
  source 1..116: mol_type = genomic DNA
gcccccaaccaatagcgaggagggaacaagagaaactccgagagcgcgaaccaatgagaggaagggagagactgaggcccgggccaaagcgcagcgccagtcgtcccctggatgct

SEQ ID NO: 26585 - DNA, 132 bp, Homo sapiens
  misc_feature 1..132: note = chr1:119531865-119531997
  misc_feature 1..132: note = hyper
  source 1..132: mol_type = genomic DNA
gatctcccccctggccgccccctgccttttgcgatctctaaggactgcattcaacatggatttctaaggaattaaaaaatccaacgctcctggccattcttaattcccacacctcttcccaagttacgccac

SEQ ID NO: 26586 - DNA, 37 bp, Homo sapiens
  misc_feature 1..37: note = chr1:119535303-119535340
  misc_feature 1..37: note = hyper
  source 1..37: mol_type = genomic DNA
agtcgcagagagctgcgggacccgcataagtcgttaa

SEQ ID NO: 26587 - DNA, 148 bp, Homo sapiens
  misc_feature 1..148: note = chr1:119535573-119535721
  misc_feature 1..148: note = hyper
  source 1..148: mol_type = genomic DNA
tcataaatttatctgcgttctatcggcattggggcaagaggagagcgaaaaggggggggaagccccgattttatatttgtgactataaaaaagcgccacccggtttcctcgccttcggccgccgcggtgtggccggcagagccggggc

SEQ ID NO: 26588 - DNA, 30 bp, Homo sapiens
  misc_feature 1..30: note = chr1:119536719-119536749
  misc_feature 1..30: note = hyper
  source 1..30: mol_type = genomic DNA
ccacccagttcttggcggtgactaggactt

SEQ ID NO: 26589 - skipped

SEQ ID NO: 26590 - DNA, 127 bp, Homo sapiens
  misc_feature 1..127: note = chr1:119543069-119543196
  misc_feature 1..127: note = hyper
  source 1..127: mol_type = genomic DNA
cgaagagcgggtagatgccggccaagcaaagtgctcgaaagtgtagctgggacgcccacgccggaagcctggagaggcaagttgcgagttcgcagggcttgggagttttttgcggcggaagaagctg

SEQ ID NO: 26591 - DNA, 1078 bp, Homo sapiens
  misc_feature 1..1078: note = chr1:119543408-119544486
  misc_feature 1..1078: note = hyper
  source 1..1078: mol_type = genomic DNA
cgcggctgtctttcccggaaagacccaagtgcgcgatgtcagcccgcctgcacttcatctgagttgtccttatgtggccatttctgtttcaaatttcagatttttctactaaaaaaggatgggttaaaacagctgagagcgcgcctgctctttcccgccctgggttctacatctctctagccgcccaccagactgcatctccaatctgggagctatcctcaccttgggagggtggggcaacaatgttattctcgtttcccgataaggaaaccaacgtccctacaacttgacgttaaatggtcccaggttcctgagcctcaaatctaggactattacctaggtcacctaaaaatttttgttctttccactcccccgagggtgattctgttagcctcgcaggcccttctcccacccgtcatttgaagtcatcgaccccggggcagccccaacagttctgtgcgggcctgcgcgcaccgccctcaccttgcgcgccaggcatctcacctcagccgggcaggtgcagaggtgacaggcgcggcagccgcggttcgtccggccgaggggcaggaggaggctggccgccgccttctgctgcccgcaggctgagggggcaggggagggggaacagggctgggaaactgccgtcagcgggtcccggccccgcctcccgaacgcaacgtccaggaaacctcagaactttctattgtctgagaagcttcactgaacaaattgtccctaaaactttagagctgcgaagagcggatcagggcaggttctagtgtggccctgtgccccggagcctgcctgccataaagtgtgaccggaagcccccccccccccgcccactgtcagaaccactgaggagagaagagcgcggcgccttagtgccgccctgcgtcgtggtcgggaagccgagcaagcggtgtggacgccccaggagcagggggatccaggcctaaactcatgggttccgaatgggcaagggagcagaatcaagcatcggtgggcgcttatagaaagcgcgtctgtcttggaacacccttaccagggtacccaaccccagcgccaggtttcctgg

SEQ ID NO: 26592 - DNA, 606 bp, Homo sapiens; identical to SEQ ID NO: 1811
  misc_feature 1..606: note = chr1:119549129-119549735
  misc_feature 1..606: note = hyper
  source 1..606: mol_type = genomic DNA

SEQ ID NO: 26593 - DNA, 392 bp, Homo sapiens
  misc_feature 1..392: note = chr1:119549914-119550306
  misc_feature 1..392: note = hyper
  source 1..392: mol_type = genomic DNA
cgtctaccccaacccgggtattaccctcttttccgtcttctagaaggggaaaaccatgctgttttgaattcaacatatttagattctgaaaatcgacggcccttcccttctttcctaggaaggcctgccccgtaggcacaaccttcggagaaacgggcggcgcgtgagttccctggagccgcctcctgggcatccaggctcctgtcgcacggctggtgcggcgcccactgggcgtggggactgggcccaaggctcccgggaccgggtcgtggttaacgccgaggccaagcccttcgaagaactctgagttctctgcctgacgttttgtccctcaggaagtgtcccttcccgacttttgagggtgtcttgttctttgacggggtggccctgtg

SEQ ID NO: 26594 - DNA, 29 bp, Homo sapiens
  misc_feature 1..29: note = chr1:119550692-119550721
  misc_feature 1..29: note = hyper
  source 1..29: mol_type = genomic DNA
acgcgcctagcagcccggcggccccggcc

SEQ ID NO: 26595 - DNA, 304 bp, Homo sapiens
  misc_feature 1..304: note = chr1:119551013-119551317
  misc_feature 1..304: note = hyper
  source 1..304: mol_type = genomic DNA
cggggtagtgggcgggagacaagggtctcagaacagaggggctggcccggcgcggcgggccaggaactcccgggcgtgtgtgtgcagtggtgcggggtgggggtggaggtgaggtctcctttagttcctgggatctgggaatcccggcttctcgatctcatccggcgcggagatcttaagggtcggtggaccagttagtgtgtacggcctcacccctccgcctccagctttcgaggctctccgcttcagagctccaaaggaaaacttctgcgacttcaagaacgtcctgcgcattcacatgggg

SEQ ID NO: 26596 - DNA, 43 bp, Homo sapiens
  misc_feature 1..43: note = chr1:119869950-119869993
  misc_feature 1..43: note = hyper
  source 1..43: mol_type = genomic DNA
tccctgccaggtgtccgaggcccgaccgcgccccgcccccacc

SEQ ID NO: 26597 - DNA, 30 bp, Homo sapiens
  misc_feature 1..30: note = chr1:119870224-119870254
  misc_feature 1..30: note = hyper
  source 1..30: mol_type = genomic DNA
agcggagctgtgcaccggcctgtgtactgt

SEQ ID NO: 26598 - DNA, 43 bp, Homo sapiens
  misc_feature 1..43: note = chr1:120190546-120190589
  misc_feature 1..43: note = hyper
  source 1..43: mol_type = genomic DNA
caacggtccactttacgaggcacaacttcgcccagccgttccg

SEQ ID NO: 26599 - DNA, 30 bp, Homo sapiens
  misc_feature 1..30: note = chr1:120254554-120254584
  misc_feature 1..30: note = hyper
  source 1..30: mol_type = genomic DNA
gcccagttactctagcgcgccaggccgaac

SEQ ID NO: 26600 - DNA, 51 bp, Homo sapiens
  misc_feature 1..51: note = chr1:147775362-147775413
  misc_feature 1..51: note = hyper
  source 1..51: mol_type = genomic DNA
tcaggcccagggagtcgcggacccgggcgtttcctgggatgctgggtctga

SEQ ID NO: 26601 - DNA, 87 bp, Homo sapiens
  misc_feature 1..87: note = chr1:147775510-147775597
  misc_feature 1..87: note = hyper
  source 1..87: mol_type = genomic DNA
ctcaggttttccgaggctttggagcctgcacaattgttctacaaaaggcagtagctccgccgaacgttggatcgtcccttggtctgg

SEQ ID NO: 26602 - DNA, 121 bp, Homo sapiens
  misc_feature 1..121: note = chr1:150185824-150185945
  misc_feature 1..121: note = hyper
  source 1..121: mol_type = genomic DNA
taagaatctgacccacgagtttcagtccaagtaacctggacctgcccagaggaagcaaagcggaagtaggatccaaaacgctttcagcaggccgcctgcgcccccgcgcatgcgcaggtct

SEQ ID NO: 26603 - DNA, 78 bp, Homo sapiens
  misc_feature 1..78: note = chr1:151118621-151118699
  misc_feature 1..78: note = hyper
  source 1..78: mol_type = genomic DNA
caaataatcccttttcgcgcttcccagtccagcgggatgcgactcgacgaaagcccaattgaacgaggtgcccagact

SEQ ID NO: 26604 - DNA, 40 bp, Homo sapiens
  misc_feature 1..40: note = chr1:151445937-151445977
  misc_feature 1..40: note = hyper
  source 1..40: mol_type = genomic DNA
ggggacagctggagccgcgaaggcgcgggggcccgcggcg

SEQ ID NO: 26605 - DNA, 30 bp, Homo sapiens; identical to SEQ ID NO: 5725
  misc_feature 1..30: note = chr1:151689335-151689365
  misc_feature 1..30: note = hyper
  source 1..30: mol_type = genomic DNA

SEQ ID NO: 26606 - DNA, 382 bp, Homo sapiens
  misc_feature 1..382: note = chr1:151694024-151694406
  misc_feature 1..382: note = hyper
  source 1..382: mol_type = genomic DNA
ccaggcttgctgcagcggcccgaccccggggcgcttagcgcagcgcagctggagcagctgcgaaaattcaaggtgggtgcgcccgcgcccccatccagcgtccaccaaagtgtagctgccccaggactggggccccagactgggaagagagccgccgagagaaggggagcgggagcctgttccctgataaagtggggagggcgcaggggagacccccggcggacctctaggcgtctgatcccagcacagagcgcgacgggcatctgagagtgcaggaagaactaactcagggactcggccagagaaatgggccgaaattactgccagacacatccgaccttagtaaaggcccctcatcctgaacaagcggcagaatgatatt

SEQ ID NO: 26607 - DNA, 60 bp, Homo sapiens
  misc_feature 1..60: note = chr1:152083305-152083365
  misc_feature 1..60: note = hyper
  source 1..60: mol_type = genomic DNA
ctctcccgctgctcccgcaatgggggcctggccgacagcctctgacggcccctctcgctc

SEQ ID NO: 26608 - DNA, 119 bp, Homo sapiens
  misc_feature 1..119: note = chr1:152083590-152083709
  misc_feature 1..119: note = hyper
  source 1..119: mol_type = genomic DNA
atgcggctcttaatccgctcccgggcctgttcctgctcctcctcagctagctcctgctcgcgcctctcttcctcatgctcgcgcttcagccgctgctcgagcctctcttcctcctcctc

SEQ ID NO: 26609 - DNA, 435 bp, Homo sapiens
  misc_feature 1..435: note = chr1:152083710-152084145
  misc_feature 1..435: note = hyper
  source 1..435: mol_type = genomic DNA
cgcttcagccgctgctcgcgcctttcctgctgctcgcgccttagttgctgctggcgcctctcctcctgctcctcgctcttcagcagctgctggcgcctctcttcctccggctcctcgcgcttcagccgctgctcgcgcctctcctcctgctcgagtctctccacctcctcgcgcttcagtcgctgctcgagcctctcttcctgctcgcgcttcagccgctgctggcgcctctcctcctcgcgcttcagcagctgatcgcgcctctcctcctgctcgcgcttcagccgctgctctcgcctctcctgctcgagcctcttctcctcctcgcgcttcagcagctgctcgcgcctctcctcctgctcgcgtcttagttgttgctcgctcctcaaccgctgctggagcctctcttcctcctcctggcgcttcagccgctgc

SEQ ID NO: 26610 - DNA, 984 bp, Homo sapiens
  misc_feature 1..984: note = chr1:152084564-152085548
  misc_feature 1..984: note = hyper
  source 1..984: mol_type = genomic DNA
ctgctgctcgcgcctctcctcctcctgctcgcgcctcagctgctgctcgcgcctctcctcctcctgctcgcgcctcagctgctgctcgcgcctctcctcctgctcgcgcctcagctgctgctcgcgcctctcctcctgctgctcgcgcctctcctgctgctcgcgcctctcctcctgctgctcgcgcctctcctcctcctgcttgcgccttagttgctgctcgcgcctcagcctttgctgctgctgctcttcctcctggcgctccctcctcagctcttgccgctccagcttccgtagctgctcttcttcctcctggagctctctttgccgctgcggctcctcttcctgcaacttctcttcttccttccggagcactgtctcgcgcttcctccactctttctcttcttcctcctggaacactctgtcttgccgctctcgcctttgctgctgtttctcctcgcggcccttcctcctcagctccagcagctcccgccttcgcagttgctcttcgtctggaaactcctcagtttcgtgacctttgcaactctgcagctgctcttcctctgcacggcgctcttcccgttcttgccattcttgcctttgccgccacagctcctcgtcgcggcgctgcctgtcgcgctgttcaagtcgctcttgtttctcactttgctcctctccctcagctagctccctctcctgttcctgcctcttctgcctgcgtcgttgcccaggttcttcttccagttgtctgtcccggggctcgaatctcctttggtcttcttcttgcctgcgatcttgtaacaggctctcctttccgtcacaccgggctcgcttctcctcatccagtcccgtggcctggccgagagcatagtaacaagcttgagccactttgaaaataaataggaggaattcgttgaaatcgacacgcccattactgtcaagatccagaagttccaggatcagatctaccgtcttagggtcatg

SEQ ID NO: 26611 - DNA, 168 bp, Homo sapiens
  misc_feature 1..168: note = chr1:152487789-152487957
  misc_feature 1..168: note = hyper
  source 1..168: mol_type = genomic DNA
gtggaaagaaaaagccggctcgcctttgaaaggctgcctttcttccaggtttgtcgtgaggagctccgcgatgtcctctcaacagagcgccgtttccgccaaaggcttttccaaggggtcgtcccagggccccgctccgtgtcccgccccggcgcccaccccggcgcc

SEQ ID NO: 26612 - DNA, 225 bp, Homo sapiens
  misc_feature 1..225: note = chr1:152487999-152488224
  misc_feature 1..225: note = hyper
  source 1..225: mol_type = genomic DNA
cggcgactcaggctgctgcggctccagctccaccagttgctgctgcttcccaaggagacgccgccgacagcggagtagtggttgctgctgctgcgggggcggcagccagaggtcccagcgctccaacaaccggagctcaggatgctgctccggctgctgagaggcccgcaacccccagcgctgcgctagagaaacccgcccagcccagagcgggcccgccccgct

SEQ ID NO: 26613 - DNA, 79 bp, Homo sapiens
  misc_feature 1..79: note = chr1:153438376-153438455
  misc_feature 1..79: note = hyper
  source 1..79: mol_type = genomic DNA
tcccaagcttccacacggtggcgccaccgagcacccacctcgccagagttgcgaggcggttccacgtggctgggccgtc

SEQ ID NO: 26614 - DNA, 590 bp, Homo sapiens
  misc_feature 1..590: note = chr1:153651798-153652388
  misc_feature 1..590: note = hyper
  source 1..590: mol_type = genomic DNA
tgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgaggtgagacgctggcacaccccgtcccgccgcttagccgcagggcctcccctctgacctgccggaggcatcgggactttctctct

SEQ ID NO: 26615 - skipped

SEQ ID NO: 26616 - DNA, 221 bp, Homo sapiens
  misc_feature 1..221: note = chr1:154298253-154298474
  misc_feature 1..221: note = hyper
  source 1..221: mol_type = genomic DNA
cgcggggctggaggggccggggagcgggtgtagactggggagcaccgggggccaagatttgggagctgcggccagacggggcggggatggcggccgactggagacgaggggctgtcgggttcccggggacggggcagagcgggggtctgcgtacaggatgggaggatggggtgccgaaggggcgcgtggagagcaggagagcggcgcgagtgccaaggaga

SEQ ID NO: 26617 - DNA, 15 bp, Homo sapiens
  misc_feature 1..15: note = chr1:154474763-154474778
  misc_feature 1..15: note = hyper
  source 1..15: mol_type = genomic DNA
tgctctttcctcctg

SEQ ID NO: 26618 - DNA, 81 bp, Homo sapiens; identical to SEQ ID NO: 95
  misc_feature 1..81: note = chr1:154474987-154475068
  misc_feature 1..81: note = hyper
  source 1..81: mol_type = genomic DNA

SEQ ID NO: 26619 - DNA, 173 bp, Homo sapiens; identical to SEQ ID NO: 96
  misc_feature 1..173: note = chr1:154475371-154475544
  misc_feature 1..173: note = hyper
  source 1..173: mol_type = genomic DNA

SEQ ID NO: 26620 - DNA, 68 bp, Homo sapiens
  misc_feature 1..68: note = chr1:154540186-154540254
  misc_feature 1..68: note = hyper
  source 1..68: mol_type = genomic DNA
gaagactatcccagccggggaccccccttttttttcctgggacccagcgtttccgcctccggggcgca

SEQ ID NO: 26621 - DNA, 47 bp, Homo sapiens
  misc_feature 1..47: note = chr1:154733207-154733254
  misc_feature 1..47: note = hyper
  source 1..47: mol_type = genomic DNA
ctgaagagccagtggcgcctgcctcgatcacacgtcccctgtggagc

SEQ ID NO: 26622 - DNA, 285 bp, Homo sapiens
  misc_feature 1..285: note = chr1:155043397-155043682
  misc_feature 1..285: note = hyper
  source 1..285: mol_type = genomic DNA
tgtgggggtctcacccggctcccagcggccccaggccagcctccttttcgcagaaccaggcgggcgcgctcgctcccgcggctggggctggcgcgcggacgcgccgctgataacgcatgtgcgaaagagacgcggggcccagtcagctttctccgcactcagacgcacgccctaactgtcgggcgctcccacttgacacggacacacgcccctgccggccgcccagccccttgcaggtgcaagggcggatgcctcagcgaccacgggagccgggctggggaggtt

SEQ ID NO: 26623 - DNA, 15 bp, Homo sapiens
  misc_feature 1..15: note = chr1:155147247-155147262
  misc_feature 1..15: note = hyper
  source 1..15: mol_type = genomic DNA
ccgctgaccgggttg

SEQ ID NO: 26624 - DNA, 372 bp, Homo sapiens; identical to SEQ ID NO: 5737
  misc_feature 1..372: note = chr1:156215329-156215701
  misc_feature 1..372: note = hyper
  source 1..372: mol_type = genomic DNA

SEQ ID NO: 26625 - DNA, 80 bp, Homo sapiens
  misc_feature 1..80: note = chr1:156339180-156339260
  misc_feature 1..80: note = hyper
  source 1..80: mol_type = genomic DNA
gagcaaccacagtaacgcggacaatgaattttactttcgctacccaagtgagtgcggggtgagggcgcgcgggaagcaaa

SEQ ID NO: 26626 - DNA, 721 bp, Homo sapiens
  misc_feature 1..721: note = chr1:156357855-156358576
  misc_feature 1..721: note = hyper
  source 1..721: mol_type = genomic DNA
tgagggaaggttctccggaagcagccgctgttctggcttggcgcaagtgcgtgtggacgacagcaggatttcctgcccagggacatctggataagaggcccaaggtccccaggagcccccaggtgcttctgccctgtgtggccagagccccctcggccaggagttagaagctgctcctctgacctctggaggacccggcactccgaaccccgcgcagcctgggaaaggcctgagattccccgctattgggattcacatcacgacgcggcggccccaactcggggaggaattagacacggcgtgagtgtcccaagtgcggggcggtggccgtcccggggcagacgagcgcggctgccgcgtccccccacctcaccccgatattccgctcccaccgtcgggaactcccccaccgccgcctccggccctgcgcgccccttctcctttgtctggcccgcccactcccagccggtccgccgcgccgccccgcgcgccccggcccgtgcgcccgccgccgccgcccaggaacaatgcgggccaatgtctccgggcgggcgagccggctatgcaaatgcccaacggcctgtgagaatccccttcgccgccgcctgggcttccacggcctgaaaagggctggcggccgggcctgggtgggggaggcggccactgcatagggatgagctgttgtcccggagcgcccgggacagagcgccattgtctgtgc

SEQ ID NO: 26627 - DNA, 1108 bp, Homo sapiens
  misc_feature 1..1108: note = chr1:156390108-156391216
  misc_feature 1..1108: note = hyper
  source 1..1108: mol_type = genomic DNA
ccccgggcccctctgcgcagtgtatggggttatttttactttcggttatctagctttatgaagactccacaccactcatacagctagataaccaaagataacaaccaaccccgcctcctggctgctgtcgccgcctcttccacgcagcctcccggccgccgccgccgccagcacctccgcagcttcccggtcgcccgtcagcgggagtaggagggaagggacacgagtggagttgagggggagggtgaagagagaaatgaagtccgagacaaaacaacaacaaaaacctcagacacggagatacagacacgacagagaccgaaaaaggcgtggaaaggacgcgatgacccgtggcgtcgaagtcggggagttgaccccgatccagacccaaaaagtttctggtgccccatttcccgctctcccattcgggccaggagcaggagttccgctggtcccaggtggaagggacgcgcgggcttttcgtgccacccgggaagaccgcagcgacccaggcagaggcctccccagcctcgccgggtctccactgcccttctctggaagatcgagggcgcatccgacagccagagccctgccttcggcggagcccgagcctggcgcgggatggaaatggggagccgcggtgccggcccggccacgtcgccaactcagaaaggcgttggaagcgaagcggagcccttgtgggggaaagagccggattcaagaggccgactaaaaggggaaatgggcagccaaaccccggaggtaaaaaccccagagatgtcctaataggaagcagggaaatcccggcgacccaaagagagaggaaaggctgtggggggcgggtgggggcgacccagagactcccaagcgagtctctcaaggagagaaggaaacagcagagaccccacccgggaagagatccgggagagtacccatgagaggggcggaggggaggaaagcagagggcgacagggcaggtgaccagagtcccaggccctgcagagccccggataaacggctttgttcaaagaggaccagagatcacccagggttgtgaaaatggccgggggttcgaggcgagcggtgctctaggggtgggaaaggggtg

SEQ ID NO: 26628 - DNA, 286 bp, Homo sapiens
  misc_feature 1..286: note = chr1:156391242-156391528
  misc_feature 1..286: note = hyper
  source 1..286: mol_type = genomic DNA
cgaagagggtgggggctcggccggcccctcgtggcggacgcgcgggcacgccggattccgaggcgctcgcccacctcgtgctccacgctggccaggccacttacatcgagcccagggtgcccatccgtgctctcccgcgcggtcctcccggccagttcccgcccctggagcgccagggccctgagttccagatgccggggctcagcgggcgccgggcagaggaggctgccctgctcttagcctccgccgagcctaggcgagcagggtggagcgggtctcacctcct

SEQ ID NO: 26629 - DNA, 48 bp, Homo sapiens; identical to SEQ ID NO: 1821
  misc_feature 1..48: note = chr1:156405367-156405415
  misc_feature 1..48: note = hyper
  source 1..48: mol_type = genomic DNA

SEQ ID NO: 26630 - DNA, 437 bp, Homo sapiens; identical to SEQ ID NO: 1822
  misc_feature 1..437: note = chr1:156405634-156406071
  misc_feature 1..437: note = hyper
  source 1..437: mol_type = genomic DNA

SEQ ID NO: 26631 - DNA, 493 bp, Homo sapiens
  misc_feature 1..493: note = chr1:156406104-156406597
  misc_feature 1..493: note = hyper
  source 1..493: mol_type = genomic DNA
cgaacccgaccccgggaaatcctcctagccgccgcctcccagcgccgggtctccccgagcgtgtgctctcggctgcgaggccctgcatgcgcagtgtctgggttcgcggcgtcaagcggagcctcggtccagcctgggcagccgagagcgcggggactgctgaacgcggtccgctccccgccagccgttcgggaccccagcctgggggaaagccgacagcgtccctctccgcgcaaactccacgcggcagcctggactgggatgtggggccagggggctgaataattaacaaccaggagaagccggggagagcgggaagcctggcaagccagggaaagggaagatgagacagagagacatagagagacagggacagagggagacagagagggggctaagagcgacgcgggcgagagaggaagaaaggctggggagaaggaaaaatgagataaataaaggaaaaaagagaagcgaagggcggtgggagaggcag

SEQ ID NO: 26632 - DNA, 30 bp, Homo sapiens; identical to SEQ ID NO: 5745
  misc_feature 1..30: note = chr1:156468873-156468903
  misc_feature 1..30: note = hyper
  source 1..30: mol_type = genomic DNA

SEQ ID NO: 26633 - DNA, 51 bp, Homo sapiens
  misc_feature 1..51: note = chr1:156474407-156474458
  misc_feature 1..51: note = hyper
  source 1..51: mol_type = genomic DNA
acctggcatagaatgcgctcagcaaatgtgttaacacgaatctgtatttgt

SEQ ID NO: 26634 - DNA, 212 bp, Homo sapiens
  misc_feature 1..212: note = chr1:156594433-156594645
  misc_feature 1..212: note = hyper
  source 1..212: mol_type = genomic DNA
ctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggtgaggcgcgggacgaaggcagggtcttggggaggggtctgaaaaatgtgggggacgaggagtggacctc

SEQ ID NO: 26635 - DNA, 203 bp, Homo sapiens
  misc_feature 1..203: note = chr1:156594850-156595053
  misc_feature 1..203: note = hyper
  source 1..203: mol_type = genomic DNA
cgcccaccctgccctcggtcggtgacccgctgtggtccccaggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtg

SEQ ID NO: 26636 - DNA, 104 bp, Homo sapiens; identical to SEQ ID NO: 5748
  misc_feature 1..104: note = chr1:156595080-156595184
  misc_feature 1..104: note = hyper
  source 1..104: mol_type = genomic DNA

SEQ ID NO: 26637 - DNA, 44 bp, Homo sapiens
  misc_feature 1..44: note = chr1:156595221-156595265
  misc_feature 1..44: note = hyper
  source 1..44: mol_type = genomic DNA
cgtggcgggggtctctcgccacccctttccggagagcctcccct

SEQ ID NO: 26638 - DNA, 169 bp, Homo sapiens; identical to SEQ ID NO: 5749
  misc_feature 1..169: note = chr1:156611775-156611944
  misc_feature 1..169: note = hyper
  source 1..169: mol_type = genomic DNA

SEQ ID NO: 26639 - DNA, 126 bp, Homo sapiens
  misc_feature 1..126: note = chr1:156611993-156612119
  misc_feature 1..126: note = hyper
  source 1..126: mol_type = genomic DNA
cgtgcacccggaggagacccccggaggaggcgacaaacttcgcagtgccgcgacccaaccccagccctgggtaggtgagtgcctccgcagccccgccgcccgccgtggggtcggggacagggagaa

SEQ ID NO: 26640 - DNA, 544 bp, Homo sapiens
  misc_feature 1..544: note = chr1:156626475-156627019
  misc_feature 1..544: note = hyper
  source 1..544: mol_type = genomic DNA
gatggagacccaggccggaactccatccctcaccctggttcctgtctcttagaaaaggcaccagcgcccctgcccaagagcccctccaggctcctgctaccccctcattctctactagctcttttgcaccgccctcctgtcccccttagtcccgcccctctcggcctgcggtagtggaaggagaccagccccttccaggggacctggccctctgggttttggggccctaagatgcccgcccttatgtgccgcaggcctccgcttctgcaaccccggctgggacgccttccagggcgcctgctacaagcacttttccacacgaaggagctgggaggaggcagagacccagtgccggatgtacggcgcgcatctggccagcatcagcacacccgaggaacaggacttcatcaacagtgggctgggagacagggcgggaggggcccctgccatatgctctcactctctctcactcgcctaaccgccttcctcattaacccatgcacttattccttggttttctcaagcgtgcattccctcactcatt

SEQ ID NO: 26641 - DNA, 166 bp, Homo sapiens
  misc_feature 1..166: note = chr1:156646634-156646800
  misc_feature 1..166: note = hyper
  source 1..166: mol_type = genomic DNA
cgtagagcctctagctcgcgctccagctctgccacctggctactcagccaggcccgggcgcatttctctgcctcgacggcgcgccggttgcgggctacctcctccgtcgtccgctcccgggccagccgcagctgctggcatcggcctgccacgccctccagctctt

SEQ ID NO: 26642 - DNA, 199 bp, Homo sapiens
  misc_feature 1..199: note = chr1:156814754-156814953
  misc_feature 1..199: note = hyper
  source 1..199: mol_type = genomic DNA
gaggggcaagcaaagcgaggctctggggttagcgagaagtcaaaccccaaacctttgcacagggtccttggggtcggtgatgggggtagaaggtgtgtgtgtggatcacctactgtggggcatggtgcgcgcaaagacgaaggtggcggcgctgcagcccacggtgtgcgccgcgtggttgcaggcatggatgtcgatc

SEQ ID NO: 26643 - DNA, 210 bp, Homo sapiens; identical to SEQ ID NO: 1825
  misc_feature 1..210: note = chr1:156815030-156815240
  misc_feature 1..210: note = hyper
  source 1..210: mol_type = genomic DNA

SEQ ID NO: 26644 - DNA, 480 bp, Homo sapiens
  misc_feature 1..480: note = chr1:156815273-156815753
  misc_feature 1..480: note = hyper
  source 1..480: mol_type = genomic DNA
cgcctccaaaagcacccacaacccgggacccgcccacacaagcaaggccccacccacaaaccccacccctcccgcaagacccgcccctcacaggccccactcatcagaccctcccaggccgcgcgcgctcttcgcacatggggatggtgatcgcgttgtgtagaaagttttcaaacttcttctggaacgaggcctcttgcgcctccagcgggggcagaacctgaccaggaggtgggtgctggcaagggcagcagtcggactccatctcggcctcaggatccccgtcttcgccgtcgaagcgcggatcgttgttgctggtgggcagccgcaagcctggcgccgcagcgggaagacactagtaagacaggcggtctacccgcctctgatcccccccacctgccggggccctgcgcctccatctccccttccccacccgccccgcggccggcctgcgcgtcgtccctgcgcaccgcggtggca

SEQ ID NO: 26645 - DNA, 467 bp, Homo sapiens
  misc_feature 1..467: note = chr1:156818562-156819029
  misc_feature 1..467: note = hyper
  source 1..467: mol_type = genomic DNA
acctgggccctaccacggagtacaacttgcgggtcctggcttcctgggtcttcatagcctcgctgagctccgccctcacctgcctgtggtcccgaagaaattggcctcgtccggtcccgcccccgctccggccccgcccccggcactcacgactccttgtagtacacgatgaagctgagcaggtcgcgggcctccagtggctcatagcgctcccagcgtagcaggatgcggtctgcctccgtcacgttggacacgaagcgcagggtgcgagtctggcctgggtggggcgaggggcctgctcgcaaccgcgcctgccagctgcttgagcgcccaccctgaccccgcggcatcccattcccagtgagacctctgaggagaacttctcagagtgtccccctcgagctttctccctcccccgggtgtgcgtgtctagtgtgtggccgcgtgtccaccggcactggggttgg

SEQ ID NO: 26646 - DNA, 54 bp, Homo sapiens
  misc_feature 1..54: note = chr1:156829171-156829225
  misc_feature 1..54: note = hyper
  source 1..54: mol_type = genomic DNA
caagtggggctgcaccgccggaggggcagccagcgcgcccgggcttctggggag

SEQ ID NO: 26647 - DNA, 30 bp, Homo sapiens
  misc_feature 1..30: note = chr1:156829545-156829575
  misc_feature 1..30: note = hyper
  source 1..30: mol_type = genomic DNA
cttggcggagagaaccgtgagcctctagga

SEQ ID NO: 26648 - DNA, 83 bp, Homo sapiens
  misc_feature 1..83: note = chr1:156830265-156830348
  misc_feature 1..83: note = hyper
  source 1..83: mol_type = genomic DNA
cgcgccgcgaggatggagcgctgagcctggggctggctaggatgacctggacagcaacctttcctcaacgcagtcatcttccc

SEQ ID NO: 26649 - DNA, 96 bp, Homo sapiens
  misc_feature 1..96: note = chr1:156830979-156831075
  misc_feature 1..96: note = hyper
  source 1..96: mol_type = genomic DNA
ggcattgcagtgccccgagggcgcggactcgctgcttgtttgctggtcaggcaggacgagcacggcggaaggctggcaccacgcagccttcggcgc

SEQ ID NO: 26650 - DNA, 425 bp, Homo sapiens; identical to SEQ ID NO: 99
  misc_feature 1..425: note = chr1:156863061-156863486
  misc_feature 1..425: note = hyper
  source 1..425: mol_type = genomic DNA

SEQ ID NO: 26651 - DNA, 84 bp, Homo sapiens
  misc_feature 1..84: note = chr1:156863640-156863724
  misc_feature 1..84: note = hyper
  source 1..84: mol_type = genomic DNA
cgcgccccctggcaggggaggcccggtggtgcggccccggagaccaccctgccccggggaaagggcttgcggtccctgaggtcc

SEQ ID NO: 26652 - DNA, 30 bp, Homo sapiens
  misc_feature 1..30: note = chr1:156890393-156890423
  misc_feature 1..30: note = hyper
  source 1..30: mol_type = genomic DNA
cctttccctcgggcccgcccgcctcgcgcg

SEQ ID NO: 26653 - DNA, 85 bp, Homo sapiens
  misc_feature 1..85: note = chr1:156890711-156890796
  misc_feature 1..85: note = hyper
  source 1..85: mol_type = genomic DNA
gaccgttctgcctcccgtgggggaggaggagcccaaaagccctggtacgctggcgccggggtttggggatcgggcttccaggctg

SEQ ID NO: 26654 - DNA, 142 bp, Homo sapiens
  misc_feature 1..142: note = chr1:156893837-156893979
  misc_feature 1..142: note = hyper
  source 1..142: mol_type = genomic DNA
cccccacccgcccttcgtcccctccgcctctttgtcggaaaaggccaccttaggtgagtgacagtggagctccccggtgcctgccagggccgcctagtccatcctcagcctcccttcccacgccgggccaaatggagggacg

SEQ ID NO: 26655 - DNA, 40 bp, Homo sapiens; identical to SEQ ID NO: 5761
  misc_feature 1..40: note = chr1:156894252-156894292
  misc_feature 1..40: note = hyper
  source 1..40: mol_type = genomic DNA

SEQ ID NO: 26656 - DNA, 41 bp, Homo sapiens
  misc_feature 1..41: note = chr1:157963385-157963426
  misc_feature 1..41: note = hyper
  source 1..41: mol_type = genomic DNA
ccctcctccccagcccgctcctctggctcgctcgccaactc

SEQ ID NO: 26657 - DNA, 52 bp, Homo sapiens
  misc_feature 1..52: note = chr1:157963443-157963495
  misc_feature 1..52: note = hyper
  source 1..52: mol_type = genomic DNA
cgggcgcacggcgggcggacagcatgctgagcctcctcgtctggatcctcac

SEQ ID NO: 26658 - DNA, 154 bp, Homo sapiens
  misc_feature 1..154: note = chr1:157963737-157963891
  misc_feature 1..154: note = hyper
  source 1..154: mol_type = genomic DNA
tgtttcctctggctgcgcgggagaaccgagcaatggggccgcgagggctggaggtccgagtaaaacggggaaccgaacgctttctcttgagcttctggcagccctaccgaccctcgccctctgaggccggggttccggacgcctgagtccagcc

SEQ ID NO: 26659 - DNA, 401 bp, Homo sapiens; identical to SEQ ID NO: 5763
  misc_feature 1..401: note = chr1:158083182-158083583
  misc_feature 1..401: note = hyper
  source 1..401: mol_type = genomic DNA

SEQ ID NO: 26660 - DNA, 44 bp, Homo sapiens; identical to SEQ ID NO: 1828
  misc_feature 1..44: note = chr1:158150605-158150649
  misc_feature 1..44: note = hyper
  source 1..44: mol_type = genomic DNA

SEQ ID NO: 26661 - DNA, 147 bp, Homo sapiens; identical to SEQ ID NO: 1829
  misc_feature 1..147: note = chr1:158150650-158150797
  misc_feature 1..147: note = hyper
  source 1..147: mol_type = genomic DNA

SEQ ID NO: 26662 - DNA, 161 bp, Homo sapiens
  misc_feature 1..161: note = chr1:158150798-158150959
  misc_feature 1..161: note = hyper
  source 1..161: mol_type = genomic DNA
gaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaaggtgggtg

SEQ ID NO: 26663 - DNA, 110 bp, Homo sapiens
  misc_feature 1..110: note = chr1:159141434-159141544
  misc_feature 1..110: note = hyper
  source 1..110: mol_type = genomic DNA
ggctccgaagcggctcgggggcgccctttcggtcaacatcgtagtccaccccctccccatccccagcccccggggattcaggctcgccagcgcccagccagggagccggc

SEQ ID NO: 26664 - DNA, 132 bp, Homo sapiens
  misc_feature 1..132: note = chr1:159141599-159141731
  misc_feature 1..132: note = hyper
  source 1..132: mol_type = genomic DNA
cgcctgctgctgggcgcccggcggggccaacctctcccaggacggtgagtgagggagggggcggcgcctggggaggtggggagtgacccgaggcgggggctgggatcgggagtctcgcggaaggagcctgtt

SEQ ID NO: 26665 - DNA, 64 bp, Homo sapiens
  misc_feature 1..64: note = chr1:159158305-159158369
  misc_feature 1..64: note = hyper
  source 1..64: mol_type = genomic DNA
cagctggctctgagtcgcgctgggacgactggcgaagttcacccgggactccaaagcccggaca

SEQ ID NO: 26666 - DNA, 40 bp, Homo sapiens; identical to SEQ ID NO: 1832
  misc_feature 1..40: note = chr1:159158471-159158511
  misc_feature 1..40: note = hyper
  source 1..40: mol_type = genomic DNA

SEQ ID NO: 26667 - DNA, 76 bp, Homo sapiens
  misc_feature 1..76: note = chr1:159750570-159750646
  misc_feature 1..76: note = hyper
  source 1..76: mol_type = genomic DNA
gtggaagtaaccccccgcccattatgatgatccagccaatcaccgcgtgatctgctcggacggggcgggatcgcgg

SEQ ID NO: 26668 - DNA, 52 bp, Homo sapiens
  misc_feature 1..52: note = chr1:159750677-159750729
  misc_feature 1..52: note = hyper
  source 1..52: mol_type = genomic DNA
cgcgttccagccccgccccaggttctgggccaatccccgcggctgggcagag

SEQ ID NO: 26669 - DNA, 114 bp, Homo sapiens
  misc_feature 1..114: note = chr1:159751133-159751247
  misc_feature 1..114: note = hyper
  source 1..114: mol_type = genomic DNA
gacgaggccaacgcacggggagaggtcagcgggcggggtcagcgcagggagggaggggcctggaaggtcagcgggggacacgggcggagctggggagaccgggcctgggataac

SEQ ID NO: 26670 - DNA, 30 bp, Homo sapiens
  misc_feature 1..30: note = chr1:160039721-160039751
  misc_feature 1..30: note = hyper
  source 1..30: mol_type = genomic DNA
gaggatctgggaccccgatgtctctggaga

SEQ ID NO: 26671 - DNA, 129 bp, Homo sapiens
  misc_feature 1..129: note = chr1:160040345-160040474
  misc_feature 1..129: note = hyper
  source 1..129: mol_type = genomic DNA
aggcggtcctgtcagcgatgggttacgagagctggagccggggggcgggactgggaccgagttaacgaagtggaaatgaattcaggaccggcccagtggccctgcaggcagcgccgaaggcggcgcctg

SEQ ID NO: 26672 - DNA, 158 bp, Homo sapiens
  misc_feature 1..158: note = chr1:160370097-160370255
  misc_feature 1..158: note = hyper
  source 1..158: mol_type = genomic DNA
cattcccctgcccaccgttcgggacccgagtgtcagccccaccgcggattcccaggatcggggagggccgctgggcatctgaaggcgcagggctgggggagcggcgactccgggaagagcggggccgcagacaatggacgcggcggtaggaggggcgg

SEQ ID NO: 26673 - DNA, 30 bp, Homo sapiens
  misc_feature 1..30: note = chr1:160370599-160370629
  misc_feature 1..30: note = hyper
  source 1..30: mol_type = genomic DNA
acaaaggcgacgggccgagcggggcgcccg

SEQ ID NO: 26674 - DNA, 114 bp, Homo sapiens
  misc_feature 1..114: note = chr1:161068047-161068161
  misc_feature 1..114: note = hyper
  source 1..114: mol_type = genomic DNA
ggtggcaccaccatacggttcccgatagccacccaggtgtcctgtctccacggtaactgctgctttgcgaccttcggtttgcagcggtcgcgctgcagccgctgcagtggttgc

SEQ ID NO: 26675 - DNA, 179 bp, Homo sapiens
  misc_feature 1..179: note = chr1:161068380-161068559
  misc_feature 1..179: note = hyper
  source 1..179: mol_type = genomic DNA
cagtggcgcgggacgcgcttttggctagagctttccattcatgcaccgaactgcggggacggttctatctcgtaggtggtctcctagcaggaggagcgagagagcccagcagcgatacggtggttttcgacccagctaggggccaggccgtacgattgggagcccggggcagccccccg

SEQ ID NO: 26676 - DNA, 15 bp, Homo sapiens
  misc_feature 1..15: note = chr1:161275564-161275579
  misc_feature 1..15: note = hyper
  source 1..15: mol_type = genomic DNA
ctctgctcatccttt

SEQ ID NO: 26677 - DNA, 484 bp, Homo sapiens
  misc_feature 1..484: note = chr1:161275639-161276123
  misc_feature 1..484: note = hyper
  source 1..484: mol_type = genomic DNA
cgatcccccgcccggcccgctaaccgctatttcttatccttgcgagactcccccagccccttggccttcttctcactgacagctttggtgcttctgctgtggtccagcattgcatacagcactggcgtctgggggaggggcgcacacatcagtcaccgagcgactggggcttgactgttcccatcccacccctcactgctgcccggcggctcccagggttctccttcccatcttgtctaggccccaagtcccgctaacctgccgcccgcgcttcgacgcgtcctttcctggcttgtgcaatttccccttctccatagcactgcaagaagagagactgctgtacgtttggcctcgccggaaccccttgcaccgcggacacagcttcctcttccccttggccctcccacccactggagtagtctccgcccagatgggggatagtggggagagggggaggggagctaggctccgccccttacctgag

SEQ ID NO: 26678 - DNA, 97 bp, Homo sapiens
  misc_feature 1..97: note = chr1:161409851-161409948
  misc_feature 1..97: note = hyper
  source 1..97: mol_type = genomic DNA
acaccctccaaacaccgcaagcctccttccccggcgcacaggcacgcagccacaggccaagctgcgacgcgagctccgcgcgcgggatctccgcaaa

SEQ ID NO: 26679 - DNA, 171 bp, Homo sapiens
  misc_feature 1..171: note = chr1:161494827-161494998
  misc_feature 1..171: note = hyper
  source 1..171: mol_type = genomic DNA
gcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcg

SEQ ID NO: 26680 - DNA, 94 bp, Homo sapiens
  misc_feature 1..94: note = chr1:161509954-161510048
  misc_feature 1..94: note = hyper
  source 1..94: mol_type = genomic DNA
caatttttttggagacgtgagtgctgagcattttttcttcagtgaagtgacttggcagccaaaatcgccaacgcccgtctctgtggcgcaatcg

SEQ ID NO: 26681 - DNA, 154 bp, Homo sapiens
  misc_feature 1..154: note = chr1:161510108-161510262
  misc_feature 1..154: note = hyper
  source 1..154: mol_type = genomic DNA
tcgcattttgtgaaccctgggtttttgaaactttgactgaaaaaactgcgtgcgatgctatccgctgggagcgctggggccttggcgctcaaaaccagccgcggtgctaaccgcagggagctctggtagcagacctccgcgttgtgtggttccc

SEQ ID NO: 26682 - DNA, 128 bp, Homo sapiens
  misc_feature 1..128: note = chr1:161581762-161581890
  misc_feature 1..128: note = hyper
  source 1..128: mol_type = genomic DNA
ctccagcggagggtgcgatttgaacgcagcgccttaagactgctcggccatcctgacacacgttttgctaaacttcctaatttctcctaattttatcatatactgatggtgcacgctatcaggtcaca

SEQ ID NO: 26683 - DNA, 168 bp, Homo sapiens
  misc_feature 1..168: note = chr1:161582427-161582595
  misc_feature 1..168: note = hyper
  source 1..168: mol_type = genomic DNA
aagacactgctagaacggtcgggaaagtcatacgctttgcttatcttatatatagatttctaaaattccaaaccggggacgcgttggtggtgtagtggtgagcacagctgcctttcaagcagttaacgcgggttcgattcccgggtaacgaaacgtttttgtctttcc

SEQ ID NO: 26684 - DNA, 30 bp, Homo sapiens
  misc_feature 1..30: note = chr1:161591283-161591313
  misc_feature 1..30: note = hyper
  source 1..30: mol_type = genomic DNA
ctaggcaagtgctagcgcggaaaaaagacc

SEQ ID NO: 26685 - DNA, 112 bp, Homo sapiens
  misc_feature 1..112: note = chr1:161591628-161591740
  misc_feature 1..112: note = hyper
  source 1..112: mol_type = genomic DNA
gctctcaaaaccagccgcggtgctaaccgccgggatccctggcagctgacctccgcgttgtgtggttcccaatgtcctcttctgccttagtgctgtacgggtaattttgagg

SEQ ID NO: 26686 - DNA, 180 bp, Homo sapiens
  misc_feature 1..180: note = chr1:161695643-161695823
  misc_feature 1..180: note = hyper
  source 1..180: mol_type = genomic DNA
tgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgca

SEQ ID NO: 26687 - DNA, 185 bp, Homo sapiens
  misc_feature 1..185: note = chr1:161697126-161697311
  misc_feature 1..185: note = hyper
  source 1..185: mol_type = genomic DNA
ccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctg

SEQ ID NO: 26688 - DNA, 477 bp, Homo sapiens
  misc_feature 1..477: note = chr1:162792076-162792553
  misc_feature 1..477: note = hyper
  source 1..477: mol_type = genomic DNA
gcatttaaaatgaggcgaaagaacaaatggaataattatagaaaattttagcctctagcaaaacactgtgaagcagctccagcctgtggtggaagatgtgcgaaagggatgggggaacgctgtggaccggtgtggagtctaggacgacaggtggtgggctctgtccccacgcgcctcgcggccagcagaggccccctcactgcggccgccgggcgggactggcgcgggcggcgctgggctgggcccgggaggctggcatccctgggtgctccggtgcggtactagggggcgacggctgagccgtgggtggagccgctgggtcagtctcggatagaaataaactgggaaactgctgtggtctctgttgcttgcgtgctcggttttcgtgcttatcacgctgatgatgaggaaggtggttttggttacggagtgagcaggtgaacgcctccccgtggaccccaccggactgggtgggga

SEQ ID NO: 26689 - DNA, 148 bp, Homo sapiens
  misc_feature 1..148: note = chr1:164290524-164290672
  misc_feature 1..148: note = hyper
  source 1..148: mol_type = genomic DNA
cccctctgttgtgtgcgccgcgtccggggagcctgggccgtgcctccctggcgtatgcaggtcgccggcgcagccgccagctccgggggccgcgcttccagccacccgcagccggcggggcccgccgggcagcacgggaatcgcggag

SEQ ID NO: 26690 - DNA, 67 bp, Homo sapiens
  misc_feature 1..67: note = chr1:165086960-165087027
  misc_feature 1..67: note = hyper
  source 1..67: mol_type = genomic DNA
taattggctgtgacacgcgggccagctgttgtgagaggtggagcgcggcgggcgttttccaggacgg

SEQ ID NO: 26691 - DNA, 189 bp, Homo sapiens
  misc_feature 1..189: note = chr1:165204385-165204574
  misc_feature 1..189: note = hyper
  source 1..189: mol_type = genomic DNA
agagcgtatagggggcgatgcagtcgatggtatctgtagcacagtacccagaagacccgggagctaggaccaaaccaggagtcagctcagtccaaaggaaatcagggttcaggtagcgacggtgtccgtgcgtttcttcactagtgcatgtgcgaggagggctggaggcatgagcgaaagagggaaggc

SEQ ID NO: 26692 - DNA, 69 bp, Homo sapiens
  misc_feature 1..69: note = chr1:165204838-165204907
  misc_feature 1..69: note = hyper
  source 1..69: mol_type = genomic DNA
gacgtcacctgggaacgcgcggcggcgcggggcggcgcggacccgggacgacctcgccgcgacctggcc

SEQ ID NO: 26693 - DNA, 45 bp, Homo sapiens
  misc_feature 1..45: note = chr1:165205298-165205343
  misc_feature 1..45: note = hyper
  source 1..45: mol_type = genomic DNA
cgcccccagcctgagcgctgagagggaaaacgagagctagaaagg

SEQ ID NO: 26694 - DNA, 126 bp, Homo sapiens
  misc_feature 1..126: note = chr1:165321661-165321787
  misc_feature 1..126: note = hyper
  source 1..126: mol_type = genomic DNA
aaaagcccctgcatccgagggttctgcagaaaaccaggaaggcgacagtgaaagggcgaacgggctgtgcgcttagctccgaatggcagcagagccatttccgagcccaaactgtccggactccag

SEQ ID NO: 26695 - DNA, 30 bp, Homo sapiens
  misc_feature 1..30: note = chr1:165323752-165323782
  misc_feature 1..30: note = hyper
  source 1..30: mol_type = genomic DNA
aagtccaaaagttcccgaaaggggggttca

SEQ ID NO: 26696 - DNA, 1179 bp, Homo sapiens
  misc_feature 1..1179: note = chr1:165324178-165325357
  misc_feature 1..1179: note = hyper
  source 1..1179: mol_type = genomic DNA
tccagttaattaacgcggagcctagggcccagccgcgcggtctaatccccgcgctgcgttgcctactggcccagaaaagtctctctcggccttgcccatggctgaaattggggctggagttggtgggggagagaagcctcctcgaacttgggcgctccaggcctcgggtctcggatgctattgcctctaggccgcgagaagagggcggcatttatgagacgtcgatcagctccgagattaaaaatccagccctgggtatttttaatcacttgccactcagacgcctacgaacaagctcgcccgcccctcgcggctttggggaattcggtgcccagtgcgtgaggcctggggcggcttgttggatttatttgggtagggacgacccacaagcactgacggacagatagtgatggggctcaatttagtgtatgaagaggggcgctagcttccctatcgcggaccaggtcccagagagcggggctccagagctcagcgccaagcggaaagagagtgcgcccaggacgcacggcctgaacactcacccagcagcgaggagaaggaggccgaggtgtcgatcgcgctttggaagttctcctccatctttaggccgtccagcatgttcgggccgggccgggaggacctgtagaggagaagaaacgatgcgtctgacgtccgtgcccgctgggactcggcgccagcagccaccgcactcctgggaaagaactgagggagtgtccagggcgaccagaatcagccaggaggatagggtccagccaagagaatgtagggtgggaggagagatcagtcacagcgaactgctctggctgatctgatttcacttgaagtcaacacgttatgtacttaggcctccgccccccaactgcgtttctccttctcctgcccccctcacccccacctacatcccttgccccaggttttccatcccgaatccgactccgccccaacctatacgaaggtgggccctcgggacgtctctgcaggaacgcagctactggggtatattgggtatataaagagtgggtaccctccctcgagcgaccgggtccaggcacgcgggacgatggggtttgcaatcccgcgtcccagccgccccgttgcggccctcacctgccccaggtcgagaaggggcactgtaagggacccggagggcgtcccgcc

SEQ ID NO: 26697 - DNA, 26 bp, Homo sapiens
  misc_feature 1..26: note = chr1:165325394-165325420
  misc_feature 1..26: note = hyper
  source 1..26: mol_type = genomic DNA
cgcgcaggagccggtgtgcggggcgc

SEQ ID NO: 26698 - DNA, 559 bp, Homo sapiens
  misc_feature 1..559: note = chr1:165325646-165326205
  misc_feature 1..559: note = hyper
  source 1..559: mol_type = genomic DNA
ctggaagcttctgcccgggaaggcgtcgcccccgagactgcagccggaggagccgccctcggcttcggagcgccggggagggagccggagcgaacgccggccgctggctctgctcctcggcgcgcccaggctgggccgggacgtggtcgcgagctgccggccttcccgggacgtcctaccagcccgcgtcgctcctcagcgggaggagagggccagttgcttctccaaggctaggagggaaggcagaggcccagggtcctgggtgcgagtcggccctgcttcgccggggcggatcctgcagcttctgacaggggccgcggcgctgcgtgcgcggcggcggagagggggtggggtgcgctgggcggggggctggcagcgcgtcccgtggcggggccgtggtgctccctttcccagcctggctgcgcggccaccacacggccgctgccctctgagcccctccgcctctgggagctctcggacacgctaagtttcctcccctccacgtgtaactgttacctcggggcgctctggcccggtcgccccccagtgcccctcaccc

SEQ ID NO: 26699 - DNA, 173 bp, Homo sapiens; identical to SEQ ID NO: 1836
  misc_feature 1..173: note = chr1:165326296-165326469
  misc_feature 1..173: note = hyper
  source 1..173: mol_type = genomic DNA

SEQ ID NO: 26700 - DNA, 209 bp, Homo sapiens
  misc_feature 1..209: note = chr1:165345473-165345682
  misc_feature 1..209: note = hyper
  source 1..209: mol_type = genomic DNA
agggagggaacagcccgagaagggagggggctgggaagggtttgttgttgctttttctgaattaaaagaaaacagggactagagcaaggaagagagcgaagttcaagggagaatctggcaagtcaccttgggcagcccctggaccgccgccagagctctcttggagagggtgaggacgccgagcgtgtgatgagcgcctagtgagtatt

SEQ ID NO: 26701 - DNA, 132 bp, Homo sapiens
  misc_feature 1..132: note = chr1:165414298-165414430
  misc_feature 1..132: note = hyper
  source 1..132: mol_type = genomic DNA
aatctgcctctagatcggagagtccacatagtgcgtttgagacggctgtggcggcagcagctggtgcctgtcagtaatcacgcataatgctgccgccgccgccgccgccgccgtcaccgctactcttgccac

SEQ ID NO: 26702 - DNA, 79 bp, Homo sapiens
  misc_feature 1..79: note = chr1:166134203-166134282
  misc_feature 1..79: note = hyper
  source 1..79: mol_type = genomic DNA
agttctgaaaggaggcgggtgcggagttatgaaaatttggtaaatataaaagtcccggacgcgaccgcccgtagcctgc

SEQ ID NO: 26703 - DNA, 608 bp, Homo sapiens
  misc_feature 1..608: note = chr1:166134283-166134891
  misc_feature 1..608: note = hyper
  source 1..608: mol_type = genomic DNA
gcccctggcggttgaggagccgcggcgatccttggtcttcaccgcagcagccaagcccggcgcgcaccaaccggcgctgctgaaagttggagagctcccagctcgccgatagaattcggcggtgggcgccaggggaatcccttccagtgccgcaattaggaaagttttaaaaagtaaggaccctagacagacaagagatccatcctttcctttagcataagaaacaccccgcgccgcgccagccgaacgctgctcgcacaaggctatccgcccttcttggccgggacgcactcggtgccttccagctccccaccagaactggtccagggggcgcggaaacagagaggcaactgtgtccggcttgtggttccagacggaaacgcctccgggctccctggcccgggggacaagggttcgaaacttcaacagtcgcgagggcaaggacagaactaccaactcccgctcggatgcccgggacctgctcttccaagcccgctccggtttctccaaaggacgcgcggcacagcccatgcgcccccggcactccactccactcctctatggtttcccccaaactcttcccggggagccccacaaagcacagacgg

SEQ ID NO: 26704 - DNA, 653 bp, Homo sapiens
  misc_feature 1..653: note = chr1:166134933-166135586
  misc_feature 1..653: note = hyper
  source 1..653: mol_type = genomic DNA
cgcctctcgaaccctccttgtcgcgttcttcccgccccgcacctttctcctcgcgtttctgggaagtcagaagcaaaccacgagaaaatgccttcgcaaggagcctccctacacccgccctgtcactgaaacaaaagcgtagggaggagggaggtgggagaggaggcgggaggaaggtttagaaagacgatggggacagcagtaggaaggagctggggaggggggtcaaggtggcaagcagagctgggggcccagagtccgctcccgtgccgcgcggcgagtcgcttacatgcccaggtcgctgtaggtgttgaagaactccatctgattgcacgcctgaatccagcccaccacccaggtctcgtggcgggggatggggggcatgaccacgcgggcggaggctttgaagtagggggtcttgtagcgcaggacgatgggcgaggtctcctcgatgcgcgtggggcactggtcgatggtggcgcacacatcgtacaccacgatgttctcgcgccggatccgcgccttgcaggtgatgctttggatacagcccatcctgcagcccggtgccggcacggcgcggcgtggggcagcgcgggggcccgcgcgggcagccgggggcgcccgtcacgccggcatggcgacgcgccgctcgc

SEQ ID NO: 26705 - DNA, 57 bp, Homo sapiens
  misc_feature 1..57: note = chr1:166853653-166853710
  misc_feature 1..57: note = hyper
  source 1..57: mol_type = genomic DNA
tagaggaagaagagacggccctgagcgcagcatcacctcggccggttggagtctgcc

SEQ ID NO: 26706 - DNA, 71 bp, Homo sapiens
  misc_feature 1..71: note = chr1:166916850-166916921
  misc_feature 1..71: note = hyper
  source 1..71: mol_type = genomic DNA
gctgagccaatttctcggtgccacccactctcgcgcctgcccccagcccccgtttcctcccccgctcgggc

SEQ ID NO: 26707 - DNA, 14 bp, Homo sapiens
  misc_feature 1..14: note = chr1:166916936-166916950
  misc_feature 1..14: note = hyper
  source 1..14: mol_type = genomic DNA
cgactacaatgcag

SEQ ID NO: 26708 - DNA, 196 bp, Homo sapiens
  misc_feature 1..196: note = chr1:166945272-166945468
  misc_feature 1..196: note = hyper
  source 1..196: mol_type = genomic DNA
ccaggcaagaggctccgcagaattgaaaaaggtaggcgggaatctcgcgtcattactttttcctgttaaaatatgaggtagaataagggcatccggccctttaacagaaaatatgtaaaaccagaatgagataaatgattataacggcttaaatccatccaacactttatagattccagcacgcattcacatggat

SEQ ID NO: 26709 - DNA, 673 bp, Homo sapiens
  misc_feature 1..673: note = chr1:167599179-167599852
  misc_feature 1..673: note = hyper
  source 1..673: mol_type = genomic DNA
gaaaaagaaagaaggcgcattaagggagggagacgttgagaaggactgagaccgtggcaaagcccagggtcctgagaaacttcgcgagacagaggggcccggtggctgcccatccccatgtttgggcacatggagtcgtggctcccgctcttgagtcctgccctgggagggacagtatctgtttagatttgcgtctaaatttaaaccctgatcgtcggcctccctccccgctccccaccctcccctcccctccccttcctccctccctccctcctcctccttcctcgttctctcgcgcagggcccccgcggccggggcagtcccgcagccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggtaaaggaccccggagggagacgcggggctgagcggtgagcggtgtatcgggcgccccttccccgggcggctgcccctgccctgagcatggagcacgcggctcatcgctgctgccaactagaagggcaaatgcctgctgttccgacgcctccttgaccaactccgaaggatcgtccctggtcccac

SEQ ID NO: 26710 - DNA, 349 bp, Homo sapiens
  misc_feature 1..349: note = chr1:169396286-169396635
  misc_feature 1..349: note = hyper
  source 1..349: mol_type = genomic DNA
taagctactctcagacgagtatccttcatacatagtgaagaaaggtgttaccagacttccccaccagtgccagactcggtggacctcggactccagaggataaggcgccaccagaaagcttcttccctcactacctaccctccctcccagctataccagacgtttatacctttaccctctatcccaccattaacatctccgcatcgtccttcccttctctccctctatatccctcttgcctgtgtaaaatgcggcggctgggatcacagagatggccgggggagttctcctctcctcctctttctaagctcttcacattgaggcaaaggagaccccggcacctgcctcc

SEQ ID NO: 26711 - DNA, 53 bp, Homo sapiens; identical to SEQ ID NO: 102
  misc_feature 1..53: note = chr1:169396636-169396689
  misc_feature 1..53: note = hyper
  source 1..53: mol_type = genomic DNA

SEQ ID NO: 26712 - DNA, 193 bp, Homo sapiens; identical to SEQ ID NO: 103
  misc_feature 1..193: note = chr1:169396730-169396923
  misc_feature 1..193: note = hyper
  source 1..193: mol_type = genomic DNA

SEQ ID NO: 26713 - DNA, 237 bp, Homo sapiens
  misc_feature 1..237: note = chr1:170630365-170630602
  misc_feature 1..237: note = hyper
  source 1..237: mol_type = genomic DNA
tgaggatagagagtgcgaaaggagggagaggcgaggagctgctctatttctagggaggttttggggagactgatcagctccaaggacagaccgctgggaagggaaaaacggcccacatcgaactggatgccggatggaaacctctctgcgctattagactgcgtccagtacagcagatggcacgagcacgtgcggcgctcagcttaggctctcggaggcagctgagttggaaatccc

SEQ ID NO: 26714 - DNA, 207 bp, Homo sapiens; identical to SEQ ID NO: 105
  misc_feature 1..207: note = chr1:170630603-170630810
  misc_feature 1..207: note = hyper
  source 1..207: mol_type = genomic DNA

SEQ ID NO: 26715 - DNA, 30 bp, Homo sapiens; identical to SEQ ID NO: 5798
  misc_feature 1..30: note = chr1:170631084-170631114
  misc_feature 1..30: note = hyper
  source 1..30: mol_type = genomic DNA

SEQ ID NO: 26716 - DNA, 264 bp, Homo sapiens
  misc_feature 1..264: note = chr1:170631315-170631579
  misc_feature 1..264: note = hyper
  source 1..264: mol_type = genomic DNA
gtcaggttagggctccgcagacggacgacagaggattatccgtagacttagatgggggttcctccgcccctctctgtcctcctgccaccacagccaggctggacgcagaaccgcacggaagcctccccaactcctgcctctgggagtgctcctgcctgcttcaaggaatctgggcagcgggaccctctgggtttagcgtcctcgcctggggaagcaactttggccttaccgtagaagttacaaaattggcgggggtagggagaa

SEQ ID NO: 26717 - DNA, 33 bp, Homo sapiens
  misc_feature 1..33: note = chr1:170633073-170633106
  misc_feature 1..33: note = hyper
  source 1..33: mol_type = genomic DNA
tatctctttggaccgcgccggacttggcctcag

SEQ ID NO: 26718 - DNA, 46 bp, Homo sapiens
  misc_feature 1..46: note = chr1:170633432-170633478
  misc_feature 1..46: note = hyper
  source 1..46: mol_type = genomic DNA
tcgacaccctgcaggcgaaaaagaacttctccgtcagtcacctgct

SEQ ID NO: 26719 - DNA, 381 bp, Homo sapiens
  misc_feature 1..381: note = chr1:170633902-170634283
  misc_feature 1..381: note = hyper
  source 1..381: mol_type = genomic DNA
cggctcggttcatcccgcacgcggggcggcggggctgggctgggaaaaggtcttagcggggtgcaaactcagagagccagcgctgtttgggaaagcagcaggttaaagatgctgagtcgggttggaagggcttctctcgggcagcgtatgacggcttgagggagggcaccaggcacagggagcaggacttggcgctgctcaggctgcactctccacgcgggcaccgtaaggccgggcgcgaccgggaggccccgagagaacgcccggccccagacgctggagctgctctctgccccctgctgttgcctctaccgcaaatgggtttgagactggcagagtcaaaagcccggctggcttgggaaaactcgggccaagcaaagg

SEQ ID NO: 26720 - DNA, 44 bp, Homo sapiens
  misc_feature 1..44: note = chr1:170637766-170637810
  misc_feature 1..44: note = hyper
  source 1..44: mol_type = genomic DNA
ctcgggaccttgccccgccaacttctcttcgccagagaaacgcc

SEQ ID NO: 26721 - DNA, 190 bp, Homo sapiens
  misc_feature 1..190: note = chr1:170640121-170640311
  misc_feature 1..190: note = hyper
  source 1..190: mol_type = genomic DNA
agaagctctaattcccgagaactttggggcttatttttaccatcattgagtctgcccaggctcagctctcttacaaaggtataaatctgaaattcatgtattaatttgaatccccaagatccgagttatgagaaagggcaagggcaggctctactcctattttgtttactttcaccgagttactgtgaag

SEQ ID NO: 26722 - DNA, 108 bp, Homo sapiens
  misc_feature 1..108: note = chr1:170640517-170640625
  misc_feature 1..108: note = hyper
  source 1..108: mol_type = genomic DNA
gtgtggtctctgcctcggcaaagaaacaaacacccccaccccatcttcgcagttctcctctctgctgtagcgacgccaggcgctgctttccgccgggtaaattagcgg

SEQ ID NO: 26723 - DNA, 15 bp, Homo sapiens
  misc_feature 1..15: note = chr1:170640664-170640679
  misc_feature 1..15: note = hyper
  source 1..15: mol_type = genomic DNA
cgaaagggggcgcgc

SEQ ID NO: 26724 - DNA, 1087 bp, Homo sapiens
  misc_feature 1..1087: note = chr1:171810200-171811287
  misc_feature 1..1087: note = hyper
  source 1..1087: mol_type = genomic DNA
cctgggaggagtcatcgcggattctggagaagggcgtgacagaggagatttcctttcgggaagtgtagtctggcagcggtgccccggtggtggcggcggcggtgctgctgttgctggtgatcgtgtggtggtgttagcggcgatagtgctttccactgggctttggcttggtagccgctgaaagagaacaacgctgccgctgctgctgatttcatgccatttcctgacccggcgctgtaacttggcctctgagccttggccacagaacgcagaggccgtggcatctggccgcagctgggctgcagtgcgtgcgcgcctggcctggtggtccgatgggaagcccggggcggggcagccgcggggcgggggcggggcgtcgcggagataggccacgcccctgcccgcccgcgcaggcgcgctgcgggtcgttagctgtcagagccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacagagctgcctgctggagctgccgcagatcgccgtggtgggcggccagagcgccggcaagagctcggtgctcgagaacttcgtgggcaggtaagcgcgcagggcgcggagtaaggatgcggcagtggggcgaccccgctgcgggccgttggaacgtggacgggcagcgggagccagagggtggatggaccaggcgctgcggtggaatggggggcagagtggaatggggggcagagtggcggtgtccgtggggcgggcggggtcctccagctctgggcatcctccgtcccctgccaccccccgcctggtggccctcctgcctgcctttcatcgtgcgatacaaagccatttcctccctgtcctccagtcggggagtcgggggaggggtccgccccgggctcgacccccaccccctcggtg

SEQ ID NO: 26725 - DNA, 238 bp, Homo sapiens
  misc_feature 1..238: note = chr1:171811320-171811558
  misc_feature 1..238: note = hyper
  source 1..238: mol_type = genomic DNA
cgccgaaagcttcccagtgcccctctcctgttttcccagctcaacacccccctccttttcctgtcgccctccgtgaggctccctgtgaggctgtggggctttatcccccgagccccctcccttaggtggagatgctttccttctcgccagggttctcgttcctctcagctgtctactgttgcctgcctctagctggggaggcggggtgcgaggagaaagacgtcgtttgttgtggtga

SEQ ID NO: 26726 - DNA, 411 bp, Homo sapiens
  misc_feature 1..411: note = chr1:173638647-173639058
  misc_feature 1..411: note = hyper
  source 1..411: mol_type = genomic DNA
tacagaaagtggcagcgccgccaggtgatccaggaggtcccgcgagggggcaacggacacttcagggcaccagagtttgctcttcggcctgaattccctagggaccttctgcgatcccttgcggctgccggcggggtaggagaccggtgcgcaaagctctggacagaagcagtgtgaggacgctgagattgaagcccactcccctccagccctgcccgagcagcctggagggaagatgtccgtctaccccatcgcactcctccccaagtgcccaccccggcccacagcgccaggacccctagactcaccacacccgggccccggcctcctcggttaccatagcaacggcgcaacacgcgaggcagcgcctcctcctgcgccgcggttccggcagcgcgggaaggttattct

SEQ ID NO: 26727 - DNA, 142 bp, Homo sapiens
  misc_feature 1..142: note = chr1:177133445-177133587
  misc_feature 1..142: note = hyper
  source 1..142: mol_type = genomic DNA
agtgggtgtgtagagcgagctggagtggggggtgggggcgccggtccagcgcctccggccgcctcgacctcccccgggactcacccagcacgaagtagggcagctccgtgttctccaggtcgtccaccacgaccatttctcc

SEQ ID NO: 26728 - DNA, 372 bp, Homo sapiens
  misc_feature 1..372: note = chr1:177133689-177134061
  misc_feature 1..372: note = hyper
  source 1..372: mol_type = genomic DNA
cgtgatgcttttgagcttgcactccagctccttggatggatccacgtcgccggcggccgtggccagcaccgccgccggcccccagcagcaggcgagcagggcgcagagcccggctaaagccatcttgagccccggccgccttcctcctagcgctgcgatggtgggggaggaagcgagcggggagggagcgagggagcgagcgcgggaggcgggggaggttagggaggggatggagagccgggagagccctggaccccggaatgagatgccgcttgcagagtcctgggtttaagctctgatgtctggagagccccggattctttgtttcccggagctgcttatctggagaagggaaagcgggggaggggggag

SEQ ID NO: 26729 - DNA, 40 bp, Homo sapiens
  misc_feature 1..40: note = chr1:177140105-177140145
  misc_feature 1..40: note = hyper
  source 1..40: mol_type = genomic DNA
gacactgcttaggtacggagcgcggagtcggagcggggac

SEQ ID NO: 26730 - DNA, 28 bp, Homo sapiens
  misc_feature 1..28: note = chr1:177140146-177140174
  misc_feature 1..28: note = hyper
  source 1..28: mol_type = genomic DNA
cgccgggctgcagctctgggatgcaatc

SEQ ID NO: 26731 - DNA, 390 bp, Homo sapiens
  misc_feature 1..390: note = chr1:177140304-177140694
  misc_feature 1..390: note = hyper
  source 1..390: mol_type = genomic DNA
cgagggagcggtgaagccggaagacctgtctctgcccatgtgcaaggcagtgatttcgggtgagagagcgggtgggtgagtctctttagagttggaaagaaggcaaaatcttgggtttctcctcggcggagggacaggggactcccccagttgggtcttgcacttcccttacctctcccaccccgcgtgcgccccggcccagtgccgaagccccacttcaaagatgctctgggagaccgggatcctggctgctcagcgggaaggcagcaggcaagtggtctaacgttggcggcggtggcggtggcggcggcggcggcaccgacagtaaagcggggagcaagagaatttgaaaagagacatccgctccctctcacacgctgagggggaggc

SEQ ID NO: 26732 - DNA, 481 bp, Homo sapiens
  misc_feature 1..481: note = chr1:177150773-177151254
  misc_feature 1..481: note = hyper
  source 1..481: mol_type = genomic DNA
tgccaccccctcactcggtgttcagccatttatcatcaatacgtcgttaggcaggagcaggggcaggtggctgacgggtgtgccggcggctggcggggtcttgggaggcgccctgcacacgcctcttctttctgaaatctccgacctttcggatttgagccgcgagggaccgcggagcaagggcagcctcctccggaagcctcgggtcactagagacccctagaggcgaaaagctgtgttacaagcccccggccgcagaggcgcaggcgggattcttgccccggaggttgccgaggagtggccggtacctttcctaaaacccttatctgtaagtacactccggcaagctcgaaagggacagcaggggagccatgtgtgcgtgcgcgtgtgcggagaaggaatggggagggacagttgcatttgcagaagcaatcctgtctggaactaagctgattagtcctggtgccgtccctccctccct

SEQ ID NO: 26733 - DNA, 30 bp, Homo sapiens
  misc_feature 1..30: note = chr1:178063661-178063691
  misc_feature 1..30: note = hyper
  source 1..30: mol_type = genomic DNA
aggcgctgtcctggccggagatgttcccgg

SEQ ID NO: 26734 - DNA, 306 bp, Homo sapiens
  misc_feature 1..306: note = chr1:179544785-179545091
  misc_feature 1..306: note = hyper
  source 1..306: mol_type = genomic DNA
ctcggacctcatccacgtccaccaccgtggcggcgggcgctcggggctcccccggggtccccgcccgtccggagcccgacggctcgggcccagcctcctggcgcccgcggcctccgccgctcctctcggcctttgccctcttgttctccttgtgcggagtcctgccgcctcgcccgcgggactccctggaggagctccgcgccctcctctccatcctcagagctgccgggcggctggagcagcagcgcgggagcgctaggggcacgggagcgcagtccctgtggagtcgctgcgggtccgcgtggc

SEQ ID NO: 26735 - DNA, 88 bp, Homo sapiens
  misc_feature 1..88: note = chr1:179545092-179545180
  misc_feature 1..88: note = hyper
  source 1..88: mol_type = genomic DNA
tgcccgggggaccctaaagaccgtcgggtgggggctgagggcgaggggcgggacaccggggccgcgggcggggcgcacccggaacccc

SEQ ID NO: 26736 - DNA, 397 bp, Homo sapiens
  misc_feature 1..397: note = chr1:179711942-179712339
  misc_feature 1..397: note = hyper
  source 1..397: mol_type = genomic DNA
gatcccgccctgccacgaggcccgggtacccctcagcggcggggacatccaggtgtccctggatttccagggcacagtgcgggccggaaataggaacacagaggagcccttcgggaggctctcgaggcagtctctttccagtggatagcgacacaccctggtccctaagattctcatgctctccgaattttccgtcctggacccgatctgtagggcgcaaagtcccctgtactgaggcgttcccagggcgcccgcctcccgcgtttacatttcttaggcaaaaaggcagcggagctaagcaggggtgtttggaaggcgcccgttgcgctgtttgactgcgtggcttcacttggcccgcgtgcatcagcctctctggcgggggattctccccggactc

SEQ ID NO: 26737 - DNA, 144 bp, Homo sapiens
  misc_feature 1..144: note = chr1:179712410-179712554
  misc_feature 1..144: note = hyper
  source 1..144: mol_type = genomic DNA
cgcccggagcagggcagtcctcggagcgccggggaggccgcggagcctcacgtgtgccgccccagccgctggcgcccggaaggacgcgctgcgaccccgtgggagccgaacgcgggagtcgctgcccgagcggagctgctcagc

SEQ ID NO: 26738 - DNA, 24 bp, Homo sapiens
  misc_feature 1..24: note = chr1:179712567-179712591
  misc_feature 1..24: note = hyper
  source 1..24: mol_type = genomic DNA
cggggcctcatcgtgcaggggagc

SEQ ID NO: 26739 - DNA, 142 bp, Homo sapiens
  misc_feature 1..142: note = chr1:179712592-179712734
  misc_feature 1..142: note = hyper
  source 1..142: mol_type = genomic DNA
agcggaggggcggggcggggcgcgggcgggctgaggagccgccgggctcgggctccgcgcggggatgtgtctggccaccgcgtactttcgagggcgcctcaacacccgggtaagcgcgccccggctgcctccctctgcccac

SEQ ID NO: 26740 - DNA, 345 bp, Homo sapiens
  misc_feature 1..345: note = chr1:179712830-179713175
  misc_feature 1..345: note = hyper
  source 1..345: mol_type = genomic DNA
cgactcgggggcatctccggcctcgtggccagaccgcgggtggcggtgctcgcgcctcggggccggacttgccgggtccctgcccccgggccgtgccgaaggcgctctactcagcgtgtctgcagcgacccgcttctctgcgctttcagccgggccggacctcacgcggacgccgctgctgctgctgcgcctcgcgcccgccgccacccggggagcatgaggccggggcaggggacccgggtagggtgggggccgaccggcggggtctgctgggccaatgcgccgccgtcggtcagtgagtccggattcgtgccggcaactgtgggcagccttgagaccggggct

SEQ ID NO: 26741 - DNA, 300 bp, Homo sapiens; identical to SEQ ID NO: 5815
  misc_feature 1..300: note = chr1:180198156-180198456
  misc_feature 1..300: note = hyper
  source 1..300: mol_type = genomic DNA

SEQ ID NO: 26742 - DNA, 158 bp, Homo sapiens; identical to SEQ ID NO: 5816
  misc_feature 1..158: note = chr1:180202237-180202395
  misc_feature 1..158: note = hyper
  source 1..158: mol_type = genomic DNA

SEQ ID NO: 26743 - DNA, 646 bp, Homo sapiens
  misc_feature 1..646: note = chr1:180202648-180203294
  misc_feature 1..646: note = hyper
  source 1..646: mol_type = genomic DNA
cgagccgcctccaaaactctccccgcggacctcagcagtccctccacgcgtcggggccctgctggccggccatgccctctgaggagacgcggaaaagagcgaggcatataggaaggtggggcgttttatccgcctcggttttgacccatctgccatgtagtctccccaggcaccgagggaaaggacgacggaagcccgccgcccggatcgctggcgggagagagggcagcccgcacgggagaaggaggagccccgcggggtctccgctgggggtggtaattggaatgcaggcctgggggtctctgtccccctccttgtctcctaaaatgcttccggcaagctctggcgaaccccgaagctgtaggaaaaaggtattttattttgtgtttggtagggtcggggtaaaggttttccctgggacttcctctcctggggctcctccggggtgcgtggggtaatgtcccagcgcaggtcgagttgcagatccgagtccccggggttgttgactgtccttcttgcaggacatttcttaagggggtgagatggattcactgtccaagacaggagttcactcaaacgctggtgctgttcgctcttctttccattcctgccttgtctcctagtgcgagaaacagacacacacaac

SEQ ID NO: 26744 - DNA, 254 bp, Homo sapiens
  misc_feature 1..254: note = chr1:180203354-180203608
  misc_feature 1..254: note = hyper
  source 1..254: mol_type = genomic DNA
taatagattgagattctatcatattccgaacattccgatatagcagctgtaggcaccatagacctccctccctgcgtcgcgagaatatattctcaggcaggagacaatttttacagatgaggtcagctgtccccgccggccgattcgggcctgatgggttgggggttccgatgtcctaactgctaggatcccgttccagcccctggccagagctgtgtaccacaaagaagggagtttggagaaacccgggtaag

SEQ ID NO: 26745 - DNA, 588 bp, Homo sapiens; identical to SEQ ID NO: 1847
  misc_feature 1..588: note = chr1:180203633-180204221
  misc_feature 1..588: note = hyper
  source 1..588: mol_type = genomic DNA

SEQ ID NO: 26746 - DNA, 398 bp, Homo sapiens; identical to SEQ ID NO: 1848
  misc_feature 1..398: note = chr1:180204222-180204620
  misc_feature 1..398: note = hyper
  source 1..398: mol_type = genomic DNA

SEQ ID NO: 26747 - DNA, 474 bp, Homo sapiens
  misc_feature 1..474: note = chr1:180204897-180205371
  misc_feature 1..474: note = hyper
  source 1..474: mol_type = genomic DNA
cgccggggaaggcgaggtggcgcgggccaccgggtgcactcaccgcacgagaggccgcggctggactgggaccgagcgcatccctgtgtctcagggggtttgctttgtgcaggatgggaccttattatttttagacagtggggcaaacgtgtcttttaaagagatccgaagggtgaaactaatgaaaaaggaaatgaattactagaaaagccgtgaagggataaaaccgggagcagcaggaagttgaaggaaggacgaccgaagctaggtgtatctgcacctgcctcttgacacgccaaaaacaaaggggggttaaggcaagaatgtagactaaatgctgtgaggattagggtaacgcgagccctcaagacgtctcggagaccgcctacagggctgcaaataccagggtccatttttaaaaatcgagtgctcctagaggtggggtgggggtgggagagccgggaaaccagcaaa

SEQ ID NO: 26748 - DNA, 60 bp, Homo sapiens
  misc_feature 1..60: note = chr1:180206312-180206372
  misc_feature 1..60: note = hyper
  source 1..60: mol_type = genomic DNA
tagtgcaggaattcacgacacaggggttttactcggcggggggggcggggaggagggcgg

SEQ ID NO: 26749 - DNA, 118 bp, Homo sapiens; identical to SEQ ID NO: 5824
  misc_feature 1..118: note = chr1:180881433-180881551
  misc_feature 1..118: note = hyper
  source 1..118: mol_type = genomic DNA

SEQ ID NO: 26750 - DNA, 428 bp, Homo sapiens
  misc_feature 1..428: note = chr1:180882004-180882432
  misc_feature 1..428: note = hyper
  source 1..428: mol_type = genomic DNA
cgcgggccgggaaggcgcgggcttggccgctcttcccctccacggcaaagccgtgaacggacagctgatgccacttccttccctgccagcgccctccctgcccgaccccgcttcccgtcctctcgccgggagggagtgcggcccgtggggcgctgcgccggccagacccacccggggcccgggggctgccagcagagccgggagctggcccggcctcggcgccgtcccggacccccagtcggccgcgccccgaggggcgaggcctgcgggccgcactccctccggccccggattcggggctggaagtccctccccgaacccagcagctggcctgggagggagaaggggctggagagggcctggcctctccgagggatggaggggacagaggcggcggcggccaaacccgcgggcggcagcccccagtg

SEQ ID NO: 26751 - DNA, 30 bp, Homo sapiens
  misc_feature 1..30: note = chr1:181286935-181286965
  misc_feature 1..30: note = hyper
  source 1..30: mol_type = genomic DNA
tggtgggcatgtatgcgagttctctttctg

SEQ ID NO: 26752 - DNA, 871 bp, Homo sapiens
  misc_feature 1..871: note = chr1:181287331-181288202
  misc_feature 1..871: note = hyper
  source 1..871: mol_type = genomic DNA
tgcactccccggcggcgccacgggtctggcccccgcgcttctacgtgttggggggatgcatggaccttggagatccgtagttggccctaaccttctcggaatctcctctgcacgcgctgcctgttcctcctctgcacgctctgtccgttcctttgcaacttctgtgggaattgtcctggcgtgggaaacgcccccgcgctctttggcacttagggtgtgagtgttgcgccccttgccgcagcgctcagggcagcatcccgctcgaggatgcagggttctcaccaagcagtgagggggactcacgcgccgccggggagcggagccaggctccgagaagggagcaggctcgagccgctgggttttcgcaagccttggggcctctggccgcccttccatgcctccgggcgcgggcggctcagcaggtccccggcttcgggaagttttgtgcgcggatcgctggtggggagggcgcgcgggccagtggctgagcttgcagcgaagtttccgtgaaggaaactgcatgtgcctttggaggcgactcgggactgctgtagggtggactgggtgtctatggagttgcgggtcagagcgagtagggtgggtcctttcctgggacaggactgggaattggggctcgaagtaggggaggaaagagcacagaggaagccaggctgcatagggtgacttgctttttgatccggcttgagtctccttgtgcgagagtggttgtgcgtcctttcccagggatggaacatccagttttctgtgcttttttgctttgtgcccatgtcttggagagaataatgggagacactaacccaccgacgtctcccttgagatcgcggcttcctccttgcgcagaggactgagg

SEQ ID NO: 26753 - DNA, 1039 bp, Homo sapiens
  misc_feature 1..1039: note = chr1:181451320-181452359
  misc_feature 1..1039: note = hyper
  source 1..1039: mol_type = genomic DNA
ggagcctgggaggtgcggaggagcggcgacgcggccatggcgctaggcgcgcaaaggccccgacaccttactagggcggcggcgggcccgtggcaccgctcccggcaccgaacagggcacagcactggggacacctctctgcagggacccaagacgcgcgtgcgtgtgcgccccacgccaggccctcgctctcttgcggagactccgccgcatcgctggctgcacctgcctctctcttctcggcattacttgggggaaaggggactcttcactggacctttgcagaggtggctgctaccctttggccacataaatcaagaaggcaagccagcctcaccttccaggaacctccagccttccggctgcgtccccgcccctcccgcctggccagctcctcccccgcttctcccagcgctcttgcgcgcctcgctgcgcctctgcgcgccgctcgctgtcctctgcctcgcctccccattctccttccgcatcttctccagtgctccgccgagggcgctgcctgcggggaagagggagactgagccgttagtgaggaagttcggtctgtggacaagtgtggtgccaggccgccgcgaggctcggctgcaacctgttcctcgcccgccggtgctcgccgcccgcccgctcgcactcccgccctctcggcggcgcagccgcggatcgctgttgcatgctgatccggggaggcggcggtggcgagcgctccgggcggatgctggcactcaggcttcgctgctctctggatgctgctcaacttctagcccaagcgcaggagctttgaagtcatttgtcccttttcgcttggatcgacttcttattttgagattttgggcattgcggtttacgcaggaacctcaatatcgctctccccacctccctccctctttctccaacctttggatgcgtctctgctggcagatataaagacccaagtcttcgcggtggaatttcttagatggacttgcaggggctggcgttataaagcatgtcatcgtaaccccgtcctcgtctttgtttattt

SEQ ID NO: 26754 - DNA, 295 bp, Homo sapiens
  misc_feature 1..295: note = chr1:181452691-181452986
  misc_feature 1..295: note = hyper
  source 1..295: mol_type = genomic DNA
ttcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcagg

SEQ ID NO: 26755 - DNA, 60 bp, Homo sapiens
  misc_feature 1..60: note = chr1:181453050-181453110
  misc_feature 1..60: note = hyper
  source 1..60: mol_type = genomic DNA
cgtccggcagaactgtttcaccgtcaacagatccctgttcatcttcggagaagataacat

SEQ ID NO: 26756 - DNA, 645 bp, Homo sapiens
  misc_feature 1..645: note = chr1:181454704-181455349
  misc_feature 1..645: note = hyper
  source 1..645: mol_type = genomic DNA
attgcctgagttgaacgtatctagctagggtggaggtttcgggcgggggaggggtcgggtccctgcagtcacgcctgccggtgcgctgcacaaagcggacagatctcattgtgttgtgtgctgcggctgcaaatattcctctaggcagtctacggatttcccagctgggccctcctttctcactcggcttctacggttctctaaatcttcccatccaccaggtgctgccttgctgtgcccctctcttaggggcgtgtttattcagacaggcgccctcccgtttctttgcggtagacaaagccgcccaaccgccccgcgggtggcaaagtgtgccagcagccatcgttggcacctcggacagcgccgctgaaactcccggcggcccggggctccccagttacccgggttcagcacctcgggtacttctggccgggcccagccttggagctgagaaaccaggcacgtttcctacaccacgtggtcaccttttttcacgttttctcttccgctgcaaagacaccgcctttccaccaggcgttgcgagcgcgcaaggtgcggctgtgagtcttactcctccctttccttgtctttggccaaaaatggaccaaagagagtcaaacgggagactctcgagggagttgattt

SEQ ID NO: 26757 - DNA, 163 bp, Homo sapiens
  misc_feature 1..163: note = chr1:182584177-182584340
  misc_feature 1..163: note = hyper
  source 1..163: mol_type = genomic DNA
cgcggctcgccgccccgggctctgtggcaccatcagcagcttgcgcaggacacagacgtcggctcacgcgccgcagccctcggccccggaagagccgcggccgcggagcagcgaacgcgtgcctgccagggaaaagcagtcaccaggaacgcggcgttttggt

SEQ ID NO: 26758 - DNA, 35 bp, Homo sapiens
  misc_feature 1..35: note = chr1:182584403-182584438
  misc_feature 1..35: note = hyper
  source 1..35: mol_type = genomic DNA
cggcctgcggctccggaaggcgaagctcttccagg

SEQ ID NO: 26759 - DNA, 334 bp, Homo sapiens
  misc_feature 1..334: note = chr1:183385985-183386319
  misc_feature 1..334: note = hyper
  source 1..334: mol_type = genomic DNA
ctccctaggagggctcgcgcagtcctcaggctccggataaacacgtgtgcccgcatccagctccggcgcgccctgcatttcagcaccgccgcctctggagagcgccttgctggcgggccaggtcagggcctcccacacgctctctcatccatcccagcccactcgcttttccctactcctcgcttctctcagtttcaagaaaaagcacccccaacttctaacttctcaattcctgcttctaaagtgacctccgcgtccctctttccgtgtctaaacgctcatgccccacgcctttgagtcctacgagcagctgcgaagccgcgtggcttcccac

SEQ ID NO: 26760 - DNA, 229 bp, Homo sapiens
  misc_feature 1..229: note = chr1:183386598-183386827
  misc_feature 1..229: note = hyper
  source 1..229: mol_type = genomic DNA
cggctccggctcgcgcagggcctcccgcagcctccgcccggccccctccccgtcctaggcagcgggtccctgaggccgaacctaggcggaaaagggccccctccctattcactcagcatccacctcgcgcgggcaatacacggcccacaattcccaaacactggtccctgggccgcccagaatcaccagccaaatccgaaattaatcttgaagccccagcccctgtcac

SEQ ID NO: 26761 - DNA, 677 bp, Homo sapiens
  misc_feature 1..677: note = chr1:183386946-183387623
  misc_feature 1..677: note = hyper
  source 1..677: mol_type = genomic DNA
cggcgccccaacctctgcccccatcccggtcttcgccagcctggtagccgaaccaccgcaccgccacactccagttctggtatctcgaacccctgcccagccccaaatgatactcatctctagtcccctcccatcccccacctttggccccctgcgagccgggtctggccccggcaagtgacgcctcggaaacgcagtctgcgtaccctcccctgagtccaaaatgaaggggccgacctccaccagctggatgagccggcccacccctccgaaggggcacacgccttcccgttcgatcgccctggaaaacacaggtgcctgggaaaggagaggagcggaagcggcttccagaggtgggcgggaggactcaccaaacatctgaatgtgccctttggtgatgggattgaagctgccgcaggcgagcaagataacgtgggtcttggtggtctcggtcatggtgcagatgggtccttcgcggtggtctaggggttgcctctctttttgtgtctcgttgtgtctgcagagggagaaaggaaggcgaggctccggcggtggatgctgtggactccaaggagccgctccagacgcaaaccgcgtcactctccgcctccccttaacgcttgcagctccggctagatccgaggctgcttttgtattgctctgctctcttctctcct

SEQ ID NO: 26762 - skipped

SEQ ID NO: 26763 - DNA, 331 bp, Homo sapiens
  misc_feature 1..331: note = chr1:183774098-183774429
  misc_feature 1..331: note = hyper
  source 1..331: mol_type = genomic DNA
tcagaactggagaaacgctttcatgctgactttatccatgggactgaagaaagggagagtgtgctcacaagcacaaacaggaaagccttacatcacggagtggcgtggggaggagtctgctcctcgcttgctcgctcgctcgccgcgctccctttgtggcccgagtcgcgcgcaccggcggcggcgggggcagcgcggcgcgtgtctgtgcgctgcggtcgctcgggaccgggaccggggcgaggcgccgcggggctgagcccagcagacattgcgttggcctccgagcagggcgcatcatgcagcgttcgcgcaccggagagaaaactga

SEQ ID NO: 26764 - DNA, 1161 bp, Homo sapiens
  misc_feature 1..1161: note = chr1:184005477-184006638
  misc_feature 1..1161: note = hyper
  source 1..1161: mol_type = genomic DNA
caagcttctttcctccggggacaaaacttggctgtttatctttcccagggcatcttcgtctctccccgggacgtggaaccccgatgcaccggcagggacagcccggagcgctcgcaggagaccaggcccacggtggtgccatggttgggcacactccgcgggctccgcccaatctccacccctaggtccaggtccccctaggagagctaggagcacatttccagcctggagcaggagcccggcaccggaaagtcagagcagcgcactgcggcgccccagccactgcggagcccctggccaaccgcagttacgttccatctgtcgtatctacatgggaatacggcgacaggcaccctatcccctcacgtcagggctagcagtatgaggtggggaaagaggaaacctcgagagttaaaagcgagggaactgaaagtccccttgaggggtgtcccccatgccccttgtgggacaaagccccaattcgcaggctaccctccagagctccagcggtccggttctccccatcagcaccctctgcgcacactgacccgcgcgtccctccgcagcctgaccgcccgatccgccagccaccggcgcgggcagcgagggggtgtgtgcgccagattttccgcgtgcccccccgcccctccagcggctccctcgccctgcagctgctgctccgggcgctgtccgcgctgggcaggccgcccccgcgtcccgccgcggcggcccggggcccgtgcgcgctcaccagatggccatcctgctcttggggtagtccagccgctccaggcagccgaggaagtgcggcagcgtgtgcgccgcgttgcgggcgaggaccgccacgagcaccgtggggctctgcaggggcgactccgggaaaaccaccggctcctctccgtcgtcctccgagtcccgctcggcgacgaagcgcgctcggcagccttcgcggagcagggctgaggagaggagcagtagcgaccaggcgagggtggcagcagggcgcgcagccatgttccgggccgaggcgggcggcggggaagtcctggcgcgagcgcccggctgggctgcctgagggcggcggcggctgccggggagcaaggggctgcgaggggcggccgggggatgcggcttgccgcggccggccggctcacacactgg

SEQ ID NO: 26765 - DNA, 34 bp, Homo sapiens
  misc_feature 1..34: note = chr1:184633316-184633350
  misc_feature 1..34: note = hyper
  source 1..34: mol_type = genomic DNA
tccccgaagtgagggcgctcgctgcggagctggg

SEQ ID NO: 26766 - DNA, 71 bp, Homo sapiens
  misc_feature 1..71: note = chr1:186649956-186650027
  misc_feature 1..71: note = hyper
  source 1..71: mol_type = genomic DNA
ctccaggaatctgagcggccctgaggtccgggggcgcagggaatcccctctcccgccgccgccgccgtgtc

SEQ ID NO: 26767 - DNA, 429 bp, Homo sapiens
  misc_feature 1..429: note = chr1:190444251-190444680
  misc_feature 1..429: note = hyper
  source 1..429: mol_type = genomic DNA
aaaggaaggagtgaccgtcagcaataatactttaacacagagcctaagaagtcattcaacagttctaaaccctacttcgcagtcagacaaggacagtgattagggttttataaagcaggcattctgaggaatcgtcgtttactaacgttaaatatagctcattaaaataaataaatattaacgcaaaaaggtactaagagactccagagatcttaagtctattctctcatacagaagaggtttgctcaagtttggcttaggaaggttggaaatggagcattctggaaggatggaaaccccctggcgcaccccactctatggggctgcaaatgcccacaccaagcacacgttcgctgcaggggctgagtgcagagcctgagctagcaggtcagagtaggggacacctttcctacacgcatgggttattcc

SEQ ID NO: 26768 - DNA, 36 bp, Homo sapiens
  misc_feature 1..36: note = chr1:190445161-190445197
  misc_feature 1..36: note = hyper
  source 1..36: mol_type = genomic DNA
gggcgccaagtggtgcggaccacagtctcaaccccc

SEQ ID NO: 26769 - DNA, 456 bp, Homo sapiens
  misc_feature 1..456: note = chr1:190445198-190445654
  misc_feature 1..456: note = hyper
  source 1..456: mol_type = genomic DNA
ttccctctcggtgggagtcaagggggaaaagcccttgaatcccgagacggggggatggggcgacgctgcagctggagtacttttatgtctgggagctaaaagggcttttgaatttaaaaaaacattgcttgggttgtcgcgtcagccatcaatgacgacaagaatagttatttcccagaaattaaaaaaaaaaaaaaggaaaagaaaagcgtgaacaataggttcttacctccatgtatcccaagaaaaggaaatgttgtagagaccaggaacttgtccttaatttgagggcggggggcggatgttcagagaaaaccctcagtgggtgttaaaaattaccgatacatgcaggtttggcatttaatgaatatcgtgctttcctcattatgtgtcaattgtgaagtaaaagtaaagattaaaatgtttctcaacacaactatacggaagaggaggtga

SEQ ID NO: 26770-26771 - skipped (2 entries)

SEQ ID NO: 26772 - DNA, 326 bp, Homo sapiens; identical to SEQ ID NO: 5843
  misc_feature 1..326: note = chr1:190447388-190447714
  misc_feature 1..326: note = hyper
  source 1..326: mol_type = genomic DNA

SEQ ID NO: 26773 - DNA, 64 bp, Homo sapiens
  misc_feature 1..64: note = chr1:196577371-196577435
  misc_feature 1..64: note = hyper
  source 1..64: mol_type = genomic DNA
cctagcagcaaatctcgaaacctgtacctgggaggcagagggggcacttcgctctccaaatcaa

SEQ ID NO: 26774 - DNA, 587 bp, Homo sapiens
  misc_feature 1..587: note = chr1:196577773-196578360
  misc_feature 1..587: note = hyper
  source 1..587: mol_type = genomic DNA
tataaaaagttacttcgccgaaaaagacgcgcggtgcctagaaagaggggagaggggtgggagtgagcgccgcttgatggtgaagcactttccttaaaggcagttgccagatcctcccagagggcagcctcccggctactgttccctcgggcgggcttgcatccggcacagccctgagctggcgggaatcgggggcggtgggtttcggccccagacgcggccaacccggctctccccgcaatctccctgtggagatggagctggaggcccagccaatgagactccccctcattagcatagcacagtgacggcacgggggtgccttggggacaaccaatgggggcgagctaattagcggattgcggggctccagacccttctctgggaggaggggggccagggtgcttggagtgttccactatgccacgagctccctcgctttgattgccttcagtccaggtgggcgggatgaaaaaattgcacgtttctggaaagggaatccccactctcagccccaggaaaatcccatttttttctcacattctgaaagaagggaggtgtttccctgaactcggggaaaaagaagg

SEQ ID NO: 26775 - DNA, 177 bp, Homo sapiens
  misc_feature 1..177: note = chr1:197879484-197879661
  misc_feature 1..177: note = hyper
  source 1..177: mol_type = genomic DNA
ttggaagatccttaacgaccacatcctcctagcagaaatttgtattctaaagtgtgagctttggtgcgcgtttcagtgtgcgtgcgcctgcgtgtgtgtgtgtgtgtgtgtgtgtgtatagaatgcatgtcgttaccaaatacctagaacggtattggaccgcaaagaggttaaacc

SEQ ID NO: 26776 - DNA, 1355 bp, Homo sapiens
  misc_feature 1..1355: note = chr1:197879716-197881071
  misc_feature 1..1355: note = hyper
  source 1..1355: mol_type = genomic DNA
cgccgtccatccattcgatggcctcgctgatgagcatagaagatgaacccgggaggactgtcccttcctggctgcgaaacctgaccgatataggggagattctagaagaaagagctaaggaggccagggcggaaagaggaaagtcaggtgtaggggagattaaaaggtaaactggtgggactgaccgggctggtgggactagttagcgaagccaagtgtttgggtagaaacagagatcttgtaggaggtgctccgagctacatttcgggatttgggatgaaaagagaaagccagggggttcgccgctcctggtttgttccttaccgaccctaaactgtatggcggagcttgtgggtcaggcgtggaggcggcatccactcccacgtgccccacatgcagcagcaatcccacgcggttttcgcaagcggctgggaggcaagcgggcgtccccccacaccccccccccactgcgccctggacccacgccacgcaccgccaaggagtagctatggtggcacgtggaggaggggcgggtaggcagggcggcaccatcaccgggaccagcatcttggaacggtcaatctcactgctcatactctcctccctaccggcgcgggagccttgctgtaatcccctgccaccccatctccgactgtgaggggcgcaccgggtgggggaatgggtaaataactggcccaaggcccagcttccaggtcctccctccactttcccgcggcctgactgcgccccgggcaacacagccccttgggaacctgcgaccaggtaatgtggcctccgccccgtcccgggtctggctgcatcccctctaacccctgcctgcccgggtccaagtgagggttttctcccggaaggttaatcaccacccccatcccctagccgggtcccgggaggaagagatgccccggctctctcgttgacccggcctcgaacgccgacctcgagcgcagaatactcccgagtgctgggttcctgatacccagcccgggagcgaggggagtgaaggagggaccgggacaggaaggcggggacgcggtgggtgaacaatcaatggcttagcctagtttccccgcaggagctaccgcccattcaccgtctatgcaagcaccagctggcggcagcatcttttaggtacaagctgcagggaggcaaaagctggctggggggccgggagcccagggcacgccgcgggactccagtccccctgctgcgccccagcctcaagacgctctgggctttatgaggttcagttaccgccgagtcctccattaacacctcctctgattattgagaggctggaagggctgaacgcaacctcagagcgtttctctgggcac

SEQ ID NO: 26777 - DNA, 192 bp, Homo sapiens
  misc_feature 1..192: note = chr1:197881412-197881604
  misc_feature 1..192: note = hyper
  source 1..192: mol_type = genomic DNA
tctgccctcggagtgcgcccggacgcccgggagtttcagggacttcttgggagcctaccggaggaaggcccggctttgctccaagccgcgtccctacctgaggtctccacgggaggagcggtttggacgcgccccaccggatgggaggaggtgcttggggaagccgggccgtaccgccggtctgactcccgg

SEQ ID NO: 26778 - DNA, 68 bp, Homo sapiens; identical to SEQ ID NO: 5849
  misc_feature 1..68: note = chr1:197882140-197882208
  misc_feature 1..68: note = hyper
  source 1..68: mol_type = genomic DNA

SEQ ID NO: 26779 - DNA, 30 bp, Homo sapiens
  misc_feature 1..30: note = chr1:197882427-197882457
  misc_feature 1..30: note = hyper
  source 1..30: mol_type = genomic DNA
ttggccgggaagtaccgcccagcgaaaggc

SEQ ID NO: 26780 - DNA, 60 bp, Homo sapiens; identical to SEQ ID NO: 5850
  misc_feature 1..60: note = chr1:197885234-197885294
  misc_feature 1..60: note = hyper
  source 1..60: mol_type = genomic DNA

SEQ ID NO: 26781 - DNA, 216 bp, Homo sapiens
  misc_feature 1..216: note = chr1:197886851-197887067
  misc_feature 1..216: note = hyper
  source 1..216: mol_type = genomic DNA
ctttccctccatcctcgagcgtctctgcgctcctacagggcagccctctctggtcccttgcctccttcactcggatgagctgaaagccccgggcgtgtgtatatggaaatagtggggtgccgagcagaagacaactcgtgtcctttccgccccccagccatgctctttcacgggatctccggaggccacatccaaggcatcatggaggagatggag

SEQ ID NO: 26782 - DNA, 311 bp, Homo sapiens; identical to SEQ ID NO: 110
  misc_feature 1..311: note = chr1:197887146-197887457
  misc_feature 1..311: note = hyper
  source 1..311: mol_type = genomic DNA

SEQ ID NO: 26783 - DNA, 416 bp, Homo sapiens; identical to SEQ ID NO: 111
  misc_feature 1..416: note = chr1:197887706-197888122
  misc_feature 1..416: note = hyper
  source 1..416: mol_type = genomic DNA

SEQ ID NO: 26784 - DNA, 60 bp, Homo sapiens
  misc_feature 1..60: note = chr1:197888180-197888240
  misc_feature 1..60: note = hyper
  source 1..60: mol_type = genomic DNA
cgtggggaagatcaacccatttctgctagtcgtgagggaaatgtccggaggttaactcct

SEQ ID NO: 26785 - DNA, 949 bp, Homo sapiens
  misc_feature 1..949: note = chr1:197888681-197889630
  misc_feature 1..949: note = hyper
  source 1..949: mol_type = genomic DNA
aaaataacctgtgctcgttgaaatttccttttcactcccttatcatttccgttgttttattttgtgtgcgtcgaaaaccacaatttttagcttgtaattatttgaattcggaaacgatcaccaaactgtagtcaatattttcctagtcctttttaagcgaggctccggatggctgggatgtctttaggttagtagtcccgggaggacgcgaacgccggttcaggcagacacggaagaaagcaagcgggccgcaaagagagaaatcacaaatgtttcccctgacttttgcctttgtgcagtggaccctggcccctgccgctctccctgcacaccctgggcttggtctgcctgggggagaaccccgcgtcgtgcggctacaccgcgcgccctcctcagccttgcggtgtgctttctttgcagggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacaggtactcccctacacccccacttcctacgcccgagtacacctggaggggccatctgcctgagcccggaatcccctctccgtcccctaccttttgccccattccgggtgctgttatcatttcggagaccaggcaaacccactgcatatgccttcaagctgtaatctccctgaccgacggtgagggtgggtgggagggacattaaaaatctagagctttatcagcgaataccacgcactcccatcacttctcagcttggctggcggaacttggggaaatctggggaagagtaaatggacgtggtctccgtctaccgagacttgattggg

SEQ ID NO: 26786 - DNA, 71 bp, Homo sapiens
  misc_feature 1..71: note = chr1:197890716-197890787
  misc_feature 1..71: note = hyper
  source 1..71: mol_type = genomic DNA
accgtgcagaaagggcggccccggaagcggaagagcccagcgctgggagtggacatcgtcaattacaactc

SEQ ID NO: 26787 - DNA, 240 bp, Homo sapiens
  misc_feature 1..240: note = chr1:199998199-199998439
  misc_feature 1..240: note = hyper
  source 1..240: mol_type = genomic DNA
agcacacaaccatttcgcatctttttcgtcgggcagaaccgccgcggtgcgcaggcaaggagtccttcccggcagctccgcgcagctccggttccgcgtccggggccgcagctagagcgcgctcgggccggagacgcggactgcgcgcgcacgggggacgcgcgctcgggggctcgcgcccgcgcgggcggtcttgggctcctgctgcgcgcagccccagctggccgctgccaaaataga

SEQ ID NO: 26788 - DNA, 30 bp, Homo sapiens; identical to SEQ ID NO: 5860
  misc_feature 1..30: note = chr1:199998758-199998788
  misc_feature 1..30: note = hyper
  source 1..30: mol_type = genomic DNA

SEQ ID NO: 26789 - DNA, 50 bp, Homo sapiens
  misc_feature 1..50: note = chr1:200008515-200008565
  misc_feature 1..50: note = hyper
  source 1..50: mol_type = genomic DNA
cctcgccaccgccgccgcctgcgcccttgcggagccgaaccagagggccg

SEQ ID NO: 26790 - DNA, 401 bp, Homo sapiens
  misc_feature 1..401: note = chr1:200009750-200010151
  misc_feature 1..401: note = hyper
  source 1..401: mol_type = genomic DNA
gctaggaaaagtcaccggtgctcttccatcctcgccccttccagggtgcaggatgtgcgggccggcgggcctgtgatcccggaacgcttcctgccatccccttgcgcgaacttgaaaggactgggaggtgttgagagcagagttcagggctggtgcactctgcggtgctgagtgggcggcgcgcccgggcgctcaggccgggggacctgtagtcgccctaccgcggaggggaaaatacgtagctggagggcgtgcgccgtgcgggttgtgatccgttaccccatcggtcatcctggggtctccccaagcctctaggtagggctgtgagagtcccctagagctgaagccccggaggctgacctgtgggtctggctgctatgggaacccggttggtccaaaga

SEQ ID NO: 26791 - DNA, 361 bp, Homo sapiens; identical to SEQ ID NO: 1862
  misc_feature 1..361: note = chr1:200011323-200011684
  misc_feature 1..361: note = hyper
  source 1..361: mol_type = genomic DNA

SEQ ID NO: 26792 - DNA, 419 bp, Homo sapiens
  misc_feature 1..419: note = chr1:200011685-200012104
  misc_feature 1..419: note = hyper
  source 1..419: mol_type = genomic DNA
ccactgattaacttaaaacaaactcggctgcgtgtttgtgcgccgttgggtagcaggaggtagagcctaggcgagagcctggtgcgcccacgggtttcgccgaagagtgcccgggggagtgcgggcagggtcccggctgcgcagacctgcgggtgcccgcccacccgcgccccgcgctcccatacttgacctgtgtggatgtggagtctccgggaaataccggatcaggcacttcctggggtctcctggtcactgcccttcctgtgcatagtttgtcatctttttagctgcgaagacgccttcgtgggtctgcgtccggagcaaggcggttacccgatcccggcagtgagccgcgccgcgcgtcgtggcggcctgatttctgtttaactttaatagggcgatctcgaggtgtttatatt

SEQ ID NO: 26793 - DNA, 266 bp, Homo sapiens
  misc_feature 1..266: note = chr1:201252527-201252793
  misc_feature 1..266: note = hyper
  source 1..266: mol_type = genomic DNA
agtgccctgcagctccgcgtctgagcagcagcagcgcgcggcccggtggagtgggtggtgcagggcaggggtggtatatcctgtctgacggagggcgggcctcgccagtgccagagagggacgaaccagggtggaagcgccaggagcagctgcagggagccctcacgcggaccacgcactctatggccgtagggagccgctgagagcgagaagagcacgctcctgcccgcccgctgcaccgcacctcgcctcgcctctctgctctc

SEQ ID NO: 26794 - DNA, 42 bp, Homo sapiens
  misc_feature 1..42: note = chr1:201437622-201437664
  misc_feature 1..42: note = hyper
  source 1..42: mol_type = genomic DNA
tctgggcgttccagccgggatcttccagggggcagcggaagt

SEQ ID NO: 26795 - DNA, 105 bp, Homo sapiens; identical to SEQ ID NO: 5866
  misc_feature 1..105: note = chr1:201437682-201437787
  misc_feature 1..105: note = hyper
  source 1..105: mol_type = genomic DNA

SEQ ID NO: 26796 - DNA, 73 bp, Homo sapiens
  misc_feature 1..73: note = chr1:201438552-201438625
  misc_feature 1..73: note = hyper
  source 1..73: mol_type = genomic DNA
tgaagggggagatggcggggaagggagggggaaggcgcatctcctcgattggagagcgcgctgctagcaaggg

SEQ ID NO: 26797 - DNA, 218 bp, Homo sapiens
  misc_feature 1..218: note = chr1:202183428-202183646
  misc_feature 1..218: note = hyper
  source 1..218: mol_type = genomic DNA
gcaggacccagaaaccgacgcgacgggtggggcgctacccgggccggccctaatccccttccattgttctgggagccgaggccgcctccccacttccggaccctttcagccatggagcgggcggcgcgggcaggggcgggcaggggcacggccaggcgggctggggtgggcaggggcgcgcgcgcgaggctggtccccgcccccggggccgccgctta

SEQ ID NO: 26798 - DNA, 234 bp, Homo sapiens
  misc_feature 1..234: note = chr1:202611761-202611995
  misc_feature 1..234: note = hyper
  source 1..234: mol_type = genomic DNA
catctcaaccctggacggctgcggcaaggcgggggcgctcagaaaggcagccagtcctgcaaaccgcccgtgcctccggcacacccccctctgcgccaggggctccccagtgtcgcgcgagcatggtcttccagctcctcctcagcgaggcaggcgctgcagggtcccatgcgccccgcacccacttctctccgcacgcccacttcatgcacctccccgcgcccttcccacggc

SEQ ID NO: 26799 - DNA, 127 bp, Homo sapiens
  misc_feature 1..127: note = chr1:202613418-202613545
  misc_feature 1..127: note = hyper
  source 1..127: mol_type = genomic DNA
agaagggctctgccacggacccgacacctcccacctccacaactctgctttctcccacttgggaaaagcgaggctgacacccacggtgagcaccaggaggggcagggaggaccgagagcctgggcag

SEQ ID NO: 26800 - DNA, 133 bp, Homo sapiens
  misc_feature 1..133: note = chr1:202678970-202679103
  misc_feature 1..133: note = hyper
  source 1..133: mol_type = genomic DNA
accttccttggagaccgctagggctggcgggggctgggctagacgcgagtgggttcgtcccagggaaaggagagagggacgggggcgcagagccggccggtgcaggggacgcgtggcccgcccctctctgcag

SEQ ID NO: 26801 - DNA, 369 bp, Homo sapiens
  misc_feature 1..369: note = chr1:202679339-202679708
  misc_feature 1..369: note = hyper
  source 1..369: mol_type = genomic DNA
ttggagagggaggtccgtgcccccaccggcgggggtatggacttaccggagagcgacccgaaggaggcgggagagatccggggtctccaatgtgagggggcgtcggacggcaaggacgcgtggctggcgacggtttcgcaggggcgcccgttcccctgggggcgcgaagtccccgctccaccgctgccccaactcggctccgaagtgcctttgccgcaagacttgctgagcttagcagtctgcgccgaggcggcagagggagggggcctgatcgatgggcgcgcgcggcgagcgctgcagtgaggggaggagaccaagcggcgtgggagggcggggaccgaggcggaggaggcccggaggaggcggagg

SEQ ID NO: 26802 - DNA, 23 bp, Homo sapiens
  misc_feature 1..23: note = chr1:202936931-202936954
  misc_feature 1..23: note = hyper
  source 1..23: mol_type = genomic DNA
atcgcgcccggccccaagatctt

SEQ ID NO: 26803 - DNA, 136 bp, Homo sapiens; identical to SEQ ID NO: 5870
  misc_feature 1..136: note = chr1:202996095-202996231
  misc_feature 1..136: note = hyper
  source 1..136: mol_type = genomic DNA

SEQ ID NO: 26804 - DNA, 15 bp, Homo sapiens
  misc_feature 1..15: note = chr1:202996304-202996319
  misc_feature 1..15: note = hyper
  source 1..15: mol_type = genomic DNA
cggtggggtggaagg

SEQ ID NO: 26805 - DNA, 179 bp, Homo sapiens
  misc_feature 1..179: note = chr1:203087019-203087198
  misc_feature 1..179: note = hyper
  source 1..179: mol_type = genomic DNA
gaacccagcacctagcgcggcggagcagggaactcaggctgcgggactggggtctggccctgcccagctcctcgcccacgcccaggcttccgttaggccagcagggggaccccgagccccggacaacagccctgagctgggcggctgcttctggctctagatcccgctgctcagccgat

SEQ ID NO: 26806 - DNA, 135 bp, Homo sapiens
  misc_feature 1..135: note = chr1:203096868-203097003
  misc_feature 1..135: note = hyper
  source 1..135: mol_type = genomic DNA
cgggggcgacagagccgcaggcgcccgagtcgagtcccagccagctaccatccctctggagcttaccggccggccttggcttccccaggaatccctggagctagcggctgctgaaggcgtcgaggtgtgggggca

SEQ ID NO: 26807 - DNA, 161 bp, Homo sapiens
  misc_feature 1..161: note = chr1:203097280-203097441
  misc_feature 1..161: note = hyper
  source 1..161: mol_type = genomic DNA
ccttgtcctgggctccgtccccagacccacgtctgccaccccagtcccaggtgcgaaacaggggcgctacctctttaaaagcgtccggggctgagtctctgccgtaccatgtgattgcttgaaaggccgggctgggagcgctgcggcgggagccggaggac

SEQ ID NO: 26808 - DNA, 130 bp, Homo sapiens
  misc_feature 1..130: note = chr1:204653466-204653596
  misc_feature 1..130: note = hyper
  source 1..130: mol_type = genomic DNA
aacagatgggagctgcggcagcctgaggaacagagcacaaagcccagctgacattttccttcctgttcgtttgggtgggggaggaagggtagggagcacagtgctacccccggggcccctccccaggttc

SEQ ID NO: 26809 - DNA, 227 bp, Homo sapiens; identical to SEQ ID NO: 1864
  misc_feature 1..227: note = chr1:204653792-204654019
  misc_feature 1..227: note = hyper
  source 1..227: mol_type = genomic DNA

SEQ ID NO: 26810 - DNA, 83 bp, Homo sapiens
  misc_feature 1..83: note = chr1:204654686-204654769
  misc_feature 1..83: note = hyper
  source 1..83: mol_type = genomic DNA
gccctgggcgcgtcgcggccggaggctggcgggcgagagccaggcgctccttgagagcgccgcgcgttcgcaggtgcccggag

SEQ ID NO: 26811 - DNA, 145 bp, Homo sapiens
  misc_feature 1..145: note = chr1:204797791-204797936
  misc_feature 1..145: note = hyper
  source 1..145: mol_type = genomic DNA
gtctctgccctaatgcggcggctggcggcgagaggcgctgcaggggacgcgggggaagtggcggcgccggcagcggacagctcggacagcgcccagggccggagcccgagcccttggaggtaggcgagcgcgaacaccggagaga

SEQ ID NO: 26812 - DNA, 129 bp, Homo sapiens
  misc_feature 1..129: note = chr1:204798148-204798277
  misc_feature 1..129: note = hyper
  source 1..129: mol_type = genomic DNA
ttctatctcgttggccgcgtcccctcccccttcccgcatcctcaaccctttccctttcctctctgtccccgcctcatccgtgagccctgcctgcccttgtacttctgtttacctcgacaccccactttg

SEQ ID NO: 26813 - DNA, 405 bp, Homo sapiens
  misc_feature 1..405: note = chr1:205312507-205312912
  misc_feature 1..405: note = hyper
  source 1..405: mol_type = genomic DNA
ggtgacggccacccccgcccgggctgtgggcagccggggcaaggcggtccactggtcggcctccggggagtagacctcgaagcagtccatggggacgccgttgtcgtcacatcccccgatggcatagacctggcccccggtctccagcagggagcagtagacccggcggctgggcagtggcgccaggcgcttccactggaagtccttgacgttaggcacctccatggcagccttggggagcgcccgggcgccgggagaggtgcgagcgcgggggtccaccggctacttggcgccggctcccacggcccctatcgccacctccatctggctcccgagcgccggacccagccagaccccggccagtgcttcaccgtgccccgagtctcagcggtccggcggcgtcca

SEQ ID NO: 26814 - DNA, 45 bp, Homo sapiens
  misc_feature 1..45: note = chr1:205312961-205313006
  misc_feature 1..45: note = hyper
  source 1..45: mol_type = genomic DNA
cgcgccctccggcgggcagcggatgggctccgcagcccctggtca

SEQ ID NO: 26815 - DNA, 453 bp, Homo sapiens
  misc_feature 1..453: note = chr1:205399652-205400105
  misc_feature 1..453: note = hyper
  source 1..453: mol_type = genomic DNA
tcctggaatgggatgcgtggttcccatgagacaggagaaagccgcccatcaccgtggagaaccaggaatggcagaccacgcggacgccaacagtttacgcagctccccagctaggtgcaaagtggccaaaggaagagccggtcttccacacgcacacctccgcgcccacactgccccaggagcttcccactcagccgggggacccccaagcagccggcgaggcgcactgcgcacgcgcactcaggccgcggctccagccgccctccctccgcagtggggcgccccgcccccgcgccgctcagttttaaactcgcagcagacggaactcgacttaaaaataactattttgacagttcagatgtaaatatgtgagtgacgcgtggggctgtttttccttcacacttcccctcacccctcgctccctaccccagctcaattcggctgaggctgaga

SEQ ID NO: 26816 - DNA, 367 bp, Homo sapiens
  misc_feature 1..367: note = chr1:205424654-205425021
  misc_feature 1..367: note = hyper
  source 1..367: mol_type = genomic DNA
ggggtataaaggaaacggaggaggcactccaagcgggtttcactcagcggggacaggaggatcggctacctccggagccaaggctccctctcacactccccccaatcccaccagcggcaaaatcctttaaaaggaacaaaggcaatgggggcggggagggggcttcctctttggtcgacctagggcggcggctgacgcagcccgccgccggtcagctttcaggtgagtgcctgaacccgcatcccgcccatgccttagggacccctcttcgcccagccaagcccggggcggggaggaaagtccccctcagccgcactcgggcccccaacccggccaaggggtcgccaactcgcggcactttctgcct

SEQ ID NO: 26817 - DNA, 535 bp, Homo sapiens
  misc_feature 1..535: note = chr1:205425423-205425958
  misc_feature 1..535: note = hyper
  source 1..535: mol_type = genomic DNA
ccctccatggccccacgagccacctccacagcctcgcgccttcccggggtcgcaacgcctatcacaagcttctacccgggtttcagggggcccctgtagtggcgtgggcgccgcgccggtgccgggagaccccctcgtgcgccctctgcggtcggggcagaccctcagccggagcttcttcctcccccacccctgcaggccgggcccaagctgcgacacccccagcacgggctcagcctgtgaacaaactccgagctcagtactcggaggaactggcgagagcgggacggctacctgcccgcacgcccgatttccgggcacagctagaaagaccgggacgcgattcaactcccaatccggtgaatccgcctagcgccttcgggtcctgccgcccccggccagtcccgacccgcacacatatgcaggcatttgcacacacgcgcgcacacacatgcacgcacatgcacacacacatatgcacaccctcgcgcacacagacactcccgcgcgcgctcacgcccgcacacactcaggg

SEQ ID NO: 26818 - DNA, 493 bp, Homo sapiens
  misc_feature 1..493: note = chr1:207627640-207628133
  misc_feature 1..493: note = hyper
  source 1..493: mol_type = genomic DNA
cactatttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcggtgagctgggagggggagcacggaggtggggacgcgtcccgggcagggaaagtttctgtgccgcgatgcaaagcagggggccaaaagcgagacggtgggggcagtgctcgacgcgtgtccgcctcccgctagctttgagggaccactgcaataaaccgcctggtcctgattgtccccactggcccctccgggagctgggacctccagaattggaggctgcgccacagaggggcgctgtctggtcggcccggtgtggctggcggcgtgcgggtgctcgcggtctcctgccgggctccccgcccccaggattct

SEQ ID NO: 26819 - DNA, 467 bp, Homo sapiens
  misc_feature 1..467: note = chr1:207669321-207669788
  misc_feature 1..467: note = hyper
  source 1..467: mol_type = genomic DNA
cgcgggatccatcggaagcccgagcattgtcaagctctgctgctgcacctgggtcagcaaggtgggctctgccagcgaaactcgttagaaacaatgcaaatggggagtaaacatgacctcgcccatgaaggggaagctgtggtcaaaagcattttgtcccggaaccccgcagccctccccacactctgggcgcggagcacaatgattggtcactcctattttcgctgagcttttcctcttatttcagttttcttcgagatcaaatctggtttgtagatgtgcttggggagaatgggggcctcttctccaagaagcccggagcctgtcgggccgccggcgcccggtctccccttctgctgcggaggatccctgctggcggttgtggtgctgcttgcgctgccggtggcctggggtgagaggcgggcgggcgtggggaggcgcccgggcggacgaggaacccggggccc

SEQ ID NO: 26820 - DNA, 232 bp, Homo sapiens; identical to SEQ ID NO: 116
  misc_feature 1..232: note = chr1:207669828-207670060
  misc_feature 1..232: note = hyper
  source 1..232: mol_type = genomic DNA

SEQ ID NO: 26821 - DNA, 15 bp, Homo sapiens
  misc_feature 1..15: note = chr1:208083989-208084004
  misc_feature 1..15: note = hyper
  source 1..15: mol_type = genomic DNA
tcctccccagtctcc

SEQ ID NO: 26822 - DNA, 652 bp, Homo sapiens
  misc_feature 1..652: note = chr1:208084031-208084683
  misc_feature 1..652: note = hyper
  source 1..652: mol_type = genomic DNA
cgcctctggcaaccagaagagaccctggcatctccaaagcgctttatctcagtccattggaaccagtcgtgctgaccgattcacacctcggctaacgcacactcgcgggggtgatggccttcccttcccctcccacccccgtcagctcccaggtgaggcgctggccccggggggaagcagctgtgggcggcagtgcgtgggttgggcaggggtcccttccctccgtgagactctgctctgctgttcagcctcccagaaagcctccaccctccccgcggcgaagccaagcggccgcggcgcgcgggcggtactcacgcagcaaactcagcaagcaaagcgcggtccagccccgcggcatcctgggccctgcgcgcgcgcccctgcggaccagcatccttcccgcgcggctcctagagagacgcaccgagtggaagacactactcggcttggccaggacgcgctcttcccgccccctccgcccgggagaggggtgggggattcttgcttttttcctctcttctcccctccctttttagtcttggcaaggcagcgcctctccttggctgctactaacttgagctcccctggttggtcccaaaggcggagggcgttaggagggaggctgggttgccgccgtcgaggccaaaaaagg

SEQ ID NO: 26823 - DNA, 64 bp, Homo sapiens
  misc_feature 1..64: note = chr1:209381523-209381587
  misc_feature 1..64: note = hyper
  source 1..64: mol_type = genomic DNA
ccattgccctcagcccgcagttcacggccagccccagtgagcgcccttgcggaggagctgtggc

SEQ ID NO: 26824 - DNA, 139 bp, Homo sapiens
  misc_feature 1..139: note = chr1:210111283-210111422
  misc_feature 1..139: note = hyper
  source 1..139: mol_type = genomic DNA
cgtggctctccgggccgggcacctgtttcgaatcgaggcgcgaggcgcggtggggcggtggggtggggtggggtaggttggggtgggggcggggtggcgtcacgtgccagcggcggccccgggaaggttccatttcttc

SEQ ID NO: 26825 - DNA, 127 bp, Homo sapiens
  misc_feature 1..127: note = chr1:210111796-210111923
  misc_feature 1..127: note = hyper
  source 1..127: mol_type = genomic DNA
cgctgggacgccgggcccgactggctcgctcgccccggccttcgtggttttgccggcctcccggcggccgcacgcggggcaaagcgggctggcgggcaggtacagcgtccgggccgccgcctcctgc

SEQ ID NO: 26826 - DNA, 31 bp, Homo sapiens; identical to SEQ ID NO: 5883
  misc_feature 1..31: note = chr1:210112036-210112067
  misc_feature 1..31: note = hyper
  source 1..31: mol_type = genomic DNA

SEQ ID NO: 26827 - DNA, 30 bp, Homo sapiens
  misc_feature 1..30: note = chr1:210405727-210405757
  misc_feature 1..30: note = hyper
  source 1..30: mol_type = genomic DNA
aaagacaagatatctcggaaggttccagag

SEQ ID NO: 26828 - DNA, 48 bp, Homo sapiens
  misc_feature 1..48: note = chr1:211306737-211306785
  misc_feature 1..48: note = hyper
  source 1..48: mol_type = genomic DNA
cccattctgaggcagcggggacctggagttgcccgtctctactgctgg

SEQ ID NO: 26829 - DNA, 267 bp, Homo sapiens
  misc_feature 1..267: note = chr1:211307126-211307393
  misc_feature 1..267: note = hyper
  source 1..267: mol_type = genomic DNA
gctggctccgagcggcgagaggttctgcaataaaggcacggataaaacgcccgggtaatcgaaatccgaatgcacctcttaccattggaccgccgaacaatattctccagaaacgtgttttgaggggccactagtcccctcctgcccccagccatggtcatcctcccagcagctcggggtccggcgggcgtcctggcgcggcttcttacgacagcaggaaactggcctcggggcccgcacgcagtcccggctcgaagcgccccatgc

SEQ ID NO: 26830 - DNA, 86 bp, Homo sapiens
  misc_feature 1..86: note = chr1:212874013-212874099
  misc_feature 1..86: note = hyper
  source 1..86: mol_type = genomic DNA
ttggggatctggacccgccatgccacggttaaacggcccagatcatttttctttttcaagatttatctgctcgtgccaagctgggg

SEQ ID NO: 26831 - DNA, 1034 bp, Homo sapiens
  misc_feature 1..1034: note = chr1:213123589-213124623
  misc_feature 1..1034: note = hyper
  source 1..1034: mol_type = genomic DNA
cgcggggtcacttctcgggtggttttgtttctcctctgcttccacagttgcaaaccctcgaagtgccacgacccctggggaaactcgatcttaagtcccatggccaaacgctccagcccgcggggctctcaggacaccacagcgatcggatttcgcgtggccgccaggctccccctactcctgtcccctcccgccagagaacccctggagccaatcagagcgtcgcggagcccggggttgtagagtcccgagcccgggacccgcccctctttgttgcggtggccaatagacgcattcggaacatcggcggctgcccgggtgacttggttatatgtcacagaataacattcgagaatgggacatggaatgaggcgacggccccagcaagccccagcagccccagccccagccccaggcccagcagcagcagcagcagcccctgctctcccgccgcccggagaggctctgcagccatgaagccaaccgtcccgaggtaggatcttggagctgccgcgcgcccttcctgcgcgccgcccgcctgcagccagtccctcccggtgataggcgctggaactcggggaaaagggggcggatggagctctttccactagatccccgccggggtccgggagggcttcctggaagaaagcgggccgccttgcaagccaaggctgctgcagcgccctcgcgccagctctgggcgctcacatgccagcacgttcgtggctcccctcctctcttggccacatctgaggacccaggaatgtgtggagccttgcgggaacctcctgttccttcatgctacacaagctgtctttcttctccccacatcttgcgctccgcatcccccaagctccttgtgcccctccatccccaaccccccgggtttaggtgtgtgtgaagcttcgtggcacattttgagctgcctttctaggtaatcgcagggctggaagcccgtcatcgattctcagggaggctgtcagcgtgcaggggggagcggggagtgtcgtggagacactccgggacccctcact

SEQ ID NO: 26832 - DNA, 365 bp, Homo sapiens
  misc_feature 1..365: note = chr1:213124668-213125033
  misc_feature 1..365: note = hyper
  source 1..365: mol_type = genomic DNA
cgctgatttcaggcaccgccggtaagcagggagcctccgcggagctcccgccgccgctcccccttggtgagtcctgccgcagcgagaggcatggagaaggccgcccccgcggggcgctgatcccctcgccgcgcccgcgcgcacacgccccccgccgccgccgccgctgccgccgccgcgcgcccccagtacctcgctccccgcccaggccccaccatgaccggctccgcggccgacactcaccgctgcccccaccccaaaggcgccaaaggcacccggtcccggagcagccacgcgcggcccgtgagcctcgccaccagcgggggctcagaggaggaggacaaagacggcggggtgctgttcca

SEQ ID NO: 26833 - DNA, 30 bp, Homo sapiens
  misc_feature 1..30: note = chr1:214155741-214155771
  misc_feature 1..30: note = hyper
  source 1..30: mol_type = genomic DNA
cttctcttttcgctgcgtcaggcaggcacc

SEQ ID NO: 26834 - DNA, 98 bp, Homo sapiens
  misc_feature 1..98: note = chr1:214155985-214156083
  misc_feature 1..98: note = hyper
  source 1..98: mol_type = genomic DNA
ttccatcccttcaaacgtgcacgcccctcccgcggtcccgggagggagtcccccctcccaggtcgagcgcgtccaccggctgtccccacagcaacagg

SEQ ID NO: 26835 - DNA, 60 bp, Homo sapiens
  misc_feature 1..60: note = chr1:214156134-214156194
  misc_feature 1..60: note = hyper
  source 1..60: mol_type = genomic DNA
cgaaatcccccggccaccacgacgttccccggctctgcggcgcgccgggagcaggtggtt

SEQ ID NO: 26836 - DNA, 241 bp, Homo sapiens
  misc_feature 1..241: note = chr1:214156417-214156658
  misc_feature 1..241: note = hyper
  source 1..241: mol_type = genomic DNA
ggccgcgacacctagcgcggggccgaggctaggaagggcgggccggggagggaggagggcactgggaggaagccgcgggcgaggaagccccgctcctgccgagtgcctggagaggagattcccagccttcctgcccaacccgaaacttttccaacacacgcaggcgtattcctcgcaggattcggcggtcccgagtcgcagtcagggaggaggctcgggaagcacacgtgccctggcacac

SEQ ID NO: 26837 - DNA, 57 bp, Homo sapiens
  misc_feature 1..57: note = chr1:214156893-214156950
  misc_feature 1..57: note = hyper
  source 1..57: mol_type = genomic DNA
actccccttgagttgcggcccgagactgcctttgtacttaagcgacagcaaaagata

SEQ ID NO: 26838 - DNA, 109 bp, Homo sapiens
  misc_feature 1..109: note = chr1:214158802-214158911
  misc_feature 1..109: note = hyper
  source 1..109: mol_type = genomic DNA
atctcgctcgcctagcgtggcgcgcgctcctatttcaagtcgccgctcctgcgccctaatgcgggctgcgaaccgccgcggcagagcgtcgcgagccgggagcctctgc

SEQ ID NO: 26839 - DNA, 110 bp, Homo sapiens
  misc_feature 1..110: note = chr1:214159571-214159681
  misc_feature 1..110: note = hyper
  source 1..110: mol_type = genomic DNA
tgcttccgtgatagacgcgtggggggagtgtgtgggggcggcaaaaggggaaagaagaaggctggggatgctcccgcaatctcttttcttatcgccgacacctaacctga

SEQ ID NO: 26840 - DNA, 186 bp, Homo sapiens
  misc_feature 1..186: note = chr1:214160132-214160318
  misc_feature 1..186: note = hyper
  source 1..186: mol_type = genomic DNA
gcccggtgaaagggacgttctagctgcggctgaggctcgcttgcatttgtaacttgcaaagcccaaggagatctttaagagccacattatctaaagaaattttgctggttatttttcaagcaagaaatgtcaaaccaaagtaaattttctagggctttattttagagcctgcgatttatgcgtttg

SEQ ID NO: 26841 - DNA, 353 bp, Homo sapiens
  misc_feature 1..353: note = chr1:214162457-214162810
  misc_feature 1..353: note = hyper
  source 1..353: mol_type = genomic DNA
accccagcagaggaccgggaactgggaggaggagagagggaggtgggggggcgctctgttactttcgtctcaaaacgctgtcgaagccgaattgtggaaatccggcttggaggggagcggtgatgggtcccgggaaacgcgcgcggcgcccctcttccgagctcctggacccagggctgggtcaagttgagtagggtaaggcggcaccgggaggctcggggggtcgcgtggcggtgggattgggacaccagcacgaggaggaccggaggatcgcgggccgggtaagagtagggggttcttgggcagcagaaatgggaggcgatgaatctcccagccatcgctggcagactatg

SEQ ID NO: 26842 - DNA, 245 bp, Homo sapiens
  misc_feature 1..245: note = chr1:214360508-214360753
  misc_feature 1..245: note = hyper
  source 1..245: mol_type = genomic DNA
aacacactctggaaacgctgtggttgtttttcacaggaacccagggagctatcaaagtcggagaacgtgcctctgtttgcaggagaggtgggcaggcagcgagatccccgcgcaccgctcgctcgggctgcgggcaggcagcaatcagctaattgcctaatcggagtggggagctggtgcccgctcgccgcggtcgcctcgcgggtcacagacaagagagcggcttgttttctctctgtcacatc

SEQ ID NO: 26843 - DNA, 105 bp, Homo sapiens; identical to SEQ ID NO: 5895
  misc_feature 1..105: note = chr1:214360754-214360859
  misc_feature 1..105: note = hyper
  source 1..105: mol_type = genomic DNA

SEQ ID NO: 26844 - DNA, 114 bp, Homo sapiens
  misc_feature 1..114: note = chr1:214360926-214361040
  misc_feature 1..114: note = hyper
  source 1..114: mol_type = genomic DNA
cgcgctctgctcagctctacccggctccgctctcaggcgtgtgctcagaacacaccgagatcctttagaaataaatgtaatcgagactaatctggaaatcgtccctgcagccaa

SEQ ID NO: 26845 - DNA, 128 bp, Homo sapiens
  misc_feature 1..128: note = chr1:214387629-214387757
  misc_feature 1..128: note = hyper
  source 1..128: mol_type = genomic DNA
tctccttcctcaaagcgagctccagagtagaaactgcaattgtgtatttgaaattctccagtcaccaaatccaagaaaggtgaagaggaactgccccagtggcgtctgcgaggcgtttcctctataaa

SEQ ID NO: 26846 - DNA, 126 bp, Homo sapiens
  misc_feature 1..126: note = chr1:214725407-214725533
  misc_feature 1..126: note = hyper
  source 1..126: mol_type = genomic DNA
gtggagagagcaaggcgaccgcagccaccccaaccctgggctgctcccgccgttggggagaaagaggcaaggcaaggaagagcccacctagacttccgaggaccgcagagacggggcggcggcagg

SEQ ID NO: 26847 - DNA, 934 bp, Homo sapiens
  misc_feature 1..934: note = chr1:215255060-215255994
  misc_feature 1..934: note = hyper
  source 1..934: mol_type = genomic DNA
tcatcaggggattcccgctgagaaagtgggaaggaagagagtttagaaacggattgaagttccactacatcacgtgtgttgttagagaattcgcctattacgacgacagcaacgtctgatctcctggctttcttcccctccttggtgggttccgttccgtccccctgtcgctgcgagtttggctgtccctacgccggggtcttggagtttgggcggggtctggtacctgccaaatacggatcctgatggggaggaggtcggggagcgctaagttcaggctggagtctgagttctcccaccctgctgctcccacccaccgcgcttagaaacctatgtttccagcaaaggggtcttgctctgagagaacctaaccgggttttcttccattccctttgcatctctagatgtcttcgccctggctccaggtgcgttccccatccttttcggtcccggacgttctgcagattatagcgcccagctcatgtccagcaccgccggaggtgaagtggggcgagctggtgactccttaacccttcccgaaggtgtagactggaagaagccagggtcttcattacctcccctactccagggctctcaaggcgccaacggggacacttccctgtacaggtctggggggccacgagggcgaggaggacgccctagtgcaggggtccaaggactcgcgtcccagagcttggtcccacacccggtcccacaccccgaacgctggtcgggaaggagataggatgcagcgcagtgtgatgtggatgccagacagcgagagtgaggattttgcggggtggggatgggggttagtggaaggggctgagaggggaggaggcagcaggtgagccaaggggttgtgcccccaggaagagggaagagaggatctttagaagggagcatcttgcaggggcgacgcaggcaagggtag

SEQ ID NO: 26848 - DNA, 606 bp, Homo sapiens
  misc_feature 1..606: note = chr1:215256219-215256825
  misc_feature 1..606: note = hyper
  source 1..606: mol_type = genomic DNA
cgaagaggggctgaacgaggctcgcgcacaaagacgccggggcgcacggcagctggggctgcacccaccgcccccgcgccgcgccgtgccggggccgggccagcgagcagcccggggctgagcgcgtggcggcggcggcggcggcggcggcggcgggcaggcgcgggacccgggtcgcccgcgctctccgggtgacccgggcccggcagcaggcgcgcgcgggggcggcggcgcccaagcccaacttggcctccgcctcgccctctgcccagcccgccggtgtcccctccttcccgcgatttcgtttcttctcacgctcccccccccgccccctcccgcgtccagccccgctctccccaccttgtaaaacaaagccggggaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggaggtgagaccccccctccggtacccccacccctctggccgcacgctctcctgc

SEQ ID NO: 26849 - DNA, 100 bp, Homo sapiens
  misc_feature 1..100: note = chr1:216896454-216896554
  misc_feature 1..100: note = hyper
  source 1..100: mol_type = genomic DNA
acacaaacaagcagtcgtgcacacaaaatacccagggcattacctgaatcagtgtgtaaagatatagtctgtccgcccccacccccgcacccccacgacg

SEQ ID NO: 26850 - DNA, 87 bp, Homo sapiens; identical to SEQ ID NO: 5901
  misc_feature 1..87: note = chr1:216896887-216896974
  misc_feature 1..87: note = hyper
  source 1..87: mol_type = genomic DNA

SEQ ID NO: 26851 - DNA, 145 bp, Homo sapiens
  misc_feature 1..145: note = chr1:217262983-217263128
  misc_feature 1..145: note = hyper
  source 1..145: mol_type = genomic DNA
ctttaactgggctcccgcgacctcggcaggcgagggggtgctggccggccctccggtggcaagggcacggccccccgctctgcccccgcgggcgcggggccggcctggcacccggggtccgcgtcccgagcggctgtgcactcac

SEQ ID NO: 26852 - DNA, 1211 bp, Homo sapiens
  misc_feature 1..1211: note = chr1:217307486-217308697
  misc_feature 1..1211: note = hyper
  source 1..1211: mol_type = genomic DNA
agggaactggggatgcgagctgggaacagaccgcgctccagcccccatggtttgtgacggggaacttcgggcgcacacaccctggggagtaggtctcctccaaatggcaccgacacagactggcgctggatcttctctccctgctaatctatccgcaaagaccgcctgggcacttttgggggaatgtggccaaaaggggactctaactgcgacatctacagaggaaggagaaactggtggtgcctaagaagttgatctcgatgcgcgcagtgagggcacagggccctgcgcgccagagaagcgaagccagcggtctccacttacttgttcttaattcctccctacccccgctctggcctctcattttcggcctcatggatccaagacccgaggttattttcagtcacaactttctccacaccccgtacccccaaaagtgtacctcagctcaggcgggaaagggcactttgacccgccgtgcgcgagtttccagccagccgctgcgcgcctgagagaaagagcgcctggctgcggctccgagcgcacagctcttccccgcgtgtttggcgcggctacgtttctcttgctccgggctgaggctcgaggaacctcgccagcctgctgtggtcccgtccccttgacgtttgatttctaaaaccgcatagtctgcggctctggcatttagaaaaagaggacaaggtcaaggcctgtggaccgaccgccgcgatccgcttgcacctttgctctcacagcaagcgagtcctggccgcagccgctggaaaaaggtgccgcagcgcccagtttacctggaattcagggacctgaccctgactctatttccggctagtcccagcctctccttcctctcctttccccgctttccgcccagggcggttctgagattttgattaagagagatctgtccccgcaccgcagagggatggtgccaaatggccaggcttcctgggcactgcgtcctcattcccaggtcagagctactgcgaaaggaaaggtctccatctggacgcacctcgtcccctcccccagcgcgcggggcagccctctagggccagctcgggcacgcgcttttccccctcctcaccccctgctccgcccagccccgtacagttttattctttatgaaacacacacgcccaccccgcctcccacgtaaaggccagtcttgactcattttgcgcccagatgcaaac

SEQ ID NO: 26853 - DNA, 358 bp, Homo sapiens
  misc_feature 1..358: note = chr1:217308948-217309306
  misc_feature 1..358: note = hyper
  source 1..358: mol_type = genomic DNA
cgaagcggggtcaggcgcggacccacattcaccgactgcagaactgttttctttgccactaccagagggtgtttcggggctccccacggtcttctccctggctgcttgccgcgtgagagcagaaataaaacaaaacaaatcacgggacacgacggagtcgggccgctgggcgcctccgggatcgctctcactttgcactcggaagcgggcgcggggattcgggctgccgcgtgtagcctataaatagcaaactttttgaccgaagcaactaacaaataagaggagcaggcgtgcattttgctcaagatccccccttttctggggacgaccttactcccacccccgccccctttgcagt

SEQ ID NO: 26854 - DNA, 30 bp, Homo sapiens
  misc_feature 1..30: note = chr1:217309653-217309683
  misc_feature 1..30: note = hyper
  source 1..30: mol_type = genomic DNA
ttttagatggaagtgcgaaaggtgagtgcg

SEQ ID NO: 26855 - DNA, 39 bp, Homo sapiens
  misc_feature 1..39: note = chr1:217310204-217310243
  misc_feature 1..39: note = hyper
  source 1..39: mol_type = genomic DNA
ccagggtcaataggacgatcagcacggatgggtgtgggg

SEQ ID NO: 26856 - DNA, 757 bp, Homo sapiens
  misc_feature 1..757: note = chr1:217310871-217311628
  misc_feature 1..757: note = hyper
  source 1..757: mol_type = genomic DNA
gggcctgggaggctgcggtaccgcctgtcggtcccggtcccgagcgcgcttgcttaagagttctcaaagacggggttggaagcagtacagacgtccccggttatcgctgccgggcttgtgcgccccacgccacctacctgtccggccttcccgctccaattgctgacccgtttagggagcccggcctggagcccgccgcctccagaggagcccgccctcgccctcccccgcgcgcctccgctctctgggacgcctggccaaatgcggggcggtctctcgcgggccattggcttgggccaccgttccgagtcagctcctaggatttccccaggctttgcggcccctttgtgggtctaggccagcgcctcaccttgcaccctattccacctccagtccccttaggtgcccccgcatccctcctccagagtccaggctttgaaactgcagcaactccgcaaagaaagcctttgggaaaacctcctagagggccgaatgtggaggtcgggtgggtgggtgggtgggtactcgcggcatttctcaaggttctgggtgttcgtaactaggggaacaggccctatgggggcagaaatgacagacgcacgaacagcgtctctgtggctgtctgcagcgcgaggttcacgtctattgttttatgcctccgggagagctaccccgcgtgatagatcttttcagatccatcactggaagaaaaaccctggtgataacgattatctcccgctcgcgctatctcgccatc

SEQ ID NO: 26857 - DNA, 66 bp, Homo sapiens; identical to SEQ ID NO: 5907
  misc_feature 1..66: note = chr1:217311944-217312010
  misc_feature 1..66: note = hyper
  source 1..66: mol_type = genomic DNA

SEQ ID NO: 26858 - DNA, 18 bp, Homo sapiens
  misc_feature 1..18: note = chr1:217313025-217313043
  misc_feature 1..18: note = hyper
  source 1..18: mol_type = genomic DNA
cccctctgcaattgccgg

SEQ ID NO: 26859 - DNA, 679 bp, Homo sapiens; identical to SEQ ID NO: 5909
  misc_feature 1..679: note = chr1:217313068-217313747
  misc_feature 1..679: note = hyper
  source 1..679: mol_type = genomic DNA

SEQ ID NO: 26860 - DNA, 30 bp, Homo sapiens; identical to SEQ ID NO: 5910
  misc_feature 1..30: note = chr1:218337322-218337352
  misc_feature 1..30: note = hyper
  source 1..30: mol_type = genomic DNA

SEQ ID NO: 26861 - DNA, 547 bp, Homo sapiens
  misc_feature 1..547: note = chr1:218337623-218338170
  misc_feature 1..547: note = hyper
  source 1..547: mol_type = genomic DNA
cagctgattaagaagcggggggagtgactttctctgggctcttacggatcaatcaccgctaaggggatgcaggttgaggggaaggaagaaagtaaatcgcggggcagtttgactaagtgaaacccaattccttcgccccaaagctgtggtggccagacgtgcgcgaccctctagacccaaaacagttttagtcagcaacgggtcatcagcaggaccgagaagactgggtgggaggtctggccggtccgaaatagggaagaggtgcgggctcatcaccgaggcggtagggctcggcttatggtctagagccttgaggcgctcccgcgtgagccccgctgcttccagtccgccctcgcctggcccggcgcgggtcgctccctcctccccgtcctgttccgcactttacccagcaggggtcccaggtcgagcagggccaaccctgctcgcgcagcgccggacccctccccgctgcccggggtgcggcggcttccctccgcccaaacggggggtgtctcctccatcacccctgccgcggcttcccagtcgg

SEQ ID NO: 26862 - DNA, 278 bp, Homo sapiens
  misc_feature 1..278: note = chr1:218338508-218338786
  misc_feature 1..278: note = hyper
  source 1..278: mol_type = genomic DNA
gctagagagggaggccggcgaaacaaaagccgtagaggaaaattaagcgacttccccctcggcggggaacttggaggtgggggagcggggagcggcgcggggcgcaaggagaaggaagtgctgagctgggttgccgacgaaccccgggcagggggaggtggggggctgcggcagaagaaagacaaacatctggggatcggaccatatgccggagctttgtcttgtccttcaaagttcggctgcccttgaagtgatttgtcaggcggcccacgggtgac

SEQ ID NO: 26863 - DNA, 156 bp, Homo sapiens
  misc_feature 1..156: note = chr1:218339178-218339334
  misc_feature 1..156: note = hyper
  source 1..156: mol_type = genomic DNA
tctttctcttttgcccgccaaccgctgaactgattagactgtaattaaggccataaagccctcagattatacacctgtttattcactgaagtcggggtctcatcaagcaaattagctgcttgcaggctacacattgggcctcgagcttgcctgatt

SEQ ID NO: 26864 - DNA, 184 bp, Homo sapiens
  misc_feature 1..184: note = chr1:218520108-218520292
  misc_feature 1..184: note = hyper
  source 1..184: mol_type = genomic DNA
tacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagc

SEQ ID NO: 26865 - DNA, 173 bp, Homo sapiens
  misc_feature 1..173: note = chr1:218520309-218520482
  misc_feature 1..173: note = hyper
  source 1..173: mol_type = genomic DNA
cgagcgcgagaggagcgacgaagagtactacgccaaggaggtttacaaaatagacatgccgcccttcttcccctccgaaagtaagtacttattttgacttccatcccctgaggtttagctctgcccggagctctcaaaaccgcagcagctcccgggatcgcccttccctctcg

SEQ ID NO: 26866 - DNA, 45 bp, Homo sapiens
  misc_feature 1..45: note = chr1:219347215-219347260
  misc_feature 1..45: note = hyper
  source 1..45: mol_type = genomic DNA
tggcagtggcatcagcgatggcggctgcgtcggggtcggttctgc

SEQ ID NO: 26867 - DNA, 162 bp, Homo sapiens
  misc_feature 1..162: note = chr1:220101049-220101211
  misc_feature 1..162: note = hyper
  source 1..162: mol_type = genomic DNA
agaagaaaaagagggcgtggggtgagaagaaagggaccgggtgggaggaggaaggaagggccaagcggtccaaaggatgcaaccgaaaggcacctgctacgtttgcgaacacggtcgcccccttctcccgcttcctttccaccgaggtcccccggagggtta

SEQ ID NO: 26868 - DNA, 243 bp, Homo sapiens
  misc_feature 1..243: note = chr1:220101370-220101613
  misc_feature 1..243: note = hyper
  source 1..243: mol_type = genomic DNA
cgcagtcctggaagatgagcagccccaccacgttgaccaacagccccaggacgccgacgatgagcaccagctcggggtcatcgatgcgctcgggccgggccaggcgcagcacggcctccacgaagatggtgaagcagagcgcggtgaggaagaccgcgttgctcagcgcgcccaccacctcggcgcgggcgtagccgtaggtggcgctgaagccccgggtggggcgccgggcgatgtagccgg

SEQ ID NO: 26869 - DNA, 30 bp, Homo sapiens
  misc_feature 1..30: note = chr1:220101929-220101959
  misc_feature 1..30: note = hyper
  source 1..30: mol_type = genomic DNA
taacgcgaggccgagcgccaccagtccccg

SEQ ID NO: 26870 - DNA, 118 bp, Homo sapiens
  misc_feature 1..118: note = chr1:220700814-220700932
  misc_feature 1..118: note = hyper
  source 1..118: mol_type = genomic DNA
gagggtgctgcagggcgcccagagcgagacgtcttccgccggccccattcccgaagaggccgcgccgtcgggggctgagacccacttgtactgagtctccagccgcctccctaggctg

SEQ ID NO: 26871 - DNA, 303 bp, Homo sapiens
  misc_feature 1..303: note = chr1:220702162-220702465
  misc_feature 1..303: note = hyper
  source 1..303: mol_type = genomic DNA
aaatgtcggcccggacgccattgccgacggtgaacgagcgggacacggaaaatgtgagtaaccggagcctccctcgggagcagtgggggcgagaccctcctctgatccccacttcacccgcgcttgggccgtcccccgtgcctcggcgcggccacccgcggcagggtctccacctggagcccggcgtgaccctcacccactgctcagccctattcttcattccaaccccatttcgcttgtttcccctcaagggtgagggtagggaaccgtaagtggcgccctctcgctcggaggtggtcctcc

SEQ ID NO: 26872 - DNA, 90 bp, Homo sapiens
  misc_feature 1..90: note = chr1:220864103-220864193
  misc_feature 1..90: note = hyper
  source 1..90: mol_type = genomic DNA
cgggggagcgggagccgggtccttaccatcgactcacccagtttctccgggctgcacctgcgacccctccgcccccgctcccattccctc

SEQ ID NO: 26873 - DNA, 436 bp, Homo sapiens
  misc_feature 1..436: note = chr1:220921624-220922060
  misc_feature 1..436: note = hyper
  source 1..436: mol_type = genomic DNA
cgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggggtcgccgcgctaggactggccgccgtggccctggggactgtcgcctggcgccgcgcatggcccaggcggcgccggcggctgcagcaggtgggcaccgtggcgaagctctggatct

SEQ ID NO: 26874 - DNA, 243 bp, Homo sapiens
  misc_feature 1..243: note = chr1:220960315-220960558
  misc_feature 1..243: note = hyper
  source 1..243: mol_type = genomic DNA
gcgctttgtcctcctcgcgcaatcccggcccgggtggctcggggttgccgcgctgggcctgaccgcggtggcgctgggggctgtcgcctggcgccgcgcatggcccacgcggcgccggcggctgctgcagcaggtgggcacagtggcgcagctctggatctaccctgtgaaatcctgcaagggggtgccggtgagcgaggcggagtgcacggccatggggctgcgcagcggcaacctgcggga

SEQ ID NO: 26875 - DNA, 1203 bp, Homo sapiens
  misc_feature 1..1203: note = chr1:221052007-221053210
  misc_feature 1..1203: note = hyper
  source 1..1203: mol_type = genomic DNA
tagcctctgaggctccggggaaaggtttggctgcgtctaagagagacgtttggagccatccgtcttattttgtttgaaaagtcactcgttcaatttgtcactgtgtgacagctcagaataaaaccaatttgcggccgcccctcctcctcgcttcccggaggatctcctgggaggcacgaggcggacgcggtgctgagttgggccgggactcagggcggcaacatttgggcaagggcccaggaaagatgaggggctttgccgaggacacggactcctggaataaaagcagaatgaggtcaagagaagggaagcaaaggggccaaagcgcgctccgctctccaccgggaggcgggctttgcagagccctaaagagtgagattaccgtcccttccccacgcccccaactcgccccgggtgacaagcgcttcaggaaagctcctgtgatcaaccctccttgccccgtggcggttcggagctgcagaagttagaagagagtcagagccctccggagcggctgcctggcccctacgcagagtagcaagaagcactgcgatgtgcgctactaagcccacgcggccgcagcaaaaactttggcgtggccggggcgtggctagggtccggccaggcccccttgttcctaattcccctccactccccgctcccattggtcacgaggatgaccaatgagcgctcggatcgaggtcctaccccgggcctgactcgaaagctcctgccaaaactttgggagtttttagagacgagtttttttttttttctattacttttccccccccctaactaacggactattattgttgttgttttaaatttagctcttagggcttagctatttgggttttcttgcggtgtccggctcccgtctccctggctcccccgcccgccctgcggccccagcgcccctcgctctcatccagcccgcgaggagtgcgggcgccgcgccgcctttaaagcgaggccagggagcgaggcggtgaccggccgagatccggccctcgcctcctccctcggtggcgctagggctcccggcctctcttcctcagtgcgggcggagaagcgaaagcggatcgtcctcggctgccgccgccttctccgggactcgcgcgcccctccccgcgcgcccacccacccagtccggctggactgcggcagccgcgcggctcaccccggcaggatgttcgcagc

SEQ ID NO: 26876 - DNA, 496 bp, Homo sapiens
  misc_feature 1..496: note = chr1:221053255-221053751
  misc_feature 1..496: note = hyper
  source 1..496: mol_type = genomic DNA
cgcttactgctcctcggccggcccaggcggctgctccttccccttggaccccgccgccgtcaaaaagccctccttctgcatcgcagacattctgcacgccggcgtgggggatctgggggcggccccggagggcctggcaggggcctcggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacagcctccgcctccgccccgggctggcgccctgcagcccccggcctcggggacgcgagtggttccgaacccccaccacagtggctctgccccggccccctccagcaaagacctcaaatttggaattgaccgcattttatctgca

SEQ ID NO: 26877 - DNA, 351 bp, Homo sapiens
  misc_feature 1..351: note = chr1:221067466-221067817
  misc_feature 1..351: note = hyper
  source 1..351: mol_type = genomic DNA
ccgcaggctgctccccgagtcccaacgctactagggtgctgtaacagtgatgaggcggcgttgcagtctggctaggcgctgcagcgggcaccagctacgttttgctgtcggcggcagttacccggacgcaagttaaggggtaggcgcgcagaggcggttggaggcgggcggccggcccctgacctcggagagctgcgccgagcagggcggaaaatttatggtctgtgtacactttctggctccagagccccgcgcaccagaaggatggggccctgcgagcgcgccccaggccgcgagctggggccgcaggcgccacggccatgtatagtgcccacccgactctgttctgca

SEQ ID NO: 26878 - DNA, 211 bp, Homo sapiens
  misc_feature 1..211: note = chr1:221914261-221914472
  misc_feature 1..211: note = hyper
  source 1..211: mol_type = genomic DNA
tgcacatagcaaagacgccaaaccccacgccaagagacgctcacctaaacgaactttaagagctatcaggaaaaatgccatctatcatccgtctacacacgaccgtcaccattctcatccgtctacacacgaccgtcaccattctctgacacagaaccaaagtgtcacaggcggaatccacactcacgcgcgcacacggggcacgcaccca

SEQ ID NO: 26879 - DNA, 141 bp, Homo sapiens
  misc_feature 1..141: note = chr1:223302777-223302918
  misc_feature 1..141: note = hyper
  source 1..141: mol_type = genomic DNA
ggaaggccctgctcccgaccgacccggagcgcgctgctgccctctaccggtcatccgtgcggccggacaccgtgtcaggcccgcgaggagggctctgccgcagtcccggggaacagcacccagcagcgccactgggagagg

SEQ ID NO: 26880 - DNA, 280 bp, Homo sapiens
  misc_feature 1..280: note = chr1:223538158-223538438
  misc_feature 1..280: note = hyper
  source 1..280: mol_type = genomic DNA
agtctcttaatttcccgcgttaacccctccccgctcccatctccgccgaagctctgcgcgtccccagggagcccgaaggaccatctgaggcggctgagagacactctccccctcccccacacccttggtattttccctctgccagccgcaggtgttgcgagtgaggacccctgtccggtcttggagatgcgcggggccctcggagccttggcctgggaggcgctcccgggggcggggaggcgggggtagcgggtgattggtgacacgcagaaggttgggt

SEQ ID NO: 26881 - DNA, 127 bp, Homo sapiens
  misc_feature 1..127: note = chr1:223936626-223936753
  misc_feature 1..127: note = hyper
  source 1..127: mol_type = genomic DNA
gccgctgcgctagtgcgtccggcggtcccgcccggcagtaggacagagggagcgagggagtccgggaggaagggagagcgggtgcggccagtctgacggttgctgtgtttgcagatcaccagcgccg

SEQ ID NO: 26882 - DNA, 215 bp, Homo sapiens
  misc_feature 1..215: note = chr1:223936995-223937210
  misc_feature 1..215: note = hyper
  source 1..215: mol_type = genomic DNA
cgggcgccgggtgcgccgcgctgccacctggtggccgcagtggccggcgccaggggccctggttttacttgttttagatgttaccctgttttacagttacaaccttactattttgataagctaaaaataataaaacaatgcatcttcatagtgttttatactctataaggtgctttctcttttgatctcgtaaaagtattcgtgcccatgttcaa

SEQ ID NO: 26883 - DNA, 256 bp, Homo sapiens
  misc_feature 1..256: note = chr1:224528612-224528868
  misc_feature 1..256: note = hyper
  source 1..256: mol_type = genomic DNA
ggggctccaggtcctcgctgggcacctctctgcccaaccctctgcacccagccggcttctcccccaccgacggggagccccgcctggccccatcgcagagacccccagagcggcgggcttttgttggggggttcccgcttgtccctggctcctgccgtctctgtggagcgcggcaccgccttggatccagctccacctcctccccgtgccctccccacgaggcctgggagcgggtcctgcccggctgcgcaagggt

SEQ ID NO: 26884 - DNA, 55 bp, Homo sapiens
  misc_feature 1..55: note = chr1:224803348-224803403
  misc_feature 1..55: note = hyper
  source 1..55: mol_type = genomic DNA
caacaccaataccaccgagccctcgttgctgcctcttcagcgcagaatagcccac

SEQ ID NO: 26885 - DNA, 486 bp, Homo sapiens
  misc_feature 1..486: note = chr1:224803810-224804296
  misc_feature 1..486: note = hyper
  source 1..486: mol_type = genomic DNA
gcttcaagtttcctccgagaggcgggcgtgcacagctgcagtggcggcggcagcggccaccaagcgcccggcggcgcttcgccacccacctttcctcagcccccggcgctgcagtctccgcccgccggggagggcgcgctcagcggaacaggagtcgagggtggggcgccgagaggagggaatcccgggtcgcaccgctacagttctcgcagtggcaaaggcggcggcggcggcggcggcagcggcagcagcaggtggagcgagctacagcgtttggcctgaaacccactgctgcagccacccgggctggagttggcccgttgggtggagccagtgctcgccccggtccgacccccggtttccgggacacttgggttgcggaggccggctggccggagtcacggttggggacgggcgcgcctcggagcgcacggctgcgctggaagccgcgtctggggcgcaggaccaacgggacctacctcctcc

SEQ ID NO: 26886 - DNA, 292 bp, Homo sapiens
  misc_feature 1..292: note = chr1:224804395-224804687
  misc_feature 1..292: note = hyper
  source 1..292: mol_type = genomic DNA
cgtttgcgccccggtggcgcgggagggtccggagcggagcgctcgtctctcctcagcggtttagtggagaaaagcagagagctcttcctggggcgaatgggacctcctccctcggtcctccgtggagtcgtcgcatcgcttgtcgtgttggtctcgaggggctcacagcttggcactaatttgcaggtgttcgctgctgatttggtttcttcttcgatttgcggacggttccctccagcgactctcgacacacgttttcctgtcttcgccggagggccgggtctggggtcgc

SEQ ID NO: 26887 - DNA, 270 bp, Homo sapiens; identical to SEQ ID NO: 121
  misc_feature 1..270: note = chr1:224804846-224805116
  misc_feature 1..270: note = hyper
  source 1..270: mol_type = genomic DNA

SEQ ID NO: 26888 - DNA, 555 bp, Homo sapiens; identical to SEQ ID NO: 122
  misc_feature 1..555: note = chr1:224805197-224805752
  misc_feature 1..555: note = hyper
  source 1..555: mol_type = genomic DNA

SEQ ID NO: 26889 - DNA, 18 bp, Homo sapiens
  misc_feature 1..18: note = chr1:224805848-224805866
  misc_feature 1..18: note = hyper
  source 1..18: mol_type = genomic DNA
cgccggtcctctcaaaga

SEQ ID NO: 26890 - DNA, 395 bp, Homo sapiens
  misc_feature 1..395: note = chr1:225117226-225117621
  misc_feature 1..395: note = hyper
  source 1..395: mol_type = genomic DNA
tgtcacatcgggggccgccgcgtacccgcggtggaatctcgcaagagccagggcccctcctcacctgcccggcacccaggatcccttgcgccgcgttcgggaccccacccccattgtggcctcttcgccagggcgcaggcgtggctcttggtcaggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcgggtaaggtcgtcagcgtcttcctgtcagcggtcggcagagcctcggcgggcgggcggcgcgtggggcagccggtgtcgcactggg

SEQ ID NO: 26891 - DNA, 62 bp, Homo sapiens
  misc_feature 1..62: note = chr1:225632491-225632553
  misc_feature 1..62: note = hyper
  source 1..62: mol_type = genomic DNA
caacagataacaaatcgacattgtcgtgcataaatgtagagctgatccgtatttcatgtcaa

SEQ ID NO: 26892 - DNA, 30 bp, Homo sapiens
  misc_feature 1..30: note = chr1:226069474-226069504
  misc_feature 1..30: note = hyper
  source 1..30: mol_type = genomic DNA
tcgcctcaccctttccgcccccgcccttcc

SEQ ID NO: 26893 - DNA, 43 bp, Homo sapiens
  misc_feature 1..43: note = chr1:226150283-226150326
  misc_feature 1..43: note = hyper
  source 1..43: mol_type = genomic DNA
aatcacggtgctgaccgtgcctctgcagcgctgtcttcaggtg

SEQ ID NO: 26894 - DNA, 207 bp, Homo sapiens
  misc_feature 1..207: note = chr1:226411017-226411224
  misc_feature 1..207: note = hyper
  source 1..207: mol_type = genomic DNA
aacggggatttgacccggagaagagagttctgtcgcctgcggcccgcgcacccgggcccctccgggctgcccctcccaggcaaatagtccttcggggatgtggattgcgccgtccgggcgggtgggcggggaagaacacggagggggccgggacccaagttcacgcctccctcctgcatcccgcagccggcggaagcgattattccc

SEQ ID NO: 26895 - DNA, 758 bp, Homo sapiens
  misc_feature 1..758: note = chr1:226411246-226412004
  misc_feature 1..758: note = hyper
  source 1..758: mol_type = genomic DNA
cgggctcgcacccggaggagacacgggtctccccgagcccacctttgatcgcaccgccccgccttcccagcccctggcccgggagggtataagtgcggcccgcgcccctccgagcggcgcgctgggttccggagcgatggccacagccgagtcccgtgcgctccagtttgccgagggcgccgcgtttccagcgtaccgggccccccacgccggcggggcgctcctgccgcccccgagccctgcggcagccctgctccctgcgccgcccgcgggccccggcccagcgacctttgcgggcttcctcggccgggaccccgggccggccccgccgccccccgccagcctgggctcgcctgcgccccccaaaggcgcggccgccccgtcggcgtcgcagcgccgcaagcgcacgtctttcagcgccgaacagctgcagctgctggagctcgtcttccgccggacccggtaccccgacatccacttgcgcgagcgcctggccgcgctcaccctgctccccgagtccaggatccaggtgagggcccgctgcgttcgcaagtgcgcgctggagcggaggcgctgcggactctaggtctggactgcgggctcctgaggccacacccgggacgttgcaggcacggtgcttcccctgaggctctgcgtactagactgaaatagggggtgatatcggcacctgctgcatagggtggttgcgaggcctgtgtgaaataatttaggcctgcactgaacgatttctctcatta

SEQ ID NO: 26896 - DNA, 83 bp, Homo sapiens
  misc_feature 1..83: note = chr1:226736126-226736209
  misc_feature 1..83: note = hyper
  source 1..83: mol_type = genomic DNA
caggggactcagcctcgaggctttcccgacggtgtcagccaagcacacactcccagttcgcagggcttcgtggtcaaggttcc

SEQ ID NO: 26897 - DNA, 692 bp, Homo sapiens
  misc_feature 1..692: note = chr1:226736861-226737553
  misc_feature 1..692: note = hyper
  source 1..692: mol_type = genomic DNA
ggggggagagaagggcgcggccggagacctcctggcggggccgcgcgctccaagtgctgcgaccacgcgccaccgcccgctcctggcgtccccgggcaggtggcagaagcgcgtggagtgtgcaccccagaggggagaggctgcgctggggtctccgacccgcaggcggggccccaaagagccggaaactttgcggccaatgttggagcccgcagcggcggccggaatggctctgccggcttcggagtagggctcccgtcccggcgccccgatttctgctccttctctccgtcgtgtgcatccgtccgcgagcccacttccccgagaggaatggggtcggatcagaatgagctctagggcctcggcggcgaggatcaaactcccgggcgtcgaagtcagctgagccggggaaagaggacgagccgggctagatatacctgcagccccctttggttcgcggagtgcggaccgcgtggggacgagaactctagccagagtctcctccgcctcattcaggggtacctgcacttccgccagcaccccgcagggcgccagggggatgggggatgattttattagtttggatgcatgtggccagagatgaacccatagctccctcggatcccttctgttcctgagaagtagagagtgcgccgatgtaattctgtgcaggactccggcagccggcaggg

SEQ ID NO: 26898 - DNA, 15 bp, Homo sapiens
  misc_feature 1..15: note = chr1:226924815-226924830
  misc_feature 1..15: note = hyper
  source 1..15: mol_type = genomic DNA
gccaccacctgctgc

SEQ ID NO: 26899 - DNA, 714 bp, Homo sapiens
  misc_feature 1..714: note = chr1:226924900-226925614
  misc_feature 1..714: note = hyper
  source 1..714: mol_type = genomic DNA
cgctgctactattcagcctgcgccggccgctccgccagcccccggggctccggggctcctcgggggacagcgactcggctggggggaagaggaaagaggcgcctctcccggggctgaaaacgctgccggggctcagcactgccctcctcgggggcgggggcgtctcgctgccactgggccccgggccgccgccgctcttcatctcgttggcgctattcatgatcaccaggctattgagcgcatagcagtacacagccatagtactgggtcccgcgctgcccgccgccgcggctcccgctcctgctccgccgccggcgcctcctcctcccggcgctcccggctcagccccggaggcccggcagccgcggctccgcgcgcagatggggcggcatggcctgggcagcgggctgggggcacgaccgcgggctcagcccccgcccaaagctccataaacaaccgtgcggctgtggagatacaaggagaaaagtcaggaccctggagggcgcgcggggggagttgggggtcgcctgcagaacccagagagagccccgggaacacaatctatccgggacccagcgccaccggacatctcacctatggggacggcgaggctcggcgagggcatgccccggctgcctcggtcgccagcgcggtttcgggtgtgcttccccgccccccacctcgccccaggctgcgatgcgctttatgaggtcc

SEQ ID NO: 26900 - DNA, 132 bp, Homo sapiens
  misc_feature 1..132: note = chr1:227505711-227505843
  misc_feature 1..132: note = hyper
  source 1..132: mol_type = genomic DNA
aagcggctacttggccgcccgagcccactccatgtcggtggtcgctcgtgggccgagccgcgccgcgccgcgccgggcagagagcccggtctccccgacacccgcaccgggccgccgcgccggaggctcccg

SEQ ID NO: 26901 - DNA, 283 bp, Homo sapiens
  misc_feature 1..283: note = chr1:227729829-227730112
  misc_feature 1..283: note = hyper
  source 1..283: mol_type = genomic DNA
cggggccgggccggcgagagaagggtccggggcacccagtgggctcggatctcgagcggtccccgtgacggccccgcgactgcgcgacttcccgctctagagagtttatggaccctgtcccaggagggctccgcagccgccagggaggtaccggagggaccgcggcgctgggagagggtggcgccaggcggccctggagccctgggcgacgcggccgggccggccagagggcggagaagtccaaagcagcagcccggacagccgcttccgcccctgcgccgcc

SEQ ID NO: 26902 - DNA, 273 bp, Homo sapiens
  misc_feature 1..273: note = chr1:227730322-227730595
  misc_feature 1..273: note = hyper
  source 1..273: mol_type = genomic DNA
ggtcctggcagaggccgcggcgagggcaggagccggtgcgctggccgctgcacatgcgccgcccggcaccgggaccctgcgggcgcgccccctggtggcagccagcgggaggtggcgtccctgtccccagccaggcggcagcgcgaagctgcctccccgcggggggagcggaagtggcccagctgctcgagtgacttactagttaaaaagctggggttggagctgccacgcggggaagtgtggaggcctgcggggctccgcctagactttctg

SEQ ID NO: 26903 - DNA, 30 bp, Homo sapiens
  misc_feature 1..30: note = chr1:227975163-227975193
  misc_feature 1..30: note = hyper
  source 1..30: mol_type = genomic DNA
agaaggtaggggtctcggtgtggccggagc

SEQ ID NO: 26904 - DNA, 89 bp, Homo sapiens
  misc_feature 1..89: note = chr1:228074787-228074876
  misc_feature 1..89: note = hyper
  source 1..89: mol_type = genomic DNA
tgagaacattttttccgacgcagcccgcagcgattgtctccctcagaagcagcgctggggacgccctcctgggccgggcagggggcggg

SEQ ID NO: 26905 - DNA, 169 bp, Homo sapiens
  misc_feature 1..169: note = chr1:228134702-228134871
  misc_feature 1..169: note = hyper
  source 1..169: mol_type = genomic DNA
tcagcgcgcccaaagcgcagcgagggtccctgtaaaggtcgcaggactgggcatcccagacctcagagagggggagggaagaaggaagggaaagaaaggaagagagagacgcgccgacagcccggcaaagcgctgctgcagagacacgtgagcacgggcaatgacaccg

SEQ ID NO: 26906 - skipped

SEQ ID NO: 26907 - DNA, 328 bp, Homo sapiens
  misc_feature 1..328: note = chr1:228135362-228135690
  misc_feature 1..328: note = hyper
  source 1..328: mol_type = genomic DNA
cgccaggcaacccggcggccccgccgcgccccggccccagccaccccgggtgcctcggggactccggacgaccccgccccggccccgccgcccccgcccaccagtgcgcgccggccgccgaaggcacctacccgaagtaggcggccgaagggcgcagcgcggcgagcagcagcgtcagcccgaaggccgcggccagccagcgcgccagcggggacccatccagcatcttgccgcgcctcggcggccgaccatcgcgctcccagctccgcgcagggcgcgccgcggccgccgccctcttatagcgcccggagcgcggccagctgggccc

SEQ ID NO: 26908 - DNA, 161 bp, Homo sapiens
  misc_feature 1..161: note = chr1:228194250-228194411
  misc_feature 1..161: note = hyper
  source 1..161: mol_type = genomic DNA
ctagcccagccacctcgggggcaagagacggagctcgccacagaccaggagcgagagggggactgcgggtcccaccgtgagcgcagggcgcgcggggctggaaacccaggacgcggcccgggagctccaggagggcgcctgcggatcgcgcggccccgggc

SEQ ID NO: 26909 - DNA, 1798 bp, Homo sapiens
  misc_feature 1..1798: note = chr1:228194727-228196525
  misc_feature 1..1798: note = hyper
  source 1..1798: mol_type = genomic DNA
agggcccagcgacgccgccgcgccagctcccagggcccggccccccccggcgctcacgctctcggggcggactcccggccctccgcgccctctcgcgcggcgatggccccactcggatacttcttactcctctgcagcctgaagcaggctctgggcagctacccgatctggtggtgagtgagcctcctcgcgttcgcccctgcccctgtgcgccgcgcccgcagcagacggtcccctcgggcagggaccccgcggtggcccgagcccgcgcccttctgctccagccccgcgtgcgggccgcgggcggttggttttccttgacggccactttggacctgttcaggccgctgggacgcgtgggtggcggagtttccggagacattgattcccgagcgggggagtaggggaggttgcggaggtcctagctgcccctggcgtcggacagggcgagcagtgggctggggagaggctgaaagaaggtcggcacgcacggtcaccgaggggacaggcagctcgaggccaggggacaggcgagggaagagggccagcgagagagaattcgccggagactttcctcaaaaaccgtatcttacacacaaacacacacacacgttttaaaacaaagtcgatgagacaagactgaacagctcggagcagcgtggttacgtaaagaaagctgggacccggcggggagtggcgcagagccggcggcggggcgcactgggggccggccctgggccccgcgcgcctccccgccgcagtccgggcacgggggtttccaggggccctctctgcgagccctccgcatgggtccacctggcaatgaggggctgctgtagagagagttaagggtgagttaagcacggggtgtgaggggctccaggaccctcaatcagaaagcgctgtgctgcgccctccacaccagaaaaggcgcgttccgtgagaccctccccagcctggcgatggaagtgcagataaaccaaaggaagggtcccgaaaggtctctctcaggcctcccacctccactgcacatatcctgtgggagggggaacggtggccacactttcgccagggcttgtgatccctcagagccctcaccaagcaaggatcaccccagttccgaattaagggcgctctgagatgcccaagattgaggaacacaagtgggaggaatgtgggcgcgcagggccgggcgcagcgctggtaggacccacagttggagagaagcctccccacaagcatgcacactcccccccatccttctccgacggcagcctggaattataataattacgccgaggggaaggggggagacccagcgagccgaggtacatctaatccgataataatttttctcttcgagatggttcaggagcgggggctcccgcggtaggggcgccgggccaggagcagcggggaggggaaggggcagccctaggcagctgaagggcctggaagaggccacgaggccgcggggacgcgcttcggggacccccgcgcgcccctatttccgcgtgccccatttcccgtgcggcacctgctgcgcccagtggcccacctgagggtcaggctcggggctcgccttggggtgcggggatactgacgcgcgtccagacggccgcagggagccaggggcagcgcgtccgtccgagagagccccgagggctgccggcttacgcaccaggcttctaattagaacccgccgccgcgttcctgagcgcaaaaggaagctccttcgccccgcgcccttcccataaatgtcgccagcctcctggcaaccccgcgccctaggatcttt

SEQ ID NO: 26910 - DNA, 109 bp, Homo sapiens
  misc_feature 1..109: note = chr1:228225753-228225862
  misc_feature 1..109: note = hyper
  source 1..109: mol_type = genomic DNA
ggtcagcacggcgcccggccgcgcgggccgcccggcggtgtcaggggccgtggccgcggtggggcgcgggccgcattccgctctcaggtggctccggggccttttgtgc

SEQ ID NO: 26911 - DNA, 46 bp, Homo sapiens
  misc_feature 1..46: note = chr1:228248302-228248348
  misc_feature 1..46: note = hyper
  source 1..46: mol_type = genomic DNA
ggaactggcctgctgcgccccaggccccgcccgtctctgctctgct

SEQ ID NO: 26912 - DNA, 124 bp, Homo sapiens
  misc_feature 1..124: note = chr1:228248612-228248736
  misc_feature 1..124: note = hyper
  source 1..124: mol_type = genomic DNA
agccctgagatgggccggcccccttcctggcccctcatggcgggactggagaaatggtccgctttcctggagccaatggcccggcccctcctgactcatccgcctggcccgggaatgaatgggg

SEQ ID NO: 26913 - DNA, 618 bp, Homo sapiens
  misc_feature 1..618: note = chr1:228463205-228463823
  misc_feature 1..618: note = hyper
  source 1..618: mol_type = genomic DNA
agctggaggtgggagcggggcttaaggaagcttcctggtttcctcgcttaaagtcgcacccgggagggtgcgcagctgcggcccgcgtgtggccagggccgcgctgtttggattgggatcccggggcgcggtgccggcagctctgcctgggcccggctcagggcaggcgccggggctgtgcgggccctctgtaccttggcttgtccgtggaggagggcgagggccgccgtgacctcccctctcctgcgaccccagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagagtgagccgcgggcgggaagggcggggcatcgaggaggagtgaggagggaggcggggcattgaggattagtgaggacgtaggcggggtgctgagggg

SEQ ID NO: 26914 - DNA, 45 bp, Homo sapiens
  misc_feature 1..45: note = chr1:228566475-228566520
  misc_feature 1..45: note = hyper
  source 1..45: mol_type = genomic DNA
aacctggcccaggtgcgctgagggtcgccccggccacacccttgg

SEQ ID NO: 26915 - DNA, 61 bp, Homo sapiens
  misc_feature 1..61: note = chr1:228566903-228566964
  misc_feature 1..61: note = hyper
  source 1..61: mol_type = genomic DNA
agttcttgggcaaagcgtgcaagcgagggcgagaagccgcgggccacgatccgctggagga

SEQ ID NO: 26916 - DNA, 233 bp, Homo sapiens
  misc_feature 1..233: note = chr1:228603691-228603924
  misc_feature 1..233: note = hyper
  source 1..233: mol_type = genomic DNA
tgcaatctcaacactcgcgaccccacgcagtggagatctacagactttcgcctacgccacggggttgctatggggaccgagttgcagaaggagttgaaaatcgcgtctacactgcaagcacgattctccccttccgttctgccatcccctaaagcgagggcgtctaggggtctcagacttccccggctctgtcccacgtccagtttctcggagctttctgcacgccaaccacc

SEQ ID NO: 26917 - DNA, 486 bp, Homo sapiens
  misc_feature 1..486: note = chr1:228604123-228604609
  misc_feature 1..486: note = hyper
  source 1..486: mol_type = genomic DNA
ggccggcggaggcgggaaggccgggcgttggagggcgaggaggaccgggttaggcttaggtcgtggcccaggcgccacaggagggtagcctaggcggcggggtgggggctactcaccgcggggaaggggggcccgcacagcgcctagtgcacctggccgagcgctcgctgccgggaaaggctgggtctgcccccacgaagcccaggaggctgcggcccggcccggggcgtggggacctggggtcgggaggcctagggactttgtggcgtcagcgggggctggggggcggcgggggaggggaatgctgggcgagggagtgttcggcggccgggactggggcggcgcctcttaggagaggttgggggtggcttggggaaggaaggcggcagggggtggaaggctctggacgagccggggacaggcgcagcgggtgctgactgggcggtggggaggatgtggtccacagcccagcgaagggaggagtct

SEQ ID NO: 26918 - DNA, 339 bp, Homo sapiens
  misc_feature 1..339: note = chr1:228633581-228633920
  misc_feature 1..339: note = hyper
  source 1..339: mol_type = genomic DNA
tgtatctagggaacacgtgatgctgcaagaaaccagtgacttaacgcgtgtaaaagcaggagagcgtcagaggttctgaccccgggggaggagcagacccgcggcagcgtgcggagacttagcgggcggaatctgccaccaacgcaacctggcccagaggttttgaactgaccaactgggagacgtccccgagcttgaataagggcctcaaaagcttagcgttttatgcagagtcgcaaccacccagcgctgggaacctgagcctgcacaacccactagaaagcacccgtgaccgtcccctgcgcccgttatccctgcgccccgcacccctgtatcccc

SEQ ID NO: 26919 - DNA, 29 bp, Homo sapiens
  misc_feature 1..29: note = chr1:228633921-228633950
  misc_feature 1..29: note = hyper
  source 1..29: mol_type = genomic DNA
gcttctctgcagctgtacaccctgcactg

SEQ ID NO: 26920 - DNA, 245 bp, Homo sapiens
  misc_feature 1..245: note = chr1:228633983-228634228
  misc_feature 1..245: note = hyper
  source 1..245: mol_type = genomic DNA
cgcaggtctccaaaacgaatcccggcttggaggggctcagcggccctgggcctgtgcgccgttgcggccgggagggtcattttcatgcctaaggacccgccccttgcacgcaacctcgggtagccagccggaaacggcgtcccgggctccaaaggacatctctttttacatttcagcaaaacagccgcacaccttctccccagatggcctctgtgcagcctgaaaatgcccgctccctccaagtc

SEQ ID NO: 26921 - DNA, 276 bp, Homo sapiens
  misc_feature 1..276: note = chr1:228644968-228645244
  misc_feature 1..276: note = hyper
  source 1..276: mol_type = genomic DNA
tccccatggccactgcgctcattcatgagcctagggtgatcaggcctccggcctataaagaactgcaggatcagtgcggctcttttctcgagatagtaggtggctctgaaaagagcctttatgtccatcaaaggggccccgggggcggcgggcggcctcacttgcccttggccttgtggtggctctccgtcttcttgggcagcagtacggcctggatgttgggcaggacgccaccctgcgcgatggtcacgcggcccagcagcttgttgagctcct

SEQ ID NO: 26922 - DNA, 604 bp, Homo sapiens
  misc_feature 1..604: note = chr1:228645305-228645909
  misc_feature 1..604: note = hyper
  source 1..604: mol_type = genomic DNA
cgccgcgttgccggcaagctccaggatctcggcagtcaagtactcgagcaccgcggccagatagaccggggcgccggcgcccacgcgctccgaatagttgcccttgcggagcaaccggtgcacgcggcccacggggaactgcagccccgcgcgcgacgagcgcgacttagccttggcgcgcgccttgccaccctgcttaccacgaccggacatttccgagtcaaggaaaaaagacaacggcaaccgaaaagcgagactaaaaacaagagggcagtgaaggccagcgagcccttatgtatggtacagaggtaggctagaccgcggcgttcgattggatggctatggtagccaatcagaaaaagaacctggcactcctaatttgcgtattcctttcccagcgatgacgtagaacaacgtttgatccaatcagaagtgagcaaatcctgagccttcatttgaatacaaaacgtacaaatagagttactccgagcgccgcgcgtttctgtttggagagactcagccatcatgccagacccgtccaaatcggctcctgcgcccaagaagggttctaaaaaggctgtcaccaaggcacagaagaaggacg

SEQ ID NO: 26923 - DNA, 120 bp, Homo sapiens
  misc_feature 1..120: note = chr1:228646029-228646149
  misc_feature 1..120: note = hyper
  source 1..120: mol_type = genomic DNA
tcaatgacatcttcgagcgcatcgccagcgaggcctcccgcctggcacactacaacaagcgctccaccatcacgtcccgcgaagtgcagacggccgttcgcctgctgctgcccggcgagc

SEQ ID NO: 26924 - DNA, 120 bp, Homo sapiens
  misc_feature 1..120: note = chr1:228646209-228646329
  misc_feature 1..120: note = hyper
  source 1..120: mol_type = genomic DNA
gaggcgttcctcggcgtcctgaacccaaaggctcttttcagagccacccacacgatcaagaaagggtttcgaacacggtgaagggttatgtaacctaatgtgtctccatgcaccctagcg

SEQ ID NO: 26925 - DNA, 82 bp, Homo sapiens
  misc_feature 1..82: note = chr1:228646859-228646941
  misc_feature 1..82: note = hyper
  source 1..82: mol_type = genomic DNA
ccccaaatgtcttttataagcaagtggtgcattcctggatgttgagcgcttgcgcccggttcaggaccgggtccaaatgagg

SEQ ID NO: 26926 - DNA, 100 bp, Homo sapiens
  misc_feature 1..100: note = chr1:228647217-228647317
  misc_feature 1..100: note = hyper
  source 1..100: mol_type = genomic DNA
caggatgtttgataccgaatcgaagcacggcgtcaaagcagcgtcctgcgcgggggagccggatgtaataagcgaccccagctgccggtaactttaaccc

SEQ ID NO: 26927 - DNA, 648 bp, Homo sapiens
  misc_feature 1..648: note = chr1:228651254-228651902
  misc_feature 1..648: note = hyper
  source 1..648: mol_type = genomic DNA
tttgggggtaaaatacgagaatcccttaattggggaaattttagctgagtgataaggagatctgtgagcctgctgttttgatgtttcaagcaggaaggcgtggcataaagagctgcttaggcgcaacgctgctgaaatggttttggctagaagctcacagtgtctagttgtggctaaggagggaggaaaggggcgggagaagaacggacccaagcgcctccgcccagacggcgcgataaccccctcacctccaaccccggacctcagtgagcacgtcctccagtctcagccgccaggaggcactgggggcggggacgtggcacaagatcttcccggaggtgacccacgctcctcgcgcgcagggcgtaagccacacacagatctttggatgggatccatggcgcaatcgcctgtactgccccctctctgactttgcctgtggccaacacaagacgaacgcagcctttctaagggaaatatgccgttacaaacaagaagcctaattttgtctctaagacttgcgcccccacggctcagtctactttccctcattactccaattgaatcacaggtcacaaccagaccaggtggcacgctccttttggagcttggaggtggctctgaaaagagcctttgggttcggggcgc

SEQ ID NO: 26928 - DNA, 211 bp, Homo sapiens
  misc_feature 1..211: note = chr1:228652242-228652453
  misc_feature 1..211: note = hyper
  source 1..211: mol_type = genomic DNA
gccttcttggagccctttttagaagccggagccgcccgcgatggctccggcatggcgaggtgacaagagcgcctagacgaacgcggatgcggggccggcagggctatttgccatctttatattcaaattaaggctccaaatttgtagtgtctgattggacggcctgactccgcggccgccactgggaggaatttctgtaaatagcagagtc

SEQ ID NO: 26929 - DNA, 121 bp, Homo sapiens
  misc_feature 1..121: note = chr1:228652508-228652629
  misc_feature 1..121: note = hyper
  source 1..121: mol_type = genomic DNA
cgcgccggagctgaggttgcgcatctttgttcaaagcctttgttttaaacctggagatttttgtgtctgcagcggatctggaggtagctaaagagaaactgaaaaacggttgcaaccccaa

SEQ ID NO: 26930 - DNA, 30 bp, Homo sapiens
  misc_feature 1..30: note = chr1:228871287-228871317
  misc_feature 1..30: note = hyper
  source 1..30: mol_type = genomic DNA
ggcgccgccggagcgcggagccacgaccct

SEQ ID NO: 26931 - DNA, 140 bp, Homo sapiens; identical to SEQ ID NO: 131
  misc_feature 1..140: note = chr1:229542813-229542953
  misc_feature 1..140: note = hyper
  source 1..140: mol_type = genomic DNA

SEQ ID NO: 26932 - DNA, 312 bp, Homo sapiens
  misc_feature 1..312: note = chr1:229543220-229543532
  misc_feature 1..312: note = hyper
  source 1..312: mol_type = genomic DNA
cgagagggagctctggtccccgaggggctgtcccgggagggagcgaggtggggagggggagcaggccctgccccgagcaccccgcggactgagcgtctggcgtgcacggcggaggggttaccgcggggaggtgacaccccagggtggtgagggcacgcagatgaggctggcctgaggggtgcctgctttggggaaagcagtctgtggagggagggaaggagggcgatcgcggccccacgcgggttgtgctgctgaggctccgcgccgcaggaaaggcaccctagccggattcgccctcggacgccccagctg

SEQ ID NO: 26933 - DNA, 257 bp, Homo sapiens
  misc_feature 1..257: note = chr1:229566603-229566860
  misc_feature 1..257: note = hyper
  source 1..257: mol_type = genomic DNA
ggggaacaccataggcggagctgagacgccctctgagaaacagctctccagccccagcaccatggtcagcgcccgctgcctgaggggacccagggccaccagcggaggccgccccggcagtgctggcaacactcgggagcgctgcgcagaggaagaaagctgcctcgccacaccccagagggtcaagtcaggccaccactagctgccagtgatctggaatggatctgatccactgcagaaaccggcaggggagcatg

SEQ ID NO: 26934 - DNA, 166 bp, Homo sapiens
  misc_feature 1..166: note = chr1:229567111-229567277
  misc_feature 1..166: note = hyper
  source 1..166: mol_type = genomic DNA
cactgtgtcagtttacgatggcagcaacggaagttgttacaaagaaagtgactgcggggtggctggagctcagccgcccccccattgagaagattcgtcgtcctgagaagtcgcgtgctggaggtggagtgtgtctagaagcatttgcggtggacgatggaagggc

SEQ ID NO: 26935 - DNA, 624 bp, Homo sapiens; identical to SEQ ID NO: 134
  misc_feature 1..624: note = chr1:229567369-229567993
  misc_feature 1..624: note = hyper
  source 1..624: mol_type = genomic DNA

SEQ ID NO: 26936 - DNA, 193 bp, Homo sapiens; identical to SEQ ID NO: 135
  misc_feature 1..193: note = chr1:229568157-229568350
  misc_feature 1..193: note = hyper
  source 1..193: mol_type = genomic DNA

SEQ ID NO: 26937 - DNA, 1128 bp, Homo sapiens
  misc_feature 1..1128: note = chr1:229569458-229570586
  misc_feature 1..1128: note = hyper
  source 1..1128: mol_type = genomic DNA
agggaactgccttggcgacaactaaagcaaaaccgtttatctccctaggcacatcctacatgccaggtaaaggagcccaaaggggctagagaaaaatttggagaagtctaatttccagaggctgactgtcttgcctcctttttaaagcgcgtgtggctccggagacgaggcacagcgctcagggcgcaggcctggggctgaccaggtgaaccgactgggttctgccccggagtccttcaggttcccctcggtagtgccctgtccccctgtcccctcccaactcctgccctacctgggcgggtagctacaactgctactctcggctcgggccctggtcgccgcggaggggaagcgaggcttcacttggcgctgtccgctgcggtggccgcttgtccctctgctcaggttttatatagcccgcgggcattccctccgcgccaccccgcaggaatgtcgctgcccttctcgagccatatttgggtgttgggcactagagccccctccctcggccggttcgcggcctgggcccccgcccgggtcccctgcgttgaccaaagaaggagcgggttggcccggtcccaggtaacgcgggccgggccgtatatggagtgtctccctagcgggtttgcccctcctgacccgacccagttgcccgccggaggggatggggtggggcgagggtcaccgcgttcgccggtgggtgcatgtgtgcgcctgcgctccgggaaccgcacctgtcccaaaggcctccccaaccatgtccactctgagcgccctgggcgctcgggaaggtgcctgactgctgacttccaatatttcaactcctcttcgggttctttgctcagatccccaaactcccacttgcgactaccgggaagagggagtcgtgtggagtggtgggcttgggaggattggagaagcagtcactcctgagtctcaggaagggaaggaaggcgaactccctctcctttacgcccctggaactccatttctctcttcccacccccgagctccctgaatccaaaaagctgagccacgtcgaccccttcccccaccgcacagagggccaccggcggccggagggcgcgcagctgtcgcaggatagacaactggcggggggaggcgagg

SEQ ID NO: 26938 - DNA, 30 bp, Homo sapiens
  misc_feature 1..30: note = chr1:230240615-230240645
  misc_feature 1..30: note = hyper
  source 1..30: mol_type = genomic DNA
aaatgccacacaggacgcttgcagtccccc

SEQ ID NO: 26939 - DNA, 120 bp, Homo sapiens
  misc_feature 1..120: note = chr1:230561556-230561676
  misc_feature 1..120: note = hyper
  source 1..120: mol_type = genomic DNA
tgtccgggccggactcgccgaacacgtcgtccgagatgtgcaggctctcgtagcgcgcgcgggcagcctcgagcagcgccggcgccctcctccgcgcgcccccgccgccctcggccatgg

SEQ ID NO: 26940 - DNA, 37 bp, Homo sapiens
  misc_feature 1..37: note = chr1:231296747-231296784
  misc_feature 1..37: note = hyper
  source 1..37: mol_type = genomic DNA
ccccctgcctgaccccgccagcctgcgcctcctcacc

SEQ ID NO: 26941 - DNA, 286 bp, Homo sapiens
  misc_feature 1..286: note = chr1:231296817-231297103
  misc_feature 1..286: note = hyper
  source 1..286: mol_type = genomic DNA
cgctacgactccggtctttagtctttgtttggagcacgggagaacctgggacggagggaggcatgacttcaatattcatatcgttgttaaataaacgatttcctaatttgtatctgtttcatgccagcgtgaaacttctgtaggcagagccggctgcgctgccagcactttcttctgctcgtccccacccacctctgcctcccccacccagccttccctcggcagcagcggggaagaacagccgagcagaccaaacagccggggccgcgggtgggaggctgttccc

SEQ ID NO: 26942 - DNA, 205 bp, Homo sapiens
  misc_feature 1..205: note = chr1:231297104-231297309
  misc_feature 1..205: note = hyper
  source 1..205: mol_type = genomic DNA
cagctcgtggctggcgttggagaatgtggagattttcccattcataaaaggaacgtctccgcttgccgccttcccgtccgccgcacaccgccacatccgcagcggggtagggctgggtctgggggcgctgggttcccaggggtctacccgggcgcgctctcgcctttctcaggaaaccccattttgtgagcggcaccgcgtgtcc

SEQ ID NO: 26943 - DNA, 30 bp, Homo sapiens
  misc_feature 1..30: note = chr1:231297520-231297550
  misc_feature 1..30: note = hyper
  source 1..30: mol_type = genomic DNA
ggctttttaggatcccgttttcacccttct

SEQ ID NO: 26944 - DNA, 852 bp, Homo sapiens
  misc_feature 1..852: note = chr1:231297797-231298649
  misc_feature 1..852: note = hyper
  source 1..852: mol_type = genomic DNA
gaaattacaactcctcggcgcgccgcgcggggaggcagcggcagcggcgggagggaggcggggaggggattcccgagccagccggacgctcgccctccgcccgccggctgcagcgtcgcgcggcccaaggtcagaggcgccgcaggagcagcagctgggaaccagggaagcgggtcaatcccggccgcagggagaaagccccagggcgcagtcagccggcgtccacagccgcccaggagtagggtgagcggctgtctccgggccggtcgggtcccgccgaggtggccgcggccccagcgacccggcgggtggcggcccaggggtcggcgagcaggcagctggagccccaccttcggctcccgggcgctgtccgccgcctcgtggtgctgatcccagccccacggctgagcggccttcgcacctgcctgtctcacctcgctatcaccccgataaggagttgggccggggcagaaggggggcctcggggtagccgcccaccggagccaggggctgaagcagcgagcgcacagcagcccggccgctggtcctggggtggagaggaggcgcgcgctgcagccggcggcggcgctggtgctgattcatcacctaaagctcctcgcaggccaccgcgagggcagccgaccggctccggaatctggccgcaggttgaagccgctggtgcgggaccctcgggcaggaggtgaggaccccctcccttctctcgcccctcaatcatcttagggcggtggctacaggacagagagaggggcgtgcccctcggctgtgaagtgggcatgcccgtgtgatgcccccgcccgtcgtctcaccggggcgcaccgcgctggtcctcct

SEQ ID NO: 26945 - DNA, 155 bp, Homo sapiens
  misc_feature 1..155: note = chr1:231298924-231299079
  misc_feature 1..155: note = hyper
  source 1..155: mol_type = genomic DNA
cgctgcggctggcccggcctgcggcggtgcaggcgggagtgcagctggcggcctcggcggcggtgcgggaggtggcggagaccacgcggacaagctcagcttgtacagcgagacagacagcggctacgggtcctacaccccgagcctcaagtccc

SEQ ID NO: 26946 - DNA, 25 bp, Homo sapiens
  misc_feature 1..25: note = chr1:231299434-231299459
  misc_feature 1..25: note = hyper
  source 1..25: mol_type = genomic DNA
atcccggggacccttcgccaagcat

SEQ ID NO: 26947 - DNA, 163 bp, Homo sapiens
  misc_feature 1..163: note = chr1:231299478-231299641
  misc_feature 1..163: note = hyper
  source 1..163: mol_type = genomic DNA
cgccgccgccgccgcccgccgaggcagcctccgggcccactggcaccgcccagggcgcccccagcggaggcggcggctgcaagagcccgggaggcgcgggggcgggggcgactgggggcagcacggcccgcaagttccccacgtgtcccgagcatgaaatgga

SEQ ID NO: 26948 - DNA, 38 bp, Homo sapiens
  misc_feature 1..38: note = chr1:232765315-232765353
  misc_feature 1..38: note = hyper
  source 1..38: mol_type = genomic DNA
cctcagtgcctgtgtcgccgagacgggaataacctttc

SEQ ID NO: 26949 - DNA, 51 bp, Homo sapiens
  misc_feature 1..51: note = chr1:233750219-233750270
  misc_feature 1..51: note = hyper
  source 1..51: mol_type = genomic DNA
ctgggacttcacctccgcgctcttcttcgccagcaccgtgctctccaccac

SEQ ID NO: 26950 - DNA, 234 bp, Homo sapiens
  misc_feature 1..234: note = chr1:234040247-234040481
  misc_feature 1..234: note = hyper
  source 1..234: mol_type = genomic DNA
gtactgaactgggagcggcagggtttgagtcaaaagagaagggtggaggagcgcgtccggtgccccaaggcttccaggcggagcgcgggcgcgaggtgcgggctccggggcggagcgcacgcccgggaggcgggaagtgggcagcagcgcccccgcctggcccctgtgcgccccgacccgacgcctccccgcccgaccaggtgcctcgagagcgcacagctgggagggctctcc

SEQ ID NO: 26951 - skipped

SEQ ID NO: 26952 - DNA, 213 bp, Homo sapiens; identical to SEQ ID NO: 1897
  misc_feature 1..213: note = chr1:234041148-234041361
  misc_feature 1..213: note = hyper
  source 1..213: mol_type = genomic DNA

SEQ ID NO: 26953 - DNA, 191 bp, Homo sapiens
  misc_feature 1..191: note = chr1:234041415-234041606
  misc_feature 1..191: note = hyper
  source 1..191: mol_type = genomic DNA
cgggccggtggggctcacgtccatcgaggagcggatcctgcgcatcactggctactatggctaccagccctgggcagcgagctgcaaaagtaagaccccctcacgtcatgtttcccgttcactggtccatcttcttaccattgtcacagcagcctcggggagcgcacgcagtgaggcgtccagccaccccc

SEQ ID NO: 26954 - DNA, 182 bp, Homo sapiens
  misc_feature 1..182: note = chr1:234349869-234350051
  misc_feature 1..182: note = hyper
  source 1..182: mol_type = genomic DNA
cagggatgagggctgcggggctgggcgtcccggggaggagggcggagcaggtgagctgcggggtgggagcagggagtgcacttgtacgtgacgttggagtttgcagcaacctccaagtaggaggctgtgcgcgcgtgtgtgtggagtggctgcgcggccggggaggatgtgcgctgcagggc

SEQ ID NO: 26955 - DNA, 256 bp, Homo sapiens
  misc_feature 1..256: note = chr1:234350052-234350308
  misc_feature 1..256: note = hyper
  source 1..256: mol_type = genomic DNA
gccgccgcagtgagcaacgcggcaaccggagcccggcgggcagccggggaggccgggactgagaggggcgagccgctggtgctccccggcggcagagggccgcgtcggccacgggcccgggagagacgcgctccagccggccccaggatgtaggcgatcggcggcagcgctcctgcaggcggccggctcatcatgaagaagcactcggcccgggtggccccgctcagcgcctgcaacagtccggtcctgaccctta

SEQ ID NO: 26956 - DNA, 279 bp, Homo sapiens; identical to SEQ ID NO: 5978
  misc_feature 1..279: note = chr1:235812015-235812294
  misc_feature 1..279: note = hyper
  source 1..279: mol_type = genomic DNA

SEQ ID NO: 26957 - DNA, 444 bp, Homo sapiens
  misc_feature 1..444: note = chr1:235812717-235813161
  misc_feature 1..444: note = hyper
  source 1..444: mol_type = genomic DNA
ggctgtccacacccgcgcgcgggcttccccggggcccggcgggaggtcccgggagaggaggccgagggaaccacaggtctttgtgtcgcgtgcagcagcagctggcggcgtgaggaccacaccggcgccagagccgtctccctaggtccggagactttcaccccgagtttcccttccgcgtctggctgcaccgggctgggctctccccgcggacacccggggctccggccgggcgcccacttacccggagcgggatcacgcgcgggcttcgtctgcagcgcggtgctcgcggggggcggccaggccgagcggcatcgctccgcatcggggcgcgggccgggctcgggtgcaaacgcgcgcctcgtgcccctcccgccgcccgcggggtctccgcgtcccgtcaccggccccgccccgcgccgcgcctcccgccctgcagggccc

SEQ ID NO: 26958 - DNA, 161 bp, Homo sapiens
  misc_feature 1..161: note = chr1:235813636-235813797
  misc_feature 1..161: note = hyper
  source 1..161: mol_type = genomic DNA
cggaggggtctggggcggggccggggttgctggaggggtctggggacggggccgcggtcagcgcgggctccccgaagcctcaggtaccgccctcgctcggggtgagctccagcgcctgggccgttggggcgcgggccgcttcccaccctgcaccaagggac

SEQ ID NO: 26959 - DNA, 139 bp, Homo sapiens
  misc_feature 1..139: note = chr1:235814009-235814148
  misc_feature 1..139: note = hyper
  source 1..139: mol_type = genomic DNA
ggttctaggagcgactgctctccaggcctcgtccctgtggcaccgcaggcttttgcgctggagattttaaaacactttagtgattacagccctcttcctttcagggaaaaaacagtttaagcgccgtccattttccgac

SEQ ID NO: 26960 - DNA, 107 bp, Homo sapiens
  misc_feature 1..107: note = chr1:236227637-236227744
  misc_feature 1..107: note = hyper
  source 1..107: mol_type = genomic DNA
ctgccaagacacatccggagtccacacacaaatacaggaggctgccggcgaaactctcccgcagccacaagagtcccggggcccgcgcgcagactgcgatccagctc

SEQ ID NO: 26961 - DNA, 152 bp, Homo sapiens
  misc_feature 1..152: note = chr1:236227769-236227921
  misc_feature 1..152: note = hyper
  source 1..152: mol_type = genomic DNA
cgcgagaacctggctccacccgggaccggccaggtcctagccccgaagggactggacagccgagggacgcggactgacctccctgcggcgatgcagcccacagccgccggggaggaagctccgcggggtccatgggtgccggggtcacggcc

SEQ ID NO: 26962 - DNA, 187 bp, Homo sapiens; identical to SEQ ID NO: 1902
  misc_feature 1..187: note = chr1:236228021-236228208
  misc_feature 1..187: note = hyper
  source 1..187: mol_type = genomic DNA

SEQ ID NO: 26963 - DNA, 61 bp, Homo sapiens
  misc_feature 1..61: note = chr1:236228563-236228624
  misc_feature 1..61: note = hyper
  source 1..61: mol_type = genomic DNA
gcagcccaatggccgcgagggggagggcgaggggcgaagccgaacctcccgccttgggcgc

SEQ ID NO: 26964 - DNA, 146 bp, Homo sapiens
  misc_feature 1..146: note = chr1:236228705-236228851
  misc_feature 1..146: note = hyper
  source 1..146: mol_type = genomic DNA
cgtggtcctctgattagggttgggtcgtggagagccggcgacgtggaaacgctccggattcaggaacggcgcccaccccattgccgctcggccgcgtccggggtccaattcgcttgaccctggtaggaagacggggtgggagctgg

SEQ ID NO: 26965 - DNA, 31 bp, Homo sapiens; identical to SEQ ID NO: 5986
  misc_feature 1..31: note = chr1:236558486-236558517
  misc_feature 1..31: note = hyper
  source 1..31: mol_type = genomic DNA

SEQ ID NO: 26966 - DNA, 660 bp, Homo sapiens
  misc_feature 1..660: note = chr1:236558547-236559207
  misc_feature 1..660: note = hyper
  source 1..660: mol_type = genomic DNA
cgcccagggggacgtgggtaccgggcaggacgcgcgctctgggcgctggggacgcccgggacactcggggccccgccttgcgtcccagccccgggtcgcggcaccccggctcccgccccgcgcctctggagggaggtaccgagggacgcgcagcgaaggggctttgctaattgccaaagcaggaagtgagctcgtggaagaagcgaaggaggagaagaagaagggaggggaaggcggaggagggcaggggcgcgcagagccacggtttgctccaggcgcgtcggaaccgcaggacttttcatccccgtggtcccacggtcctcccgcgccccggaggcctgccagccccgctcggacgctcgtttgcccctaacccgccgccatggcttcaccggacgaccctctgcgcgcaggtaaagggacacagcgccgcgcccgctcctggagcgagcaccgcggggcgggagctcgggaggcgctcgcagcagccgcagggctatcgaggccgggcctcggcgacccccgagggaggcccgggaaccacccccgacccaggcgccagacccggagtcgcacggggctcccagtccagccccgcgagcggctgctgaccgcccctcccgcgctcgccagggcccctgccccgcgtcagccaccgcg

SEQ ID NO: 26967 - DNA, 112 bp, Homo sapiens; identical to SEQ ID NO: 5990
  misc_feature 1..112: note = chr1:236559256-236559368
  misc_feature 1..112: note = hyper
  source 1..112: mol_type = genomic DNA

SEQ ID NO: 26968 - DNA, 49 bp, Homo sapiens; identical to SEQ ID NO: 136
  misc_feature 1..49: note = chr1:236849457-236849506
  misc_feature 1..49: note = hyper
  source 1..49: mol_type = genomic DNA

SEQ ID NO: 26969 - DNA, 15 bp, Homo sapiens
  misc_feature 1..15: note = chr1:236850197-236850212
  misc_feature 1..15: note = hyper
  source 1..15: mol_type = genomic DNA
cgctttgtggaggtg

SEQ ID NO: 26970 - DNA, 165 bp, Homo sapiens
  misc_feature 1..165: note = chr1:237206101-237206266
  misc_feature 1..165: note = hyper
  source 1..165: mol_type = genomic DNA
cgcggctagccggcggcaggcgcccgggctcggacccggggcaccggggacaggagcgtcggagctgcgggaaccgggagaggaggggacggccggtccggcctgcctggtggcacggctgggacctcccgggcggccgggggcagggtgcagagcagggtggcc

SEQ ID NO: 26971 - DNA, 224 bp, Homo sapiens; identical to SEQ ID NO: 137
  misc_feature 1..224: note = chr1:237206511-237206735
  misc_feature 1..224: note = hyper
  source 1..224: mol_type = genomic DNA

SEQ ID NO: 26972 - DNA, 210 bp, Homo sapiens
  misc_feature 1..210: note = chr1:239549605-239549815
  misc_feature 1..210: note = hyper
  source 1..210: mol_type = genomic DNA
aatctatctttgaagcgccgcgggaggcacaatttgggaacaggtgaggccatgctgggtgggtgaggcccccctctctcctgcttggtgttccgctttcagccaacccaccccaggagtaccctgggatctcctcgccccctgccaggcggagaacgcggagcccagcgggcacgcgggaatggagctaggcgccggcagggcaactgg

SEQ ID NO: 26973 - DNA, 89 bp, Homo sapiens
  misc_feature 1..89: note = chr1:239550034-239550123
  misc_feature 1..89: note = hyper
  source 1..89: mol_type = genomic DNA
gagaaagggaatacacgataaagaaggagacggaaagaagagaaaaagtgaggcgggagacagagggaaaagggcgtgaacagaaaggg

SEQ ID NO: 26974 - DNA, 579 bp, Homo sapiens
  misc_feature 1..579: note = chr1:239550614-239551193
  misc_feature 1..579: note = hyper
  source 1..579: mol_type = genomic DNA
ggaggaaaaagttttcggcgcgggtaggagaggtcttgtgtttggagtccaaagaaggggctgggtagggacgagagaggctgttgatttggggaagatgggggcacttgaattccgacagcgcgatctggtgcggagttggagttctgggactgagggtggggaacgcccgctggcactcaagtgccccgaaagggacgggaatcatgcgagcggtggccgggagagagtcggggacgtcccaccccgctctccctcgcttcgattctctcttcgccactgccggatctgaggctccaaagtgcccgagcatgaggagctactgggctccgggtgtgtttgtgagcgcactcgtgtgttgagcgtttgtctcccatctccccatttggtttcctgtcatttctaagaaggctaaagctggcacccgccaacctcgcagtggggccgcaagttcggattgcatttcagggggcgagaaggcaaatttggcacttcgagtaacacttgggcgaaggtacctagcctagtgcgcatctttactgacccggggagagtctgcactcgcgaggcagcggccgc

SEQ ID NO: 26975 - DNA, 134 bp, Homo sapiens
  misc_feature 1..134: note = chr1:240160952-240161086
  misc_feature 1..134: note = hyper
  source 1..134: mol_type = genomic DNA
caagacatttaaacccgggcggtgggggggcgggcggtgtcagacgcccaacgaccacctccctcccggcccgcgccgagcccggccacaccctccccgcgacacccgcgatcgccccccaggactggcggccc

SEQ ID NO: 26976 - DNA, 259 bp, Homo sapiens; identical to SEQ ID NO: 5995
  misc_feature 1..259: note = chr1:240161122-240161381
  misc_feature 1..259: note = hyper
  source 1..259: mol_type = genomic DNA

SEQ ID NO: 26977 - DNA, 667 bp, Homo sapiens
  misc_feature 1..667: note = chr1:240254819-240255486
  misc_feature 1..667: note = hyper
  source 1..667: mol_type = genomic DNA
tatgtggctgtgacccgatggcacctctaaactggaattgggcttcagtttttctccgtgtaaaaatttcttcttttttatttaacttttctcttggcaggtccagcagctttgaagatcagagtgcatcttccagctgacgatctcttcggtcggggacaatgcattcgattcgcacggtggagattaaagtccccgagatagaggaaacgtttttcgcgcccaggttcagcgaggagccgcgcgggggcagagggggcggcggcggcgggcggggagccaggcccgagctgcgttctgcgcagccattggtgggcgccgcgctctgcactgagcatgttcgcgccccgccggcccctagccgcagccgcagccgcagcgacggcagccacgggagccgccgcgcattatgcaaagcggcggcagatgcgagcggggccagccgggcgcgcgtcggcctcccctcccagcggctccccccgccgccgcctgactctcccgggagactccctaggcccggacctggggccgaggagggccgggatggcctgagtgcccgcggcgcggcggcgcagcagcgggattgcaccatggggaaccaggatgggaagctgaagaggagcgcaggtgatgctttgcacgaaggcggcggtggcgccgaggatgc

SEQ ID NO: 26978 - DNA, 672 bp, Homo sapiens; identical to SEQ ID NO: 139
  misc_feature 1..672: note = chr1:240255487-240256159
  misc_feature 1..672: note = hyper
  source 1..672: mol_type = genomic DNA

SEQ ID NO: 26979 - DNA, 156 bp, Homo sapiens
  misc_feature 1..156: note = chr1:240256624-240256780
  misc_feature 1..156: note = hyper
  source 1..156: mol_type = genomic DNA
cgctgtttcaagccctacccgctcatcaccccctgctacatcaagaccaccacccggcagctcagctcgcccaatcactccccgtctcagtcccctaatcagagccccaggatcaagaggcggccggaaccctccctgagccgagggtccagaact

SEQ ID NO: 26980 - DNA, 238 bp, Homo sapiens
  misc_feature 1..238: note = chr1:240775075-240775313
  misc_feature 1..238: note = hyper
  source 1..238: mol_type = genomic DNA
ggtcctgaccagccacggaacaaacaacgtcaattcattctaagtgcctggtgaaggtagaaatcagaaaccgtgtctgtgtcacgttagtcgtgacaagctgcgtacctgcaatgacgtgatggaagcctcctcctcgggtcccttctctctctctctctccctctccctctgccttctctgagttctctagtccacagcggggtctaagtttggtctcccgccgccgctttcagtt

SEQ ID NO: 26981 - DNA, 77 bp, Homo sapiens; identical to SEQ ID NO: 6000
  misc_feature 1..77: note = chr1:240775378-240775455
  misc_feature 1..77: note = hyper
  source 1..77: mol_type = genomic DNA

SEQ ID NO: 26982 - DNA, 434 bp, Homo sapiens
  misc_feature 1..434: note = chr1:241520099-241520533
  misc_feature 1..434: note = hyper
  source 1..434: mol_type = genomic DNA
cggacgctcccgctgcgcagagcgagggctgggtgcgggccgggggccgggagggctctgggtggcgctgcctcctccccgcccgccttccctatttacctcctccgccaaggtcacggccccgcggcgtctcccctcccgggcgggctgggtgcaggcggtgtcagctggcggcaagcggagcagcgaggcagggtagcttcatcacactcgcggcggatgcggattccgcgccgccccggctctagctgctcaggcgaccgccaccctcgcctcgccgccgcccgtgcacaggcggctccggcagccgccactcgcgcccgctcccctgggccgcctcgctggctctctccctcctccgcttcttctcccggggactgggaccagccgagcgcgcgcgggagtcgagacgcccggcccgtgcgcgcgactgg

SEQ ID NO: 26983 - DNA, 145 bp, Homo sapiens
  misc_feature 1..145: note = chr1:241587106-241587251
  misc_feature 1..145: note = hyper
  source 1..145: mol_type = genomic DNA
gcaggcagtcctgagcggccgctgccatcgcgccggctgcagcggaaaggtacaagcggtggcggcaggagccgctgtgggagcagcagtggcggcagtgggagccctgtgccacgcgtcccctgtgcgccgtgtccccaaggca

SEQ ID NO: 26984 - DNA, 138 bp, Homo sapiens
  misc_feature 1..138: note = chr1:241587471-241587609
  misc_feature 1..138: note = hyper
  source 1..138: mol_type = genomic DNA
gggtagcagggcagtcgagcacggagggaggggcgggcctccaggggacttcagcgggagccgggcctggggcggtgccgcacttgcacacggagtgtggggggccaggcctgggaccaggagctggggccgggcttc

SEQ ID NO: 26985 - DNA, 268 bp, Homo sapiens; identical to SEQ ID NO: 1911
  misc_feature 1..268: note = chr1:241587610-241587878
  misc_feature 1..268: note = hyper
  source 1..268: mol_type = genomic DNA

SEQ ID NO: 26986 - DNA, 40 bp, Homo sapiens
  misc_feature 1..40: note = chr1:242161790-242161830
  misc_feature 1..40: note = hyper
  source 1..40: mol_type = genomic DNA
ccggggcacgctctgcgccacctaccggatgatgctgagg

SEQ ID NO: 26987 - DNA, 1065 bp, Homo sapiens
  misc_feature 1..1065: note = chr1:242686734-242687799
  misc_feature 1..1065: note = hyper
  source 1..1065: mol_type = genomic DNA
gaggtcccctctcaccggctcccaccctccagaggggaggatttctggggagcccgacgatccgctcgcttttagcctttctccttgcaacgcgcaaatctctccctagttgggctcaagtagagaggatcaccaactgctcatcccagcggacactctgcaaaaaactctaatggcttgtgcgcgggtccacgctggtcgctagcggcgccaactttactcattcgttaatttgctagtttttggactgagtaaaacagcccccaaagacgcgggcaaacgccgctctaaagcccactaccatgcaacgccaggttgctcggagccacgctggtggcacttccccttcgtgctcactctgcacaggcacctccagaaccccgtgcaaatgaaccctaccgggagacgcaggtgggcaggtcgggtcggcagggaccaagagcctgaaagggaacctgccctcccctccccgcagcccggtcattaaggcaagaaactgcaggcagagaagcccccgaatccgacctaggacgtcggcgcctgccaggatcccctcgcctgccccccgcgccccgcgcgcgctcatgccaccaccacggggagggtgcatgcggcaggtgcctggccgaggcccccgggagcgagtcgcccttacgtgctccagcttgtctttcctccgaagccagacgctggcgctgtagtcctgctgcttgacgctgctgtagaagttcgcgcccactcgggtcaggcttggggagggctccttggggcggcttttgagcctcatctgctcgaagccctcatggggggaggccgagagccactcgtgctgccggatctccatcctgacatgaccgggcggccgccggcgagcagcggactcgggacgggcgcgcggggagccgggcgcggagggcgagcgggaggcccagcgggagccggaggtggagctggagactgagctggaggagctggaggagcgagcgggcgcggggagcgcggggtgctgagcgccagctgggagcgcggccgggcgggagggggcgatcgcgggaggcgcggggc

SEQ ID NO: 26988 - DNA, 27 bp, Homo sapiens
  misc_feature 1..27: note = chr1:242688007-242688034
  misc_feature 1..27: note = hyper
  source 1..27: mol_type = genomic DNA
ggccggctcccggggcggcggcggcgg

SEQ ID NO: 26989 - DNA, 164 bp, Homo sapiens
  misc_feature 1..164: note = chr1:242688080-242688244
  misc_feature 1..164: note = hyper
  source 1..164: mol_type = genomic DNA
cgcgcctgcaggttggtgcagtgaggagccgccgccgcccctcccgccgcgcccaggcccgggcggccgcgctcccgctccgcacccgcctttcccgagcaggctacacctctccctggcgcatctttactggaaagccggcaggcgaggggagaagtgagcgc

SEQ ID NO: 26990 - DNA, 418 bp, Homo sapiens
  misc_feature 1..418: note = chr1:242688277-242688695
  misc_feature 1..418: note = hyper
  source 1..418: mol_type = genomic DNA
cgcggggatggctccggagggagacactcaggaaaccacctccgcccttcccccatctctatccagcggcgccccctcaccctgcccccggctcgcttgggctgcgccttcccccattctgaaagttcactaacttcccaccccaagggacttagagcagagggtgcccagcattcccccctgaaaatagccgagagacatgtgttttctggagccgtacacgctactttcatccgatggtgtggcgatgcaaatacgcccgggggcagtagcccctcgggcaggcacgcgggaccggttgctccccagccctcggtgtccacctagaaccgggctccccgggccgcacccattccgatcctgggagggtgatccagggctcctctgcaacgctccgcttgtgcggtgactgttcctt

SEQ ID NO: 26991 - DNA, 92 bp, Homo sapiens
  misc_feature 1..92: note = chr1:243053773-243053865
  misc_feature 1..92: note = hyper
  source 1..92: mol_type = genomic DNA
ccggccagcaggcctcgcgctgctctcggtcctgggcgcagggagagccgcggaggcggagagcagggctggcgggccggctcctgggcctc

SEQ ID NO: 26992 - DNA, 167 bp, Homo sapiens
  misc_feature 1..167: note = chr1:243053866-243054033
  misc_feature 1..167: note = hyper
  source 1..167: mol_type = genomic DNA
ctgaagagcttcccgcgggccaggctcggccccagcacgacctgaacaacgtctgcttcttgcaagccgccacccggcctatgggcgcgaactccacccgctcgccccctccacgtccccgcctggcctgccgctgatgggggcgggcagggcggaattccagcaac

SEQ ID NO: 26993 - DNA, 263 bp, Homo sapiens
  misc_feature 1..263: note = chr1:243646485-243646748
  misc_feature 1..263: note = hyper
  source 1..263: mol_type = genomic DNA
ggcggctgcggagcccggggaggaggcggcgggcgcccgggtcttcctcggagcgcgccccctgggctgggcggcgtgtccctgcctcccgccggcgccctcgtccccgcagcagcgtccccgccgccaccccgctgcctcgtcgcctttctcgcaaacagcggtgccctctacgtgggggatcctggaggctgctgagcacgagcgccctccgcgacccgcccctgctcccgcctccactcttgcctcggggggagggtctc

SEQ ID NO: 26994 - DNA, 248 bp, Homo sapiens
  misc_feature 1..248: note = chr1:244014423-244014671
  misc_feature 1..248: note = hyper
  source 1..248: mol_type = genomic DNA
ccaccccctgcacctcggggaagagggaacccgggtcagcccgtagcaagaatcattcctgactatcccaggagaccacggcagaccaaaaacacctctctgaacagccttccgcaccgctcgctgcaagcattcgtccacacacggtacacagattgcgggcggatcgtaattcactcttgaaatcacaccctttttagggatattcgttttcaatgactttgggaaagccacgaggtactacattt

SEQ ID NO: 26995 - DNA, 325 bp, Homo sapiens; identical to SEQ ID NO: 6011
  misc_feature 1..325: note = chr1:244080470-244080795
  misc_feature 1..325: note = hyper
  source 1..325: mol_type = genomic DNA

SEQ ID NO: 26996 - DNA, 786 bp, Homo sapiens
  misc_feature 1..786: note = chr1:244893526-244894312
  misc_feature 1..786: note = hyper
  source 1..786: mol_type = genomic DNA
ctgctccgaggccctcggaccaaagagaggctgcgaggaggacgcggctcgtttagctcgctgcgaacctcaagataacccttggtttccatgcacatccccccaacattgcatgtgctttcattcctacggtgctggggttactttcatttattgcttttgttgaccaaaaagaaaaaaacaatcctgagcgtgcacagggggcgcaacgggggaccggctcctcgtggctgaccggcggcggggctggcgcgcgggggcggcctgcgcgggccgcccggggacgctgctctggggtccggccgcggcctcgtggccgccctgcgcgcggtccagcaccagcagcgggatctcctccagccggtccggccgctccttgcgccgcaggtagcgccgcctccacgtcgccagcctctgaagcagcctctgcaggctcgaggggccccacaggccgcgctccggggcctccttgcctgcgcgcgcgtgagcttgcctgagcttcttcctgcgcgggccgcggaacagccgccgccagcaccagcacccagagcaggagccgccgtcgccggccaccgcgcgccgcccgaccgcctccggatccccgcgcggaggggggccccgctccaggcgcgccgccttctccagcagctcgtgctgcgcgccgccgcgccgggggccaccaaaccggggggccgccatggcccgcgcaggcctcttctcggagcgcggggcccacatctcgggaaccgtcgggctggacaacaacgctgccgcctccaggactcc

SEQ ID NO: 26997 - DNA, 176 bp, Homo sapiens
  misc_feature 1..176: note = chr1:247171005-247171181
  misc_feature 1..176: note = hyper
  source 1..176: mol_type = genomic DNA
cagcggccgggatcccgctgccggcccggcccccacctgcgcgggacgggactgagggccgagctgcgccagcgggactcggccgcacactccggagccgaccgccgggaggcccggggccgccagcgctggttccagccaattccaaccgattccaaccaccccctctcccttct

SEQ ID NO: 26998 - DNA, 166 bp, Homo sapiens
  misc_feature 1..166: note = chr1:247171251-247171417
  misc_feature 1..166: note = hyper
  source 1..166: mol_type = genomic DNA
cgcaatacctgcaggccacagggcgatggagcctgcggcagtcacccgggactctccgagaggcagcagacgggaacccagcaccccgccggccgcaaggagacaaaggccccgccagatccccaaggccgccccttcctctctggctgcacgcctgattggacag

SEQ ID NO: 26999 - DNA, 120 bp, Homo sapiens
  misc_feature 1..120: note = chr1:247274343-247274463
  misc_feature 1..120: note = hyper
  source 1..120: mol_type = genomic DNA
agagctcggggccgcgagcaagcctccgacgccctggtcccctggacccgccggttaaactgtgattctctttctaaatcctttgtctgcgccggactcggggtacccgccgggtggtgt

SEQ ID NO: 27000 - DNA, 77 bp, Homo sapiens
  misc_feature 1..77: note = chr1:247274523-247274600
  misc_feature 1..77: note = hyper
  source 1..77: mol_type = genomic DNA
ctccccagtggttgggattacaggcgtgagcccccgcgcccggccaaagggccccctaggaccggctgtctcccccg

SEQ ID NO: 27001 - DNA, 111 bp, Homo sapiens
  misc_feature 1..111: note = chr1:247274826-247274937
  misc_feature 1..111: note = hyper
  source 1..111: mol_type = genomic DNA
gctccggaaagtttgcggcggctgccccgggagggacttcggcggggaggaggcggcggcgccaggtggccgaagtcggaggggtccgtccgctcccgcagcctaggagcg

SEQ ID NO: 27002 - DNA, 29 bp, Homo sapiens
  misc_feature 1..29: note = chr1:248020420-248020449
  misc_feature 1..29: note = hyper
  source 1..29: mol_type = genomic DNA
ttgaactgaagccagcggacaccacccgt

SEQ ID NO: 27003 - DNA, 116 bp, Homo sapiens; identical to SEQ ID NO: 140
  misc_feature 1..116: note = chr1:248020515-248020631
  misc_feature 1..116: note = hyper
  source 1..116: mol_type = genomic DNA

SEQ ID NO: 27004 - DNA, 384 bp, Homo sapiens
  misc_feature 1..384: note = chr1:248020956-248021340
  misc_feature 1..384: note = hyper
  source 1..384: mol_type = genomic DNA
ggcagctaccaggtgaggcgccccccggcgggggctgcgggcgctgcggtgaccgggaagcgggcgacagtccggagcggagccgccgaggccacccgtctcctgagcggctcccacggccgctccccccaccgcgcgccgtcccccccgcccacgcggctcactcagtgtgggtctctttgccttggctgtggtaaccccctttgcgacacacacccattattttacaccgtccgcccctcccccaagcactctcctgtcgtcgaactcgcgctgggctggtttctcccgatgcggatagtctggtccctcagctgggctctggtcgggagggctgtgtggtccagttcattcttggtaacaattgtacgtctatatcgtaaa

SEQ ID NO: 27005 - DNA, 191 bp, Homo sapiens
  misc_feature 1..191: note = chr2:287500-287691
  misc_feature 1..191: note = hyper
  source 1..191: mol_type = genomic DNA
tgtctctttttgaaacgtgtttctcaaagacaattctatttcccagcagccccggccctcgggcgcgctcggccccactcacccactcgctgctccggcgaaggccccagccccgccgcctccgcgcggcccagggcgcagtcccgcccgaggagctgcaggcccttgtgctccgccgagtggtgcttccg

SEQ ID NO: 27006 - DNA, 42 bp, Homo sapiens
  misc_feature 1..42: note = chr2:288009-288051
  misc_feature 1..42: note = hyper
  source 1..42: mol_type = genomic DNA
cacctccgcggaccccgaggaacaagccggcaggtgagggag

SEQ ID NO: 27007 - DNA, 573 bp, Homo sapiens
  misc_feature 1..573: note = chr2:288269-288842
  misc_feature 1..573: note = hyper
  source 1..573: mol_type = genomic DNA
ggacctcggaggggccgcgctcccgcgcctaccgctctccaagaaggcggcgccgcgcgccgggcccggcggccgcgctcaagtttccagcgtcgcctttgcgcggtggtcgccggcgagcgccgagtccccgaagcccacggaggaggccgggtgcggaccctcgcgctggccccggccgcgccacgtgctggaagcccctccacctcccggccatggcgccctcccgcacctgcccggcgccacccgggagccacctgcgcgtcgtggccgggccggttacctggagccgccggagtcgtcgccgtctgtgcgcacgtctgtccccgcgccccgagctgcgccactactccatgcccggcgggcggagcgcacgggacgcggggactcggccgctccgagcgctggacccacggccgacctggggtgcgccggctccgagtcccgcctcagacctcggggagcttcttatccccgcgcccgccgacgtcaggcgggtccccaagggctccgagcggggctttaattagaagccgctgaagtgttagtacccccatgcggatcttcgtcagt

SEQ ID NO: 27008 - DNA, 123 bp, Homo sapiens
  misc_feature 1..123: note = chr2:289223-289346
  misc_feature 1..123: note = hyper
  source 1..123: mol_type = genomic DNA
caattagagtccatccgttttggagggatccgctctccggacctcgaggggtctgccccgcccgagcccagtccccaggttcgggtccccaagccctggtccccgaggcggggcggccaggag

SEQ ID NO: 27009 - DNA, 740 bp, Homo sapiens
  misc_feature 1..740: note = chr2:289672-290412
  misc_feature 1..740: note = hyper
  source 1..740: mol_type = genomic DNA
attatcaatcagttgcgcactttcccattcgattggtgctttctgggcaagagctggacgtcttccaagtccgcgatctgtttgggaaaggtgttctgagtgcaatcagagaggcggagtgggcgagaattaaaggcctgcaccatgatcggggcagtcgcaggaccgcggcgggaaggtgctggcccaggcgcacgtgagcgcgggcggtgcgggcggaaggctccgcgccccgatcccccagctcccggagaggccccgtctgcgcccgtccccgcgtcctttctctcttcctgcacggggtctgtctcctcaggaggagaaagtgtccggcagagctgggcggggaggcagcgtggagagagaagatatgaaatgtgccggttccggaccccgccccacacccttgggatctgcgttctctccgctcccttgaaaaacagatggtttgatttcacagcgaggcttttctttttctttttgcaagctacatgactgaaatgtgaacatttctgctaaaatacactcaggaaaaagtaaaattttatgtcaaacagaccttaggcacataaaaggaggcatttttcgtttctctctttccccttcccatgtccaagaagacacttgagttccacgggcaagagcgacgcctggcgatggaaccggccctccccggccctgctcccggtcctgcttgccgggcccacctcgcagctggtggacaccgcagttcccagaaa

SEQ ID NO: 27010 - DNA, 119 bp, Homo sapiens
  misc_feature 1..119: note = chr2:468115-468234
  misc_feature 1..119: note = hyper
  source 1..119: mol_type = genomic DNA
cgcgaggggcaggacgaggctgcatgggccagcgagggggtcgacaccgagccagagtgagcgcggggcctggggcgcagagcccgcccagggagccgggagacgccgcgcaagctccc

SEQ ID NO: 27011 - DNA, 280 bp, Homo sapiens
  misc_feature 1..280: note = chr2:468423-468703
  misc_feature 1..280: note = hyper
  source 1..280: mol_type = genomic DNA
ggggctcctgcgcgccccttgaaccccgcctcccgcatcctcctgcaacagcctggagctccctgtgcaggacgcagcggggggcggggggcggtcttaggaggctgcggggcgcactcccacctcctgcctccccgagacccccagcgccttctccagggtttagagcggaggtgaaggggcctcgtcctgcaccgccactgggcgcctgggctgttcatcatcggttaccgccgattcataggaactcctcaacacattggctcggaaatgtacagtc

SEQ ID NO: 27012 - DNA, 198 bp, Homo sapiens
  misc_feature 1..198: note = chr2:945812-946010
  misc_feature 1..198: note = hyper
  source 1..198: mol_type = genomic DNA
ggagactccgcggaccggaggagggataggacccccgagctttgggggcgggaagggagggtggaaggaggaggggagcggggttggggaaagttggagcttcggtatcttttctccgggccaggccgtcctcggggccctgcgctgcgtctccaagtgctgggaagactccgcggggaaaggtctgaggacgcggcc

SEQ ID NO: 27013 - DNA, 207 bp, Homo sapiens; identical to SEQ ID NO: 1921
  misc_feature 1..207: note = chr2:946011-946218
  misc_feature 1..207: note = hyper
  source 1..207: mol_type = genomic DNA

SEQ ID NO: 27014 - DNA, 115 bp, Homo sapiens; identical to SEQ ID NO: 1922
  misc_feature 1..115: note = chr2:946289-946404
  misc_feature 1..115: note = hyper
  source 1..115: mol_type = genomic DNA

SEQ ID NO: 27015 - DNA, 135 bp, Homo sapiens
  misc_feature 1..135: note = chr2:946432-946567
  misc_feature 1..135: note = hyper
  source 1..135: mol_type = genomic DNA
cgctcgccgccctccccgcgggtgcgcgcccggcccctccctcgcccggggcgggtctgcgtgggcggtgctccgggtcggcgggcggagctccggttccccagccctgcgccccggtggagcccgagccggagc

SEQ ID NO: 27016 - DNA, 128 bp, Homo sapiens
  misc_feature 1..128: note = chr2:946916-947044
  misc_feature 1..128: note = hyper
  source 1..128: mol_type = genomic DNA
cgcagtgggcacccgccccctggccgctctgctccctccagcccagtgtcttactggaaacttgcaggctttgctcctccagcgtcttctaaggtttggttttgaggcgcccgggcttccctttactg

SEQ ID NO: 27017 - DNA, 55 bp, Homo sapiens
  misc_feature 1..55: note = chr2:947126-947181
  misc_feature 1..55: note = hyper
  source 1..55: mol_type = genomic DNA
cggtggctcggaccggagcgtcccccctgcagccttcgggcgcccaggccaggtc

SEQ ID NO: 27018 - DNA, 516 bp, Homo sapiens
  misc_feature 1..516: note = chr2:1746517-1747033
  misc_feature 1..516: note = hyper
  source 1..516: mol_type = genomic DNA
tgggctgaccattcacgggctctggaaagaaagccttggtctctctgcggaggaggagaggaactcgggcccccgccccgccccagggcctccaggaagcagcctgcaaactcggcgacccctgggagccgtggtctgtcccagcactttgtttcggaggtaggcgcactggccgcccacttcctgaattgttcactcaatttttttacaacttttgcagactctttgctggtgccaaaaagtcctctggctcagctaagaaacgtgaaaactatttttggcatgcagaaaagtcgctacaggactaaattagagtcggcgcctgaaacgcagcccgcgttcacagatcccgaaaatgttgaatccgactcgcttcagaacacaggaggcctgcagcgaactctggcggcatctcggtacctggagccgcggggcggagggatggggattcctgctgtggagaccgtgacgcgggacggcccgcaggacagggtgtcaaccccaacgcaacgcatc

SEQ ID NO: 27019 - DNA, 358 bp, Homo sapiens
  misc_feature 1..358: note = chr2:1747650-1748008
  misc_feature 1..358: note = hyper
  source 1..358: mol_type = genomic DNA
ggggaagcgggaggccggcggagcatgagagggggcggcgggaggcgagcggggggagccccggaggctccaacaacttcccagtcctgcggggattccgagttccgaacaaaggcggctacgaaggccgcgcgcacagcgctctgttccgcccctcggcgtctcccgcagggcgaacaaaggcccagcgggtccccgcgcccaggtccccccacgtcccccttcggaggttcccttctgcgtcccaagtccccaggccccccgcgcgcccgatgccccctccaccctccgcgccccccacctccgatcacccctgcgctcccggatctccacgaagccccggaccccgcgcccccgg

SEQ ID NO: 27020 - DNA, 339 bp, Homo sapiens
  misc_feature 1..339: note = chr2:1748396-1748735
  misc_feature 1..339: note = hyper
  source 1..339: mol_type = genomic DNA
ggggcgagaacccggggccccagcgtccggcctgagcgccctcatcccggtggggcggcccgcatggccaaggcgagcgctcgggggcgcggaggagagcattggcacccctgattctgcgctcgagactcggggctcgggaccctggggcctacgcgaagcttctccacttctcttacccgtggtttctgcctgcgctcactacgggttttttagttggcgccttaatgtttgtaacacttttagagcgcttgctctgatccgggcacgattccaggcgcgcaggcgcgctcctctctttctccttctccctacccgcaaccacgtaggaaattattt

SEQ ID NO: 27021 - DNA, 42 bp, Homo sapiens
  misc_feature 1..42: note = chr2:5813681-5813723
  misc_feature 1..42: note = hyper
  source 1..42: mol_type = genomic DNA
acacctgcccctccacggccgcgcgggcggaggatggcactg

SEQ ID NO: 27022 - DNA, 226 bp, Homo sapiens
  misc_feature 1..226: note = chr2:5830979-5831205
  misc_feature 1..226: note = hyper
  source 1..226: mol_type = genomic DNA
tttcccagtcctacacggctgatttctctggtgaagggatccgggcagtgtcttaggaactgctcaaagttcccagatacccagtgctggggggtgtggagaaggcgagggtggcgacagaccatacctatgaagcggtgattttctttaattgcccccagaatatccgtagaggtagtagggactcaataaagaaacacaaaggagacgaacacggcacgatcgc

SEQ ID NO: 27023 - DNA, 164 bp, Homo sapiens
  misc_feature 1..164: note = chr2:5831237-5831401
  misc_feature 1..164: note = hyper
  source 1..164: mol_type = genomic DNA
cgccccaggtcgcggctccccggccgccagcgcacctttccatctccagggaaaatatttagacgggaaactcgagtgcaccttattttctctttggtttatgagtgacccagaaggcttctagctcacaatcgcacgatttcaggacgaggctgccggagaag

SEQ ID NO: 27024 - DNA, 86 bp, Homo sapiens
  misc_feature 1..86: note = chr2:5831467-5831553
  misc_feature 1..86: note = hyper
  source 1..86: mol_type = genomic DNA
cggaggggcggggagaggacggggcggggagaggaggggcggggagcagagggagaagggaaggagggcgccgggcccctcgcagg

SEQ ID NO: 27025 - DNA, 259 bp, Homo sapiens; identical to SEQ ID NO: 1924
  misc_feature 1..259: note = chr2:5831789-5832048
  misc_feature 1..259: note = hyper
  source 1..259: mol_type = genomic DNA

SEQ ID NO: 27026 - skipped

SEQ ID NO: 27027 - DNA, 116 bp, Homo sapiens; identical to SEQ ID NO: 1925
  misc_feature 1..116: note = chr2:5832731-5832847
  misc_feature 1..116: note = hyper
  source 1..116: mol_type = genomic DNA

SEQ ID NO: 27028 - DNA, 151 bp, Homo sapiens; identical to SEQ ID NO: 1926
  misc_feature 1..151: note = chr2:5833282-5833433
  misc_feature 1..151: note = hyper
  source 1..151: mol_type = genomic DNA

SEQ ID NO: 27029 - DNA, 141 bp, Homo sapiens; identical to SEQ ID NO: 1927
  misc_feature 1..141: note = chr2:5833499-5833640
  misc_feature 1..141: note = hyper
  source 1..141: mol_type = genomic DNA

SEQ ID NO: 27030 - DNA, 366 bp, Homo sapiens
  misc_feature 1..366: note = chr2:5833734-5834100
  misc_feature 1..366: note = hyper
  source 1..366: mol_type = genomic DNA
cgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgacta

SEQ ID NO: 27031 - DNA, 490 bp, Homo sapiens
  misc_feature 1..490: note = chr2:5836085-5836575
  misc_feature 1..490: note = hyper
  source 1..490: mol_type = genomic DNA
ggctcgggagctggccggggaggggcggatggaggggcctgggttgccagctcccttggtcggggtcctgctcgctggggcttgtgtgttctctgcggcgggccgcgtccccgctgagcctcgcggtgacagccgcctttggcagcgagcgctcggggcacttctatccccgcctctcaaagggtggggacagccgtttccagatttgaattttttctgttctttatttttaacgctgcatcttcgcgtgtgctcagaggtggttgttggcggagaacgccgccgcagtgtttgacctctagcggtgaagggggaaggggaagaggaaaggagagaagtggtcggtgtctgtttccttctgtcccccggggccgtggagctgtcggagggaaggaggacggtgcggggccgcagggggcgcggggcgcggcgggacccaggctacgagcgggagggaggcgggagtcgggggaagacgcggcaggccggc

SEQ ID NO: 27032 - DNA, 124 bp, Homo sapiens
  misc_feature 1..124: note = chr2:5836621-5836745
  misc_feature 1..124: note = hyper
  source 1..124: mol_type = genomic DNA
cgcggtctccggggtgcctgggagggccgaaccactggtgagggcgtggggagcagggggtggcagagggcacccgggcggtagtccgggacgcgcaaggcagagccctgacgctccgggtccc

SEQ ID NO: 27033 - DNA, 165 bp, Homo sapiens
  misc_feature 1..165: note = chr2:5836827-5836992
  misc_feature 1..165: note = hyper
  source 1..165: mol_type = genomic DNA
cgctggcttcccgggcccgcgggccggggagggaagcctcggggctgcggggtgagaggaagaaagcaaacccggggagcaggcggctgccgcacccgcgcaccccgggccctcaccacgccctccccgcgcgccggctcaggggctgccccggaatcagctccc

SEQ ID NO: 27034 - DNA, 116 bp, Homo sapiens; identical to SEQ ID NO: 6040
  misc_feature 1..116: note = chr2:5837352-5837468
  misc_feature 1..116: note = hyper
  source 1..116: mol_type = genomic DNA

SEQ ID NO: 27035 - DNA, 137 bp, Homo sapiens
  misc_feature 1..137: note = chr2:5866074-5866211
  misc_feature 1..137: note = hyper
  source 1..137: mol_type = genomic DNA
ctgggggcagcagagcgacgtgccagcgtccgtgttgggcgggtgtcggggggacccggacaccccgccctccttcctgcagagctctgcgggccctgtggcatccatggagaccctggctccggtttcacaggaag

SEQ ID NO: 27036 - DNA, 228 bp, Homo sapiens
  misc_feature 1..228: note = chr2:6121893-6122121
  misc_feature 1..228: note = hyper
  source 1..228: mol_type = genomic DNA
ttccctgcaataccccgggaccgtcggtaaagcaggctttgtcatcgtctgcgttttcgccgcggcgctgtcctgtctcagctcctcctgactcagctgaagggggctggtgaataatgcatcacctagggagaggcgctggggctgcggggcacagctgagcgtgtgcagagggagcccctcaggctttctctctgtctgcctccatcttaccgtatccagagacca

SEQ ID NO: 27037 - DNA, 30 bp, Homo sapiens
  misc_feature 1..30: note = chr2:7057304-7057334
  misc_feature 1..30: note = hyper
  source 1..30: mol_type = genomic DNA
tgctgtgtgttccctcggtgtaggaatcag

SEQ ID NO: 27038 - DNA, 235 bp, Homo sapiens
  misc_feature 1..235: note = chr2:7058143-7058378
  misc_feature 1..235: note = hyper
  source 1..235: mol_type = genomic DNA
cgggcgagctggcggcgggggctttcaaggttcgcggccccgcccgcagaccctggggctggagcctcggccccaagaggaggtctgggaaaggacgacgcgtccggggcatcgccaccggcggggaaggtcggaactggccaagaggatgccccgcacatcccctgcgcgcggggtccgcggctgctactgcccctggtccccaccgcgagccctttcccggggaatgagccgc

SEQ ID NO: 27039 - DNA, 33 bp, Homo sapiens
  misc_feature 1..33: note = chr2:7571090-7571123
  misc_feature 1..33: note = hyper
  source 1..33: mol_type = genomic DNA
tgggctgcaggcctgcgagtggcaggcgcagcc

SEQ ID NO: 27040 - DNA, 320 bp, Homo sapiens
  misc_feature 1..320: note = chr2:7571157-7571477
  misc_feature 1..320: note = hyper
  source 1..320: mol_type = genomic DNA
cgctgccctctctccggaactgtttttttctgtcctggtctctgaaagccttattgattgctcaaagtgaacttctcagcccacggtttcctcacccccggggcagcttgcatttcctctgccgcggcctctgtcgcctcccctcccgcgcgcctcggccttttacatttcaaatgctcgacagctgggccaacttctgcttccgcccaaagaagggctctttgccgctcacaatggccggccagtggcgcgggggctcttttctctccagctgtgagagaggctttttcaaaggccggggggaagctgccgtccagctg

SEQ ID NO: 27041 - DNA, 150 bp, Homo sapiens
  misc_feature 1..150: note = chr2:7571576-7571726
  misc_feature 1..150: note = hyper
  source 1..150: mol_type = genomic DNA
gggcaggtgaggccaggccggccgggcgtcaccgcaggtgtgcactccgcgcgcgcactcagctcgctttggtgtttctccaggccctcagggcccaccactcctagtcccagcccacaggtctgcccgagtctccgcccaggaatgtgg

SEQ ID NO: 27042 - DNA, 80 bp, Homo sapiens
  misc_feature 1..80: note = chr2:9143213-9143293
  misc_feature 1..80: note = hyper
  source 1..80: mol_type = genomic DNA
ggggtcgctcagaggcgcgcgcggggcaggcagcaccacgccaggctccccaaagcgcagccttccgcaccctttccaca

SEQ ID NO: 27043 - DNA, 340 bp, Homo sapiens
  misc_feature 1..340: note = chr2:10182780-10183120
  misc_feature 1..340: note = hyper
  source 1..340: mol_type = genomic DNA
aaccacaccaagagacgcgagcaaccgaaatatagggagaaaaaaaaaggtgccctggacagcgggctagatgtctcctgcaggctcgaggacttcccggagggggcggcgttttctcggggcctgggaagaatgggcgggtttcagcgggcgccttctgggtgactgcccgtttcggcttcccctgaccccgtaacagagcggaagaggcccagagacgccagaggaggggcgtcagcgggacactcaggccaataagctctgactcccgctgtctgcaaaaatgaccggatgcaggaatgtcacctagaaccggccagctttccgacctctccggtca

SEQ ID NO: 27044 - DNA, 155 bp, Homo sapiens
  misc_feature 1..155: note = chr2:10220786-10220941
  misc_feature 1..155: note = hyper
  source 1..155: mol_type = genomic DNA
gttcatttatggaaacgctccccagacgacgctcgccgggcccgtgggaggccgcgggagcttggggggacttcccaaagcctgagccccctagcgatgcgcggggtgggcgggggaaagaccctgagggctgcgcgcgctgcgttcgcgaggtc

SEQ ID NO: 27045 - DNA, 49 bp, Homo sapiens
  misc_feature 1..49: note = chr2:10220958-10221007
  misc_feature 1..49: note = hyper
  source 1..49: mol_type = genomic DNA
cgacctttcagtgtccgccaggcctgagacgccccgggagggaaggggc

SEQ ID NO: 27046 - DNA, 143 bp, Homo sapiens
  misc_feature 1..143: note = chr2:10444448-10444591
  misc_feature 1..143: note = hyper
  source 1..143: mol_type = genomic DNA
acggcgtaaaattggcgcttcccgcacatgcagatctcgggctcccggggtgtcccggccgccaaaggccacccctttcctcctggctgaccccaattccaccagaggaggatgtttgccagggacgccgagtccagctgctg

SEQ ID NO: 27047 - DNA, 30 bp, Homo sapiens
  misc_feature 1..30: note = chr2:10589172-10589202
  misc_feature 1..30: note = hyper
  source 1..30: mol_type = genomic DNA
atgggtcctggcctgcggaggtagtttccc

SEQ ID NO: 27048 - DNA, 71 bp, Homo sapiens
  misc_feature 1..71: note = chr2:10688822-10688893
  misc_feature 1..71: note = hyper
  source 1..71: mol_type = genomic DNA
tgcttgcagcctggccgcgtgtgcgcctctgctgggatgacccggtcctgttgccccggggccccatcgga

SEQ ID NO: 27049 - DNA, 44 bp, Homo sapiens
  misc_feature 1..44: note = chr2:10861191-10861235
  misc_feature 1..44: note = hyper
  source 1..44: mol_type = genomic DNA
agtttcctgggcaaccgggcgcacacccgcgcccacacggacag

SEQ ID NO: 27050 - DNA, 30 bp, Homo sapiens
  misc_feature 1..30: note = chr2:11052102-11052132
  misc_feature 1..30: note = hyper
  source 1..30: mol_type = genomic DNA
gctctctgcacacctcgagcacctcgcgga

SEQ ID NO: 27051 - DNA, 332 bp, Homo sapiens
  misc_feature 1..332: note = chr2:11052361-11052693
  misc_feature 1..332: note = hyper
  source 1..332: mol_type = genomic DNA
ggtgcatgcctcccccgcggcgcgcccccgcaggctgctgcccgctgtgaccgcccttccccgcaggcgggcgccggccaggctctccccgagatcagcgcacgggtggcacccgccggacccccagcggcagcggcggcggcggctgcagggggcgcggggcggaggctgcgagggcgcgcgcggggaggatggacgggtccggggagcgcagcctcccggagccgggcagccagagctccgctgccagcgacgacatagagatagtcgtcaacgtggggggcgtgcggcaggtgctgtacggggacctcctcagtcagtaccctgagacc

SEQ ID NO: 27052 - DNA, 556 bp, Homo sapiens
  misc_feature 1..556: note = chr2:11622808-11623364
  misc_feature 1..556: note = hyper
  source 1..556: mol_type = genomic DNA
gccaagcccaccgcccggccctcctccgcggccgtcccgaagacccggagaagtggaccacagggggcggccagtgtcaggggtcgagtcctccgcgctggccgcggttccggagatccgggctttgccgagcgccccgcgccgtggccggggccggggccaggtccgggtgcggggcctggcgctgcggccgcgagctcagcctgtaggctgggctagcctccgtcggcggcgggcgctcaggagcggggccgcggcggccggaggacaaagggcccgaggtaggagcggtccctccgggcggcagcgggcggagcgggggcgcggggctgtgcggggctgctcggggcgggcactcggcgcccggcggggaaggtgcgccccgccggacgcgggcacttcctggccctggtcccgggaaggaggtggaaggtgtccgggatcggccctggcagcgtgtagggacctgggtgctgccgctgccgtgcgcttgtgcgtgcgtgtgcgcgcgggtataggtgtgggcgcgcgtgtgtgtggggtgtgcgtgcgtgtg

SEQ ID NO: 27053 - DNA, 135 bp, Homo sapiens
  misc_feature 1..135: note = chr2:11623424-11623559
  misc_feature 1..135: note = hyper
  source 1..135: mol_type = genomic DNA
catgtgtacgcgtgtatcggtgtgcgcgcgcgtgtgtgtgtgtgagagagagagagcacccgaggctcctggcgcttggcacatggtgagccctcggtaggtgggagccgtgaacagtgacggtgataatcgtat

SEQ ID NO: 27054 - DNA, 289 bp, Homo sapiens
  misc_feature 1..289: note = chr2:12858341-12858630
  misc_feature 1..289: note = hyper
  source 1..289: mol_type = genomic DNA
tcagtggcaccgaggcgcctgcagccgcactcgccagcgactcatctctccagcgggtttttttttgtttgtcgtgtgcgatcctcacactcatgaacatacacaggtctacccccatcacaatagcgagatatgggagatcgcggaacaaaacccaggatttcgaagagttgtcgtctataaggtccgcggagcccagccagagtttcagcccgaacctcggctccccgagcccgcccgagactccgaacttgtcgcattgcgtttcttgtatcgggaaatacttatt

SEQ ID NO: 27055 - DNA, 30 bp, Homo sapiens
  misc_feature 1..30: note = chr2:14773043-14773073
  misc_feature 1..30: note = hyper
  source 1..30: mol_type = genomic DNA
ggagcagggaaatcacgggtagggagaagc

SEQ ID NO: 27056 - DNA, 71 bp, Homo sapiens
  misc_feature 1..71: note = chr2:14773957-14774028
  misc_feature 1..71: note = hyper
  source 1..71: mol_type = genomic DNA
ggcacgtaagctagccggcaggtcccaggggcactgcacgtcttggggagggacaccgaaaggggcagccc

SEQ ID NO: 27057 - DNA, 50 bp, Homo sapiens
  misc_feature 1..50: note = chr2:14774593-14774643
  misc_feature 1..50: note = hyper
  source 1..50: mol_type = genomic DNA
acagcctgtatgaggcgggcgcggccaacgtgggccgggtggtgaatagc

SEQ ID NO: 27058 - DNA, 319 bp, Homo sapiens
  misc_feature 1..319: note = chr2:14774939-14775258
  misc_feature 1..319: note = hyper
  source 1..319: mol_type = genomic DNA
agtgctccaggagctcgccgacctcgtggacgacaaggagtagccgcctaggggctgccggcccctctgcctcccccgcacctcgctcccttcccttccccgcacccggacttcgcagtcagcggttctcaacctctgccccgccccgccacgcgcgtccgccgccggtggcccgggcccgggctgcacccccgcatccccaagccagcggcaggaagtctcaggaactgccccagggccgaaagggcgccgctgcgagcgcctggctgacagccacagcggtggtgacggtgctgggagaccccgcgtgcgctttccc

SEQ ID NO: 27059 - DNA, 83 bp, Homo sapiens
  misc_feature 1..83: note = chr2:14775608-14775691
  misc_feature 1..83: note = hyper
  source 1..83: mol_type = genomic DNA
ttgtgttccaggctgcgggctaagccagacagtgtttgcctccggttctttccaccgtgggaagcgaacgccacccccacccg

SEQ ID NO: 27060 - DNA, 46 bp, Homo sapiens
  misc_feature 1..46: note = chr2:16080930-16080976
  misc_feature 1..46: note = hyper
  source 1..46: mol_type = genomic DNA
ccctggacgggattgcgacgtgcgcaccgggcgccctaatatgccc

SEQ ID NO: 27061 - DNA, 989 bp, Homo sapiens
  misc_feature 1..989: note = chr2:16082016-16083005
  misc_feature 1..989: note = hyper
  source 1..989: mol_type = genomic DNA
cccctcggtctgccccgtttgcccaccctctccggtgtgtctgtcggttgcagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcaggtaaagaccgaactcgggtccggctgcct

SEQ ID NO: 27062 - DNA, 43 bp, Homo sapiens
  misc_feature 1..43: note = chr2:17699420-17699463
  misc_feature 1..43: note = hyper
  source 1..43: mol_type = genomic DNA
agtctgtggagttatcgaaaatagcattcgttgaaacaaggag

SEQ ID NO: 27063 - DNA, 135 bp, Homo sapiens
  misc_feature 1..135: note = chr2:17719677-17719812
  misc_feature 1..135: note = hyper
  source 1..135: mol_type = genomic DNA
taaacattacaatatcgcatttaggacgcaaacagcgctgcagtgcaaatggaactttaaaaaatctgcccgcccacgtagacaaagctactttacaaaagcgcacgcgtcgatatcaatcgtaccctacaacag

SEQ ID NO: 27064 - DNA, 290 bp, Homo sapiens
  misc_feature 1..290: note = chr2:17720027-17720317
  misc_feature 1..290: note = hyper
  source 1..290: mol_type = genomic DNA
tgtagtaggggaaatcgaccaaagacgagattttgaaagccttttgaaagtcgtttttctagctaaaaagaaaaagtgacttattcaggactgactccccctgccagtcccaggaaacaggagcagcccggcgcgcccgggagccccgcagcgcagtgcgcactgcggctccagagcgaagggctggcgcccgccagattctaaacgtgctcggctgccgcagcccgccggggccgcgcgccgtggtccgcgcgactccgcgctccgggtttccgcggtcaccagcactg

SEQ ID NO: 27065 - DNA, 157 bp, Homo sapiens
  misc_feature 1..157: note = chr2:17721522-17721679
  misc_feature 1..157: note = hyper
  source 1..157: mol_type = genomic DNA
taacaaagggtgggccgggggtcggctaggacagaaagcagcgggaaaagcggctccacgtgttccatctctggcctcggccttcagcccccaggttcggtaaccactgggcgtggcgagtccgggtaacccgcagtccctcgcgcccgtccaggtg

SEQ ID NO: 27066 - DNA, 117 bp, Homo sapiens
  misc_feature 1..117: note = chr2:17721750-17721867
  misc_feature 1..117: note = hyper
  source 1..117: mol_type = genomic DNA
cgtggaatccacccgcggaaactccgagcccctccgactgagcatgcgccatcgccaggcggcttttggtcacaggctcccgagttctcctagctggggctgcggagctggggggag

SEQ ID NO: 27067 - DNA, 151 bp, Homo sapiens
  misc_feature 1..151: note = chr2:18011883-18012034
  misc_feature 1..151: note = hyper
  source 1..151: mol_type = genomic DNA
actggctgcagatcccgcaaccctcgggtgttcaagtgcgcggggtggtgcgggcgctcccgcagtccgcgcttggctcgtgggaggcctcgggcgccccctccaggattccgtgctaactgcaaacgatcgcgctcgcagggaggccccc

SEQ ID NO: 27068 - DNA, 1192 bp, Homo sapiens
  misc_feature 1..1192: note = chr2:18058949-18060141
  misc_feature 1..1192: note = hyper
  source 1..1192: mol_type = genomic DNA
ccagggaacactgggcgccttagcttggagcagctggctccgaggaattgttccacgtctgcacaacttaaaaatctgcagtttgggggcgggagggggagcgcgggggtgggtcccgaagcgtcccatttctcctcctggctgttaactgagcgctctcgctcagtgcagcgaggccagcgatgccttctggaccacacgctgtcctcgccgaggtcctggtttgttcctcaacgtcggctgaaggcatcgtcccctgacttcctcttccattcgtccttccgaaaggggacccgactggttcctcttctacatatgaggcgcatctgcttggtgcaaatgtccaagcacctcttctgactcggtgagtggaggaataagacaaagcatcttgttctgcactgtgcctgagtcttcaggcagcgggaccgatggcaaacattggcaggaactggagctatatgtactctccttcgcactttgttttaaaacaagtttgggcctcgcgatttcctgaggaaatccaggcaaattagcaaagtgtcgcttgggccgcgactttagaaaggcggttgccccagccgccggggccgcgggggaggtcatctttttcccgcagggccacggcgcttccggcccaggagggcgcgcaggtgggaggcgcggggcgcgctcctggtcccacccggacagcgcctgccgctccggggtgactctgcacttgggcctgggcgggggcgcgcggccggcagggcagcatctaggtctatgggtctgtccgcctgtctggcggtcggagccccgcagtcctcagccgcccgcgccctcggcccggggcgcccggctgcgggcccgaagcgaggggctggcggagctgcgaccaatggggcggcggccgagcggcgggccccgccccgtcccgtccggccccgccccgcccgcagctcccgggagcctcgctctagcggggcgggaccgacggacagaccggccgacgcgggccaccccgctctcctcgccgccgcggcggcaggcgcggggccgcgccgcgaggcctgatccctgcagcgcgggcaggcggcgtcgcagagcggagctagctggatgcgtccggactcctgcaggtacctggctggcgtccccacctccctgcgcgctccggagacttctccgggcgaccctgcaactttac

SEQ ID NO: 27069 - DNA, 30 bp, Homo sapiens
  misc_feature 1..30: note = chr2:18060643-18060673
  misc_feature 1..30: note = hyper
  source 1..30: mol_type = genomic DNA
agttgcagggaagagcgaacccagggccct

SEQ ID NO: 27070 - DNA, 67 bp, Homo sapiens
  misc_feature 1..67: note = chr2:19551382-19551449
  misc_feature 1..67: note = hyper
  source 1..67: mol_type = genomic DNA
cgcggcagcggaggccgggccccctgcagaccccaggcccgaggtccccgtcccgctctcctagtcc

SEQ ID NO: 27071 - DNA, 157 bp, Homo sapiens
  misc_feature 1..157: note = chr2:19551499-19551656
  misc_feature 1..157: note = hyper
  source 1..157: mol_type = genomic DNA
cgcggtccctagggcaggaggctgaagcagatacagggattacacttttgcaggctccgggggtgggggcaggggcgggaggaggaggtgggagctgccagtgctaaggacttcgttgcctctcctctctccactcactctccgcagtcagagttac

SEQ ID NO: 27072 - DNA, 282 bp, Homo sapiens
  misc_feature 1..282: note = chr2:19556318-19556600
  misc_feature 1..282: note = hyper
  source 1..282: mol_type = genomic DNA
ggatgagtgagcccccggctcctccggctccggtttcccagaccgcggaaccccagggcgaatactttcgatctttaaacacaggatggaaaacccttccccaggctaggcacccattcctcaaacagcttgggcctcaggacctgcgggaaagaataaggggacccgaccacgcacagcagacgcaattcgcgctcgggatcccgagtccctgcgcagtgcgggcactcgcgtccctcgcgcggtggagcgccaatcccaggtctgcggccagtcctatgc

SEQ ID NO: 27073 - DNA, 105 bp, Homo sapiens
  misc_feature 1..105: note = chr2:19556980-19557085
  misc_feature 1..105: note = hyper
  source 1..105: mol_type = genomic DNA
cgccgccggtcgctgctagtcccctccagcgcttctcttccctagggggttgtgaacctgggacacctagccttgcacgtggttttgttccgcagagccaatgcg

SEQ ID NO: 27074 - DNA, 33 bp, Homo sapiens
  misc_feature 1..33: note = chr2:19558008-19558041
  misc_feature 1..33: note = hyper
  source 1..33: mol_type = genomic DNA
gagagaggaggcacccgccgagcagtgacaagg

SEQ ID NO: 27075 - DNA, 30 bp, Homo sapiens
  misc_feature 1..30: note = chr2:19558491-19558521
  misc_feature 1..30: note = hyper
  source 1..30: mol_type = genomic DNA
cccaaccctgccctgcgcctgcgcaatgaa

SEQ ID NO: 27076 - DNA, 251 bp, Homo sapiens
  misc_feature 1..251: note = chr2:19558733-19558984
  misc_feature 1..251: note = hyper
  source 1..251: mol_type = genomic DNA
tcctaggacacagcccgtgctctttgggaggagggagggaggggcagtagctctgtgcaccgggatccccacaccgcggcttgggtttcaacgcactttggcgcctgacagagtcgcatctcctcccagaatctctttccagaggcggcagaccccgagtgtggagcagctcctggctatccaagcgtgctcggggccagggtgttaacccaggcagcgctggttaattcctggtgcgggagggccagggt

SEQ ID NO: 27077 - DNA, 342 bp, Homo sapiens
  misc_feature 1..342: note = chr2:19561131-19561473
  misc_feature 1..342: note = hyper
  source 1..342: mol_type = genomic DNA
catgtgtttaggactcgcgaggacgtcacgtttcgaatttggtaaaagtcctcggtagctaggacccaacagttctgccctcctggaaacccaatgaaggtgacaaaactcccatctcattactgggagtccagcgcactccgccaccgcggctgcagcttctgctagctcggagcctgcggactccagccggcgcgaactccgccgcgactctttctggctctctcgctcactgccttcggggcggaaccgcgggcgccggagtggtcccagactcggctgggaccgggcagcctagaagaagggtcccctcagtagagaccaggcctccagctctccgtc

SEQ ID NO: 27078 - DNA, 184 bp, Homo sapiens
  misc_feature 1..184: note = chr2:19561523-19561707
  misc_feature 1..184: note = hyper
  source 1..184: mol_type = genomic DNA
cgatccctccgtctgcccgggcttccgggctgtggaccgcactgaacccagtcccgcagcaagccctgctgccgccttttcctgggcacgcctgcggtggtgacggcccgctgctcatgtctccacgccaaaccccagcccctctcccgattcctgctccttggtaaagcgccccagcctgtct

SEQ ID NO: 27079 - DNA, 30 bp, Homo sapiens
  misc_feature 1..30: note = chr2:19563338-19563368
  misc_feature 1..30: note = hyper
  source 1..30: mol_type = genomic DNA
ccctcccggcacacccggaggtgagaagtg

SEQ ID NO: 27080 - DNA, 195 bp, Homo sapiens
  misc_feature 1..195: note = chr2:20068725-20068920
  misc_feature 1..195: note = hyper
  source 1..195: mol_type = genomic DNA
tgggatgcaagtgcccgccaagccccccgtttcccacgtggagttcccacagggcagcagggaggggccgcgccttctctaactgacccgaaccgacccgggcttcacaggcttcgtggagagcagctgccccgccggcatcttccggatgaggctctctagacaacaaagccttctacgcggaagttactggtg

SEQ ID NO: 27081 - DNA, 67 bp, Homo sapiens
  misc_feature 1..67: note = chr2:20212718-20212785
  misc_feature 1..67: note = hyper
  source 1..67: mol_type = genomic DNA
cggctgcagcctgcccggccctccactctccctcccaccccagcggggcctgcgccccaggtacggg

SEQ ID NO: 27082 - DNA, 133 bp, Homo sapiens; identical to SEQ ID NO: 1931
  misc_feature 1..133: note = chr2:20865714-20865847
  misc_feature 1..133: note = hyper
  source 1..133: mol_type = genomic DNA

SEQ ID NO: 27083 - DNA, 408 bp, Homo sapiens
  misc_feature 1..408: note = chr2:20865848-20866256
  misc_feature 1..408: note = hyper
  source 1..408: mol_type = genomic DNA
ttcccctgagacttggcctccgcaacctgtcccagccgcggagcaaactgctctgcggcccgcgcgagtgcgccccagggcttcgccgctgccgggcgtcccctccatccacctcgggacccgcgccatcaccgcggcggggtaagaagctcggaggcgccatcccggggctctgcgccgtccgctctcccggctcctggccgctcacgcacacagccggtagctggttttcgttagccgctgccctcgcccagaaggcgggtggaaggtcgccagttggacgcacagccaaactcttagcgcactcccgcgcgagatcccccatcacccggggctgccgtcctcatttcgagctctttctagagcttggctcccgctgaagcgcaacttccgcgcccaaaccttgct

SEQ ID NO: 27084 - DNA, 65 bp, Homo sapiens
  misc_feature 1..65: note = chr2:20867171-20867236
  misc_feature 1..65: note = hyper
  source 1..65: mol_type = genomic DNA
gcgccgcggctgtcccggccgccgcggttccccgggcccgcgccgcgcgccgcgccgcgggctcc

SEQ ID NO: 27085 - DNA, 349 bp, Homo sapiens
  misc_feature 1..349: note = chr2:21022707-21023056
  misc_feature 1..349: note = hyper
  source 1..349: mol_type = genomic DNA
atagagaagaaggggcgccagatcccgcgtgcctgcccacccgtccttcctttgggcagtcaccctgagctcggcaagctgtacctcacctgtccacctggaaggctgcccgctctccctgagggtcctgggaaggcggcacgagaccggaagtgcccccctcaggtgacgtcacagtaccgcgccggagctgatccgggaagccgatgtcagcctggcgcgcggcgcacagctggctgggagatttcttactggcttggagccggtggtccagatcagagagacctcttggagggtgtcggggttttcctttctttttcatttgaattttatccgccttttattttct

SEQ ID NO: 27086 - DNA, 131 bp, Homo sapiens
  misc_feature 1..131: note = chr2:23608959-23609090
  misc_feature 1..131: note = hyper
  source 1..131: mol_type = genomic DNA
tgtgtgacccctggccggagcagcccccctgctgggcccggcggcgcgcgcccctctccaggccacgttcccctgagcggcccagggccccggccgggcaggagacctggaggcgacggagggctggcccc

SEQ ID NO: 27087 - DNA, 120 bp, Homo sapiens
  misc_feature 1..120: note = chr2:23609527-23609647
  misc_feature 1..120: note = hyper
  source 1..120: mol_type = genomic DNA
ctccgtggcctggagcgggctgagagcgctagggttatctgcggtcgccgcgcgggtgcccgcgctgggcagcgtcggccccgggccccaagggagggacgtgctcgcctggggccggag

SEQ ID NO: 27088 - DNA, 174 bp, Homo sapiens
  misc_feature 1..174: note = chr2:23609896-23610070
  misc_feature 1..174: note = hyper
  source 1..174: mol_type = genomic DNA
tgggtaaggagctgccgccgccgccgctgccatccccgccgctctgcaaacgttctcctccctccctcccgtgcttgcgccgcggcgcgccccgggcgaatcgtggacgcaggtatttatgtagcattaggcgagacctcggcgctggagggaccagaccgtggaggacgccga

SEQ ID NO: 27089 - DNA, 16 bp, Homo sapiens
  misc_feature 1..16: note = chr2:24232773-24232789
  misc_feature 1..16: note = hyper
  source 1..16: mol_type = genomic DNA
gtcctgagggcctgcc

SEQ ID NO: 27090 - DNA, 114 bp, Homo sapiens
  misc_feature 1..114: note = chr2:24233349-24233463
  misc_feature 1..114: note = hyper
  source 1..114: mol_type = genomic DNA
gcaggtcctcccggggtccccgagctctgggcaggcagggctttctgaagcgcctggggaggctgcgtccttcccgacctcaggcagctgctgtggcctcggcctccctcccag

SEQ ID NO: 27091 - DNA, 199 bp, Homo sapiens
  misc_feature 1..199: note = chr2:24273048-24273247
  misc_feature 1..199: note = hyper
  source 1..199: mol_type = genomic DNA
agtcgttcggttatccgctgctgctgataccccagcctgggtttcggcttcgctttccctgccctactcggcgagctctggaaagcaggacctgctctcggatacccgctgctcggggacctcctcctagcgcgtcccccgccgggcctcccctcggtcgcttccctgcgggccgggctgtgagcggctgtggggacag

SEQ ID NO: 27092 - DNA, 209 bp, Homo sapiens
  misc_feature 1..209: note = chr2:25354748-25354957
  misc_feature 1..209: note = hyper
  source 1..209: mol_type = genomic DNA
catgttccaggaggccgtcatcaagaccgtgggtgcggcgcggggccgggccggggcggggcggggccgaggcgcggagtggggaggggaggggagggacgggacggggcccaggggctcaagactgaggcgcagggcggggtggggccaaggggaggaaagagggaccctggaaaggggcggggcaccgggggcggcccggggatggg

SEQ ID NO: 27093 - DNA, 699 bp, Homo sapiens
  misc_feature 1..699: note = chr2:25391035-25391734
  misc_feature 1..699: note = hyper
  source 1..699: mol_type = genomic DNA
aaagaccgggttgtcccaagacctcctagcaagctctcggagcctccggaccgccgcgagcccctgggggagaggaggccgccggctccctggagacagcgcctgcagcttcgcggccgtccgcccaggggccggacgtgggccctccagctcagctactggcggcttctcatgccgcagtcggcgcagaaagtttgtcgagaactcgggaccgcggagagccagaggcgcccaggtccgccttcggagccggagccggccgactgcatcgcgaggacggggacaggggatcccggggaaagagcacgggtcccccacgctgcgcccttacctgtctcgggaggctgctctctgagggcggggacgctcggcggcctctctcggtcgcggctcttcttcccctccttcgccgccgcttggtcccgcgctcctctgtccttatatacttgccgagctctcctggtgggcgcgggactttgaccttcccggcagcacaaggagcagctccccgggccaggggaaggggggccgcggggcgtgggaggggggcttccagacgggggacgagcgcggggagacgcgctggaaaggggctggaattagcactgtcctgccgaaggcgcacctggccgctcgccctcaggaagaacttaattatggatggcgttgggtctccgcttagaacgggcgggaggctta

SEQ ID NO: 27094 - DNA, 51 bp, Homo sapiens
  misc_feature 1..51: note = chr2:25438821-25438872
  misc_feature 1..51: note = hyper
  source 1..51: mol_type = genomic DNA
atttatcctaaaaaacgacaaggtccgggcgcccagcagaacggcccggct

SEQ ID NO: 27095 - DNA, 245 bp, Homo sapiens
  misc_feature 1..245: note = chr2:25439138-25439383
  misc_feature 1..245: note = hyper
  source 1..245: mol_type = genomic DNA
ggagtgcccggcgcccgtcgaaaggcccctgcgccggttcaggacccgcacccagctacgctgcggagccccagctcgcagcaccctcccacccaccgctcctggctgcttttctcctgagtctgcggggcggggtcgtttttgttttttacaaaaatgtatgtaaaggtatttcgatgagtgaaggaacacgctataatgctcactcaatgcagcatcggtgataattgcgccggcgggcgcgg

SEQ ID NO: 27096 - DNA, 57 bp, Homo sapiens
  misc_feature 1..57: note = chr2:26395401-26395458
  misc_feature 1..57: note = hyper
  source 1..57: mol_type = genomic DNA
gcagaattcagaacccgagctttgggcggcggagcaggacagggcgcgggtgggcgc

SEQ ID NO: 27097 - DNA, 53 bp, Homo sapiens
  misc_feature 1..53: note = chr2:26395459-26395512
  misc_feature 1..53: note = hyper
  source 1..53: mol_type = genomic DNA
gcctccgggaggccagcacgagggggagcggcggggcccggacacacccagcc

SEQ ID NO: 27098 - DNA, 282 bp, Homo sapiens
  misc_feature 1..282: note = chr2:26396681-26396963
  misc_feature 1..282: note = hyper
  source 1..282: mol_type = genomic DNA
ccctaggagcagcctcggtcctggggcgggcaggccaccttcgggagaggccggcgggagccgggtctgctgcccggcgtgacccccaaactcccggccctcccccgaatcttgtcccacttcttaataggacctggggcccccagccgctcggctgatggaaccacgcatgggggcccgagagggtacgcccggaggctgcatggagcgaggggaccgtttggggggaggggggtgctgcttggttgggggatgggcggtagccggggctggcagccaggc

SEQ ID NO: 27099 - DNA, 46 bp, Homo sapiens
  misc_feature 1..46: note = chr2:26397014-26397060
  misc_feature 1..46: note = hyper
  source 1..46: mol_type = genomic DNA
cgcttccatgaatgctaatggggcccgcggccgcaggctcctcgtc

SEQ ID NO: 27100 - DNA, 524 bp, Homo sapiens
  misc_feature 1..524: note = chr2:26401702-26402226
  misc_feature 1..524: note = hyper
  source 1..524: mol_type = genomic DNA
ccagccccatcttttcgcggggctgcttctgtccgcccgcacgggggaggggaggaggaggcggaggcggaggcagaggcccctaggagggcgaaggccggcgggttaacgaggaggcgctgagtgcacggctgggctccacgctgatttctcctaatgaattaataatggcgctcgggcgggcgggggtggccggctgcggaccgcggagagagccgaggggaaggccgtggagggaggaggacggcgactcgcgccgggtggggctgaaggcactgcggggtgactcggtctccaggctgcggcgctctgctccgggagtcagggagacctggcctggccccgtactgtcccccgtcccagcccccgcccctggccctgcgggaggggccaggcgtcttccctgagcatggtgccacttccccagtgttggccttgtttcctgctcagcatttggcagatgcgcctctggcccaactaggatgtttccattttacagacgggaaatccgaagcccagagaga

SEQ ID NO: 27101 - DNA, 179 bp, Homo sapiens; identical to SEQ ID NO: 145
  misc_feature 1..179: note = chr2:26407743-26407922
  misc_feature 1..179: note = hyper
  source 1..179: mol_type = genomic DNA

SEQ ID NO: 27102 - DNA, 149 bp, Homo sapiens
  misc_feature 1..149: note = chr2:26521984-26522133
  misc_feature 1..149: note = hyper
  source 1..149: mol_type = genomic DNA
gtgcgggttgtgttccgaggccagtgtgggggaaaccagacctagaacgttgtatacggctgataggaccaggtccaccgctgcagcaggctgtgagaggggaaggcacgttcctggctaagcagcgtccaaaactcccgtaataggac

SEQ ID NO: 27103 - DNA, 390 bp, Homo sapiens
  misc_feature 1..390: note = chr2:26915677-26916067
  misc_feature 1..390: note = hyper
  source 1..390: mol_type = genomic DNA
agcggcggccggggccgaggcgcgggccgggggcgccggggggccggcggcggcccgggcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggtaacggctcgccgggcggggggcgggaacccagggctggg

SEQ ID NO: 27104 - DNA, 301 bp, Homo sapiens
  misc_feature 1..301: note = chr2:26916088-26916389
  misc_feature 1..301: note = hyper
  source 1..301: mol_type = genomic DNA
cggggccggctggggctgggggcgggggctcccccgagaggggctgggcgccgaaccctgcgctcgcagaaacccgagttcagcctggcgtgtgtgctccgcggggacggaactcggggaggcgtcgattcctggctccggacctgactctccggccgggccagccctaacttggccctgccatgttgcataggcccccagggactccgaagtgtgtgagaggggcagggacgaccggcggaggctcgggcaggaggggtgtggccgggccaggccctgaacagggcgctgagagtgagcg

SEQ ID NO: 27105 - DNA, 30 bp, Homo sapiens
  misc_feature 1..30: note = chr2:27069901-27069931
  misc_feature 1..30: note = hyper
  source 1..30: mol_type = genomic DNA
gatcgccggggagcccggggagggagggat

SEQ ID NO: 27106 - DNA, 950 bp, Homo sapiens
  misc_feature 1..950: note = chr2:27070324-27071274
  misc_feature 1..950: note = hyper
  source 1..950: mol_type = genomic DNA
tctcagtggagagaacgcactccgggttcgagacctccccgggtgcagatgcgaactgcggtggccccaagtggccgtccactttgttcatgagaacagttttcctataacgcccacccggccctttgcatcccgcaatcccgcgggcgtcggagcgggtcttggcgcgaaccaggcggcctcggcggggtcctgcggcggagggcagcgcggccgcagcccgggagaggcggccgcggcattgtttcagcccctggggtgggatccagctgggggaggggaggcggggtgtcctccggaaccgcccccggccctccctggggacccgtgcctcagcgcgtccaggctttgtggtgtcctgagtcgccatggaaacccgagggaacgcggagccgggtgctaggggggtcggtgagttctccggccgcgccctccgtccgctctcggaccccggccctgcagcagggcctgccgggagttgtagtccccaggcggcggcggcgcgcggcgccaaggatgcgggacgccgcctgtccccgcctccccttaacctgctagctgaggtggggagcggcgggaggagccggccgcgcggtgattggcggaggccgctcccagcccccgacacgcgcccctcccccgctccccactctggactcccgcgctgggcgcgctgaggcggcccccgagcgagcgcgcgtgcagccgccgccgccccgagcacccgcagctccggcgccgcggcgagacggagacggaccgagccacgggcccccgcggccgcagcatctcggaggagtgggtgatggcaggggggtcggtgggcttacccctcccgggctaggacatcctcctctcccccttctgtttctgcgtgaggcgcacaaaagggcggggagccgggtgagcctggggcccggccgcaggggacgcggcgggaggtgtggttt

SEQ ID NO: 27107 - DNA, 161 bp, Homo sapiens
  misc_feature 1..161: note = chr2:27071758-27071919
  misc_feature 1..161: note = hyper
  source 1..161: mol_type = genomic DNA
ccgagccgggtccctcggctggagcccagcgcgggagcccgccttgcagcatcgatctcagcgggcaccgacgtcgacgccccgggcctggggacggggctgtagtctgagctggagagaagccgggagagggcgaggggaggcctcggttgagaaaagat

SEQ ID NO: 27108 - DNA, 30 bp, Homo sapiens
  misc_feature 1..30: note = chr2:27072330-27072360
  misc_feature 1..30: note = hyper
  source 1..30: mol_type = genomic DNA
ccaggatggcagatccgggaccgggctggg

SEQ ID NO: 27109 - DNA, 359 bp, Homo sapiens
  misc_feature 1..359: note = chr2:27072672-27073031
  misc_feature 1..359: note = hyper
  source 1..359: mol_type = genomic DNA
ccacgccgggaatcccgtgtgggaggcgctcccccggcctgggggcctgcagacagccacccccccactccggctcgggtgccttctggtgcagcgccgccgcccgccccgcgctgtccacccgctgccgagacgcggcgtggttagcggcgcggagctgccgggcggcgacgcaggtgccaaagactggaggtcgcctcggtgcagcgcgggttcccccgagcagcggctttgtctgccgaggcggccgtagtctaggggctgcagctgtgctttctcagggggagccgtaagggctggtgcggattgtggtcaaattgcggagaagcgggtggaaatgatcccgcaagggtgaggct

SEQ ID NO: 27110 - DNA, 302 bp, Homo sapiens
  misc_feature 1..302: note = chr2:27341792-27342094
  misc_feature 1..302: note = hyper
  source 1..302: mol_type = genomic DNA
gccgccagcctcccccgggccgctccacgtggccgctccacgtcgccctcccggctggagccgccgccctggccgggcagagtccggagccagtgccagccgccgccccgcccgccggacctggcccttcgcagctccaccagcgcccccgctgcgcccgcggccggaggggctgcgcgcgcccgtgtgagtgtgcgcgtgtgtgcgtgcgtgagtgcgcatgtgcgcgtgtgcgagtccgcgtgtgctcgtgagtgcgctcgtgtgcttgtgcgggtgtgcacatgcgtgtgacattgtga

SEQ ID NO: 27111 - DNA, 168 bp, Homo sapiens
  misc_feature 1..168: note = chr2:27473190-27473358
  misc_feature 1..168: note = hyper
  source 1..168: mol_type = genomic DNA
tgccccagttgggggcgctgctccccagccagccgggctctaggaagcgggagggccaaatgcctcctttaagccggctgcaccggggccctgaccgggcgggagggctgctggagggtggtgcttatcacccgggcttcctcttgaccctgccggctgggccctggg

SEQ ID NO: 27112 - DNA, 482 bp, Homo sapiens
  misc_feature 1..482: note = chr2:27484899-27485381
  misc_feature 1..482: note = hyper
  source 1..482: mol_type = genomic DNA
agacaagatggcccacgggggtgggcagggaggtcggacggccgctcagaggggcaggtggacggtggcggcaggcgcgggggccggcggggcgcgttggcggttctcctgccacccccggcccgctgtcccggccgctccgcgcgcctcatttcacacctcgccgcccccggccccgtctgtgcggagccgggaatacccccgctgcccagaccgcacctgctccttcctcgccgccccctcgcttcccggcggccgcccgccccccaggggcccgcaagacccgcgcggagcccggcccatcctcgggccccggcgcccacagctggccgcggctggagggggcgcgcggaggggagcccccggggcctacagagggagctctgaagcctgggcagcgaggcgctcccgccctgggcccggggcaatgcggaccttggcgcaccgggcgagggctccggcccgaccgagcggcagctgct

SEQ ID NO: 27113 - DNA, 30 bp, Homo sapiens
  misc_feature 1..30: note = chr2:27485609-27485639
  misc_feature 1..30: note = hyper
  source 1..30: mol_type = genomic DNA
agacaacgaaatggacggagggtagtaggg

SEQ ID NO: 27114 - DNA, 32 bp, Homo sapiens
  misc_feature 1..32: note = chr2:27486442-27486474
  misc_feature 1..32: note = hyper
  source 1..32: mol_type = genomic DNA
tgccaatcactgtaccgcgaatgatcatttat

SEQ ID NO: 27115 - DNA, 181 bp, Homo sapiens
  misc_feature 1..181: note = chr2:27486854-27487035
  misc_feature 1..181: note = hyper
  source 1..181: mol_type = genomic DNA
acccaggggagggagcgacttacagcaaagtcggtggccgagcctcaagtcgaagcttcaaatgctcaatgttctctcccctcgcacctgccgccactgtagaatgggagggggtgggaagaggattgtgcactcgaagctgtgacagtctgtgaagaggagggtccgtaggaggagggga

SEQ ID NO: 27116 - DNA, 200 bp, Homo sapiens
  misc_feature 1..200: note = chr2:27717830-27718030
  misc_feature 1..200: note = hyper
  source 1..200: mol_type = genomic DNA
cctaccccatcccggcgcgggcccggcgacgcgggcagcgcggggccgagctgcgggcggagcgggcgcgggtctgcggagcccccagggctcgagcgggccacggagtctgtccgggagcagggggcgttgcccggacgctggcctgggtccccggtgcgggaggcagtgcggcggcctccgcccgcccctgcagcggg

SEQ ID NO: 27117 - DNA, 296 bp, Homo sapiens
  misc_feature 1..296: note = chr2:27938325-27938621
  misc_feature 1..296: note = hyper
  source 1..296: mol_type = genomic DNA
gggggcaggcctggccgagtggctccgtgaagacgcaggcgcggccggagggcgcggggctcgggcaggatcgcgccgccgggccgggagggggctgcgggcgcgcggcggatgtcacggcttacctcagagcccaaattagaaggctgaaaaaatcacagcaggaaataatgtgctgcctaaaatagaagcatcaactgggagagaggccggggagtaggtggcatctgaggctcccgccgcgtcctccccagcggctgcctgacgctgcatcggaggcgcgtgggtggcgcccg

SEQ ID NO: 27118 - DNA, 326 bp, Homo sapiens
  misc_feature 1..326: note = chr2:29033372-29033698
  misc_feature 1..326: note = hyper
  source 1..326: mol_type = genomic DNA
gcggggaggggaggccgcagccccagccccgggggcctggttgtctaatcgaagggaagtaaacggccccaacgcaagcctgactgcgagacgtgcccaagggaggtaggtcgaatgaagagggttgtgtgagttttgcgcgggcaggcgggataacggaggagggaggcccgcggccgaggctcgggcgggcggggggcagggaggggcggggttcgccggcgcgcactcccaggcaggccccgccccctcggccggctgtgcgcgctgattggcccctgccggcctcgcgctccctcgctccgggttggcgggagaccttagag

SEQ ID NO: 27119 - DNA, 590 bp, Homo sapiens; identical to SEQ ID NO: 1940
  misc_feature 1..590: note = chr2:29338158-29338748
  misc_feature 1..590: note = hyper
  source 1..590: mol_type = genomic DNA

SEQ ID NO: 27120 - DNA, 296 bp, Homo sapiens
  misc_feature 1..296: note = chr2:29338809-29339105
  misc_feature 1..296: note = hyper
  source 1..296: mol_type = genomic DNA
cggggtgtgcgggacccggcggcggagctgggctctgggccacgaccgccagccgcggctgccccgagagtccccgcacgcgcagtggctttccaacgcggcctcttcccatttctcacttgactccccttgcgcattaaattgtcgagaaacctttggccagtgggtcttcaaagctaaaccaaatggctgtccttgcagtccttggctacctgagatcccttaattctgaaccatccgcacctgggaggggaagttgaaaggagcgctggagctgagcccgcatccttaaggat

SEQ ID NO: 27121 - DNA, 32 bp, Homo sapiens
  misc_feature 1..32: note = chr2:30142892-30142924
  misc_feature 1..32: note = hyper
  source 1..32: mol_type = genomic DNA
ggaggcgcgaattgccgcggacagccttccct

SEQ ID NO: 27122 - DNA, 47 bp, Homo sapiens; identical to SEQ ID NO: 6091
  misc_feature 1..47: note = chr2:30143276-30143323
  misc_feature 1..47: note = hyper
  source 1..47: mol_type = genomic DNA

SEQ ID NO: 27123 - DNA, 330 bp, Homo sapiens
  misc_feature 1..330: note = chr2:30143382-30143712
  misc_feature 1..330: note = hyper
  source 1..330: mol_type = genomic DNA
cgcgagtagctgagtggctcccggggctgcagcggcggccccgcagctggggagcccgcgcgctggccggtccccatcccggagcccacagctgccgtggaaagcagcagcggcaggagccacaggagcccgatggctcccatcccgccggaggaggccgtttacactgctctccgggcccagcctcacccttcgctctccccgagatgggaagaggctctgaacagtccttggtacccagcggctccttccacctgatctccagaggactgtgcgtgcgcgcaagtctcttgctttcccccaactgcacggaggcgagcaggagtctaa

SEQ ID NO: 27124 - DNA, 193 bp, Homo sapiens
  misc_feature 1..193: note = chr2:30143958-30144151
  misc_feature 1..193: note = hyper
  source 1..193: mol_type = genomic DNA
ttttaaggctgagaacggcggctcccagctgctgcacgctgtcctggccgccttttgcgttccttttggctcctccaagctcttctgcccggtctgggcgggaaccgagggcggaggctgccgtcttgcgcaccctcaagctatctctccgctgcgggaaggcttcggactgtctgcctgctgaacttctggg

SEQ ID NO: 27125 - DNA, 405 bp, Homo sapiens
  misc_feature 1..405: note = chr2:30144174-30144579
  misc_feature 1..405: note = hyper
  source 1..405: mol_type = genomic DNA
cgcaagtttgcagcgtccttgctctcaccggcgcctcggctcctcagagttcgcaggcactggagcggccccggcggcagcagctgagggcgttcagggcaggggcgcccgaaatcttgccgccccctcctcacccatcatcagcgcccgcggctttgggtggccgaccagagggcggccggaaagcacctcggtgccccgcgaccctccgaacagaggcggcgggaggtaccagctgctaccaccgctgccgcccccagagccgctggatcgcatctgcctgggcgcccgccacttgcagctggctgagccgcgcgagcgcgcgcagggagggggcggggcccggagggggcggggctcacaagccaactccgcgctgctgcccgacccacgcagtccggcctc

SEQ ID NO: 27126 - DNA, 113 bp, Homo sapiens
  misc_feature 1..113: note = chr2:30144580-30144693
  misc_feature 1..113: note = hyper
  source 1..113: mol_type = genomic DNA
ccccgccccacccgcaccctccaaccaatggcgtggctcgatcggctcctatgcaaatctgcagaggcctcggcattcattgagaaaaggagtgagcccgccccaccctccct

SEQ ID NO: 27127 - DNA, 29 bp, Homo sapiens
  misc_feature 1..29: note = chr2:30453625-30453654
  misc_feature 1..29: note = hyper
  source 1..29: mol_type = genomic DNA
cacaccttctgcccccgctgcagaccggg

SEQ ID NO: 27128 - DNA, 445 bp, Homo sapiens
  misc_feature 1..445: note = chr2:30453784-30454229
  misc_feature 1..445: note = hyper
  source 1..445: mol_type = genomic DNA
cggtcccccggctccgcgtctctgccaccttcccaccgcttcttctttaaccatgctcttgtttcccctcgctgatcgcaaggctgcgggcgaggattccagagagaggcctagtatggggaacaaacgcttcagaggggtccgaggtgggctggggacagccagtggatgggaaggagggcgctggcgccgggcggctggggtggaggagtggcgggtgccctaccccggcgcagagcagccgccgagctgtcatgtcccgagcggcccccgcgccctccttgcgcccacctccgccgcgctggagttcggggtgtgcgtggagggggctgtgagcgggaagcggcgcggacgcggagtccgggccggtgcgagtgagcgcgtgtgcgcgtgggagagcggcgggagggggccgggctcgcagccgcagcgaaccacggccccg

SEQ ID NO: 27129 - DNA, 133 bp, Homo sapiens
  misc_feature 1..133: note = chr2:30454460-30454593
  misc_feature 1..133: note = hyper
  source 1..133: mol_type = genomic DNA
gctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgc

SEQ ID NO: 27130 - DNA, 247 bp, Homo sapiens
  misc_feature 1..247: note = chr2:30455560-30455807
  misc_feature 1..247: note = hyper
  source 1..247: mol_type = genomic DNA
aaagttcatgcttctcgcttcaacttttcgggccggcgccacagccccgagcgaggaagagccgcccctacgtcagactcttcaccctgcgtgcgctcttctggctcctttctttggaggtcgccagcagcctttccaagacccgggaggaaactgcctttgcagggcccagctcccgaacctaaacttgccgcaaagccccgcatcttctgttagtctccctgcccccatccgtcccagcctggca

SEQ ID NO: 27131 - DNA, 395 bp, Homo sapiens
  misc_feature 1..395: note = chr2:31360195-31360590
  misc_feature 1..395: note = hyper
  source 1..395: mol_type = genomic DNA
atttcctcaactccccgccaataccaaggcgtctgtttttacaggctctttcgtggtgttctgggcacattcaacttccaatgcagctgagagggtcgggaacagttagagaacaggggtggcagccgcccgggaggctgcaaggcgctcgcccgcaacgcacaggcgcgcgcggcgcacccggcctccggcctccccaggtcgggcctggcagctgcgggaaggaggtcagcgcagccgccacacttcgcccgggcgctggcccgacccgaccgccggcgactctctggcagcgcccggagaccgccagcccctgggccgcccgtccgcagagccccctccgccccgggaccctcgcgcgcagctcaagttgggagccccgctccgcaggcgag

SEQ ID NO: 27132 - DNA, 63 bp, Homo sapiens; identical to SEQ ID NO: 6096
  misc_feature 1..63: note = chr2:31360630-31360693
  misc_feature 1..63: note = hyper
  source 1..63: mol_type = genomic DNA

SEQ ID NO: 27133 - DNA, 62 bp, Homo sapiens; identical to SEQ ID NO: 6097
  misc_feature 1..62: note = chr2:31360694-31360756
  misc_feature 1..62: note = hyper
  source 1..62: mol_type = genomic DNA

SEQ ID NO: 27134 - DNA, 176 bp, Homo sapiens; identical to SEQ ID NO: 6098
  misc_feature 1..176: note = chr2:31360803-31360979
  misc_feature 1..176: note = hyper
  source 1..176: mol_type = genomic DNA

SEQ ID NO: 27135 - DNA, 394 bp, Homo sapiens
  misc_feature 1..394: note = chr2:31361296-31361690
  misc_feature 1..394: note = hyper
  source 1..394: mol_type = genomic DNA
atagggaaactgactcgagcagcgagagggaggaatccgaggctgtgccaagcaccccgggaggagcacgagggcggagggagtgagcggggagggcgggcccgacagacaggccgactcggagcgagcccaggtgggagtgagcggggctctgagagggggcgctaccgccgcccgccgaccgaaacgctcggtgctgttgcggggccgccagcgccaagccctgggcgcagctcccagaccatcgtgggttggggcaaggcggggcggggcgggagcggtgcactcgggatgcccgccacccccagctgccagctgggacccaagggccggccctcgccaggcggcgctgtgcctgggaggactttcccgctcatcgcgggggctgcacgtg

SEQ ID NO: 27136 - DNA, 464 bp, Homo sapiens
  misc_feature 1..464: note = chr2:31456725-31457189
  misc_feature 1..464: note = hyper
  source 1..464: mol_type = genomic DNA
ggtcaactctgtcctcgcagccgtccctgagagggcgctgttcccaaatcgaagccccagaggcggagactgagacaccggcactctcccactggactgggtcagcatccctctccccgcgcggccgcaggtctagagctgagcgcctgcccacaaacatggcggcgccctgcgcggcttcccgtcgccgcaaccgtggggccggccctgccttgccagtactaggggacttcctctgcgcgccggcttcctgcccagctggcatttaaaccaccgcctggggctgcaggatgctgctgcggatgcagagctgtccgcgggctgggcagcgtcgccgtctcccctgagccgcctcggtccggcaggagcggagccgaagcatcccttgctgcacgcagggcagagcaggcgagggctgggggccgatcggggaccccggcttgggaccccggcatctggcagtt

SEQ ID NO: 27137 - DNA, 128 bp, Homo sapiens
  misc_feature 1..128: note = chr2:32852511-32852639
  misc_feature 1..128: note = hyper
  source 1..128: mol_type = genomic DNA
caaataaggtaccagcggaggctggtttgtctccttgcaatttctttgtgatcacccctgggatcactcttctacagcgttccgacagtgttccaaaaacttccctgcaccagcggcaggggcagatt

SEQ ID NO: 27138 - DNA, 110 bp, Homo sapiens
  misc_feature 1..110: note = chr2:37571787-37571897
  misc_feature 1..110: note = hyper
  source 1..110: mol_type = genomic DNA
ggagaagagggaaggcgaaggacgcgcgttcccgggctcgtgaccgccagcggcccggggaacccgctcccagacagactcggagagatggcaggcggaagacaccggcg

SEQ ID NO: 27139 - DNA, 24 bp, Homo sapiens
  misc_feature 1..24: note = chr2:38301261-38301285
  misc_feature 1..24: note = hyper
  source 1..24: mol_type = genomic DNA
gacaagataggagaccggaggggt

SEQ ID NO: 27140 - DNA, 99 bp, Homo sapiens; identical to SEQ ID NO: 6102
  misc_feature 1..99: note = chr2:38301762-38301861
  misc_feature 1..99: note = hyper
  source 1..99: mol_type = genomic DNA

SEQ ID NO: 27141 - DNA, 532 bp, Homo sapiens
  misc_feature 1..532: note = chr2:38302369-38302901
  misc_feature 1..532: note = hyper
  source 1..532: mol_type = genomic DNA
cgggcccgggggcgcggaccggagctgccgcctccgttgcctcagcagccgctggcccacatgcacagtggccagcaccgacaggagtagcaggagcgtggtctgctggatggacagcgggtttagcggccaagggtcgttcgggctgaggctggtgcccatgctggggacagagaggagaaggcgtgacactcaggggtgcagagacaggagcgggcgccccacgcccctaccccagcctctggggactgagtgccgttgggtggagaggtcggagctgactctctggagaaatggccgaagacgccccttcccatccccaacccactctcccttggagaagagaaggggcgtgtttccacctcgctgtaacccagcgccaaacccttcccctccccgcaaggcgcgtaacggttcctgcaatctggggacaacgctgcgggcatcgaggcggtggcgcttgatttcctttaaagtacctaccacgccacccgctacctgtaataatccatctgaagaggtcgccgggcag

SEQ ID NO: 27142 - DNA, 746 bp, Homo sapiens
  misc_feature 1..746: note = chr2:38302948-38303694
  misc_feature 1..746: note = hyper
  source 1..746: mol_type = genomic DNA
cgcgggacagccggctccgagaaggaactgggacctttgcctagggcaagacgtcaacaggaacccgcagcccggcctggacacctgctgccctcactggaagctttaactcccactcgagtctcttggcgtcgtcagtgccaggagcgcttggattgggatggggacggagaagggtgcctcgctcgccgagccccgctgcccttggggacctggcaaagtcgaggtttcctcacagcgttgagattgagactgggggtcggtgagtggcgtcaattcccatgcccttgcggctctcacaactggagtcgcagaagcgctcgctcccactcccactccagagtcaaagcgcgccatcccgctcctccgggttttaaggactgggtagaaggagggcagcgcgacctggcagggcggggcctgcggggggcggggcgcgccgcacaccaggccgctttgacccggactcccgtccaggcgcaccggccggcctcggagctctaccagcaggctttcatgggagcggaggtgcccacgtttccattgtgcggtaaccgcgcttcatcacagccacctccaatcgaggccgcacggtgtccccagaaccacgctcggtacaacctgccccggccgctgcgctcgacttgggagcgcgccccgccccgagcgcacgacctcccttccctctccgcgacttgagcttgcttcccggaaagccagtgtagtggcagcggtttgcctcacag

SEQ ID NO: 27143 - DNA, 79 bp, Homo sapiens
  misc_feature 1..79: note = chr2:38755384-38755463
  misc_feature 1..79: note = hyper
  source 1..79: mol_type = genomic DNA
gccgctgtgattgggcgaaagatggcgctgggcggatggaaatcctaatgacagtctccaaattcgcctccatctgtac

SEQ ID NO: 27144 - DNA, 57 bp, Homo sapiens
  misc_feature 1..57: note = chr2:39187181-39187238
  misc_feature 1..57: note = hyper
  source 1..57: mol_type = genomic DNA
acttcgagtcctctccggcggagccgctgggcaacgtggagcgctccctgcgcgccc

SEQ ID NO: 27145 - DNA, 123 bp, Homo sapiens
  misc_feature 1..123: note = chr2:39187544-39187667
  misc_feature 1..123: note = hyper
  source 1..123: mol_type = genomic DNA
gcaaggccaagccgctgagccgctctctcaaagagttcccgcgtgcgccgccagccgacggcgtggccccacgcctctacagcacgcgcagcagcagcggcggccgcgcgcccatcaaggccg

SEQ ID NO: 27146 - DNA, 963 bp, Homo sapiens
  misc_feature 1..963: note = chr2:39893018-39893981
  misc_feature 1..963: note = hyper
  source 1..963: mol_type = genomic DNA
ggaagagggagggagcgggcggagagctggggccaagtgcattgtgtctggcggcggcgcgcgagcccaccggcggctgcggcggggcgggaagccatggagccgcgggcgctcgtcacggcgctcagcctcggcctcagcctgtgctccctggggctgctcgtcacggccatcttcaccgaccactggtacgagaccgacccccggcgccacaaggagagctgcgagcgcagccgcgcgggcgccgaccccccggaccagaagaaccgcctgatgccgctgtcgcacctgccgctgcgggactcgcccccgctggggcgccggctgctcccgggcggcccggggcgcgccgaccccgagtcctggcgctcgctcctggggctcggcgggctggacgccgagtgcggccggcccctcttcgccacctactcgggcctctggaggaagtgctacttcctgggcatcgaccgggacatcgacaccctcatcctgaaaggtgagcggcgggcgcaccccgcgtccccggcgcccgcgcgtggagcgcagcccgcggcttcccaggggcgcgccggtccccgcagccccctcccagccgcggccccgcgcctgggcattcttgcatccttcccgccgcctccagtctttatctcttccctttctttccccactgcctcccttcttctccctctccttgactctcttctttcgtccacatcctgcgcgtcctttcaagtccgtgccgcacctcccgcctctgtctccttctttcctgccttcgcctcccattccccggttctctctctctccccgtccttctctgcctttgtacacctgcctgacatgtgtgtcttttcttgacgctgctccccgtgagggggactaaccgtcaaagactcgacttttctcacccgggctccttccttcaagttgtgctccttttggaaataccgtttggaagaaaag

SEQ ID NO: 27147 - DNA, 379 bp, Homo sapiens
  misc_feature 1..379: note = chr2:40678462-40678841
  misc_feature 1..379: note = hyper
  source 1..379: mol_type = genomic DNA
cctacatttcttcctcgtctgtctctgccccgccacacctccctcctctccgcagtccgtggtgaatgagcacccaacgcccgctggaaaacagggggctcggaaatgtggccttggggaaagaccccagggattaccggaaggagggatgtccgcggagaagagtccagtgggtggggacgcctggatccccagcagctctgcattcggggtggacttagctcttcgcgccctgaatcctcagagcccagcgcggtgcagggtgcagcatctctccttagcagccctttcttcctccggcagcctgcactggcaggcaggcaggcaccctcacgcccagacgcaccagcccgagcaatttcactctgggaagcgcgga

SEQ ID NO: 27148 - DNA, 185 bp, Homo sapiens
  misc_feature 1..185: note = chr2:40678901-40679086
  misc_feature 1..185: note = hyper
  source 1..185: mol_type = genomic DNA
cacacacacacacacacacacacaaatttagaagccgctcgtttgccaaagcagagggaagtgtagccttatgagcagcaaatggaaaatagttcttggtctctgactaaatgccttctgcctgtccatcataagatcctacctggtttggggagtgtgaatggattcttcctccgttcctccac

SEQ ID NO: 27149 - DNA, 432 bp, Homo sapiens; identical to SEQ ID NO: 152
  misc_feature 1..432: note = chr2:40679087-40679519
  misc_feature 1..432: note = hyper
  source 1..432: mol_type = genomic DNA

SEQ ID NO: 27150 - DNA, 85 bp, Homo sapiens; identical to SEQ ID NO: 153
  misc_feature 1..85: note = chr2:40679520-40679605
  misc_feature 1..85: note = hyper
  source 1..85: mol_type = genomic DNA

SEQ ID NO: 27151 - DNA, 30 bp, Homo sapiens
  misc_feature 1..30: note = chr2:42274603-42274633
  misc_feature 1..30: note = hyper
  source 1..30: mol_type = genomic DNA
tccctgcgcccaaaccgccccgaggccccc

SEQ ID NO: 27152 - DNA, 130 bp, Homo sapiens
  misc_feature 1..130: note = chr2:42275776-42275906
  misc_feature 1..130: note = hyper
  source 1..130: mol_type = genomic DNA
aggctacaccaaggccgtgtaccgggtccgcctgcccggcggtgccgcggtggcgctcaaggcggtggactttagcggccacgatctgggcagctgcgtgcgcgagttcggggtacggaggggctgctat

SEQ ID NO: 27153 - DNA, 109 bp, Homo sapiens
  misc_feature 1..109: note = chr2:42329336-42329445
  misc_feature 1..109: note = hyper
  source 1..109: mol_type = genomic DNA
aagtgcagatgggttcgcaaacgtggactctctagttttgggtctgcagatggggccggccaccacgtgctctctgagttctctttccaagtacagatccctccggaga

SEQ ID NO: 27154 - DNA, 43 bp, Homo sapiens
  misc_feature 1..43: note = chr2:42329493-42329536
  misc_feature 1..43: note = hyper
  source 1..43: mol_type = genomic DNA
cgtgagaaccggagcccggggtgacttgcgggggaggggatcg

SEQ ID NO: 27155 - DNA, 86 bp, Homo sapiens; identical to SEQ ID NO: 6114
  misc_feature 1..86: note = chr2:42329751-42329837
  misc_feature 1..86: note = hyper
  source 1..86: mol_type = genomic DNA

SEQ ID NO: 27156 - skipped

SEQ ID NO: 27157 - DNA, 185 bp, Homo sapiens
  misc_feature 1..185: note = chr2:42720262-42720447
  misc_feature 1..185: note = hyper
  source 1..185: mol_type = genomic DNA
agaaggtgtaggtgtcggacatgcggtcgtcgaggcggcgctggcagcagtactcgaggtgcgcgccctccaggccccagtagatcatctcgttgtagaaggagagctcgcacatccgcggcgcgaagcgcagcttgccgtggccgcgcacgtagagcaggatgaagccgaaggcctccgagtgc

SEQ ID NO: 27158 - DNA, 440 bp, Homo sapiens
  misc_feature 1..440: note = chr2:42720772-42721212
  misc_feature 1..440: note = hyper
  source 1..440: mol_type = genomic DNA
cgctcctgccctccgctggcccgggggtccctgggctcgagtatctccggcgctgctagtagcgcgccctccgcccggcggtacctgcgggtggccggggagtcctcgccggcgccagcgctgagccccaccggctgggaacgcggctgtgtccgcgccgccgaccctcgcgcccgagggctgcgcacaccgaggccgcggtgccctctcccaagccgcggggccgaccccctgagggctgcgggcgccgaatggagccgccggggcggaatagctccccgtctccggcgctccctgcggccgcgaatccggcggccgccccgccgccgtccagaggcgagaggcaaagtgagcgggttcggaggcggcgaagagccggctcgcggcggcgggggcggggcctctgtgcagtcctcctcctcgcccgccggctccgcgcg

SEQ ID NO: 27159 - DNA, 727 bp, Homo sapiens
  misc_feature 1..727: note = chr2:43019598-43020325
  misc_feature 1..727: note = hyper
  source 1..727: mol_type = genomic DNA
gagcttgttgcagaccgggggctggaaggagccccggttctccttcacccaggccctcactcccaggcggcgctccatgactgtcccgggcgcctcctcgcagcgctgtcctcccgccgtcggaggcccgcagctccgcccagccgcctttttaaccagaatcccaagctcacgaggcggagcaaacccccgcgaccccgtggtgggggcttggggcccgcggactttgccccctggtggactttggtctgagcccgccgccctccgcgccactccaggccctggcgagcgcggcggcggcagcgctggggaacggcgtcccgcgccctctgcttctccgcggggcaggggctcggtccccgccaccgtctccggggcgccccacacactggcgcctgcggtggggcctgctcccggcggaggacaaagaatccagacccttcctggacgcttgtccccagacgttccttccctctacgccccgaggggaatcccagggaaggttcccagaaatactacagtgaggagatcgcgggttggaagtcccagcacctgagaacacggtgctggcgctgggctcaagatttggctttcccatctggaaaaggggaatgactgccccgccactcagggctgcggcgctcacccagcgggaagccgcacggcggtccccgcaggtcccgattcaaggtgagccccagacctgctgcgtgcggccggcagactc

SEQ ID NO: 27160 - DNA, 203 bp, Homo sapiens
  misc_feature 1..203: note = chr2:43037974-43038177
  misc_feature 1..203: note = hyper
  source 1..203: mol_type = genomic DNA
gacatccacccactgcgtccttctagtgctcttcttaggcgggtcctgtaactgcacctagtcccggaccacaggagggcggatggaggtggcgaggcgctccactgtggcggggtccctagctggccgtggggatcgaatattctacagggcacttcattctacagtgtgagcccgagctcccggtgcggagatgaggcctg

SEQ ID NO: 27161 - DNA, 51 bp, Homo sapiens
  misc_feature 1..51: note = chr2:43448422-43448473
  misc_feature 1..51: note = hyper
  source 1..51: mol_type = genomic DNA
caccagtgcaatcatcgttaacgtgaaacagctgcccgaggcctggcgtat

SEQ ID NO: 27162 - DNA, 318 bp, Homo sapiens
  misc_feature 1..318: note = chr2:43451091-43451409
  misc_feature 1..318: note = hyper
  source 1..318: mol_type = genomic DNA
aagtcccaaactcatcggagtcctaacaaagtttaagtgttttttttttttttttgttctattcgtatcacaactgccctgttgtgaatattttgttcaacagaaaaagttcgacttttttgctcaaaaagaatgaaacttcgtaataaaaataaaaaaaaaaagacaagaggaaaccgaaaaaggaggggtgggggcccctcccggcacagagttcgagtccaagtgctcggtcgggcttgcagtctgcctagggcccatgtcaccccccccactcccgtgcccccagcaagggcgagatggcgaggggtgtcctcc

SEQ ID NO: 27163 - DNA, 152 bp, Homo sapiens
  misc_feature 1..152: note = chr2:43451694-43451846
  misc_feature 1..152: note = hyper
  source 1..152: mol_type = genomic DNA
ggtcgcgctgggcggcgccggcggctgcgcggggggcgccaggccctgctgctgctgctgctgctgactgcggtagtaggcggcggcggccacggcggcaaagttgtgggtctggatggcgagcggcgtgatgaggctgctgagctccggac

SEQ ID NO: 27164 - DNA, 552 bp, Homo sapiens
  misc_feature 1..552: note = chr2:43451891-43452443
  misc_feature 1..552: note = hyper
  source 1..552: mol_type = genomic DNA
cgcacggggcccccggcgccagcaggtcctcggcgcccccggtgccgtacagcagagcggccgcagccgcggccgccgcggaggcgcagcatgtcggggcgcccgagggcgtggaggccgcggaggccgaggaacaggaggaggcggaggaggagcaggacgaggccgaagagcaggagggcggcggcggcgtgcgcgacgtggggctgtcgagcagcagcggcgactcgaggccgcccgggggctgatggtggcccgacgggaagcccgagaagctgaggctgtggtgcaacttgggccgcggctcccgcgggaagcccaggtgcaacgcatcgcgcgtgccaaaggcacgcaggtccccggaggcgccccccgacggcgcgggccgccgctcgtccgcgttgtggatgaagtggcagcgcggcccataggggcagaagccgatggtatgaaaggtgcggcacagctcggtcttgtacttcggatggcgagtcaggctgcgcagctcgtggaagccatgcgcgaactggcacttttcgccgtacttgcacg

SEQ ID NO: 27165 - DNA, 61 bp, Homo sapiens
  misc_feature 1..61: note = chr2:43864669-43864730
  misc_feature 1..61: note = hyper
  source 1..61: mol_type = genomic DNA
ggctgactcgggatccgccgctgcacctcccgccacagcccagagtcggcccccaagtctg

SEQ ID NO: 27166 - DNA, 119 bp, Homo sapiens; identical to SEQ ID NO: 154
  misc_feature 1..119: note = chr2:45028940-45029059
  misc_feature 1..119: note = hyper
  source 1..119: mol_type = genomic DNA

SEQ ID NO: 27167 - DNA, 188 bp, Homo sapiens
  misc_feature 1..188: note = chr2:45029183-45029371
  misc_feature 1..188: note = hyper
  source 1..188: mol_type = genomic DNA
cgacccggcgccgactctcctcctcttctccctgcgagggcccgcgccgcccgggcccagtcctgggggatagatccctcggggcccaacggctgggccaccgccggtctccggccactgctgcgaggacaggcgctgcctaactaatttctcctctaagggggctgtgcgtgcgtctccttcccaac

SEQ ID NO: 27168 - DNA, 118 bp, Homo sapiens
  misc_feature 1..118: note = chr2:45029987-45030105
  misc_feature 1..118: note = hyper
  source 1..118: mol_type = genomic DNA
cggctgccccgtccgggacccgctaattacagggattcggtttccccgctctgaaggaatgcattacctgcagcaaaggaggcgcggcctctcaggaaggccccgagaggaagctgaa

SEQ ID NO: 27169 - DNA, 37 bp, Homo sapiens
  misc_feature 1..37: note = chr2:45154244-45154281
  misc_feature 1..37: note = hyper
  source 1..37: mol_type = genomic DNA
gctgcagagtcccagcgccgaacggttctagcttccg

SEQ ID NO: 27170 - DNA, 86 bp, Homo sapiens; identical to SEQ ID NO: 156
  misc_feature 1..86: note = chr2:45155125-45155211
  misc_feature 1..86: note = hyper
  source 1..86: mol_type = genomic DNA

SEQ ID NO: 27171 - DNA, 636 bp, Homo sapiens; identical to SEQ ID NO: 157
  misc_feature 1..636: note = chr2:45155355-45155991
  misc_feature 1..636: note = hyper
  source 1..636: mol_type = genomic DNA

SEQ ID NO: 27172 - DNA, 820 bp, Homo sapiens; identical to SEQ ID NO: 158
  misc_feature 1..820: note = chr2:45155992-45156812
  misc_feature 1..820: note = hyper
  source 1..820: mol_type = genomic DNA

SEQ ID NO: 27173 - DNA, 205 bp, Homo sapiens
  misc_feature 1..205: note = chr2:45156832-45157037
  misc_feature 1..205: note = hyper
  source 1..205: mol_type = genomic DNA
cgcggccggccccgaaggcgcgagggacagcgcggccggcggtggagcctcactcaggcacggagcccacagagcgaggctgaggaggactccatgctgttgtccgtcgggaaaccggactactctggggcgcgctggagccaccattctgccagcagccggggaggggccgcgagggctcccaagtggacggaagtaggcgacc

SEQ ID NO: 27174 - DNA, 426 bp, Homo sapiens
  misc_feature 1..426: note = chr2:45157254-45157680
  misc_feature 1..426: note = hyper
  source 1..426: mol_type = genomic DNA
gtatgggatttttgccgtcggagcacctcgtatccggcgcgcgggcccagtgtgggactgcggctgggagcccgggccctccgggagtgaagatacctttggaggtgagacggcctctctagcgcgttgacactgttgatggaagggattaaaggggtatcaggttattttaatttattgttgaagatgatgactgccccctccccgatccgcataccgtcctcactttcccaccccaaccctagacccgacaacaccgttcagccctttgccccgggcagcggaaatggttagcttcctctaggagtttctgctgaggaaggcgcaggcaaccctagtcggcttagagagagacaaccgcacgcgatcaccgagcacgatttctcccaacaaaaaaactaacaataatagcgatccacacactca

SEQ ID NO: 27175 - DNA, 779 bp, Homo sapiens
  misc_feature 1..779: note = chr2:45159488-45160267
  misc_feature 1..779: note = hyper
  source 1..779: mol_type = genomic DNA
gttggggtcactcctcgcaggcactgtggcttttgtctgcatctggacaacagggtgtgcacccgtgtattcaaataattatgcctgtgggcacttctttattcctcaaattcctgttagtgttcctttaattctcccgtagtgttcctttaattctcccatgtgtattcggtacgattgcctgtacgttccaggcatagtcaggtgactcagcttgagtctgagctcaaacgtgcgcgaccccctgggtctgcatggggagaaggaggtgtgcacgtgcaaacgcgggactttgggtggagtgtgaggttgatagggctttcggccccagggccctctaggcctcttttaaataccttcatctgcccaatttcttaacctttcaggacaaggagggagaccctccgcgatcctgcgccttgccaccctttgggaaggataggaccatcatctagggcgtctctcggtggactgtggctgggccgggctgaatgggcgggcggaggtctcgaggtcgtctcctggctctcgattgctcccatcacccaagccacctcgaggtcgagtgcgccctggggctatgtctggggaggtcatggcgtctcggggcgaatgatatgcacgttttggggcaaaactctcctaggcctcgcaggagcagctgtatttgtaacttggaattggcctgggcccgcctcccttggcccctcctccagctcctacctcaacacgcagcgctcagcgggctgccagagtgagcttcccggaccacccccaag

SEQ ID NO: 27176 - DNA, 476 bp, Homo sapiens
  misc_feature 1..476: note = chr2:45160538-45161014
  misc_feature 1..476: note = hyper
  source 1..476: mol_type = genomic DNA
gtagatgtgttttctcgtgagaatgatgcagacttactgctgacttaaggtcagtttgtttgaaaagggagaacgtcagtccgatggtcggtggttgtgtctctcctgagcattcgtacaaagtgaagccacctcccctccgccatgcagtctcccagaccgggtcaaaggacccaggctccaggtcgctgaggcctggagggctgaggcccttgctgtgcgccctggtgctctgatcccaaggcccaagctgccccggtacccacttagggtcagggtggaaagcctacgtgggaaagggggacctggaggactacccccacgcccatggcagggtggagtcccgaccttggcatattggacctactcacttggcatctccctgccccgaccccgtctgggatccgtattggcagcgacgaggaagggaggaatggtaagggagttgggtcggtacaggacggaagtgaagatgg

SEQ ID NO: 27177 - DNA, 112 bp, Homo sapiens
  misc_feature 1..112: note = chr2:45161221-45161333
  misc_feature 1..112: note = hyper
  source 1..112: mol_type = genomic DNA
gagaggatggggaaacgcgcgccccaagagcaaaagcaaacagctgtggaggcgctgcccgcggctcaggcttcccaacaggttagctatactgggatccacccggcatttc

SEQ ID NO: 27178 - DNA, 207 bp, Homo sapiens
  misc_feature 1..207: note = chr2:45161334-45161541
  misc_feature 1..207: note = hyper
  source 1..207: mol_type = genomic DNA
caggaaggggtggggggaagacagagcgagagggggagagaggctcacaagaggacagagggagggagggaaagagagataggagccagagagcgcaccgcgcggcttaaaaggagagacttactaatgaatatttatccgccgctgctccgtgctcccggcttcccttacctttcggcaggtaagatcctccctgtgccccagccc

SEQ ID NO: 27179 - DNA, 439 bp, Homo sapiens
  misc_feature 1..439: note = chr2:45161597-45162036
  misc_feature 1..439: note = hyper
  source 1..439: mol_type = genomic DNA
cgttggtgggggtgggagggcggctctactctgcgttcactttgggtgcccaggcatgcgaccctgcacgactaggaaccgcgtgcgtgggctccatgtgtggaatgagtgtgagcatgtaagagtgtgtttgtgtgtgtgcgagagagagacagagagactatgcgcccgcaagcgcgcgcgcgcgcctgtttgtggcgcgctctggaaacattttccgacttttcactcggacgccctggatttctcgcctttgcctttctctgcttcccctccctcttctctcgccctcccctcccccacccaggtctaccccaccctaccccactcctaccccggctgctgaggcgctcttctgccggctattgtacggctggcgcgggctccccctggccacatcccgggcctctcacacaagaagaatagttctgtttccgcc

SEQ ID NO: 27180 - DNA, 198 bp, Homo sapiens
  misc_feature 1..198: note = chr2:45162037-45162235
  misc_feature 1..198: note = hyper
  source 1..198: mol_type = genomic DNA
taaacccccacacaaaggctgcccggccaccgggtcccctgtcccccttcccggggacttcggcttttgaggtgctgctgcgcgttctttctccctccccctctcagggcgccagggcccagaccaaggagctaagagtgatcgggacttgggggtaccgggtggaactccttgggggccgcccgccaggcttcctgg

SEQ ID NO: 27181 - DNA, 628 bp, Homo sapiens
  misc_feature 1..628: note = chr2:45162443-45163071
  misc_feature 1..628: note = hyper
  source 1..628: mol_type = genomic DNA
ggggtcggctggctccggagttgcgcaaggtggacacacaaaaccaaaagccggagttgggaaaagaaaattctttctctgaccatgccagacgcggccggtcaggctcgcagctccgcgctaggatcgggcggctgtacaaccaagatcgactttgccctgtcccccaacgcccccctcatcccacggctccacggctgggaggctccggactcagagctcgcggactcggcgctcagggtcagcaccagcagctcggcttaagccggggcaggctctctaagccctgctcagaagtcaagagcagcagtgctgcctctcctcgccgcctttcatgccgcggccgctccttattcttgtgtctcggcctctcccggccccctcggacaaaacccccagagcccggccactctcttcccgctaaatccccttcggggtcagtgctctaccagcaccgggccgcgcgcctctcctgccagccgtgtggctcttaaagagctgcacccctcctccgccctgcgcgatcccccgacccccgcctcccctcccctctcctccggatctagccccccacgccgacgcctgaggtccctgctgccccgaccgatgcctgcggactcccagcccc

SEQ ID NO: 27182 - DNA, 322 bp, Homo sapiens
  misc_feature 1..322: note = chr2:45164822-45165144
  misc_feature 1..322: note = hyper
  source 1..322: mol_type = genomic DNA
gtttactgtccggggcgacaattgcttggagcgccagtccccggaggctaaggcggggggcgggggtgcggggagggagcagttgttgttgttgtttttcaaaggaaagtaatcggggtccttgaagggcttcgcggcctccccgcctgcgtgctgcgctcccctgcgccctccctggccgcccgcgccaagcgcctcagtttgcagcttgcggggaggcccagactacgggccacccggccagcctccgcctcccgacatcctgggagccggaaggggcgttgcccccacagggcaaaccttcccccggcctcctggtcgg

SEQ ID NO: 27183 - DNA, 286 bp, Homo sapiens
  misc_feature 1..286: note = chr2:45165500-45165786
  misc_feature 1..286: note = hyper
  source 1..286: mol_type = genomic DNA
ccaagtcccagatcccgcaatcagagcggccagagagcagagaagagacctagaggatctgcaagctgacctatccacccgagactctccgctctgagcgaccccagggtgcaggcgccctccacgcgccacctcctctagcggtcccccagggtcccttcccagtcctcgcactgccctagggcttgcttggttcccagaccagcgtggaaggccgctgggccccggaacccaaggtccctctgcttctgctccactccccagtgcccagcgcctgggaatttgg

SEQ ID NO: 27184 - DNA, 73 bp, Homo sapiens
  misc_feature 1..73: note = chr2:45166113-45166186
  misc_feature 1..73: note = hyper
  source 1..73: mol_type = genomic DNA
gcgcacaaagctacacgcctctctgcagccctctgccctgcttcgcgttccggaaccgcggtcgccacccaag

SEQ ID NO: 27185 - DNA, 30 bp, Homo sapiens
  misc_feature 1..30: note = chr2:45166483-45166513
  misc_feature 1..30: note = hyper
  source 1..30: mol_type = genomic DNA
gcagtttcggggtcacgagctgctttcaaa

SEQ ID NO: 27186 - DNA, 93 bp, Homo sapiens
  misc_feature 1..93: note = chr2:45168959-45169052
  misc_feature 1..93: note = hyper
  source 1..93: mol_type = genomic DNA
tctccctctctgtctcgggttctctctctgcgcgcgcgcaccgggccgctctcctacctccctctctatgtggctgcgcgggtgtgtgtgtgt

SEQ ID NO: 27187 - DNA, 232 bp, Homo sapiens
  misc_feature 1..232: note = chr2:45169316-45169548
  misc_feature 1..232: note = hyper
  source 1..232: mol_type = genomic DNA
gctccatacttctggcgagtagcggcggcgggaacggtgcgggaggcggcggcggcgcgggaggcggcagcggcggcgggaacggtgcgggaggcggcggtgctggcggagcaggcggcggcggcggcggcggctccagggcccccccggaagagttgtccatgttccagctgcccaccctcaacttctcgccggagcaggtggccagcgtctgtgagacgctggaggagac

SEQ ID NO: 27188 - DNA, 574 bp, Homo sapiens
  misc_feature 1..574: note = chr2:45169549-45170123
  misc_feature 1..574: note = hyper
  source 1..574: mol_type = genomic DNA
ggcgacatcgagcggctgggccgcttcctctggtcgctgcccgtggcccccggggcgtgcgaggccatcaacaaacacgagtcgatcctgcgcgcgcgcgccgtggtcgccttccacacgggcaacttccgcgacctctaccacatccttgagaaccacaagttcaccaaggagtctcacggcaagctgcaggccatgtggctcgaggcgcactaccaggaggccgagaagctgcgcggccgcccactcggcccggtggacaagtaccgcgtgcgcaagaagttcccgctgccacgcaccatctgggacggcgagcagaagacgcattgcttcaaggagcggactcggagcctgttgcgggagtggtacctacaggacccctaccccaaccccagcaagaaacgcgaactggcgcaggccaccggcctcactcccacacaagtaggcaactggtttaagaaccggcggcagcgcgaccgcgccgcggcggccaagaacaggttagtggcggggcccgcggcctggctacagcctcagaggcctgggaaggggagaggggttgagatggggctag

SEQ ID NO: 27189 - DNA, 45 bp, Homo sapiens
  misc_feature 1..45: note = chr2:45170168-45170213
  misc_feature 1..45: note = hyper
  source 1..45: mol_type = genomic DNA
cggagaaagtttccgcttgtccgggacgcgcggaagagggggccg

SEQ ID NO: 27190 - DNA, 318 bp, Homo sapiens
  misc_feature 1..318: note = chr2:45171246-45171564
  misc_feature 1..318: note = hyper
  source 1..318: mol_type = genomic DNA
tccccacttttccaccgccagctttcctattttctctaccctcggtcctgcgctctgcgctggcatccagagagcaaagtatgcagttctacccggagactggccgggcggtggggaacccgcagctcccggtgtgtgtttgagggagcagggacggggttactaggggaactcgaccggtcgcggggcagccggctcagtttgaagagccccagggactgcggagggaagaagcgcccggctcctctccgacttctgcttctccagggcttggcgtactttgtcgcttgcacccaggcctccccaagcggccgggct

SEQ ID NO: 27191 - DNA, 88 bp, Homo sapiens
  misc_feature 1..88: note = chr2:45171836-45171924
  misc_feature 1..88: note = hyper
  source 1..88: mol_type = genomic DNA
cgcgcagacaccggcacctccatcctctcggtaacctccagcgactcggaatgtgatgtatgatagccaaggccgccctcctccctct

SEQ ID NO: 27192 - DNA, 264 bp, Homo sapiens
  misc_feature 1..264: note = chr2:45172185-45172449
  misc_feature 1..264: note = hyper
  source 1..264: mol_type = genomic DNA
caaacgctgatgttgcgggcagaaaacataaaagaggtgacaattgtatactttctaggacaagcacggcttctcctttcggttcccatggacccggcaccccacctgcatgacgatttatttgtatctgggaaaatattctctctagttaaaaatgatttaaagagtcgactatacaaaaatcaatcaccaccacgaggacaagagggcaaaagcaaaacagacaaaaagaaaaaaaatcgccgtctccgttccgaatttgtt

SEQ ID NO: 27193 - DNA, 536 bp, Homo sapiens
  misc_feature 1..536: note = chr2:45176593-45177129
  misc_feature 1..536: note = hyper
  source 1..536: mol_type = genomic DNA
gcctgagactttgggcggggagacggttcagtgaggcagcgggaaggcccttgcctgggcttgccgagggggctgtgatggtggagtggcccccaggttcttctgcaaggagaataggacagcctggtacattctcgacccagcgcatcacccgggaccccggagctcgaagtccattcccaggcctgtggcgcactggatgcactcggcgtcttggagcagtctcttctccctctcttcttcctctgcctccgtggccctgtcagtcccgcctaagcctttgtgtggccgtcacctggagcaccggctgtgcctcagggactttcccgggccttccccttgtcctctctgtcccccagcgctggagctgagatgcccggcccgcgggacgctcgaccccctggtacgcgcgctgaggcccccacggcttcccaccgctccggccctttccggccccagctgagctgaagctccctggccccagtgtgcgggccccggtggccgtctggcccgagggagggcgggggcaggcgaga

SEQ ID NO: 27194 - DNA, 700 bp, Homo sapiens
  misc_feature 1..700: note = chr2:45179296-45179996
  misc_feature 1..700: note = hyper
  source 1..700: mol_type = genomic DNA
aaggcagggtccagacgtgagggggagcgcggcggggcgtgggggacgcggcccccggggcaggggtccgggatctgcggacgtggcccggtggggagcgcgccccttggtccccgctccgccctccggccttcgcggcgctctctcgctgggcctttgtccccacctctcaggctcggactccgtctttcttctttcaggccgctgggaggcgctgtggccgaagccccggcctctcccagcctgatgccctggtcctgcagccgcgccgtctttctccgcacccggttcccgcggggctgggctgcctcaggcgatggcccggcctgtggctgggcccgcactgcctttggtttgttggattttgcgatatttaccataataattaatttgccgccattcaacagaatatcttagcaaggccccttaacgactggaagcgctgctaattccctgcgtatgcgcctctccctctgcagcccgggacaggcgcagccgccttttgcctgcccctacctcgcccgggacacactggcgccgcctggccaggcccgactgggaggaaggacagaggaccgacggacacttgtacatgtgcgggcgcacggaacccaggccccggccaccgctgcctttcccctgtgtgtctgagctgaagcggctacgcttataccgggaggtgaaacggaagctcagagag

SEQ ID NO: 27195 - DNA, 713 bp, Homo sapiens
  misc_feature 1..713: note = chr2:45181520-45182233
  misc_feature 1..713: note = hyper
  source 1..713: mol_type = genomic DNA
aggactgagctaagacgccagaatgggttaaaggcatttccaaggaggaatggtgaggacttgatgaccagctgcagaccttataggctgccctccgaccttcagcttcctgtgcgctcacaattcacgtgctcacacgtgctccttagaggggtctgtcggtggacgccgcgaaccaatcaaacccttgcactttgttccaaaacccattccctaccagaatgggagtcctgtagggccaggtctcctcccatacccacccatttcggcctttgttctactgcacaataacagctggcactggggtgcgggaggacggtgaaagctcgagtcccaggctccaaatcctccaggagtaactggggtgacccgaggagagcagcgcactgggtgagtggaagcgtggcccgtgagaagggtaccgagggtcagaagtgtcgcaagggacccaggacgcgcgcgcctccgaacccctgagtcttcgcaggctctgcgaaacttcagtgcgcgcagcctcctgcacaccgttttcgcgcgacctccttgcctcggtctccaggggtcaagccaacccagcgcgggaatgttccatttgcccttttgggacattcagagaggcttttccgggctgccgcggcgcttccacgcagaggaggcgtcggcttccaggcagcttggcgatcttgttattggacacgcgagagtttagagac

SEQ ID NO: 27196 - DNA, 15 bp, Homo sapiens
  misc_feature 1..15: note = chr2:45231136-45231151
  misc_feature 1..15: note = hyper
  source 1..15: mol_type = genomic DNA
attctgattttatcc

SEQ ID NO: 27197 - DNA, 123 bp, Homo sapiens
  misc_feature 1..123: note = chr2:45231244-45231367
  misc_feature 1..123: note = hyper
  source 1..123: mol_type = genomic DNA
cgcccggccgcggtgccctggtcgctgagggacgcggtcagtacctaccgccactgcgacccgagaagggaaagcctcaacttcttcctctcggagtcctgcccactacggatctgcctggac

SEQ ID NO: 27198 - DNA, 341 bp, Homo sapiens
  misc_feature 1..341: note = chr2:45231852-45232193
  misc_feature 1..341: note = hyper
  source 1..341: mol_type = genomic DNA
gtctgagcctgggaccggcaaatccgcgcagcgcatcgcgcccagtctcggagactgcaaccaccgccaaggagtacgcgcggcaggaaacttctgcggcccaatttcttccccagctttggcatctccgaaggcacgtacccgccctcggcacaagctctctcgtcttccacttcgacctcgaggtggagaaagaggctggcaagggctgtgcgcgtcgctggtgtggggagggcagcaggctgcccctccccgcttctgcagcgagttttcccagccaggaaaagggagggagctgtttcaggaatttcagtgccttcacctagcgactgacacaagtc

SEQ ID NO: 27199 - DNA, 30 bp, Homo sapiens
  misc_feature 1..30: note = chr2:45232401-45232431
  misc_feature 1..30: note = hyper
  source 1..30: mol_type = genomic DNA
cacatgagggcattacggggagacggcaag

SEQ ID NO: 27200 - DNA, 323 bp, Homo sapiens
  misc_feature 1..323: note = chr2:45233446-45233769
  misc_feature 1..323: note = hyper
  source 1..323: mol_type = genomic DNA
caggctgtgcagggacggcagcccagggggcggcgggctgaggagcagtgcggggctggatgatgagtggtctggcgtccccgatggagtcttctcatcctccgagctgcctaacaccgacttgccgctgccattcagcgggttgtggctgttagaattggagttctcgttgttctccctgcaagtgcgggagcaaagcagcggggtcagcagggacatcgagaccacccagcgccatctcagtcacagtcagagccagccaccagcctcgggagacagatcccgggcttgtggcctgcgggtgttttcggtttctaccattt

SEQ ID NO: 27201 - DNA, 1411 bp, Homo sapiens
  misc_feature 1..1411: note = chr2:45235475-45236886
  misc_feature 1..1411: note = hyper
  source 1..1411: mol_type = genomic DNA
ctgaattgctctgcccgctttagacaaatccctgctcgccgggtctccggcatagaaaggcctaagcatcgtccaagtcaggccgggctgccgctgggctgtggccgggcctgggggcccagtttaggcctctccgggggaccggcagaagccctgcgaacccctcccttgggccccggggagctggcgccgaagaaggtctacttactcgtacctttccttggcctcggccgcccggtcgcgctgccgccggttcttgaaccagttgctgacctgtgtggtggtgaggcccgtggcctccgccagctcacgcttctcgcggggtgaagggtaggggttgtgcgcgtaccactcgcgcagcacgctgcgactcttttccttgaagcagtagctggtctcctcgccgtcccagatggagcgcggcagcgggaatttgcggcgcacgcggtatttgcccacggcgcccaggggtcggccgcgcagcttctccgcctcgatgtagtgtgccttgagccacagctgctgcagcttggcgtggttgtgcggcgagaactggtggctctccaggatcttgtagagctcgcggaagttgccgcggtggaaggccaccacggccttggccttgagcacgctttcattcttgtgaaggtgctcgcaggcgggcagcgaccacaggaagcggcccagccgctcgatgttgccgccctgctgcagcacctcgcacacgcacgccacttgctcctgcgtgaagccgaaggtgggcagcatggacatggtgccggctgcgtccccgcccgcccgcgcgcgccctcaccgggccgcgcggtcccgcatgggagcttcctcgccgggccgtccgggccgagacgcgggcggggctggccccctggcccggcactggcccccggtgagccccgagtcactgccgtacgtccccgcgccggccgcgggtcccacgaagctccgaaccccaacggcccgcgcgcctggcccaagccctcgcccaagcccgggggccgcccggggcgccgctccgcatgctccgcgcccgcccgccgttccctcgctcgcttctcactcgttctccctcccgtctagctggctctcagctttcttaataatattattctaagcgggcatgaggcgcggcggcccgcgccctgattggtccggttatctgacccggggcctgccagcgccagacaatagtcggagtcaaattattcgccatggagacgctgtcagtcactggtaacccgagcctcggcgggccgggcggctccccccggccggctccgctgacagatcgccccgctccgcgcagaactgagggcggctctactggagcctggggcgctctgagagcctgggaggcggagaggggccgggttggggccggcggcggcggaga

SEQ ID NO: 27202 - DNA, 147 bp, Homo sapiens
  misc_feature 1..147: note = chr2:45237178-45237325
  misc_feature 1..147: note = hyper
  source 1..147: mol_type = genomic DNA
gggcacattctaccccggcgcaggccagtgggatgggagagtttggacgtgctcgggtgccgcccaaagacttggctttttctgctgacagcgccccacccccatcctagaaactctggactcagcggtcctcgagggaaaagggga

SEQ ID NO: 27203 - DNA, 44 bp, Homo sapiens
  misc_feature 1..44: note = chr2:45237645-45237689
  misc_feature 1..44: note = hyper
  source 1..44: mol_type = genomic DNA
gcagggactctaggacggtggtggggcttccccggtgggtggtc

SEQ ID NO: 27204 - DNA, 253 bp, Homo sapiens
  misc_feature 1..253: note = chr2:45237690-45237943
  misc_feature 1..253: note = hyper
  source 1..253: mol_type = genomic DNA
gggaggagaacggaggcaagattcccagtcctcccgcttcgccgctggggatcggctcggctcctggccactccagcctgggaaccggctcgctgagctccgggatgaggtgctttaaaagggggtcctgttttttgcttctttgtcagggtgccaatggaaacatgtggtgctggtcctgtgggagaagggctcgcacaaaggtgggagaactgaggatgggtgtgttcttgctctacgttttgaaaagccc

SEQ ID NO: 27205 - DNA, 30 bp, Homo sapiens
  misc_feature 1..30: note = chr2:45240323-45240353
  misc_feature 1..30: note = hyper
  source 1..30: mol_type = genomic DNA
tccagcctataaaggcggcagaaatcccct

SEQ ID NO: 27206 - DNA, 39 bp, Homo sapiens
  misc_feature 1..39: note = chr2:45240592-45240631
  misc_feature 1..39: note = hyper
  source 1..39: mol_type = genomic DNA
tccccacctgcccctcgtacctgccggtctgtcgggtcc

SEQ ID NO: 27207 - DNA, 406 bp, Homo sapiens; identical to SEQ ID NO: 1963
  misc_feature 1..406: note = chr2:45240763-45241169
  misc_feature 1..406: note = hyper
  source 1..406: mol_type = genomic DNA

SEQ ID NO: 27208 - DNA, 551 bp, Homo sapiens
  misc_feature 1..551: note = chr2:45241232-45241783
  misc_feature 1..551: note = hyper
  source 1..551: mol_type = genomic DNA
cgggcagggccacggggcgaggggacgggctcgcggctttgggttcagggagccgcggagctccaccgccgggttgttttgcaatggggctttggagaggttgcgcgtcccgggccccatggctccgccgggtctgcacgccagcgcccccacgcggcgggcccagagttcaggccggcggggctgcgcgctcggctccccgcaggcctgtagcccaggagggagaggagggagaggacgcggagagggcccgctggttcttccctcctcaccccagcactgacccgcctgtgcgctggcacggagggctcgaaaatcggggcgcgtccgcgaagagcgagacctcggagacagacacacaacccagaggtgcactaggttgccagacggtctgatcacaggattcttggggggatagacgctggcttttctccatcacacgtttcccctgcaacgtctgggtgcccaggaaatgtttgaatggatgcctgaatgaccaatcgggtttgactgacagcaacagctgggaagtgacccggccaataggagaa

SEQ ID NO: 27209 - DNA, 66 bp, Homo sapiens; identical to SEQ ID NO: 6161
  misc_feature 1..66: note = chr2:45395854-45395920
  misc_feature 1..66: note = hyper
  source 1..66: mol_type = genomic DNA

SEQ ID NO: 27210 - DNA, 291 bp, Homo sapiens
  misc_feature 1..291: note = chr2:45396160-45396451
  misc_feature 1..291: note = hyper
  source 1..291: mol_type = genomic DNA
gctccgctccgcgcacgtggctgtgggcgctgcggacgggggacggcaggcgggggacggcaggcggggagtggagggtgcagtgcccgcaggtgccgacggcttcctcccagagcccttcgcgccgcgccttgcctggctggtggcgcggggaaaccatggcagcattgcggctccggcgggcgggctctgcgcggggccccaccgagctttccgggagcctctcccgcagccgatgggcatctaggggcgcagaacgaagagtgggcgccgaaacgggtgtaggcgctg

SEQ ID NO: 27211 - DNA, 310 bp, Homo sapiens
  misc_feature 1..310: note = chr2:45396672-45396982
  misc_feature 1..310: note = hyper
  source 1..310: mol_type = genomic DNA
ccgccaccctctgggcgaacggaatggcacccgcggagacgggcggggacgggcgaaagcgggtttgctccgacccgaagctgagcccgggttggagggcgagaccgtaggcgagaatggccgcgcgggctgggagacccgggccggtatggagtgagtggagccgcccgaggtagggtagttggggatggtagttgtgaagacagtcggagtctagctccgggcagacgaaacaccggggcgcgccagggtccgtttcctccttctctctgctttcccaccagccctgtagatacggagccagcagtcg

SEQ ID NO: 27212 - DNA, 33 bp, Homo sapiens; identical to SEQ ID NO: 6164
  misc_feature 1..33: note = chr2:45397223-45397256
  misc_feature 1..33: note = hyper
  source 1..33: mol_type = genomic DNA

SEQ ID NO: 27213 - DNA, 37 bp, Homo sapiens
  misc_feature 1..37: note = chr2:47596757-47596794
  misc_feature 1..37: note = hyper
  source 1..37: mol_type = genomic DNA
tgggctggggggcagcggcccccggccctcggccccc

SEQ ID NO: 27214 - DNA, 299 bp, Homo sapiens
  misc_feature 1..299: note = chr2:47748224-47748523
  misc_feature 1..299: note = hyper
  source 1..299: mol_type = genomic DNA
gcatggagatgagctcgcccgagaggcggcggccctcggcgtcgctgtcgcgggccgcggggtcggcaccgagcgcggccaggcggcggcgcagccgggagcctggggtgatggcattgcgccgggccaggggcgcgccaggagccgggcagcagcgcgcgcagcagcggcagctcagcttgcgcagcatccagttgagcacctgcttgatgaggatggagatgacgttgaagagcgagtaaatgcagcacacgccgagcaggatgaagaggaagttgcccaggcggtagagcccctgg

SEQ ID NO: 27215 - DNA, 40 bp, Homo sapiens
  misc_feature 1..40: note = chr2:47748726-47748766
  misc_feature 1..40: note = hyper
  source 1..40: mol_type = genomic DNA
gtcggcctccgagagcgcggagccgcggcggaaggtggcg

SEQ ID NO: 27216 - DNA, 738 bp, Homo sapiens
  misc_feature 1..738: note = chr2:47796750-47797488
  misc_feature 1..738: note = hyper
  source 1..738: mol_type = genomic DNA
aaaacaggaaggaaccggtagcccttggcacgtattcttagaggagaaaacggaggctcacaaaggtcagatcacagagccggccagtgttggagcacaggcggcccggggtgagcgccagaggtgggctttcttccctcactgaaagccgggagggagagagagagagagaacgggggccggcggagaagagggcgagacgaaagtaagcaaagggacattagaagggaaggcagagccgagggacgcggaccgagcggccgagcagtggaaagggcggcaggtgaaaggcacagagaggaaagatgcgcgggggacgcgccgctcacctatggttgacaccacggtgcccacgaagtagaaggcgccggggaagtcccagcgcgggcgcagcgcgtcggcgcggacgccggcggccagcgcggcctcgtagtgccggaggaaggcgcgcagctctggctcggccacgccgtgcgcagcgctgaagttgcgcagcgtggcgccccagcgcgcccgcgcctccgcctcgccggggctctcgagcgccgagaagactgtggcacccgccaccaggtagaggccgatgagcgccgccagcagcacgaagcggccggtgtcctcgttgaggtgcgaacggcggcagcagcagcagcagcaggaggggcgcggcaggcggcggcggctacggcggggcgggggccgggggctgcgggaggacatggtccggagctcagcccc

SEQ ID NO: 27217 - DNA, 474 bp, Homo sapiens; identical to SEQ ID NO: 1966
  misc_feature 1..474: note = chr2:47797489-47797963
  misc_feature 1..474: note = hyper
  source 1..474: mol_type = genomic DNA

SEQ ID NO: 27218 - DNA, 1069 bp, Homo sapiens; identical to SEQ ID NO: 1967
  misc_feature 1..1069: note = chr2:47797964-47799033
  misc_feature 1..1069: note = hyper
  source 1..1069: mol_type = genomic DNA

SEQ ID NO: 27219 - DNA, 98 bp, Homo sapiens
  misc_feature 1..98: note = chr2:47799123-47799221
  misc_feature 1..98: note = hyper
  source 1..98: mol_type = genomic DNA
cggctgcgggtgctcctctgctggacacaagccggctttgccggggccacaaaagttctggcgtggaacaccctcagtacaggcggaaaatcatcctc

SEQ ID NO: 27220 - DNA, 119 bp, Homo sapiens; identical to SEQ ID NO: 6170
  misc_feature 1..119: note = chr2:48982582-48982701
  misc_feature 1..119: note = hyper
  source 1..119: mol_type = genomic DNA

SEQ ID NO: 27221 - DNA, 145 bp, Homo sapiens
  misc_feature 1..145: note = chr2:48982753-48982898
  misc_feature 1..145: note = hyper
  source 1..145: mol_type = genomic DNA
cggctgcagcagcagcagcagcttcagcagctgcagcgccgagaaccgctgcttcatggccggcgaactgggcttctgcggcttgccagtgtcttggacggcctctgagtgcggcccgcacccctctccccgccccttggctgcc

SEQ ID NO: 27222 - DNA, 155 bp, Homo sapiens
  misc_feature 1..155: note = chr2:50573484-50573639
  misc_feature 1..155: note = hyper
  source 1..155: mol_type = genomic DNA
cgccccatccggccactgagtgaccttctggcaactgacgcccccttcccgcggggcccagccgcgcgaccagggctggtcctttagtaggtgtccacatctctctcccagtacctcgacaaggaacgcccctcccacccctcaccaccaacacc

SEQ ID NO: 27223 - DNA, 141 bp, Homo sapiens
  misc_feature 1..141: note = chr2:50573691-50573832
  misc_feature 1..141: note = hyper
  source 1..141: mol_type = genomic DNA
cgcaccaagcacacccaaatgcacctcccttttgtcgagctcccatttctctgagccttaggagcccaggagcgagtgcagggtagaaagaggggagcgaggggataacccgcgagaacttggcatcgcagacccaccgtg

SEQ ID NO: 27224 - DNA, 247 bp, Homo sapiens
  misc_feature 1..247: note = chr2:50574097-50574344
  misc_feature 1..247: note = hyper
  source 1..247: mol_type = genomic DNA
ccgccgaggggcagccgccgcgggaggcaaagtttggggcgcggggagaggagagggcgcaggggagcgggcggcgcggagtgggctgaggggccggccgcctcaccgcgccagggcacccatcctctccctccttcggacagtcttctcggggtcctggagtccgccgtgcctagcaccccaaacaatccgaaacatagccgaggcgaatgcagctggagaggggcttgtccggaaaggcagcccc

SEQ ID NO: 27225 - DNA, 54 bp, Homo sapiens; identical to SEQ ID NO: 163
  misc_feature 1..54: note = chr2:50574631-50574685
  misc_feature 1..54: note = hyper
  source 1..54: mol_type = genomic DNA

SEQ ID NO: 27226 - DNA, 121 bp, Homo sapiens; identical to SEQ ID NO: 164
  misc_feature 1..121: note = chr2:50574738-50574859
  misc_feature 1..121: note = hyper
  source 1..121: mol_type = genomic DNA

SEQ ID NO: 27227 - DNA, 57 bp, Homo sapiens
  misc_feature 1..57: note = chr2:51259509-51259566
  misc_feature 1..57: note = hyper
  source 1..57: mol_type = genomic DNA
caggtctggatgctgcggagcgaggtgcttttacctttgcatcgtccccttgcaggg

SEQ ID NO: 27228 - DNA, 71 bp, Homo sapiens; identical to SEQ ID NO: 6177
  misc_feature 1..71: note = chr2:56149951-56150022
  misc_feature 1..71: note = hyper
  source 1..71: mol_type = genomic DNA

SEQ ID NO: 27229 - DNA, 206 bp, Homo sapiens
  misc_feature 1..206: note = chr2:56150227-56150433
  misc_feature 1..206: note = hyper
  source 1..206: mol_type = genomic DNA
aaagtggcatttccacgcctttctctgcgcacagctttgtttaaaagtcccaggttgtgtggaggggcagcccaaagcgactgattctcttttgtcttatcagtctgggtccccgacacgctaccttcggtttcaggctgcctaggaccggaaccagggatcgcaccgcagcccaaggtaccagtttcgggcgggcggcctggccc

SEQ ID NO: 27230 - DNA, 383 bp, Homo sapiens
  misc_feature 1..383: note = chr2:56150770-56151153
  misc_feature 1..383: note = hyper
  source 1..383: mol_type = genomic DNA
cccacctcactctcccgcgcgcggcccagtgagtactgggctcgctcggggcgaccccccgttgggggctcctacctgtgcggccgcgctgcgctccgggcccgggcagcgaggggagtgcgcaggggagggcagccccgtgggtctgatctggcgaagtccggcagcggccgcggcggcaggaggaggaggagaaagggagggaaagggggagggcgaaggggggcggaggagagagctgagggaggcgcgagcgctgagcccagcgttgcgagcccggcggtagagcgcgcagcgcagcgaggtccgcgccccctgctccaggggccctctttgccgcccccgcttgccctcccttgccagctcctcgtttcccagactcg

SEQ ID NO: 27231 - DNA, 113 bp, Homo sapiens
  misc_feature 1..113: note = chr2:56411049-56411162
  misc_feature 1..113: note = hyper
  source 1..113: mol_type = genomic DNA
atgcgggagctgctgcgggttacgggtggccccagctccaggctcctcctccagccggtcccccaccctccaccccttctcgactccgctctgcaaatcgaaggctttccgga

SEQ ID NO: 27232 - DNA, 63 bp, Homo sapiens; identical to SEQ ID NO: 6180
  misc_feature 1..63: note = chr2:56411703-56411766
  misc_feature 1..63: note = hyper
  source 1..63: mol_type = genomic DNA

SEQ ID NO: 27233 - DNA, 98 bp, Homo sapiens
  misc_feature 1..98: note = chr2:58655439-58655537
  misc_feature 1..98: note = hyper
  source 1..98: mol_type = genomic DNA
ggagcgcctgggactcgagacggcggcaggttcaattagctaaacaaagaaatcatggcggattgtttacatttggcagcgcccgggctgcgccgacc

SEQ ID NO: 27234 - DNA, 199 bp, Homo sapiens; identical to SEQ ID NO: 6182
  misc_feature 1..199: note = chr2:58655998-58656197
  misc_feature 1..199: note = hyper
  source 1..199: mol_type = genomic DNA

SEQ ID NO: 27235 - DNA, 39 bp, Homo sapiens
  misc_feature 1..39: note = chr2:60784424-60784463
  misc_feature 1..39: note = hyper
  source 1..39: mol_type = genomic DNA
tttttatcttgcccgcggaggagacgccccaggacttcc

SEQ ID NO: 27236 - DNA, 80 bp, Homo sapiens
  misc_feature 1..80: note = chr2:60796529-60796609
  misc_feature 1..80: note = hyper
  source 1..80: mol_type = genomic DNA
tgcattttgccttgccgcgtctcttcccacttccaacctacaccctctccaaatcttgccccatcctctccatcgctccc

SEQ ID NO: 27237 - DNA, 20 bp, Homo sapiens
  misc_feature 1..20: note = chr2:60796669-60796689
  misc_feature 1..20: note = hyper
  source 1..20: mol_type = genomic DNA
acgcacgcacacacacactt

SEQ ID NO: 27238 - DNA, 304 bp, Homo sapiens
  misc_feature 1..304: note = chr2:60797038-60797342
  misc_feature 1..304: note = hyper
  source 1..304: mol_type = genomic DNA
tgtagtggaaatctacgtgggtttgcaggttcctgcttttcttgtgtagagcctccggtgccctccacctaaccctgccccaatgcctcgggtcttttttgaactaatgctgtgcgtctccgcaatctgcaattactttggatatttctcaggagctaaacgcagcctgaatttcgtggcgcgtgcaaaaaaaaaaaaaaaggcgaaattaacaaaaccccaccaccgcgctgttgtttttttctggagtttttttttttttttttttttagttcggttcagaagcaaacgctacctagtttct

SEQ ID NO: 27239 - DNA, 294 bp, Homo sapiens
  misc_feature 1..294: note = chr2:60962755-60963049
  misc_feature 1..294: note = hyper
  source 1..294: mol_type = genomic DNA
cagctcttggcggtgcgccacaggaactctccggtggtcgggttgtagatgaagagcttccactcggcgaggctctggttgagggactccttcttcatcgtgtgcgcgcggacgacgaggggagcggcggccgcggggacggaggcggcgagggcagcggggacgggggcggcgagggcagcggggacggaggaggcgagggcagcggaggcgcgtcccggctccggcggcgcagcccggcgacggcaggggagggtgggacgaccgagaacacctcctcgttactgggagtac

SEQ ID NO: 27240 - DNA, 91 bp, Homo sapiens
  misc_feature 1..91: note = chr2:62798343-62798434
  misc_feature 1..91: note = hyper
  source 1..91: mol_type = genomic DNA
gtgtcaggttgtccccgagtgcgcttgccgtgagtttctgccgcgtgactcacccgtgtccctcgctctcagccatcggaacagcagaagc

SEQ ID NO: 27241 - DNA, 615 bp, Homo sapiens
  misc_feature 1..615: note = chr2:63275877-63276492
  misc_feature 1..615: note = hyper
  source 1..615: mol_type = genomic DNA
ggcgcctttcctcggaacctaaggaaggggtatatttcgttgctttctttaaacctcagcacgatcacagtggctccgagccgcgggcggctgaccgcgggcctcgcgggctactcctggtaggggcctgcgcgagcctaaggtgtgtccccgcctgggttagcgctgcgctctgcactgtttcttttcctcttaaagcttctttctcactcactctctccctccttctctctctcattttttccccatttctctcgttcttttattcagctttctctctttctctcccttttgtgaatgggccgcggtgtctttgttctgtagagaagcgcccgtgtcgctgacttttgtgaaccagagaaggatcttgtaaaacctccttttctccttcgtacgcccccactcccacccctcctcccctgcctctttgattagatgttccctcatcgtcaaaaaaaaaatgtaatttcgttggtctggcggccactttctttgaacattagctcgctttcagctccaacttcaattagaaggagttgattttgagagatcaacaaaagaaccgaccaaagccttattaaaggtcctaagaagatctcccgggtcctttgagaa

SEQ ID NO: 27242 - DNA, 319 bp, Homo sapiens
  misc_feature 1..319: note = chr2:63278703-63279022
  misc_feature 1..319: note = hyper
  source 1..319: mol_type = genomic DNA
gcagcttcgcaaagccgtcgcagctttgagtcccattttccttcggccctagagccctggctgcttcccttccggtccccttcctacaagctggactccctcagcccaggtcttgggtcccagaagacgggggcgggaacggggctggggggagcttctttagctctaacttctctccttgaacgtcctagcccgagtccctggcttgcttcacagcgatcccgctaagcggggtgtagcgatggccccccagggccccaggcccagtttccagcgcccctccctgacccctgagagtggcaccccgggttcccggcag

SEQ ID NO: 27243 - DNA, 699 bp, Homo sapiens; identical to SEQ ID NO: 166
  misc_feature 1..699: note = chr2:63280952-63281651
  misc_feature 1..699: note = hyper
  source 1..699: mol_type = genomic DNA

SEQ ID NO: 27244 - DNA, 66 bp, Homo sapiens
  misc_feature 1..66: note = chr2:63282650-63282716
  misc_feature 1..66: note = hyper
  source 1..66: mol_type = genomic DNA
cgccgcgccaaatgccgccagcagcagcagagcgggagcggaaccaagagccgcccagccaagaag

SEQ ID NO: 27245 - DNA, 224 bp, Homo sapiens
  misc_feature 1..224: note = chr2:63283882-63284106
  misc_feature 1..224: note = hyper
  source 1..224: mol_type = genomic DNA
gcccattggagcacccgcacactactccaaatcaaaaccactaagagttcctcccgcgcagactgctgccccttcagctgccctcgattttgctccacgcctgccggccagagcctcccggcgtttcttccgccccagcggagtgcgctggggcgcgccagggctaggcccgccggaggagcgcgtccccagccttccgcgcacagagccgcatcccgccccgc

SEQ ID NO: 27246 - DNA, 1052 bp, Homo sapiens
  misc_feature 1..1052: note = chr2:63284558-63285610
  misc_feature 1..1052: note = hyper
  source 1..1052: mol_type = genomic DNA
gtctaagcacagggtcgcagttccagtttacaaacctaaaacaagaaaaccaaaaccagggaacaaaacaacaaaacaaaacaaaatccgtaaaagtacagcattagggaaaaacaaacaaacccaggccccaaacccagttccaactcctctgtcggcttctctctttcaacacccttgttttgtctagtgagtttttagtgcaccttcgttctccgaaatctgcggagagcccgcgcgcctgtgtatcaattttggctttggccgcttcgtccagtaggtgggaaagtaatttgtaaatttgatttgtctgatgtgaagatcacaaattacttgttgaaatgtaaggcagtccccctcctcctctttatctacattacttcccgaaaataaatgcaaattaatgaacggcttgtcagtgttgctcttctgattccagcccgaggtcctggtctcggggggctaaaagcgagggaaactccgtgttaataacccgcgtgttaatgacctgcgtgaagctggaggccaaaggatgaggcgggaggacttggcaagagaagtccccagaaactttcgcttagggagtgtctccccccacccccaccacgcccctccgcgtcagcctggcctcttcccccaggcgttttgaccccgcatcccccctcgccatccaggacagagacaggtgtcaggactcaattcccgaagcaattcctttctcttcagaggcaggagcctggcactgatttcttcaccctaattgcctgcaccagaaagaagagggggaggggaagagggtcgggaggcgggaaaggatagctctgtaatgctctcagagctgagccaaaaaggaaaagaaagcaaaacgacaaaaaactgatccgtgtcctgcatgttggcagcagacaaccttccttgctgctgagctgtcccgggtggcttcaccgcggctggggaatccgagccattccttccacgtgctaagatgtccctctaagccctcagctcctgccagaagtagccaaattacctttcttcgtactgtaaacttc

SEQ ID NO: 27247 - DNA, 227 bp, Homo sapiens; identical to SEQ ID NO: 168
  misc_feature 1..227: note = chr2:63286358-63286585
  misc_feature 1..227: note = hyper
  source 1..227: mol_type = genomic DNA

SEQ ID NO: 27248 - DNA, 55 bp, Homo sapiens; identical to SEQ ID NO: 169
  misc_feature 1..55: note = chr2:63286693-63286748
  misc_feature 1..55: note = hyper
  source 1..55: mol_type = genomic DNA

SEQ ID NO: 27249 - DNA, 244 bp, Homo sapiens
  misc_feature 1..244: note = chr2:63287082-63287326
  misc_feature 1..244: note = hyper
  source 1..244: mol_type = genomic DNA
ggcggcgggaacgcggaaggttccctccacccccaccccaacccccacccccacccccgggccggccacctgttgacaggcaggttctctgagaaccgacttcagctcgcccttctgtccaggaagtttgttcggtttgggtttgggtgttcgtgacacaatcggagcaattagaattgaagcaacttcaggagatttagcaacccgcgaaaatttagcaacgttcagacgtcaacagttttct

SEQ ID NO: 27250 - DNA, 143 bp, Homo sapiens
  misc_feature 1..143: note = chr2:64455493-64455636
  misc_feature 1..143: note = hyper
  source 1..143: mol_type = genomic DNA
ggcatgaatattcatcgggggcgtggccccgccagcgcgcagggctccaagcagctgcgactagcggaaagcgcgcgccagctgcacgcagggaaacagttctcattttgtgtgctcggctgactgcacgtccagcctcgggc

SEQ ID NO: 27251 - DNA, 110 bp, Homo sapiens
  misc_feature 1..110: note = chr2:64836323-64836433
  misc_feature 1..110: note = hyper
  source 1..110: mol_type = genomic DNA
tctggccgccgggcccgggatgccaggatgcggggggccggggctgccggtgctcttgggggcagggggaagctccgctccctctacagaggacaaccgccccgccgccc

SEQ ID NO: 27252 - DNA, 163 bp, Homo sapiens; identical to SEQ ID NO: 6195
  misc_feature 1..163: note = chr2:64836470-64836633
  misc_feature 1..163: note = hyper
  source 1..163: mol_type = genomic DNA

SEQ ID NO: 27253 - skipped

SEQ ID NO: 27254 - DNA, 148 bp, Homo sapiens
  misc_feature 1..148: note = chr2:66653040-66653188
  misc_feature 1..148: note = hyper
  source 1..148: mol_type = genomic DNA
ctgtctcctttcctccgtctcccggtcctctcccagcgtcacccctcactacctatacccccgcgccctacccccacctggggcgctgggttccacgcctcctcaagaggtgtgagcgcccgcgctgggcgcccgtagcgcggccctc

SEQ ID NO: 27255 - DNA, 535 bp, Homo sapiens
  misc_feature 1..535: note = chr2:66653399-66653934
  misc_feature 1..535: note = hyper
  source 1..535: mol_type = genomic DNA
agtcctaaaaggaatcgtagagcaattgatctcggaggagatgagcgcaccccggggctcattgctgcccctgaggaagagccgtccaggaacggaggcgagaagcttccagaattaggccaagaggcaggtggcggggtgatccggcgtccccgagtccagctggggagaaaggcgccctcggatgctcagccccaaagcagcagaagacagaagccggtgcgccatcgtcgctgcgccccagtccgcgggtcctcgcgctcctgctccggctcccgggctgccacccaccgctgcccaagcctgaccaactcccaactccctccggcacaggctgaggcgacccccaaagagaaaaataggatcgcagtcaaaactggcggggatggggcacactggtgggagaggggaccttttcaccttttgctcttcccaggggacacagtcccccaaacctacgtccctgcgccaaaccaggtgcgagcaaactccgcggaccccgcagctggaagtgcatcctgccgggacccccacc

SEQ ID NO: 27256 - DNA, 226 bp, Homo sapiens
  misc_feature 1..226: note = chr2:66659963-66660189
  misc_feature 1..226: note = hyper
  source 1..226: mol_type = genomic DNA
tctttcaaggcaaagcgcttctgaaggttttgggagaacgtgtgtcagcccttcaggcacacagggtgccagtacggagttgggggcggggaagggtgcagtgcaggcggctgggaaggctcatctgctcggctttatggaaacgctccactgttgggggcaaccaaccccgcgttgactcctgcgaagtgctaaaggaagcgatagatgtcgcctaaggagacta

SEQ ID NO: 27257 - DNA, 101 bp, Homo sapiens
  misc_feature 1..101: note = chr2:66660603-66660704
  misc_feature 1..101: note = hyper
  source 1..101: mol_type = genomic DNA
ataattgattttccccgcagccaatgcgcggcggcctgggcgggggcgcctcctgattggccgagcactcctccacggctgcctaccgagatttgggtgag

SEQ ID NO: 27258 - DNA, 318 bp, Homo sapiens
  misc_feature 1..318: note = chr2:66802623-66802941
  misc_feature 1..318: note = hyper
  source 1..318: mol_type = genomic DNA
atcttttggggatttcgaaaaacgactcggtaggaaacggagggaggcggaggcgcgggagtgggggaaacccccttattatccagtgtcggaactggctcccttaatctgatgcttaaatatttgatgtggaaaaattacccataaaattagttactaacaatttcaaattgaaatcacttatcgaattataaacgcattaaagctgtatggatggtattaggagttcctcgggaggcagcgggtgtctccttgaagtgagccaggcgggcgagtttcgccccggggaaaagagcccccagccgagcccgggggcaa

SEQ ID NO: 27259 - DNA, 157 bp, Homo sapiens
  misc_feature 1..157: note = chr2:66803441-66803598
  misc_feature 1..157: note = hyper
  source 1..157: mol_type = genomic DNA
gaccacagctctggtcgcggggggtggcgggggtgggggggctgcacgggcgcctgccttaccctcctgccctcacccccatctgagtctagtctaagggactgttgactttgtctctggagatggggcgaccaggggtctgcgaaggaggttgtgg

SEQ ID NO: 27260 - DNA, 78 bp, Homo sapiens
  misc_feature 1..78: note = chr2:66808556-66808634
  misc_feature 1..78: note = hyper
  source 1..78: mol_type = genomic DNA
gttttctttccccgccgccccactgtcccttttctcgtctccccgcgcacctccccagacgccctgccggggtggctc

SEQ ID NO: 27261 - DNA, 837 bp, Homo sapiens
  misc_feature 1..837: note = chr2:66808726-66809563
  misc_feature 1..837: note = hyper
  source 1..837: mol_type = genomic DNA
cgccggccggacgtcggctaggctccttctccccgcgggctgggggccctggggctctgcaaggctctggctccgaacagattgcgcctcccgcctggctgccagtaggaactggggtgggagccgcgtaactaacagttgcgcgcaggaggcgagccccaggtgtgagcgcagaggctctctccccagcccgcgggtctgggaacctttcaggacgcctccctccccaactcctacccatgcgtctgctccctaggccgagcccccctcgtgaggttttaatgaccgcggacgcaggggagcccgcacttgagcgaggaccgacttctctggcgggtccacgctgctcgcgcttgcgtccgcgggtagcgcgctgtgcccgggtcagggggcgagctgcgagaagtaggaggggtcaagacccccagaaatccctccatgggcacacacacaatcaagaatagggttgagggtcttgagaggtagaactaccctaggcagggcttctccaactcggcctttggaccccgcgcgcgcccaagggcgtgcccaccgcggaagcacagatcatcttcccgggactgggtctcctggaccctgcgttgctccctttttcctagcggccccgtagctggctgccgcatgtagggcgatcttcattaacttggacgcccaacgtgattgaaatagagaggaggaaaaaacacatttgatctgggccgaccctttgtcttgaagcagattaggcagcctagaaataggaggaaaaacagaaagtctaggcaggaaaacttattgtgttcacaacatataaaaatgatccgagcggtctggtac

SEQ ID NO: 27262 - DNA, 268 bp, Homo sapiens; identical to SEQ ID NO: 173
  misc_feature 1..268: note = chr2:68546249-68546517
  misc_feature 1..268: note = hyper
  source 1..268: mol_type = genomic DNA

SEQ ID NO: 27263 - DNA, 561 bp, Homo sapiens
  misc_feature 1..561: note = chr2:68546552-68547113
  misc_feature 1..561: note = hyper
  source 1..561: mol_type = genomic DNA
cggcggctccggggggcggaggacagcgccggctgcggccgagtggctggagcgcgaggggcggagaggaagcgcggggagggtgagggaggtggtggagctgaggctgccgctaggaacccgcgccgtcgccgccgtccgcccgggcttttgaggagcagctccttaggctgtggcccccctccccactcggcgaggaagcgggcccaagagacggctccaaggccgcgcgcttccccatcccccgctccagtgctgcgccctccacgcacccgaaggctcgctctggcccgcaggccgccgcgcagatccgcgcagctgggggcgagggagttaatcctgtttacgcaccacaatccccttcagctggggaagcggacatttaggctcctcctagaacagccccgggcaggaggaggagaggtttgggaggcactgggaaggcgctggagttaagcgaccactatgccaaggagcgagacccccggaatctggataccgcctcggccagctacgtgaggtggacactgctgctcgcggatccggcgccagccaggcggg

SEQ ID NO: 27264 - DNA, 123 bp, Homo sapiens
  misc_feature 1..123: note = chr2:68870366-68870489
  misc_feature 1..123: note = hyper
  source 1..123: mol_type = genomic DNA
ggtcctttgcaagctcgcggctgagcggggccgtgtccgtccactccgacggcgctgggctgccaaggtgagccgccgaggagccccgtgccccgaggcgggcacagccgccctgcatgggtg

SEQ ID NO: 27265 - DNA, 292 bp, Homo sapiens
  misc_feature 1..292: note = chr2:68870746-68871038
  misc_feature 1..292: note = hyper
  source 1..292: mol_type = genomic DNA
gcgcctcacggccaccggaggcggggacagggagtccggcgcgggccgggtcgggggatctgcagcggcggcgcgaaggtaactcccccgccagagccgggaaagagccccgagcagaggaggaagggagcggggacctgcccttcgcctgccggcttctggaagaagcgtctcctgatccggccccggaataagaaacccggaccttgcctgccgggctccgcgatgccgcaggtacagagcgcgccctcccggggaggatgctccagggaccccgcgctgcactggctgc

SEQ ID NO: 27266 - DNA, 631 bp, Homo sapiens
  misc_feature 1..631: note = chr2:69240089-69240720
  misc_feature 1..631: note = hyper
  source 1..631: mol_type = genomic DNA
gcctggaagcgcccccgcccccgacgcactcccgcgggtcccacgcgtgctttcgccgcctttgtccacaaggtggcagcctttgaactttcttccccgtaagaacgcgaaaggggggcagagaggaaggagagaaggcaaagcactgcccccaccaagaacaatttgaaacccccccccccccccatcatatttaaaatctgggacaaagaaccgtcgggacggaactccttccattgcaaaagctcggcgcggcctcgggagctgcccggcggccccggaccgaggcagccctcccctttaaaagaagcggaggacaggattgggatccttgaaacccgaaacccagaaacagcatcggagcggaaaccagaggggaaaccttgaactcctccagacaattgcttccggggagttgcgagggagcgagggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaaggggg

SEQ ID NO: 27267 - DNA, 40 bp, Homo sapiens
  misc_feature 1..40: note = chr2:69241225-69241265
  misc_feature 1..40: note = hyper
  source 1..40: mol_type = genomic DNA
tgttttgttttgaaacgctgtcccacggaaggcattatct

SEQ ID NO: 27268 - DNA, 175 bp, Homo sapiens
  misc_feature 1..175: note = chr2:69533635-69533810
  misc_feature 1..175: note = hyper
  source 1..175: mol_type = genomic DNA
agggctctctgtgtgcgaatccaggccctgagttcgcacgcccacctggggcggtggtccagccgccaggaacccgcttcccagccgctccccctcacgcaggaagccgggactctgggcgcagctctcccggaccacggccacgtcctggctccagctacggaggcagaaagaa

SEQ ID NO: 27269 - DNA, 57 bp, Homo sapiens
  misc_feature 1..57: note = chr2:70313348-70313405
  misc_feature 1..57: note = hyper
  source 1..57: mol_type = genomic DNA
ccgaccccaatttctcgttggcgacgaatgctaaccacgtgtcgccattttgtgttc

SEQ ID NO: 27270 - DNA, 909 bp, Homo sapiens
  misc_feature 1..909: note = chr2:71503413-71504322
  misc_feature 1..909: note = hyper
  source 1..909: mol_type = genomic DNA
tctgtaaacagcaggcgaagaaattattagtcttaaaaaggacagaaagactcccgcaaaagcagcagcgcgtgccgaacaccttaggcctcacagaccttctatttgaggaatgtgctcccccaatcccagaccgctcctggtggggcgggcgcgagcgcaggaccgcggagcctgctgcgttgctcggctgcaggggaggagctgggccccgcccccggcttcccgcgctccgcgtccattggctggcctcgggggtgggcgggtcccgccgcacggagtcctgcgccttgaggctcaagcggcggcgtgcaaggcgtgtgaggcgcgtagagagccgcgcgcgccgtctgcgatgccccgggacggcgttcctgccgggaataccaccccggcggcagcccaggctgccgcgcagagcccggattccgcgactgccggggcaccgcaggttttggactcgctgaagcggtgagctctgcctttgccctatatgccgcgctctcgcccgtgctctggggcagttggcagtgggtgggcaggaaggggcgggccggcagggcgtcgcacgttggcgtccccgcgtcgcgggaatggggttcggattccccccgtgaatgtcattccccaggctaccggtctttagcgctaagttgcatgggctggtgtgccagtcggtcagcgaatagcggcagaacgcctggccgggccggcgttttccgggacactcgtttcggcctcgcagtggcagcgcctcctgcgagcctagaccggctcagtggacgcgccgcgctgtgcacgcgggtctggggagacggcggttcttgaatgatccctcacactgcagggtatctgggagcggtggattgagggggcacaacgtggcttctgtgtcggtgaaatcgcttg

SEQ ID NO: 27271 - DNA, 558 bp, Homo sapiens
  misc_feature 1..558: note = chr2:71680684-71681242
  misc_feature 1..558: note = hyper
  source 1..558: mol_type = genomic DNA
tctcctgtccaagagcgagatctgggctacgccgggcgcccggagccctagtccagcccccggccatcgcggccgccgcccagccaggtgcaaaatgccgtgtcattgggagactccgcagccggagcattagattacagctcgacggagctcgggaagggcggcgggggtggaagatgagcagaagcccctgttctcggaacgccggctgacaagcggggtgagcgcagccggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggtaggaggggccgaccaccctcgccc

SEQ ID NO: 27272 - DNA, 75 bp, Homo sapiens
  misc_feature 1..75: note = chr2:71693520-71693595
  misc_feature 1..75: note = hyper
  source 1..75: mol_type = genomic DNA
ggtgcgcaccgggcccgggatccctggctggtgtggagccttggtcaccggaggcccccgcggagcaggccccac

SEQ ID NO: 27273 - DNA, 43 bp, Homo sapiens
  misc_feature 1..43: note = chr2:71693820-71693863
  misc_feature 1..43: note = hyper
  source 1..43: mol_type = genomic DNA
cattggtcacttctccgcggaggagcagcgaaggcgacagctc

SEQ ID NO: 27274 - DNA, 171 bp, Homo sapiens
  misc_feature 1..171: note = chr2:71694277-71694448
  misc_feature 1..171: note = hyper
  source 1..171: mol_type = genomic DNA
gaaaagcgaaagtgccgtaggtcagcggttatcacttttctaagactgacacccagaggaaataaagtccgagcttttactgggtagtggggataagggtaagttggaagatgggtgcagaaggtagagaggaatcagggcctctgaaaaacggggcgtgtagatgatgtg

SEQ ID NO: 27275 - DNA, 30 bp, Homo sapiens
  misc_feature 1..30: note = chr2:72372207-72372237
  misc_feature 1..30: note = hyper
  source 1..30: mol_type = genomic DNA
taacccttctcctgccggggcagcacccgg

SEQ ID NO: 27276 - DNA, 167 bp, Homo sapiens
  misc_feature 1..167: note = chr2:72372591-72372758
  misc_feature 1..167: note = hyper
  source 1..167: mol_type = genomic DNA
gataattccccctgccgtgcagcccttctagacggcgtctacccctttaagaaaaatctaggcggaggtggggtgcgacagaaggggtggtgaggcgagggtttccctccctccgtctgctatacccgtctccctcgctccgtctcactctccgtctttcctctcct

SEQ ID NO: 27277 - DNA, 127 bp, Homo sapiens; identical to SEQ ID NO: 6212
  misc_feature 1..127: note = chr2:72374563-72374690
  misc_feature 1..127: note = hyper
  source 1..127: mol_type = genomic DNA

SEQ ID NO: 27278 - DNA, 52 bp, Homo sapiens; identical to SEQ ID NO: 6213
  misc_feature 1..52: note = chr2:72374713-72374765
  misc_feature 1..52: note = hyper
  source 1..52: mol_type = genomic DNA

SEQ ID NO: 27279 - DNA, 30 bp, Homo sapiens
  misc_feature 1..30: note = chr2:72375350-72375380
  misc_feature 1..30: note = hyper
  source 1..30: mol_type = genomic DNA
agggagcctctctctcgtaagccccttccc

SEQ ID NO: 27280 - DNA, 30 bp, Homo sapiens
  misc_feature 1..30: note = chr2:72377270-72377300
  misc_feature 1..30: note = hyper
  source 1..30: mol_type = genomic DNA
gttaacatggagctgcgtacagcaaccccg

SEQ ID NO: 27281 - DNA, 58 bp, Homo sapiens; identical to SEQ ID NO: 6214
  misc_feature 1..58: note = chr2:73142033-73142091
  misc_feature 1..58: note = hyper
  source 1..58: mol_type = genomic DNA

SEQ ID NO: 27282 - DNA, 30 bp, Homo sapiens
  misc_feature 1..30: note = chr2:73142786-73142816
  misc_feature 1..30: note = hyper
  source 1..30: mol_type = genomic DNA
tccttccatatggaacgaaaatctccttct

SEQ ID NO: 27283 - DNA, 30 bp, Homo sapiens
  misc_feature 1..30: note = chr2:73143592-73143622
  misc_feature 1..30: note = hyper
  source 1..30: mol_type = genomic DNA
agcggcgcctttctgcggcctcgaaggtgg

SEQ ID NO: 27284 - DNA, 30 bp, Homo sapiens; identical to SEQ ID NO: 6215
  misc_feature 1..30: note = chr2:73143902-73143932
  misc_feature 1..30: note = hyper
  source 1..30: mol_type = genomic DNA

SEQ ID NO: 27285 - DNA, 744 bp, Homo sapiens
  misc_feature 1..744: note = chr2:73145232-73145976
  misc_feature 1..744: note = hyper
  source 1..744: mol_type = genomic DNA
ctaccctcaccccagcgcggccgaggcggccttcgtgagtggcttccctgccgcggccgccgcgggcgcgggccgctcgctctacggtgggcccgagctcgtgttccccgaggccatgaaccaccccgcgctgaccgtgcatccggcgcaccagctgggcgcctccccgctgcagcccccgcactccttcttcggcgcccagcaccgggaccctctccatttctacccctgggtcctgcggaaccgcttcttcggccaccgcttccagggtgagtgtccacgctgtgcccgccgaggcggccggccggcgcccgtgctgcggcgatgcgggggaggctcgggggcgcgcggggctgtttagaagttactgccgggaaggctgcaggtccgcggaggtagattcccaggcagggaagagctgtgcggcatccacccgcgccttcgccgcgtaggtctccctcccaggaaagcaggtggagacctccaggcttttctagaaaatataccagttcggacgcaagcccaggcgcgtcctcggagcctgtgctggccctcgccacagcctgcccaattctctctcccagctgagccagtctcagaccagagtacaactcctcccgctctccctccgcccggcttaacctcgcaccacgcttctctcgcaagtccaccaccacctccgagacctcagccttcgctggcgcgtccgggcgggggaaagtccattcgcgtgccccagctctg

SEQ ID NO: 27286 - DNA, 48 bp, Homo sapiens
  misc_feature 1..48: note = chr2:73146224-73146272
  misc_feature 1..48: note = hyper
  source 1..48: mol_type = genomic DNA
gagggcttttaaggtcgtagccagtccgaaccccggagtttgcatcca

SEQ ID NO: 27287 - DNA, 361 bp, Homo sapiens
  misc_feature 1..361: note = chr2:73147167-73147528
  misc_feature 1..361: note = hyper
  source 1..361: mol_type = genomic DNA
aggagagggcggggtcgttcctaagtcctgtggcctccagccgttcagcttgtccggagtcggcatcctgggccgcaccctcggcttcgaatccagcccctgacgccctccgcaccgcggttcctgcctccgggcgccgagggccgggggcgcctggagagaaatccagctccggctctgagcgtctccagtcaggcgaggcggataaatccttcgcaaaaccctcttggaaattgccgccgcttcctgagccatcagtcccagcgggtacgttatcgagtagcacaaacagttggatttttccctcaagaaccgagtctggacgcggagatggagccaagtgtggctgcattttcggacc

SEQ ID NO: 27288 - DNA, 101 bp, Homo sapiens; identical to SEQ ID NO: 176
  misc_feature 1..101: note = chr2:73147966-73148067
  misc_feature 1..101: note = hyper
  source 1..101: mol_type = genomic DNA

SEQ ID NO: 27289 - DNA, 43 bp, Homo sapiens
  misc_feature 1..43: note = chr2:73148174-73148217
  misc_feature 1..43: note = hyper
  source 1..43: mol_type = genomic DNA
cgtccggccctgagcccctggccggcggcggcctctccagcga

SEQ ID NO: 27290 - DNA, 47 bp, Homo sapiens
  misc_feature 1..47: note = chr2:73150907-73150954
  misc_feature 1..47: note = hyper
  source 1..47: mol_type = genomic DNA
gtgtgcctagcaccccgctgctccccttatcacgttcctgaccccca

SEQ ID NO: 27291 - DNA, 662 bp, Homo sapiens
  misc_feature 1..662: note = chr2:73151187-73151849
  misc_feature 1..662: note = hyper
  source 1..662: mol_type = genomic DNA
agctgttattccccgcgttcccccgcggagtggctctcgagtgcggggaggtgttgcggaggggagtggacttagggaaggggcggcaaaagggcaaagggagaaatggcgtgtgtgtgcgtgtcaaggaatggagagggcagggcgcttgggagcagggcgcgaggccaggctctgttgggccccggctcacggcgccccttctctctgtctgtacctgcgtgtgttgccgtcggcggcggggccgcagccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtaatcacccccggtcgcggcctgccctgcgcccggagcccgggtggaggtgagggtgcgcgggtgcaggagaggccctgagcccgccccagcccagccctgctgggttccaaaaggcccccattccccgcggcgctgcggtcaagcccgtctttagagcctcttcctcgagactgcgtgcagcctgctgagcccgcaggacttttgtcaagcgctaaagacctagc

SEQ ID NO: 27292 - DNA, 53 bp, Homo sapiens; identical to SEQ ID NO: 6222
  misc_feature 1..53: note = chr2:73152398-73152451
  misc_feature 1..53: note = hyper
  source 1..53: mol_type = genomic DNA

SEQ ID NO: 27293 - DNA, 256 bp, Homo sapiens
  misc_feature 1..256: note = chr2:73152739-73152995
  misc_feature 1..256: note = hyper
  source 1..256: mol_type = genomic DNA
cgaccctactacaccaccgtcccctcccaagtcccgggcagtgagaagatgcccggcatggggggcagccggagcctccctttagcagccagagtaggaagggggcttagtgagggagcccagacccaaacttcatccgcagctttcttcggcggaccttaccctctcctccttcagtggcattttggcatctattgtcgtcatatctgtctgctgccccacttaatctacaaatcgctcacgggtcggaggcagg

SEQ ID NO: 27294 - DNA, 568 bp, Homo sapiens
  misc_feature 1..568: note = chr2:73429355-73429923
  misc_feature 1..568: note = hyper
  source 1..568: mol_type = genomic DNA
caggcactgccctaccgctctccagatcacagctccgcctctgcaaggccccggggaaacgggcatcccttcttcagtgagcaaaggagaaagacggagcccggtggctgggtgtttcgcccaggatcaccagcgagctcagagtcctccccacgaccgccccagggtgggcatttttaaaagcggaggaagggagggaacacactctttggtgctgtgcccaccttgcctcgcacagagcgggcgctcacaggctttgggggccccgcccggaccgcagtggggagaggccgccccatgccccgccccgccaaatttaagagccttcgccgagcgccaggaggttcccagacaaccggtcttgctcgctgccttttgcagaatcttctcacttctcccgagctcccttccttgcgtccgtccgggcaacggccgcgtcatgcctagccccaggccgcgaggcagcccgccacccgctccctcgggctctcgggtccgacctccgcgctctggccgctctccggcgcccaggtcccctactggcccgaacacgccccgcgctcccgga

SEQ ID NO: 27295 - DNA, 93 bp, Homo sapiens
  misc_feature 1..93: note = chr2:73429976-73430069
  misc_feature 1..93: note = hyper
  source 1..93: mol_type = genomic DNA
cgcgccggcggcctcccagccgtcgggctccgcctgcgtccacccggccttctggaccgctgcttccctgtgcgccaccgggggtctgccctg

SEQ ID NO: 27296 - DNA, 51 bp, Homo sapiens
  misc_feature 1..51: note = chr2:73430322-73430373
  misc_feature 1..51: note = hyper
  source 1..51: mol_type = genomic DNA
ccttgcagttgaagccgaggaccgcgacagtcttgctgaaaaagaccccgg

SEQ ID NO: 27297 - DNA, 314 bp, Homo sapiens
  misc_feature 1..314: note = chr2:73430442-73430756
  misc_feature 1..314: note = hyper
  source 1..314: mol_type = genomic DNA
cggtgggcaggaggccagcgctggggctgcaaggggacccagccctgctcccggtctccgcgtcccttgactccctcgcacaccccggggtagcgcttagtgacagagacgcttcccaaagcggctctcgacccgaaccaatggccctgttttttttttttacggggtagggggaagtggacgctccgggcggtgctgttgagcgaggagctgttaggagctggtcaaggctcacaccccactaccgcctccactgctcacgtctgtgaacttgagctacacacttcgctctgagcctgcgtgcatgcaatgct

SEQ ID NO: 27298 - DNA, 32 bp, Homo sapiens; identical to SEQ ID NO: 6228
  misc_feature 1..32: note = chr2:73512107-73512139
  misc_feature 1..32: note = hyper
  source 1..32: mol_type = genomic DNA

SEQ ID NO: 27299 - DNA, 1606 bp, Homo sapiens
  misc_feature 1..1606: note = chr2:73518261-73519867
  misc_feature 1..1606: note = hyper
  source 1..1606: mol_type = genomic DNA
ggttatagaggaaggcgtggggcgtgtgccagttacaaaagactgtcttgaatcccagggtagtgcctattcactgggtggtctcagaagacttcccccaaagcgcggctgacaagggtgacagcgcctggaccgcgggaactgtccgcggagctggtgctgaatagggcgtgtgcggcgggcgcttcaaggaaactggaagcgggaccggaggccggccctcgggcgtgcgaggaggagttggaagaagagcggggaggggaacggcccggaactcgtgcgcgccgaacggcggcgccccaacccataaacccatctcttgctcagagagaagcgaaggagaggcccagcgagtaaaagccgaggcccttgagccgctcctcggcgcgcgccttctgcttgaggtgcaccttgctgtgccgtttcttctcatcgctgcgcgcgaagcggcggccgcacacgtcgcaagcaaaaggcttctcgccggtgtgggtgcgcacgtgcgtggtgaggtggtcgctgcggctgaagttgcggaggcagatgcggcactggaagggtttgtggcccgtgtggatgcgcaggtggcgattgagctcgtcggagcgcgcaaagctccgcacacaactctccaccgggcaagcgaaggccttggcgtgcggccgcgggcagaagcagcgcgtgctgcatttgccgccgcggcgccccttgcgtcgcgccttggcctgggggaaaggggtgggcggcggcggcggcacgggtggtgcagccacgccactgcttccagggatgtccgccaccagaggtttagggaagtccgccgcggcggcgctgcgaaggcccagcggggaaagctgaggctgcgtactggccagaaactctccgccgtcgccgctactccctccctccccactaggaggggtcaggagcccagggaggccctcagccccctcccctaagtcacccggggccagcgggaaagcgtcataggccccgctgggatagagtctgttggctgggacggccggcagttccgcagggcagctgatggacagcaagtcctcaatcttggtccctattacgggaaaacgagcctccggggcggcctggtagtctccctgtgacccacagttccctggggcccccacagaaagcagctcccagggcgcgtagggacccttgaaggcagagacagcgtccagcgctggcgaggcgggaggcgcccggaggccgggcttgacgtcgggcggggagagctgaggctcatacaggcactgcgagggggcacccgcgcaaggcgaggcctcccagaacgcctctgggaaaggggcagcgcccagatccggggagtaaaggtccggcggacccggcagcaaggcatcggaccccgcaggaaaaggggcatccagcggggatctggacgctgctgcctctggaccggggaagggtgccaggcctaagatgcccgacatgaggttgaagagtgcctccgggtcgtgcgggtgttcgggcactgcctgaatgaagaagctaccgctgtagctgaggccgggagggggtgtgggcgcaggcccctccaggaagcaggagtcggctaagtccccac

SEQ ID NO: 27300 - DNA, 802 bp, Homo sapiens
  misc_feature 1..802: note = chr2:73520242-73521044
  misc_feature 1..802: note = hyper
  source 1..802: mol_type = genomic DNA
ttctcaggtatggtgcgcccccgcgctgcgccgtcgtcgtctgagcacccctgctcgccctccttacctccagggtagccggtggccgcgggagcgtccctggcaggcagccggggcaattcagcgctgggttcggcgcaacagccttcagtggacttgacgaggagcgcgtcgggttcggaaaactcgctaaggtggagcatggcgcggcgccggctgtggggcgcccggggcctcgcccgctgggcttgggggcgcgcgggtggcggggaggctggcggtaggggttccccgcagcgcacagacctaggcgcccgggctcctggcttcgggcactcacctctgggaaaggagtcggggagccgcggcgccctcgctcgcccgcaccggcctcgggcggcggctcctcgcctctccaaagcgctgccgggctcccccagcccacagcccccccacttatatagctgcggcggcgctggctccgggcttccgactccccgggccactgccattttgggaggccccggccctgccgccgtgacgtaaatgcccaaacatggacacaggatgtgtgccggggactcccgaaaaggaaagctcgagctgtgacgttgttgttgtcgccgccgccgccaggctcgcgccgctgcgtgcgcgcgcgctccccaggcgtggagcgctggggccgcggatgcgccagtctggggcgctgcgcctcaccgggccgaccgtccggtagatgcgcttcccacctggaggcagaggccgaggggcagcaggggaggaccgtgttgggtttgaa

SEQ ID NO: 27301 - DNA, 35 bp, Homo sapiens
  misc_feature 1..35: note = chr2:74229462-74229497
  misc_feature 1..35: note = hyper
  source 1..35: mol_type = genomic DNA
ggggttagagagtggcgaagcgggaatcccccccc

SEQ ID NO: 27302 - DNA, 126 bp, Homo sapiens
  misc_feature 1..126: note = chr2:74230043-74230169
  misc_feature 1..126: note = hyper
  source 1..126: mol_type = genomic DNA
ggggagcctgtctgccgtgatccaggcggcagctggaggcaggaagatggtcccagatagcctttctttcccaggctgtatcccctcccgttcgccttcttcccctccggccgggctgggggctgt

SEQ ID NO: 27303 - DNA, 44 bp, Homo sapiens; identical to SEQ ID NO: 6233
  misc_feature 1..44: note = chr2:74726199-74726243
  misc_feature 1..44: note = hyper
  source 1..44: mol_type = genomic DNA

SEQ ID NO: 27304 - DNA, 30 bp, Homo sapiens
  misc_feature 1..30: note = chr2:74726744-74726774
  misc_feature 1..30: note = hyper
  source 1..30: mol_type = genomic DNA
ccgggcccccagcctcggacccgcccccgg

SEQ ID NO: 27305 - DNA, 52 bp, Homo sapiens
  misc_feature 1..52: note = chr2:74730183-74730235
  misc_feature 1..52: note = hyper
  source 1..52: mol_type = genomic DNA
gtccgggggtgcagacggcgccctggggtggtcctgccgccacctctccttt

SEQ ID NO: 27306 - DNA, 30 bp, Homo sapiens
  misc_feature 1..30: note = chr2:74730614-74730644
  misc_feature 1..30: note = hyper
  source 1..30: mol_type = genomic DNA
tcgacgccgagctgccgcccagccccaatg

SEQ ID NO: 27307 - DNA, 531 bp, Homo sapiens
  misc_feature 1..531: note = chr2:74740605-74741136
  misc_feature 1..531: note = hyper
  source 1..531: mol_type = genomic DNA
cacaaggtcaccaagcggcttaggtctttccccacctcccttctctgacagctccaggccattttttgagtttgggtggggtaaaatgtttatgggaaacaaggcggccaggatccaaccaaggcctcagtgaggtcccacgtgtcccccgtggcgagatttcgccctcccgccgttgaggaggaagagtgtgagaacagacttcctaggcacagaatggaggggcagagtcctgcattgaggactccctgcacttggggtccgggggtaagtgccagccccaagaacccgccggcctgatttggcccgggttgagccatggtccgttttacacggattttggaaaatcgaaattctaggaaacacaggacaccaattaccggtgcgcatgaacagggctggggggacctacaggagaggccagaaggcgcaccacgatcgccagcccaaagcggccgttccccgcccttagcccctgccgtccccttcccacacctgttctcttcctgggcctgcagctcaccgggcgcc

SEQ ID NO: 27308 - DNA, 708 bp, Homo sapiens
  misc_feature 1..708: note = chr2:74741137-74741845
  misc_feature 1..708: note = hyper
  source 1..708: mol_type = genomic DNA
ttccccagccgcttcttacgcagccgggaaaccacaacgagatttggtcttcgagagcatttaggcggggaccacaacgaatccgggagttggccagaaggatccatcgagaggcgaagagtgggggctgggggaggaggcacctgcggaggaagccggtgaggcggaggcagcccaaaggcggaggccgcccaaaggcggaggccagcaaggatggaggcgcggtgagcatctccgctgactcagcggcccatgctcgggcccctcccgcgctgagcctggctcctaacaccctggccccctgtccccctccccgcacatctccgccagccagccttccccctgcgcttggcgcaaacaggcgtcccttcccctttaactgctgggccccgcccctgccctacccccagcccccactacccacccgggccgatccgtcagtcactgccccagccggagctggccaaccctctccacccgggacttgggcagcggcgccggcagcccagcgtctatttgcgcttaagagccagcaaggaagctccaggggccccagctggccgtgctcccccgggatgcaagtccctgcgctgacgcccggcagcggctggcacgggcgcggctgctccgggtgcacagggatgctgctgtttcggggaccccggcgccctgccttggccagccccgcgggcccctgaggccactctc

SEQ ID NO: 27309 - DNA, 279 bp, Homo sapiens
  misc_feature 1..279: note = chr2:74741872-74742151
  misc_feature 1..279: note = hyper
  source 1..279: mol_type = genomic DNA
cgctgcctgaggcatcctccccaaccaccgaacctccggcggttctcctcggcccagaccgatggagccggggatgctgggtccacacaacctcccacaccacgagccaatcagcttcggcatcgatcagatcctgagcggccccgaaaccccagggggcggtctaggcctgggtcgcgggggccagggtcatggggagaatggggcgttctcgggtggataccacggagcctcgggctacggtcccgccggctcacttgccccgctgcccggcagctc

SEQ ID NO: 27310 - DNA, 324 bp, Homo sapiens; identical to SEQ ID NO: 180
  misc_feature 1..324: note = chr2:74742324-74742648
  misc_feature 1..324: note = hyper
  source 1..324: mol_type = genomic DNA

SEQ ID NO: 27311 - DNA, 452 bp, Homo sapiens; identical to SEQ ID NO: 181
  misc_feature 1..452: note = chr2:74742693-74743145
  misc_feature 1..452: note = hyper
  source 1..452: mol_type = genomic DNA

SEQ ID NO: 27312 - DNA, 15 bp, Homo sapiens
  misc_feature 1..15: note = chr2:74743766-74743781
  misc_feature 1..15: note = hyper
  source 1..15: mol_type = genomic DNA
cgaagcaatagaggg

SEQ ID NO: 27313 - DNA, 142 bp, Homo sapiens
  misc_feature 1..142: note = chr2:74781946-74782088
  misc_feature 1..142: note = hyper
  source 1..142: mol_type = genomic DNA
ctggcgcatggatgccgaaccttatccgggctagtagtgggtgagagagcccagaaacagggagaggtgggcagcgggctggagagcggcgccgggagttggagagcctgtgactttcccgtgaagttgctttgcacactcc

SEQ ID NO: 27314 - DNA, 97 bp, Homo sapiens
  misc_feature 1..97: note = chr2:74782218-74782315
  misc_feature 1..97: note = hyper
  source 1..97: mol_type = genomic DNA
cgtcgggacccgggccgcctgcgcacgccactccctctcgagcactctctctctctccctagaggtggaggaagacctgggccgtgctctacccggc

SEQ ID NO: 27315 - DNA, 80 bp, Homo sapiens
  misc_feature 1..80: note = chr2:75146976-75147056
  misc_feature 1..80: note = hyper
  source 1..80: mol_type = genomic DNA
aggcctcgataaatgtttaatgaataaaacgatgaaaggacccgtcgcctcctaaatgcagatctcgagggagcctccag

SEQ ID NO: 27316 - DNA, 67 bp, Homo sapiens; identical to SEQ ID NO: 6243
  misc_feature 1..67: note = chr2:75426808-75426875
  misc_feature 1..67: note = hyper
  source 1..67: mol_type = genomic DNA

SEQ ID NO: 27317 - DNA, 518 bp, Homo sapiens
  misc_feature 1..518: note = chr2:75427525-75428043
  misc_feature 1..518: note = hyper
  source 1..518: mol_type = genomic DNA
cctgcaggccagagccgggctcggggtggcatcggtggtccttctccctgttccccttccaggtttgcataggggctggaggacaggtcagccagccttctctgcccgcctccatcctgccctgccgtcttctgactttgaggcctcgtatcccagtccaagaccatttcaaacggtagaactggtgccagacacttggaggaggcagggcaaagactcgccagtccgtataaacccttttggagaagccaagatgggatgagctccgcagcacgttcccgccagactgctgcaggcagagttccgcggaaaactgaaccccgggagtcctcaggggcccatctaccccggtgcaccgccccctcctttcactgcggggactcggagctgtgggactggagcgcgcaccggcagacttgcgcgcaggttggagttggcgcacacccgcgccagccggggagcggcgtttacgcactggtaccgcgagcgctcaaagcatctctcgggaagtgctttaa

SEQ ID NO: 27318 - DNA, 30 bp, Homo sapiens
  misc_feature 1..30: note = chr2:75428245-75428275
  misc_feature 1..30: note = hyper
  source 1..30: mol_type = genomic DNA
tccctttatttagagcggctgcacaagagg

SEQ ID NO: 27319 - DNA, 157 bp, Homo sapiens
  misc_feature 1..157: note = chr2:75787200-75787357
  misc_feature 1..157: note = hyper
  source 1..157: mol_type = genomic DNA
tcccagatagagcagcgtggactgtctgcgcgcccctctccaaaagcaaagcgtcccactgggactttagggggcgccaacagcctttcactccctgatgcactcggctttcggggtcctgggggtcgccaaatgcgcgcggcgagttggctgcctc

SEQ ID NO: 27320 - DNA, 482 bp, Homo sapiens
  misc_feature 1..482: note = chr2:75787804-75788286
  misc_feature 1..482: note = hyper
  source 1..482: mol_type = genomic DNA
cctttgctggggccccggcgcgcacttccggggactgcgcttggggcgcgcggggccgagcagggggacccggagctgatcactgaggggcggacacgacaaagcgctgcccgggtcttgggccggcaccagtacctcggaaaggaatcccggcggaggggccgccggggtcagggctggcctggggatgtggggtcccggcctgggtgctcacggacggcggcgccaagccccgcagaagctgcaggagcccgagtcagtgggaggaaaaggttgtctcatttccttcgatctcccccctcctccacccgcttggctccggacctgccctccctctcccccgcccccttctgcaagccagcggcccatgtgggcgcccgcaagacgcgaaacctgaacggctgcggcgtgcggcacctccctccgcgccaagttagttcacgctcccaactcctgcctgcctccccgcgctgccgactgtc

SEQ ID NO: 27321 - DNA, 15 bp, Homo sapiens
  misc_feature 1..15: note = chr2:75788330-75788345
  misc_feature 1..15: note = hyper
  source 1..15: mol_type = genomic DNA
cggtcctccaggctt

SEQ ID NO: 27322 - DNA, 166 bp, Homo sapiens
  misc_feature 1..166: note = chr2:79739850-79740016
  misc_feature 1..166: note = hyper
  source 1..166: mol_type = genomic DNA
ccccacctgcggcgccgagcctgccgcgcctccagagctccgccctaccccgccccgccctttcgggcgctccccaggccgcgcgcgcccgcggccccccacccagccacccctcgatgcccggtgcctttccaggcgccgcggagccacggggaccgcgggggcg

SEQ ID NO: 27323 - DNA, 242 bp, Homo sapiens
  misc_feature 1..242: note = chr2:79740063-79740305
  misc_feature 1..242: note = hyper
  source 1..242: mol_type = genomic DNA
cggcgatccgggccgctgccgctcgcgcttgggcaggacgcggggcgggcggggggaggggggagcggcttcgcttccagccccgagtgaggcggagacccaggcgggcgggcagagcaggcggcaccgcacctcggccagaggcggctgcagcagctgctgcccttgtccctgccgccgcctctccagtcccttctgtgattaccactccagctgctgggaacgggcgagaaagaggagga

SEQ ID NO: 27324 - DNA, 144 bp, Homo sapiens
  misc_feature 1..144: note = chr2:80529299-80529443
  misc_feature 1..144: note = hyper
  source 1..144: mol_type = genomic DNA
cagcctggtgcccgccggcccgtcccggctgcccaggcgtatttggtagcgcatgggttgagagccactgggacaatcacacctcgcattccctcgcgggctgctggtggcaggtacacgagccatactcgttgatgatcacca

SEQ ID NO: 27325 - DNA, 211 bp, Homo sapiens
  misc_feature 1..211: note = chr2:80529698-80529909
  misc_feature 1..211: note = hyper
  source 1..211: mol_type = genomic DNA
cgcctggaagagccacggtggcaggctcgaatgtgccgtcgtgctgcccctccccgccgtccgcgagcgtggtggccgagctggcagggggccccagatcactgcggttggtgacggccgagagcaggtggccgctggtgggctcggccccatcctcgcacaggtggaaggcgtacacggcgtccaggacgtcctcgccctgtgcgtactc

SEQ ID NO: 27326 - DNA, 270 bp, Homo sapiens; identical to SEQ ID NO: 1999
  misc_feature 1..270: note = chr2:80529985-80530255
  misc_feature 1..270: note = hyper
  source 1..270: mol_type = genomic DNA

SEQ ID NO: 27327 - DNA, 72 bp, Homo sapiens
  misc_feature 1..72: note = chr2:80530256-80530328
  misc_feature 1..72: note = hyper
  source 1..72: mol_type = genomic DNA
ggaagtgggcgaagttcaccttgaccaagtcgttgtgctcgaggtgcagctcggtgagcttaaacaagccgg

SEQ ID NO: 27328 - DNA, 179 bp, Homo sapiens
  misc_feature 1..179: note = chr2:80530408-80530587
  misc_feature 1..179: note = hyper
  source 1..179: mol_type = genomic DNA
cgcacgggcacaaactggatggcgttggcccgcatatgcagcgtggtgagcttccgcagcccgtggaagaggtcgggcgcgagcgcctgcagcttgttgtacgagaggtccacgctgcgcaggttgggcatgggccggaaggtggtgttgggcagttgggtgatctggttggaactcag

SEQ ID NO: 27329 - DNA, 685 bp, Homo sapiens
  misc_feature 1..685: note = chr2:80531328-80532013
  misc_feature 1..685: note = hyper
  source 1..685: mol_type = genomic DNA
taattatatgcagggcgagagaagacccctctgtgtttccgaggcagccccggtccgcggccggcggatctggcaggcgcacaatgtctcactttgctgctcggctcggggctgcaagggcggccggcaaggcggggaggcgacttctaggacccgcaagtttcccaactacgtgccggagcccgagcttcgccttcctgccgccttcctttccctctgcagttcggactgtgacgttgtggggggaaaaaactccaaactcggggctcgcgactccccaggatctgacagtctggttaatgtccgtcattggaaacgaccactgaccggcgccaccttttactccgcggaaacagcctgccattcgcgccccgggcagctgcagagagcgggctcactcatgctttgcgggcggcgggcggcgggcggcgggcggtggggaggtgcggacggcggcgcggggagcggcgagcggcgcccgggctccttccctccaccaggcagtgtgcggcgcgagcttgcacaggcacctactgctcactgagtgtcgtaagctgctcacgattgtgcgtcttccccgagcacctcagacatgggcagattgaaaaggggtgggcataaaaccaacattttaccgaaccactaaagtaatatatgttttttgatgaaacggaaaacactttca

SEQ ID NO: 27330 - DNA, 160 bp, Homo sapiens
  misc_feature 1..160: note = chr2:80549571-80549731
  misc_feature 1..160: note = hyper
  source 1..160: mol_type = genomic DNA
cacaattcgggcccacgtagacttaatcccgagaggcaattgttcccttgcttgggcggctacgctccccgcggggctgcctgcagcccccgggcccttgcagctccgggacggcgcgcggcggcggaggccgcggggccccaagcgccagcctggcccc

SEQ ID NO: 27331 - DNA, 217 bp, Homo sapiens
  misc_feature 1..217: note = chr2:85107435-85107652
  misc_feature 1..217: note = hyper
  source 1..217: mol_type = genomic DNA
aacatctaaagcgcccggctggacacgcaaggctcggacagtggtcactccgcgaacgcactctgtgacctggagcacacaggtcccccgctgagtgtcagtttcccagatcggtaaaaacaagggaaatggcttcaactccctaaagtcccttctaactcaggcactgaacatatgaaggttaagccaagcagcttcagggcgctgttaatatttt

SEQ ID NO: 27332 - DNA, 401 bp, Homo sapiens
  misc_feature 1..401: note = chr2:85360051-85360452
  misc_feature 1..401: note = hyper
  source 1..401: mol_type = genomic DNA
atcagctcgcgcactcggagggactctaggcagggggagggccccgcggccagtatgtgcgtccgaggctttcccgcagggggcagtgccgcccgcccgcgcgccgatacggtgggagggggtgggaacctgcgcggagttctggaggttctttgggagaaagttaggggatgcggaggggtgggcgcaagacttccaggactccagggaggccgtggggagggccgccgagggtgcagtgtgaggcgcaggagggggttgggggcggtgcacgttgcagggagacgcagcccctggaagatgcgagtgtgaacgtgtgagtgtgagtgcgtgtgtatgtgtgtgtgtgcgcgcgcaccgcagctctccgggttccgcgaggcgcgcgggtgtcagcttgc

SEQ ID NO: 27333 - DNA, 90 bp, Homo sapiens
  misc_feature 1..90: note = chr2:85360920-85361010
  misc_feature 1..90: note = hyper
  source 1..90: mol_type = genomic DNA
gatccccttccaggacgaggggggcgaggagcaggagccgagcagcgatagcgcctcggcgcagcgggacctagacgaggtcaagtcgtc

SEQ ID NO: 27334 - DNA, 15 bp, Homo sapiens
  misc_feature 1..15: note = chr2:85361295-85361310
  misc_feature 1..15: note = hyper
  source 1..15: mol_type = genomic DNA
cgcacccttgccctc

SEQ ID NO: 27335 - DNA, 63 bp, Homo sapiens; identical to SEQ ID NO: 6255
  misc_feature 1..63: note = chr2:85361466-85361529
  misc_feature 1..63: note = hyper
  source 1..63: mol_type = genomic DNA

SEQ ID NO: 27336 - DNA, 299 bp, Homo sapiens
  misc_feature 1..299: note = chr2:87016575-87016874
  misc_feature 1..299: note = hyper
  source 1..299: mol_type = genomic DNA
cgacatttaggagagggcccgggacctcccaaccgccccaccgtcccgggaacgtctctccgcctcagatctcggtttcccaccacttggacagcccttgactctacctacagtatcagggctgtccctggcatgggctctccccgcggtgcgtgccgcccccgccccgggcccccgcacgcctcacctgcgccccccgccgctggccggcacgcctctgggcgcagggacaggggctgcgacgcgatggtgggcgccggtgttggtggtcgcggcgctggcgtcgtggtgggcttcgc

SEQ ID NO: 27337 - DNA, 507 bp, Homo sapiens
  misc_feature 1..507: note = chr2:87017729-87018236
  misc_feature 1..507: note = hyper
  source 1..507: mol_type = genomic DNA
tcagctccactgtctcgcccaggttccaggtccgatccagcggcgacacccggaactggctcggcctggcggcgtctgcaggcggcaagcagcgaggctgagcccgcagtcccgcgccccccgccccccgcccgccccatcccctgccttcccgggcgtctcaaactcacggagcagcaaggccagcggcaggagcaaggcggtcactggtaaggccatgacgcgctccccaggacgctgcttggctcgaagctcgggcgcgaggggaggcgcgcgggagccggtggggcgccgaggggggaaagttgcgcccttcggccggcccggagcctgatttcgcatttggaggatgtgatgtcacccgaagcccccgccgaggagagtcaccctccttttcgcggttgtcgccttccagcccggcgaggaggctggggcccgtgaatagggccgtcgaggcagcctggccaggcaactgggggcagctgaaaactgcgggtttggggatga

SEQ ID NO: 27338 - DNA, 367 bp, Homo sapiens
  misc_feature 1..367: note = chr2:87088683-87089050
  misc_feature 1..367: note = hyper
  source 1..367: mol_type = genomic DNA
cctccccttctcctgcgtccaggcttttgaggggaggtggcctcagtccaggggctctccggtcccccggggtaatgcgatatgggggtattttatttccacccttagggaccgtgcctgccaagctgcctcccgggcgccccgccaccgcgggctcgacgctgcaccctgccaggaccagggccaggacagccacttatcacctccccgctcaggccccgggagcgcagacccttgggtagcccgcgcgccgccgccttacctgtcagctgcgcggccaagaggagccacagccgcggccgcatcgtggcgcgcccgggacacctggccccgggggctcggcggagacagtcgcggctggggtggg

SEQ ID NO: 27339 - DNA, 30 bp, Homo sapiens
  misc_feature 1..30: note = chr2:88469803-88469833
  misc_feature 1..30: note = hyper
  source 1..30: mol_type = genomic DNA
aggtccttcccactgcgaagctgagaaccc

SEQ ID NO: 27340 - DNA, 139 bp, Homo sapiens; identical to SEQ ID NO: 2004
  misc_feature 1..139: note = chr2:88751281-88751420
  misc_feature 1..139: note = hyper
  source 1..139: mol_type = genomic DNA

SEQ ID NO: 27341 - DNA, 356 bp, Homo sapiens; identical to SEQ ID NO: 2005
  misc_feature 1..356: note = chr2:88751460-88751816
  misc_feature 1..356: note = hyper
  source 1..356: mol_type = genomic DNA

SEQ ID NO: 27342 - DNA, 893 bp, Homo sapiens
  misc_feature 1..893: note = chr2:88751942-88752835
  misc_feature 1..893: note = hyper
  source 1..893: mol_type = genomic DNA
gtaaggcgccctggctgccgggggggcgcccggggcggcggcggtggcggcgggcgggggcaggccgggctgcgaatacactccgaagttgtcgccgcagtagagggccatgtcggcggccgtgggcggctgcggcgcggccgcggcgaggggcgagcggggctggtctcgccgctcgggcgagagcatccctttgggggccaaccctgcggctccgccttcacccgcgctgggcgcccggtgctccgggccggggtcgggcgggtgctagcggagcgcctgctagccggcctcttataaccgagcccggcgcggctcctcctgggccggcccggagcggggcggtggccgcgggcctgggctctccacgcccccgccacgccccacctgcccgcgcgcccaaacccggagcccgcccgccccgcccctaccgcccctctgcccgggcccgggagcgtctgggaggccggcgcctccaggtttcgggcaaaaagcagcaccccattcctagcccacgtttcttaacatcataataagtaaagccacgaatattaaagagaagataacccgaacagtacgaatgatttctaaaaagttaacttggggtggccgctcgggccacctgcctagtcatccttttggcttttctacctctttcctcctaaccttttgtgatcgagtcgcggaattcacgtccagtctcaaccgatcggcttccagtcgaaaataatcgatgtgatttacaacgctttggggtatacggtagaggttattaacaggcccgcttggcgtgtccccttctcctcggggattctgtgattggaggaacggaaatcagtgttgagtttttctaaccaaactgtaggttcgctcacattcgggaagcatttatt

SEQ ID NO: 27343 - DNA, 38 bp, Homo sapiens
  misc_feature 1..38: note = chr2:88753098-88753136
  misc_feature 1..38: note = hyper
  source 1..38: mol_type = genomic DNA
tgtaaaatactgtggcgacctcacgttccacgtaatca

SEQ ID NO: 27344 - DNA, 171 bp, Homo sapiens; identical to SEQ ID NO: 184
  misc_feature 1..171: note = chr2:89064805-89064976
  misc_feature 1..171: note = hyper
  source 1..171: mol_type = genomic DNA

SEQ ID NO: 27345 - DNA, 371 bp, Homo sapiens
  misc_feature 1..371: note = chr2:89065128-89065499
  misc_feature 1..371: note = hyper
  source 1..371: mol_type = genomic DNA
cgcgtcgggagccggtggaagaggagaagagcgcgcgggcgacagtcatacaggccttggggcagggcgcgcctcgcgctccagggagccacgccagcccgctgcgcctccgcagcaaccgccgcctgcacgtggcggggcgagagagctgctagggcggtttctccgcctcgggcctgttgggcggggccggctaaggtgcgcgtgctcgctggtcctaacggttctgttgggcgtttctgctgagaggcgggaggggctgagagtctgtgcgaaggtaggtggacagactgcattgcttgttgttgcgcttcggaggcggcgatccccgaaggcgagctgaaatacggctggagcgttcccaggctaca

SEQ ID NO: 27346 - DNA, 192 bp, Homo sapiens
  misc_feature 1..192: note = chr2:91635152-91635344
  misc_feature 1..192: note = hyper
  source 1..192: mol_type = genomic DNA
cgtatgcggcttccggcccccgccgccacggctttttatcacccccgccgctttttgcccccgccgccgcgggtttttgcccccgcccccgttgctttttacccccgccgccgcggctttctgcccctgccgacgagggtttttgcggctttatatccccgctgtcatggctttttgcggccgtggcttttt

SEQ ID NO: 27347 - DNA, 163 bp, Homo sapiens
  misc_feature 1..163: note = chr2:95663969-95664132
  misc_feature 1..163: note = hyper
  source 1..163: mol_type = genomic DNA
cgccccactgggtggcgcgtgggctccgcgcgcaggcagggagggcggccctcggtggggtcgactgggcggagccgccgcctcctatcttcccttgaaggcacctgcgcagggggacccgcggtgcctgggaggggagggggactttcgcatgaagcccctc

SEQ ID NO: 27348 - DNA, 753 bp, Homo sapiens
  misc_feature 1..753: note = chr2:95690747-95691500
  misc_feature 1..753: note = hyper
  source 1..753: mol_type = genomic DNA
aacgtcccttcctgtcgcatggattcaaggccgacctgccccagcaccaccaccagcagccttctgctggggccggcacagctgggagcaacctcctactctcaggcagacgcgcagcaccaagcagagaggcccggtgcaggatcccagcgccgaaccagcgccggctcagtggacgcggaaggggccggcggccgcggccggtcccatcccccactgcagacccccagcctgtggcggtggtccagttccgccaggaaaccgccgcctggagctgtgggtcgcgcacattaacgcatccagcggaaaaatgaaggagacccaaattcaaagttaaagtaatggtgacccgagaggtgccttgatgagaaggtttggggtcccggttactgatggttatcattcttacgagatgctggtcacctacgaagggagaaaggcacgaggagcgcctgaccaaagtggttttgccctgcttcccgcaagaggtggcacccacggctggaacgcaggagtcagacccacagtccccagctctggacgcccgcagcggggcctcgaagaggttcagggcggtgcccgcggcgctcgggccgggtctcccggggcgtggggcggggggcggggttgggcggcggccggggctcctccctcttctgccccgggctcccctgctcttaacccgcgcgcgggggcgcccaggccactgggctccgcggagccagcgagaggtctgcgcggagtctgagcggc

SEQ ID NO: 27349 - DNA, 979 bp, Homo sapiens
  misc_feature 1..979: note = chr2:95691501-95692480
  misc_feature 1..979: note = hyper
  source 1..979: mol_type = genomic DNA
ctcgtcccgtcccaaggccgacgccagcacgccgtcatggcccccgcagcggcgacggggggcagcaccctgcccagtggcttctcggtcttcaccaccttgcccgacttgctcttcatctttgagtttgtgagtggctcctggccggggaagggacggggtgggctgagccgtgcgctctctcgggcgcccagcacagctgtcggacgggatccgctagctgcgcaggttctgggagcatcggggcagcaggcgcagggcggggactaagccagggaagtcccctcccacctccggtcctttgtgcccttctagaccaacagaatgaggggaacagtctacaggactatggaggaaaaactgggttcccaactggggtcagatgtaggcagcggggcagggggggacggctcttggttcgctggtcccaaagctgcgcgcggggcccacttgacgcgcgcagcgccaccgaagctcccgccgcgctttgcgcggttgggtagaagtgcgcagcttttacaagggagaaggtttcgttaaaaaagaaaaaaaaatcagcaagagaaacattagtattaccaaccgagatttggagatgagagggagctgaatccggtttattttcttctggccttttaaagtttctggcgagggaacgtatttgcgaccaattcgatctggaaatgaggccatcgtttgcttggccgcagtccttctgccccgtgtgcggggtgggggtggaggagatggggggtggggggtggggggtggcggcgagagcgatccgcgcgcctcgactgaccttgggcaggcccggggcctctgcacctgcggtcggtcccgccttgcacgcacggtctctgcctgaggctgcaggaaagcgcttcctactgagaactcctgataagcgctcacggtgtcgcgaagccgaagtgacctccctcagcctcaactccccgggggccgctggccttcacct

SEQ ID NO: 27350 - DNA, 98 bp, Homo sapiens
  misc_feature 1..98: note = chr2:95873425-95873523
  misc_feature 1..98: note = hyper
  source 1..98: mol_type = genomic DNA
tggcgggaggacccccgggtgggggcgccaggctgcccacgcgtgcgttcccggcctcttgggggacccgagcggcggacctccggctccttcccctg

SEQ ID NO: 27351 - DNA, 204 bp, Homo sapiens
  misc_feature 1..204: note = chr2:96012452-96012656
  misc_feature 1..204: note = hyper
  source 1..204: mol_type = genomic DNA
tggccgtccgcgctgcgtttcgcgccgccgccgccgccgcgcctcgaagtttgccggctgactcggaaagttgcgctcgggctcggccgccgcgtccggtccccgcgtccagcctccggcctgacccgctcgccgccgccgccgccctccacggggccccggcccagccaacccagcagccccgcctgccgggggcatgtgagc

SEQ ID NO: 27352 - DNA, 41 bp, Homo sapiens
  misc_feature 1..41: note = chr2:96192504-96192545
  misc_feature 1..41: note = hyper
  source 1..41: mol_type = genomic DNA
cggcgcaggaaattccggcggcgcggcgaggggtgggggga

SEQ ID NO: 27353 - DNA, 77 bp, Homo sapiens
  misc_feature 1..77: note = chr2:96781907-96781984
  misc_feature 1..77: note = hyper
  source 1..77: mol_type = genomic DNA
agagggagcgctgcccgcccagtgcgcaccgtggacgacagcgctgcccggctcggctagacaagagcgtcgcccct

SEQ ID NO: 27354 - DNA, 196 bp, Homo sapiens
  misc_feature 1..196: note = chr2:96782022-96782218
  misc_feature 1..196: note = hyper
  source 1..196: mol_type = genomic DNA
cgagcggggcctaggaggtcgggaacacccaggaccagcagccgccctcctacatcctcctccaccggtgcccggggtccctgccgtccgccccagagaagtttcccaagttgtcccgccgccgtccccgtcccgcccgggaccggagaaagtcgcgccctcccgccacgcggatgccgtacgctctgggggcgcg

SEQ ID NO: 27355 - DNA, 69 bp, Homo sapiens
  misc_feature 1..69: note = chr2:96987148-96987217
  misc_feature 1..69: note = hyper
  source 1..69: mol_type = genomic DNA
acgctccccgtcccccgcctcgtctttcttcggctcggcccgtggggcttccgccgccctgggcttgca

SEQ ID NO: 27356 - DNA, 435 bp, Homo sapiens
  misc_feature 1..435: note = chr2:96990881-96991316
  misc_feature 1..435: note = hyper
  source 1..435: mol_type = genomic DNA
agggaggccgagcagcggagagtgtgtggccacggcccctccactctcccagcaaacccacgggggcctcggtgcggacagagacccggtgtggggaggccgctgcccctgcacgctgggccacgggggtttgggcggggaggagcttgtactgggtgggcggggaggagcccggacggcgggagcggctgcggcgcgcgggcgccctcggagccgcgtgctgggggtcgtaggggcccaccgcgctcagccagacgttcagacgctcggacaagcatggtctataacccaggaaaggggagcagggccactcccgcgggcggccccagcgatgaaccggacgcccccaccctgccgggaaaaaagcagtggcggtcaggccgcgctgtctctttaagatcgtgttcctactaacactgacggtgagtaacctgg

SEQ ID NO: 27357 - DNA, 49 bp, Homo sapiens
  misc_feature 1..49: note = chr2:97193015-97193064
  misc_feature 1..49: note = hyper
  source 1..49: mol_type = genomic DNA
ggcaggggaaggcctcgggagggacacgacggtccggcagcagagcctg

SEQ ID NO: 27358 - DNA, 401 bp, Homo sapiens
  misc_feature 1..401: note = chr2:97193251-97193652
  misc_feature 1..401: note = hyper
  source 1..401: mol_type = genomic DNA
cggtttgagccagctcccctttttgagtcagatccggcggcagggccagaaaagcgctttctgaaaccccagcgcggtcctcggtgggggtggaatggggtggggtggggggcgcggccgcgccgctgggcgccctccccgccctcccccctccccacccccagtcctccctccgctgcccgccccccaagcccggtgtcgccccctccgccccctgccgcatccccggagccagtgcccacaggggccaggcagcccgcaggggtcgctcacggctggtgtaggggcttggtccaccacgctagtacttcgggcaccaaaatagaaaaagaataacgcttggaaagaatctgatgtttccgaaggagcatcgaaaatcgccgttacgggaaaagtaaaac

SEQ ID NO: 27359 - DNA, 104 bp, Homo sapiens
  misc_feature 1..104: note = chr2:97203428-97203532
  misc_feature 1..104: note = hyper
  source 1..104: mol_type = genomic DNA
gctcggcgggagctgcgggccaacccgggcccgcgctccgtccctccgcggtgtctaggggtcgcccgggctggggtcgcgtcaccctccgcccagcgccggcg

SEQ ID NO: 27360 - DNA, 208 bp, Homo sapiens
  misc_feature 1..208: note = chr2:98962692-98962900
  misc_feature 1..208: note = hyper
  source 1..208: mol_type = genomic DNA
ggagagaacccagaacggaacgacggacttgtttgctttcttgcccctgactctccccgtcctccctgggagggttggggatgtgaactaatgacttctgcctctttcggaccgcctttgaggctccagagcctcaccttactttcccacggagagggaggccacaggctccttcagcagtcgccgagcagagtcctgggccgggagc

SEQ ID NO: 27361 - DNA, 79 bp, Homo sapiens
  misc_feature 1..79: note = chr2:98963329-98963408
  misc_feature 1..79: note = hyper
  source 1..79: mol_type = genomic DNA
ccgagcccgctgagccgtcggggcgggaggcagaaggagcagggctggctcccgctggggacgggtagggcttgcagcc

SEQ ID NO: 27362 - DNA, 417 bp, Homo sapiens; identical to SEQ ID NO: 189
  misc_feature 1..417: note = chr2:98963409-98963826
  misc_feature 1..417: note = hyper
  source 1..417: mol_type = genomic DNA

SEQ ID NO: 27363 - DNA, 332 bp, Homo sapiens
  misc_feature 1..332: note = chr2:98963868-98964200
  misc_feature 1..332: note = hyper
  source 1..332: mol_type = genomic DNA
cgcccctgggggccttggcgcgcaggccctcgcagtcccgcaaccccgggccgggtgattcatttttctccctgtgtaatctccctactgagcggcgcagctgggactttaacttcggccctctgcagcgggggtctccggttggcgcggcgcgtgagggaggatgaatggcgctggaacctagaggacctggagccggcgccccggcctctttggcctgaaccaggtgcctctgacacgcagtccgccggctcaggcctcgccggaagctggcgggagcagtcccttgcagcgaagcccggcaccccgacggcagacgctccccatcacat

SEQ ID NO: 27364 - DNA, 245 bp, Homo sapiens
  misc_feature 1..245: note = chr2:98964473-98964718
  misc_feature 1..245: note = hyper
  source 1..245: mol_type = genomic DNA
caactgggtcttctacgccagagtcccagttgtagaaaagtcggccaggtcagaggacccagatgggatttcactaagctggtgggagcttctttgcgttctttggggtagggggaaggacaggaactccccctgcttcgcaccaatgcccaaacaccgcacttcctcttcagcctcggttcagccacagagaggggcctcctcctgtgtagatgcccggaggggaggagcggtggttcttgggg

SEQ ID NO: 27365 - DNA, 139 bp, Homo sapiens; identical to SEQ ID NO: 191
  misc_feature 1..139: note = chr2:99439368-99439507
  misc_feature 1..139: note = hyper
  source 1..139: mol_type = genomic DNA

SEQ ID NO: 27366 - DNA, 477 bp, Homo sapiens
  misc_feature 1..477: note = chr2:99552170-99552647
  misc_feature 1..477: note = hyper
  source 1..477: mol_type = genomic DNA
ctttgggcacttgcacgagcgcgtccggctccccctcggccgcaggagctgcccagggcttcggcggcgggggtggcgcctctccgggtccgaggggcccctggcttcacggcctctgccctcgaccccctagccccggcccgccccacctccgcccggtgcccccgcgcccaccccgccttcgacccacgcctgccttgggacacgcgatttcaaacccctcgaggtacctgggacaggagcgtggcccgggctcggcgagacgcgcagagaagggcaccttccgcggggtgcggcgagccggggctgctcccgccgcggtgcgcgtctagccccagcccaaagccggggcgacgcagcaggtggccgcgcggcctccagacagcccgggtctgcggccgaagagctggacgcgggcgctgacactaccctcccgcggccggcccggccctgcgcccggcgcgctcccagctccca

SEQ ID NO: 27367 - DNA, 74 bp, Homo sapiens
  misc_feature 1..74: note = chr2:99553081-99553155
  misc_feature 1..74: note = hyper
  source 1..74: mol_type = genomic DNA
actccaggtgacctccggatccgccctctaagtcagtggcctgcggcgggcgtgggcgccgagggaaggaagtg

SEQ ID NO: 27368 - DNA, 115 bp, Homo sapiens
  misc_feature 1..115: note = chr2:99553419-99553534
  misc_feature 1..115: note = hyper
  source 1..115: mol_type = genomic DNA
gctgccttgggtggtcgcccagcgaatctcctccggagcccgagccgcggctttggtctgcggatggcacagcccggcgaccccgtcccggcctcttccccggcggtgcacgccc

SEQ ID NO: 27369 - DNA, 186 bp, Homo sapiens
  misc_feature 1..186: note = chr2:100720888-100721074
  misc_feature 1..186: note = hyper
  source 1..186: mol_type = genomic DNA
ggagcagggctaagtcgaagctgtccatggtgggaggtgtcagcgtcgccgccgccgctaccgccgccgccgaggctcgggccgcccgcgcgctgcaacgaaaggcgccgctcaaggtgcatcccagccgcgccagagcggccgccgcccgcccaccgcccacccccaggtcggggctcccgacgc

SEQ ID NO: 27370 - DNA, 30 bp, Homo sapiens
  misc_feature 1..30: note = chr2:100721292-100721322
  misc_feature 1..30: note = hyper
  source 1..30: mol_type = genomic DNA
ctgcgcccgcccgcccgcctctttctcctc

SEQ ID NO: 27371 - DNA, 374 bp, Homo sapiens; identical to SEQ ID NO: 6284
  misc_feature 1..374: note = chr2:100937836-100938210
  misc_feature 1..374: note = hyper
  source 1..374: mol_type = genomic DNA

SEQ ID NO: 27372 - DNA, 216 bp, Homo sapiens; identical to SEQ ID NO: 6285
  misc_feature 1..216: note = chr2:100938329-100938545
  misc_feature 1..216: note = hyper
  source 1..216: mol_type = genomic DNA

SEQ ID NO: 27373 - DNA, 225 bp, Homo sapiens; identical to SEQ ID NO: 6286
  misc_feature 1..225: note = chr2:100938574-100938799
  misc_feature 1..225: note = hyper
  source 1..225: mol_type = genomic DNA

SEQ ID NO: 27374 - DNA, 10 bp, Homo sapiens
  misc_feature 1..10: note = chr2:100938800-100938810
  misc_feature 1..10: note = hyper
  source 1..10: mol_type = genomic DNA
ggacaggcac

SEQ ID NO: 27375 - DNA, 192 bp, Homo sapiens
  misc_feature 1..192: note = chr2:100938984-100939176
  misc_feature 1..192: note = hyper
  source 1..192: mol_type = genomic DNA
cgcctccccgcagaggtgccggggccctgggagcaggtggccttggccgcgggctgctggcgcgccggcaccgcggcacctgctcttccccagaggcctggccgcccccacaacctgtggctccgcttaagcaagaacccaggaaaagtcaccaaacgcatcacgcatctctagcttcgacttaggaaattg

SEQ ID NO: 27376 - DNA, 61 bp, Homo sapiens
  misc_feature 1..61: note = chr2:101033731-101033792
  misc_feature 1..61: note = hyper
  source 1..61: mol_type = genomic DNA
cgccaggacaaaacccgcgggttccccggtttttccgtgcgccccgcggcggggagagggg

SEQ ID NO: 27377 - DNA, 273 bp, Homo sapiens
  misc_feature 1..273: note = chr2:101033998-101034271
  misc_feature 1..273: note = hyper
  source 1..273: mol_type = genomic DNA
ggtcccgggatgtggcggcggcggcagcggaagtaaggaagacgcccggcgcgctagaccggctttgggggccagaacgccggcaccgcctcacgcggccccctcgcgcctatccggccgtgcgcgccgcctgcccgcgcgcgtccccgccgccgtccccggccgtgcgcgttccagcgggtcgcggggagtggggaggggcgcggccgcgggaccccaggcccggatcccgagtctccctttctgccgctgcaaaagcgttctttctgaccg

SEQ ID NO: 27378 - DNA, 41 bp, Homo sapiens
  misc_feature 1..41: note = chr2:101436001-101436042
  misc_feature 1..41: note = hyper
  source 1..41: mol_type = genomic DNA
ctttgtgccctgggtcgagacctgcgcgcaaccctgcccct

SEQ ID NO: 27379 - DNA, 159 bp, Homo sapiens
  misc_feature 1..159: note = chr2:102003995-102004154
  misc_feature 1..159: note = hyper
  source 1..159: mol_type = genomic DNA
cggaagcaaggagcccgagcccccttcccgcccctgcaggatccccgggcgcggtcccccgcgcgagtcccggcgaatccctgcagccgcgcgcgaagctcagaagtccaggctcgcagaagaccaggttccacgcacacgccgcgcatcctgcggagt

SEQ ID NO: 27380 - DNA, 861 bp, Homo sapiens
  misc_feature 1..861: note = chr2:102090355-102091216
  misc_feature 1..861: note = hyper
  source 1..861: mol_type = genomic DNA
gcagggtccaaccaacgggtccccgcggggcagaccggatggctttccgcgggaagggtgacaacggggaagtcacagatgggaagcccggccccatcgccgattcgggcccggggcttttacgcgtgtgcgtgcatggcaggtccctccgcgctgcggcgggcgagcatcagaaagcgctgggcctggggccgctcctcacacccggctttgacccggcgtcccgagggcagccgtagcgggaaccacgcttcccctccccggccccacctcctccatcccagcgtcccaggcgcctggcggctcaccactggatgacgccgctgtgcgggccccggctaccctcgccgctcgacggcgaggccggcaccccctcggccatggctcggccccgggcctgcagcaccgaggcaggcagcgagcggcggccgtgggcggcgctgggttgcaccggtcctgctaccgccgctcctcggtgtttactttagaaaggagcgcgcggggggcgcgcggggcgcggggcgggagcccagtcctccaggcccgagcccgggggcgcggaaggcgcgcggcgagtacgggaggccacagctccccaacccccgcgccccgccgaggatgcgcggaccccgccctgcatcctgcggtgtgggctggagctgcctcccgctctcacccagcgcccttcccaccggcgtagcaaccagtcaaacagggacgcgaacaacaagcaccaacttacaccttttccaatctggtcgcggtgttgagtccgtgggtgtccttgacttgcttgagcgttggagttattcaggcagttttcaaaaatattgataccccggctgccgctccccatcccag

SEQ ID NO: 27381 - DNA, 37 bp, Homo sapiens
  misc_feature 1..37: note = chr2:103236062-103236099
  misc_feature 1..37: note = hyper
  source 1..37: mol_type = genomic DNA
gggctgctgagggtacgcgcagcggcctctcgtcgcc

SEQ ID NO: 27382 - DNA, 195 bp, Homo sapiens
  misc_feature 1..195: note = chr2:105458957-105459152
  misc_feature 1..195: note = hyper
  source 1..195: mol_type = genomic DNA
ttgggaagactcaggcgaaagagggagatgcccgtgtagagaaccgaggaggggggctggggtagaataatcagctctaaggttgcagatttagatctcaaggctgaaaaggataagcttccaccagagcatcctgtagcgcctcctgtcctgccctgccctgccctgcgcgcgcaccgcactcacacgtacacc

SEQ ID NO: 27383 - DNA, 361 bp, Homo sapiens; identical to SEQ ID NO: 193
  misc_feature 1..361: note = chr2:105459902-105460263
  misc_feature 1..361: note = hyper
  source 1..361: mol_type = genomic DNA

SEQ ID NO: 27384 - DNA, 247 bp, Homo sapiens; identical to SEQ ID NO: 194
  misc_feature 1..247: note = chr2:105460264-105460511
  misc_feature 1..247: note = hyper
  source 1..247: mol_type = genomic DNA

SEQ ID NO: 27385 - DNA, 144 bp, Homo sapiens
  misc_feature 1..144: note = chr2:105460921-105461065
  misc_feature 1..144: note = hyper
  source 1..144: mol_type = genomic DNA
ggagagggtgatacacgttcacacaccgcttgctaaatgcagtggcgagaggagggagcagcgtctacatgaagcgaacttttcaagcgcagagccctgactcccaggcgcgggggctcaccgggaggggcccgggcgagagag

SEQ ID NO: 27386 - DNA, 251 bp, Homo sapiens
  misc_feature 1..251: note = chr2:105461163-105461414
  misc_feature 1..251: note = hyper
  source 1..251: mol_type = genomic DNA
cggccggtgggcagccctcgacccggggcgcgtccacagcgcccacccgcggcccccaaacacctcgagagcagatcttaggggttaaccaggcaccgacctgaggcgccctgcagctgccaaaagctcgaccggaaacctagaacatgggacccaattcatcggttttcctcgtccatacatgcatccatccatccctgcatgcgtacatgcatgcaatacaaatcccgggacgccggcacggagagctg

SEQ ID NO: 27387 - DNA, 113 bp, Homo sapiens; identical to SEQ ID NO: 2022
  misc_feature 1..113: note = chr2:105461555-105461668
  misc_feature 1..113: note = hyper
  source 1..113: mol_type = genomic DNA

SEQ ID NO: 27388 - DNA, 122 bp, Homo sapiens
  misc_feature 1..122: note = chr2:105461699-105461821
  misc_feature 1..122: note = hyper
  source 1..122: mol_type = genomic DNA
cgcgcaccgaatcagtgacaaaggcaagcgggcggcgccgagctccaagccggcgctcctacggcttggcgggaaggaggcccagaagatggggtgcgatttgcacccggattttcctgggc

SEQ ID NO: 27389 - DNA, 57 bp, Homo sapiens
  misc_feature 1..57: note = chr2:105462165-105462222
  misc_feature 1..57: note = hyper
  source 1..57: mol_type = genomic DNA
ctaaataaaataaaacgccgttagaatgcgatctaaggaagccgagcttagccctgg

SEQ ID NO: 27390 - DNA, 1294 bp, Homo sapiens
  misc_feature 1..1294: note = chr2:105468563-105469857
  misc_feature 1..1294: note = hyper
  source 1..1294: mol_type = genomic DNA
ttatatatacatatacgcatacgtaaatataaaaagcaacctttgggggccgcagaggaaaaaaatccgttctgtttggggtttggttaccaccgcctttggtatctataccttggcaataatggctttgctaaaacctacctacgatggtatctcacccggcaagcaggagctggacaagagcctacataaattctacgcgtctagtgttaatcttgagatcacgcgggggctgcctggctgcggctgggcaggagaactcctgctttcactgagttcacttaactgcgctcggcagaggcacgatacagcgggagagaagggcaggcccgttcacattttaatcggagcgcaccggcggccgctcctcggctgcgtcctgggctgccgctcgggctcgggactgccagatgcaggctctggctgggggcggcgggcgcaagcgggcgcacccgcagctaggggtgcggggtgcacgcacacgcacgctcattaagagccatgtatttattgaatgtccgagttgggttagttcattggaaatccccgaggagggctcaatttgcccttgttttcgttgccactttctcttttttcttggttcgctgaggttcctctgtgcagcgtttccgcttggccgcgtccccccaccccaccccaccccacccccgcttctctcgcctaccgggtgcactccccctcccatcccccttaactctttcagctgggttagagctgagaaagcatttgtcgccgccagccccatccaccacgcaaatccatctgagacagaaaggaaagaaaaaaaagcaccaccatgcctaagaatagagagcgagcaaacccccccaccgctaatcacacacacacacacacacacacacacacacacacacgaggaagcggtggagcagagaagggcgcggctagccgatcccggttctttcgcccggctcctgctgccacagggaattcctaaagccattggggtcgaatacacttacgatgaatctatgggggaaggtcggactgattgcttttcaaatacatcgcacggctccgctgaccggcaccctccaaactcacaagggcacgcacgctacttgcacgaatcccagaggagggaggagggaggaagggagggagagcgaaggagggagagagggggtggaggagccagggagcggcggcagcgagcggtccgtctcgcacgcgcgggcaccgcgctggtcctgggctgcaggtttcccagatgatggcatccgagaacttaaacaaagggggctgccgccgg

SEQ ID NO: 27391 - DNA, 681 bp, Homo sapiens; identical to SEQ ID NO: 2025
  misc_feature 1..681: note = chr2:105469880-105470561
  misc_feature 1..681: note = hyper
  source 1..681: mol_type = genomic DNA

SEQ ID NO: 27392 - DNA, 405 bp, Homo sapiens
  misc_feature 1..405: note = chr2:105470562-105470967
  misc_feature 1..405: note = hyper
  source 1..405: mol_type = genomic DNA
gagggtaaacattcgacagtccccgctctgagagggagggacagagagcgaactgtcagatcggagcgagagcgggcgcccgagagagggagagagagagagggagggagaggaaaagtgagagagggaaagagagcgcgaacgagggcgcagagcgagctcctgctgcaactctgctccagcacggccagcgccagcgcccgccgtcggtgcactctacgagccgtgcagcgtgcccactggagttgttgtgtatcaaggatcgatcccctatatgcacacacacacctccacctccaccaatgcactcttcttcctcctccttctccagacaactgctgggaaaaaaataaaacaccaaccccaaccgtcagcaacaaggtaacagagcgattcgacatcatt

SEQ ID NO: 27393 - DNA, 853 bp, Homo sapiens
  misc_feature 1..853: note = chr2:105471573-105472426
  misc_feature 1..853: note = hyper
  source 1..853: mol_type = genomic DNA
gccggggctggggggcggccacgaccccccctgaagggggtggccacggagcgcaccccgagaagcgagcccccctccccagagcgctgctcctgcggctgctgctgctgctggtgaccaaggccggccggcgacccccgcgccctgccgagcggccttgcagctgcagccgggggccgcggcggcggcggcggcggcgggggcggaggcggcggcggaggaggaggcggcgaaggcggcggggccggcgggggcccggggcgggggcggggaaggagggggggaggaggcgggaggcggggggcgcggcggcggcggcggcggcggcggccgcggctgctgctgcggcggcggcggcggtggtggcggcggtggggtggcgggagcggagcggcatggccacggcggcttctaacccctacctgccggggaacagcctgctcgcggccggctctattgtgcactcggacgcggcaggggctggcggcggcgggggtggcggcggcggcggcggcgggggcggcgcagggggcgggggcggcggcatgcagccgggcagcgccgccgtgacctcgggcgcctaccggggggacccgtcctctgtcaagatggtccagagcgacttcatgcagggggccatggccgccagcaacggcggccatatgctgagccacgcgcaccagtgggtcacagccctgccccacgccgccgccgccgccgccgctgccgccgccgccgccgtggaggcgagctcgccgtggtcgggcagcgccgtgggcatggctggcagcccccagcagccaccgcagccgccgccgccaccgccgcagggccccgacgtgaagggcggcgc

SEQ ID NO: 27394 - DNA, 756 bp, Homo sapiens; identical to SEQ ID NO: 6306
  misc_feature 1..756: note = chr2:105472783-105473539
  misc_feature 1..756: note = hyper
  source 1..756: mol_type = genomic DNA

SEQ ID NO: 27395 - DNA, 215 bp, Homo sapiens; identical to SEQ ID NO: 6307
  misc_feature 1..215: note = chr2:105473599-105473814
  misc_feature 1..215: note = hyper
  source 1..215: mol_type = genomic DNA

SEQ ID NO: 27396 - DNA, 370 bp, Homo sapiens
  misc_feature 1..370: note = chr2:105478684-105479054
  misc_feature 1..370: note = hyper
  source 1..370: mol_type = genomic DNA
cgttcttgatgagtccggtcttcctcaaggaagagttggctctggaagtgacctcagaggggtctgggaagagggcaacagtcattctcttggcggcacgatgtgtgcgctagtgtgtgcgcgcgcgtgccgtgtgcatgtgggtgcgcgtgaggggagggggaagcggaaattcgcagtctggaccccgaagccctaggggtacaggcgacggggtcaggtgtaaggcctgcctccggtgaaaaccccggatcagaagaggcggagggggagggggacccgaggcagccgggcgtccaaagctcgcttctctccgggagggagggcagggctgggcgcggaggtggggcggtggcggtcgcggtggggc

SEQ ID NO: 27397 - DNA, 47 bp, Homo sapiens; identical to SEQ ID NO: 2028
  misc_feature 1..47: note = chr2:105479055-105479102
  misc_feature 1..47: note = hyper
  source 1..47: mol_type = genomic DNA

SEQ ID NO: 27398 - DNA, 210 bp, Homo sapiens
  misc_feature 1..210: note = chr2:105479657-105479867
  misc_feature 1..210: note = hyper
  source 1..210: mol_type = genomic DNA
ttattattctggaaacgctcaggcctgtggagccctagagactaaagggcagtcagcagagtaatgagcaaacctgggggctggagaaagtccaaggaattgaggagcgaaggaaagggaaacttctgaaagtttccctggaaggttgagggagttgctggaggctggagtcggctcaggttccagaggttctggcgataactttctgca

SEQ ID NO: 27399 - DNA, 64 bp, Homo sapiens
  misc_feature 1..64: note = chr2:105483752-105483816
  misc_feature 1..64: note = hyper
  source 1..64: mol_type = genomic DNA
gcgccgggccctctccgctgggggcgagcccggagggaaccgaggggcccgggagggggagctg

SEQ ID NO: 27400 - DNA, 236 bp, Homo sapiens
  misc_feature 1..236: note = chr2:105484041-105484277
  misc_feature 1..236: note = hyper
  source 1..236: mol_type = genomic DNA
gtaggggtaggtgcccgcgcctgggcccgcggggctttggtcatggctgttccccgggaggctcagttaggcagcagccttgctgggcaacaggccccgcccttggttaatccgggaaggtcgcgggctgcaatctggcctgacgaggcaggccctgaagtctccccgctgggcgatcagaagagcgttcgagaagccgggagctggtggggttggcagggcgtctgagtcacccg

SEQ ID NO: 27401 - DNA, 207 bp, Homo sapiens
  misc_feature 1..207: note = chr2:105488281-105488488
  misc_feature 1..207: note = hyper
  source 1..207: mol_type = genomic DNA
actcaatgctcaatgcgaacgcagaaagaactcaacaactgaaccgccagtggaatccagtatctgggcaagttcactttattccttcgcaggaagagggtcagcgacggccagcgaaagtttcccccgctctttgaagagggaggtgacaagacctgccagaccttcccacgcgcgggccgcctgggttctggggctttcgtgacg

SEQ ID NO: 27402 - DNA, 686 bp, Homo sapiens
  misc_feature 1..686: note = chr2:105488548-105489234
  misc_feature 1..686: note = hyper
  source 1..686: mol_type = genomic DNA
ctcttccttgctcgggaaacttggcttcaacctggctccccctttcaaaaccccctggagaacttcccctgcagggatgccctgcgcccgccggctgcgccctccctctcctcagccctgctcctcctgtccgctccccggcgttctggactcacccggcacggtccttccattccacatacagacaggaaaccggcctcttcgggacaacatttgaaaccacattttatcaacatcatcaaagaccagagcacacacttcgggctctgagctctggagcccgcttcttgcagaaaaccgggtatgggggaagggctgcaggggcgagaaatcctgcttccaactgcgatttcagctttcttatggaaatgaacgcgacggcccgttcgccccgagcctccctcccgttcccagcccctcttcagcttaccctttcctcccgctaacccccgccctcccggtccccgagttcccgcggcggccaggctggtggggacgcactcgctctgcgcccgggtctcggcgcgcgcggaaacccaggccgcgggctcccctccgccccgccggcccgcgtgcagcattaaatattcatagggatgctactttcttaaaggagaacctaccgcgcgggaaagttcacagccaaggagaggcacaaaagaaggtctccgcgctggttctcaagg

SEQ ID NO: 27403 - DNA, 45 bp, Homo sapiens
  misc_feature 1..45: note = chr2:105489909-105489954
  misc_feature 1..45: note = hyper
  source 1..45: mol_type = genomic DNA
cggcccgacccgacccgcgacggggccacgcgtagtgccaggcaa

SEQ ID NO: 27404 - DNA, 81 bp, Homo sapiens
  misc_feature 1..81: note = chr2:105760590-105760671
  misc_feature 1..81: note = hyper
  source 1..81: mol_type = genomic DNA
gcctttgtctcgggccgccgggcgcgcggggcccagcgcaggcgtaagtgaccggtggccgggccgcggggggtcggcggg

SEQ ID NO: 27405 - DNA, 147 bp, Homo sapiens
  misc_feature 1..147: note = chr2:105760937-105761084
  misc_feature 1..147: note = hyper
  source 1..147: mol_type = genomic DNA
tctgggcagaggccacgcggggacggaggaggcagagaggacgggctgtgatggagaaacgggagaggagccggccaggcgccaccgtcaccaccatcaccaaccaccaccaccatcaccatcactgactgtcgcccatcccagctc

SEQ ID NO: 27406 - DNA, 171 bp, Homo sapiens
  misc_feature 1..171: note = chr2:106014945-106015116
  misc_feature 1..171: note = hyper
  source 1..171: mol_type = genomic DNA
acagcgtcacctccccgcagccgccggctgggacccgcggccagcctttacccaggctcgcccggtccctgcccgcatggcggtgccccacctggtgaggacgcgggctgcagtcctccctctggggatgagtcggtgggctcctctgagctccagcgcccccagggtcta

SEQ ID NO: 27407 - DNA, 30 bp, Homo sapiens
  misc_feature 1..30: note = chr2:106681724-106681754
  misc_feature 1..30: note = hyper
  source 1..30: mol_type = genomic DNA
aggggaacagtggcgcggctggggcgggcg

SEQ ID NO: 27408 - DNA, 34 bp, Homo sapiens
  misc_feature 1..34: note = chr2:106682012-106682046
  misc_feature 1..34: note = hyper
  source 1..34: mol_type = genomic DNA
gacctcggtggtactcgcccgtgcgctgggcgca

SEQ ID NO: 27409 - DNA, 30 bp, Homo sapiens
  misc_feature 1..30: note = chr2:106682246-106682276
  misc_feature 1..30: note = hyper
  source 1..30: mol_type = genomic DNA
tgtcctggccctgaccgggctggcgctgct

SEQ ID NO: 27410 - DNA, 322 bp, Homo sapiens
  misc_feature 1..322: note = chr2:107103818-107104140
  misc_feature 1..322: note = hyper
  source 1..322: mol_type = genomic DNA
cacccaccccagccgcgactgtctccgccgagcccccggggccaggtgtcccgggcgcgccccgatgcggccgcggctgtggctcctcctggccgcgcagctgacaggtaaggcggcggcgcgcgggctgcccaaggtctgcgctcccggggcctgagcggggaggtgatacgtggctgtcctggccctggtcctggcagggtgcagcgtcgagcccgcggtggcggggcgcccgggaggcagcttggcaggcagggtccctaagggtggaaataaaatacccccatatcgcattaccccgggggaccggagagcccctgac

SEQ ID NO: 27411 - DNA, 149 bp, Homo sapiens
  misc_feature 1..149: note = chr2:107502581-107502730
  misc_feature 1..149: note = hyper
  source 1..149: mol_type = genomic DNA
cgacaccgtggtgctcggtgctccccctggcagcgcggcactggagtccaaggcgtgcgtgtcacattttattccccggcagccgctcgggtgcgcgcgctacgcgctcccacactcacgctggcgcccgctagagctgggaccctggc

SEQ ID NO: 27412 - DNA, 43 bp, Homo sapiens; identical to SEQ ID NO: 2030
  misc_feature 1..43: note = chr2:107502865-107502908
  misc_feature 1..43: note = hyper
  source 1..43: mol_type = genomic DNA

SEQ ID NO: 27413 - DNA, 241 bp, Homo sapiens
  misc_feature 1..241: note = chr2:107503421-107503662
  misc_feature 1..241: note = hyper
  source 1..241: mol_type = genomic DNA
cgaaggttacctgcacagtacccgcctggcaccgcgcctggacacctccggggcactcgggtcccgggcggcggcaggaatgcaggaatgcgcacaggctgtgggcggccaggagggagtcccggcgcctgccccggcggaagtgagtctttgtgtaccctgtccaacacctccccccgccagcgcggaaggccgggctacctgcgcgcctggcagcgcctggcagccggctgggtggggc

SEQ ID NO: 27414 - DNA, 274 bp, Homo sapiens
  misc_feature 1..274: note = chr2:107503663-107503937
  misc_feature 1..274: note = hyper
  source 1..274: mol_type = genomic DNA
caggggagcgcagcatcctccccggctcgctagctccctttgttcatctcgctcaaccaggctccgcactgccgcctggccctcgctcccagagcttctctaaggatatgggatggacttgggagcgggccacctttcatttgggaagggtagctcgccaagtccggtgacggtgctccctggagacccccacctgcccgcccctccacactgccggtccccaaccccaagagggacggaaagttcttggggtagaagccggcgggacaagtgg

SEQ ID NO: 27415 - DNA, 30 bp, Homo sapiens
  misc_feature 1..30: note = chr2:108602866-108602896
  misc_feature 1..30: note = hyper
  source 1..30: mol_type = genomic DNA
agcgtccctagcacacgccctagcaccact

SEQ ID NO: 27416 - DNA, 114 bp, Homo sapiens
  misc_feature 1..114: note = chr2:108603211-108603325
  misc_feature 1..114: note = hyper
  source 1..114: mol_type = genomic DNA
cactccaggtaggagcggagcgggcattcctgcgcctacgggcccgcaccctcggaaacgccttgggcaccgagcccgggcggttttagaggggagggacgcggcgtttttccc

SEQ ID NO: 27417 - DNA, 234 bp, Homo sapiens
  misc_feature 1..234: note = chr2:109648039-109648273
  misc_feature 1..234: note = hyper
  source 1..234: mol_type = genomic DNA
gtgcggcgaggagggcgcagtgaagttctgctgtgtgcaccccctgcagctcggccgggaagcgcccgctggaggaacggagagcgccgcttcagcgtcggccacgtgggccgggctctgccggtggcaacctggacgcgctgcgggcgccggcgagacctgcgccaacgcctacctccgggccacaggcgggataaagctgccccactttgcccccagcgaagagaaccctcc

SEQ ID NO: 27418 - DNA, 30 bp, Homo sapiens; identical to SEQ ID NO: 6319
  misc_feature 1..30: note = chr2:109744973-109745003
  misc_feature 1..30: note = hyper
  source 1..30: mol_type = genomic DNA

SEQ ID NO: 27419 - DNA, 1154 bp, Homo sapiens
  misc_feature 1..1154: note = chr2:109745234-109746388
  misc_feature 1..1154: note = hyper
  source 1..1154: mol_type = genomic DNA
aggctcacgaaaagccgaaaaagactcggacgcttggaggaggcagggccaagcctgcgcaggagaggttccccggagccctggagatgtcctaggggaccaggctaatcgccggcttgcgcccaagcgaagggaagtcctgcaggcacggcgcctccttccctgagccccgcagtgaccgtgacctccgcgcgcacccccgcgcacgtgctcgcggccgaggaagaggaacggtcctgctgaatcctctggaggacagcgactagcgagcaggccaggggcgcatggaggtgccgcgggggcggtgcggctcgccagctgcgcggaggagcgtgcacgccgcgccccggcctccccggggacctggccggccgctgcccgcacttcctgccgctggtctcccaggcgcgagccgccgcttgcagcacagaacccgttgagcttcgtgcccggcagcacccccggtcccccgcgcggggcggacttgcggcgggacaggtgtagcccgcagccgcaggcgctgcgctcaggactgggcgggctcggctggccggtccccgccacgcaggccggtccccgccacgcaggccggtcggtgagccacttcgcaccgccacagccctagcatcgggccaccagccggggtgaagaaagtcacggcggagcccggctccccagtcctgatgctggctgccggtggcgggctccacgccggccccgggacctaggcagccgcgcgagaccgctgcgggcgcctcccccatgctgctcggagcgtcctggctgtgcgcatccaaggcggccgccgctgctgcgcagagcgagggcgacgaggacaggccaggcgagcgacggcggcgtcgggcggcggccaccgccgcgggggcgggcgaggacatggacgagtcgtcgctgctggacctgctggagtgctccgtgtgtctggagcgcctggacaccacggccaaggtgctgccatgccaacacactttctgccgccgctgcctggagagcatcgtgtgctcgcgccacgagctgcgctgccccgagtgccgcatcctggtgggctgcggcgtggacgaactgcccgccaacatcttgctggtgcgactgctggacggcatccgtcagcggccccgcgcgggcaccagccc

SEQ ID NO: 27420 - DNA, 39 bp, Homo sapiens
  misc_feature 1..39: note = chr2:109746462-109746501
  misc_feature 1..39: note = hyper
  source 1..39: mol_type = genomic DNA
cggcaggcagcaccccgggttccccggttttcctctccg

SEQ ID NO: 27421 - DNA, 69 bp, Homo sapiens
  misc_feature 1..69: note = chr2:110371731-110371800
  misc_feature 1..69: note = hyper
  source 1..69: mol_type = genomic DNA
tgcaggcgggaactgcggagcagtgattgcggccctcgcgaggccggaagtgggcgggccttgaggcga

SEQ ID NO: 27422 - DNA, 119 bp, Homo sapiens
  misc_feature 1..119: note = chr2:111490570-111490689
  misc_feature 1..119: note = hyper
  source 1..119: mol_type = genomic DNA
ggtgccctctcctcccgagctccctcccccacgaagagtcgggtgcagggctgggccccgcggtgacaggcgcggtgtctacgaagaccgtgtggctggaagatcggccttgctggttt

SEQ ID NO: 27423 - DNA, 30 bp, Homo sapiens; identical to SEQ ID NO: 6325
  misc_feature 1..30: note = chr2:111875387-111875417
  misc_feature 1..30: note = hyper
  source 1..30: mol_type = genomic DNA

SEQ ID NO: 27424 - DNA, 493 bp, Homo sapiens
  misc_feature 1..493: note = chr2:112656599-112657092
  misc_feature 1..493: note = hyper
  source 1..493: mol_type = genomic DNA
gcatcgtggtgaagccgggtcggggtcggcgttgcaggctcccctcttcaccgcagaggaggaaatcgagctcggccgggcgcgctgcaagtcctgaagttccgacgagtggaacgtaggtagcaggtctggtctgggatgcgacgagaactttccactagagttgcatggtggggccccgctctggccggagtcccgggggccacagatccggtctcccgagggaccggcgcggggcgaacgaacgggctgcgggagtcggagccgcagtccgggagccgcgatagactgaggccgagcgacgggccagggggggacggcagtcctggctgctcccaatgggcccttacgggcattattagtatccctttttaggggcacccagagagtgtgggaaaaggggagcgttcttttcactcctgttatggcagaacagaacttacagtgctcggcagcgtttacgtttatctggattcagcgaagtgttgttaca

SEQ ID NO: 27425 - DNA, 53 bp, Homo sapiens
  misc_feature 1..53: note = chr2:113190973-113191026
  misc_feature 1..53: note = hyper
  source 1..53: mol_type = genomic DNA
ggtgagacccagcaccgaggcgacgtaccgctccacatcggccttgctgcgcc

SEQ ID NO: 27426 - DNA, 248 bp, Homo sapiens
  misc_feature 1..248: note = chr2:114256940-114257188
  misc_feature 1..248: note = hyper
  source 1..248: mol_type = genomic DNA
agacgaggtggaagacgaggaggaggaggcgagccagaagttcctagagcagtcgctccagccggggctgcaggtggcccggtggggcggggttgcgcttccccgagagcacatcgagggcggcggcccgagcgacccctcagagtttggcaccgagttcagggcaccgccaaggtctgcggcggcctctgaagatgcccggcagccggcaaagcccccctactcgtacatcgcgctcatcaccatgg

SEQ ID NO: 27427 - DNA, 478 bp, Homo sapiens
  misc_feature 1..478: note = chr2:114260999-114261477
  misc_feature 1..478: note = hyper
  source 1..478: mol_type = genomic DNA
tcctcccggcctctgcgccaccgcccccggtgcaggacgcgctttgctctcgccgagacccagacgcgctgaaagcctcgcgcgggcagttccccgccccacgccccgggctgcgcgttctcccgcaaagcctctgccgagtgcgcgcaacggcgccgccggactccccgggaccgcgctcccgcgcacgcctgaccggagcaccccgcttcacgggggcgttctgcgcgtccttcctccccggtgcgatttccattctttttcctctcgcggtccccaggagcccaggcacccctcgactccccgggactccctgcgggcccgaagccgccttcccgaggcggcggagttgggcagctccgggccccgcgccgccccgcagagccggagtttctctccggagtctggatacagctctccgcttcgtcgccgcgcactggaccccggtagcgtggagcctgcccgggaagctgggctg

SEQ ID NO: 27428 - DNA, 171 bp, Homo sapiens
  misc_feature 1..171: note = chr2:115918722-115918893
  misc_feature 1..171: note = hyper
  source 1..171: mol_type = genomic DNA
aatctgggctggattcggaaggcgcagctacaggacgcccgctgccccggatcggaaggcgcagcacctcaggccacaatctcagacacgccctcgggtcccgacaggtgttgcccgcctcccacggggctccgggaccccggtccccgggctgccccctgccttctgggg

SEQ ID NO: 27429 - DNA, 88 bp, Homo sapiens; identical to SEQ ID NO: 6332
  misc_feature 1..88: note = chr2:115919337-115919425
  misc_feature 1..88: note = hyper
  source 1..88: mol_type = genomic DNA

SEQ ID NO: 27430 - DNA, 30 bp, Homo sapiens
  misc_feature 1..30: note = chr2:115919853-115919883
  misc_feature 1..30: note = hyper
  source 1..30: mol_type = genomic DNA
aggctgaaggtgccccggggaaccccggcg

SEQ ID NO: 27431 - DNA, 468 bp, Homo sapiens
  misc_feature 1..468: note = chr2:115920144-115920612
  misc_feature 1..468: note = hyper
  source 1..468: mol_type = genomic DNA
agtgtcccagacatccgtagtctgctgagcggaacggagcttggggagcggcgaggcattaacgattaagtggagccgggaaggcgctggctttggtgatgtgttgggtttggatgtgtcgcgtctgcacagatgaggtgccctgcgtgggctgagggttattcctgtctctttcccgtccgtctacacccgccaacccctttttgttttggtctttagaaatctgtagcataaccgtaccgtcgtggatccccatctcgtctctgtccctgatctggggtgattgggacttcggtgtcgctctttttccaaagttggagggtcgggagcgccgagacaccctggcgaggaggaggaggaggaggagggaggctgcgctgagccgggtgcaggtgcgctcacgtttgcatcaattaggaactccgggcagagagagctgcacttaggtcagggattaactgtggaccc

SEQ ID NO: 27432 - DNA, 57 bp, Homo sapiens
  misc_feature 1..57: note = chr2:115920613-115920670
  misc_feature 1..57: note = hyper
  source 1..57: mol_type = genomic DNA
cgggacccaagcgctggggtaggaggactggggatctttgttcggagtgcgctgcga

SEQ ID NO: 27433 - DNA, 706 bp, Homo sapiens
  misc_feature 1..706: note = chr2:118981151-118981857
  misc_feature 1..706: note = hyper
  source 1..706: mol_type = genomic DNA
ttgcttaaaatcttccgggcttattgtgaagccaagggcgcttggcatgggaagagagccgctcgtgatttatttgggagagggatggggttttggaaaggaaattggggggtttacaaggaggacgggtgggttttactcaacaacttattcttgggcgttttcgtggactggagaggagtttcgatcccgtctcgggctcacctgggaagccccctcctggcgcccgctttgtttggcgttcctttaaagcccggtgttggcagagcgacccacaatgaaacaaattctcattttatgacgtctttccccccgtaggagtccgaacaatgtctgggggcttggcacgcatgaagataaaagaattttattttaaatgcgatacatgtcaggattagacagcgtttcctttcagctaaactacagagcgaatcttcatttcctgtttcactgcttcccccgaaagaaacttttctttttctttttctttttctttttttttcttttctttctctcccccagcagagagtccgagagaaaagtgctgggcacagagctccccacgaggtccccggaaagcagacttagctcctgatcgttgtcaatctttgggcaacccggggcctcgcaacggctcgggtttagtgtgatctggggaggctgcagcccagttccggctaccgtgggcgcctgagcagagccgggg

SEQ ID NO: 27434 - DNA, 203 bp, Homo sapiens; identical to SEQ ID NO: 196
  misc_feature 1..203: note = chr2:118981945-118982148
  misc_feature 1..203: note = hyper
  source 1..203: mol_type = genomic DNA

SEQ ID NO: 27435 - DNA, 269 bp, Homo sapiens
  misc_feature 1..269: note = chr2:118982253-118982522
  misc_feature 1..269: note = hyper
  source 1..269: mol_type = genomic DNA
cggaggagccgggcgagaaagcccgaaaagggaggcggttatttacgaccggcgggttggagtctggcaccagatggtgggggtctgtcaggcccggccgccccgcccagcgccccgcaaacagcgcccggttggcagcgtcgcctgagcagcccccatcttcgcttccagcccctcccgtatattttctcccgtccaagtcgatcaaagacggactttaaaaattactcgcaattagacccaaaaaagtcattcgtgatctttgggta

SEQ ID NO: 27436 - DNA, 478 bp, Homo sapiens
  misc_feature 1..478: note = chr2:119067648-119068126
  misc_feature 1..478: note = hyper
  source 1..478: mol_type = genomic DNA
ccacttgtggcactccgaaggcagcggagaagtctataaactacttccattaaaatgcaaatcgggcccgctgagaaaacaagtgacacaaaaagtgggcgccgcgcggccgccgcccgcgatggcgccgatggctgatgccgcgattacgccggcgggggcggcccgcgcgccacgaacgtgcccgacaagccgcgccgcttaatttctgaagagatttatattttttttgttgtcaggaaatgaacaaatacttatcaatgtaaaaactgctatctccgatctccccgccgggtttttcatactgatattctttgcaccccgtaacacaggaaatgaaaatcttctccgcctctcacgtcgccgctgcgccttcaaatcctctgcgagcagactggcctccccccaccggccccctcccgggctcccctccccggtaaacagaaaagaaaacttctgtgggcgaaggagggagaaa

SEQ ID NO: 27437 - DNA, 245 bp, Homo sapiens
  misc_feature 1..245: note = chr2:119532083-119532328
  misc_feature 1..245: note = hyper
  source 1..245: mol_type = genomic DNA
tgaaagcctcagtagcggacccggccgggaaaggcggagccgacagctgtcgcggggcggggcttccagggccgggaggtggaaggcggagagcggcgagggctccggctccggacccagccgagcgcgcagcgtgaagcggagaacgccgggttagcgccaggctgaatcctcgctctgactcctattgcggtgggatgtggtctctgagtctccgtttaccgattttacggaatggaacttat

SEQ ID NO: 27438 - DNA, 101 bp, Homo sapiens
  misc_feature 1..101: note = chr2:119566171-119566272
  misc_feature 1..101: note = hyper
  source 1..101: mol_type = genomic DNA
tcgcagcaaagggcccgggctgggtgttgccgagcggtcctcggctccccggtggaccatgcccctccagaggtctggcccagcgtcgctctgctctgcaa

SEQ ID NO: 27439 - DNA, 608 bp, Homo sapiens
  misc_feature 1..608: note = chr2:119590773-119591381
  misc_feature 1..608: note = hyper
  source 1..608: mol_type = genomic DNA
gatatggtacatggggctcctggctctccctgtgtaatgtgccccaagttcccctggattccactgaaaatagggagtggaagggtgggtttggagtgaggataaccaggatcgtcacactcacataagcacagaacctcagggatcttcagggctgacaccctgaacgcccaccactttccctagcccccagtgtctcagctctccaggcggggcctctgaggctagaccgctgtctcgcccagggatgctcgcggactgcggcactagcgaacgcgcaattcccttccccagggaagccacgcaggggctttccccgacggcgtctcacagccaagtgagcttgtgaacacggagacggccgaggatccgagacaaggagctcgctcgctcggtttttcccgggctgtgtttgccattcgcgggaataaatgaagcatcggtaatctccataaaagagctttcacgcttcattctctgaaactaagttgaggcttagacggaaaggagaaaagagacttttaatttaaagtaatgatcatcaacactcaggtgctagagggtctctggggaaagggggtccctaccccacccggggtagcgggagg

SEQ ID NO: 27440 - DNA, 15 bp, Homo sapiens
  misc_feature 1..15: note = chr2:119591658-119591673
  misc_feature 1..15: note = hyper
  source 1..15: mol_type = genomic DNA
cgccgcccgggaccc

SEQ ID NO: 27441 - DNA, 300 bp, Homo sapiens
  misc_feature 1..300: note = chr2:119592997-119593297
  misc_feature 1..300: note = hyper
  source 1..300: mol_type = genomic DNA
gtgactggagagcagcgggggacagcgtggcctcacccaaggtcagcgctggtccccacgtgtcggccgggggaggggaggggagcggacagtcggagcgttcggatgtccagttgagccgcggcgcggggcagccgggggcgcaaagttggaggcagggctgggcgacgaggagagagggagggccgggagccgaagggacgcccgggtgcaccccgctgcagaggccgagtccgagcggccggagaaggctggtcgcagaagggcggcctccggtgcaaaaaacggaaaccttggagc

SEQ ID NO: 27442 - DNA, 428 bp, Homo sapiens
  misc_feature 1..428: note = chr2:119593535-119593963
  misc_feature 1..428: note = hyper
  source 1..428: mol_type = genomic DNA
gcaggacctgcgccccgcggtgggcaagaagatttggggtttcgcagttcctggggtcgggggcgggggtgaagtgccctcagagacctcggcggagccccagttgcgctcccatctccagcccccactggagagagggggtccagggccgtaccctcctgcggcctgggctgcgctgaccggaagtgcctgtaagaagcgccctccgcggaccgtgccgggcgcgggcagctccagccgggttggagcaaggccaagacgcccggatggggcgggccgtttcggcggacccagtctggacgcaggtgcgggaggaaagtgtgaggggggaaactgctgattgtgcggggataggggcatcttaatctgggaaaagatcggaatctcttgggacgctaatctgagacccgggtcggaggtgtagagta

SEQ ID NO: 27443 - DNA, 30 bp, Homo sapiens
  misc_feature 1..30: note = chr2:119594194-119594224
  misc_feature 1..30: note = hyper
  source 1..30: mol_type = genomic DNA
cagtatagacttcaacgtgatttggtgaga

SEQ ID NO: 27444 - DNA, 30 bp, Homo sapiens
  misc_feature 1..30: note = chr2:119594750-119594780
  misc_feature 1..30: note = hyper
  source 1..30: mol_type = genomic DNA
ctcacaggaggctcccgcccctctgcgctg

SEQ ID NO: 27445 - DNA, 969 bp, Homo sapiens
  misc_feature 1..969: note = chr2:119599895-119600864
  misc_feature 1..969: note = hyper
  source 1..969: mol_type = genomic DNA
ccgacagaagggacccgggaggtgggggagaagaggtgggcagacacgaaaggaaacacactctcgcacacaaagaaaagtcccagagaaaccagggccggcgatgcgggtcgggaggcaccggagaagcaatgacattcaaatgaaaaaggcaacgaaaacgaaactgggcgggggcagcgaggcggtgggggaggggataaaataattataataattataataattataacaataataataaaggagattaataaaaatgtccagcaaatagagatcgctacacgtatgtgttttccttacctgaaattaaatatatacaaggtcgtaagcggtttggctagatagagctttaaggagttcgcagtttcgtcccttatactgggaatagagaatggatcttatttttcgatagcacctgtccgagtctttctcccttttcaaaaatgctgcgtttcaacgtcattgtccattctgaggctctctttctgtctctctcgctcttttccctgcgctccctccctccttggagcagatgctttctcccccagcgaggggccgggagacgacggcggcggtgccgggagggggcgcgggcgcggccccggcctgtggcggctactcgctctcgtctttgtcctggaccgtggtggtggagtggttgtacagtccctgggccatgaggtgcagcgccaggccgttcttgatgcctgtggctttcttgatcttggcgcgcttgttctggaaccagatcttgatctgggactcgttgaggctgagttcctgggccagggtctgccgccgctgctccgtgatgtagcggtttgcctggaactccgccttgagtctctgcagctgctcggccgtgaacgcggtccgcggccgcttgtcctccttctcgttcttcttcttcttcagcttcctggtgcgcggacctgcagcggcggagagggccggggtggggtgggg

SEQ ID NO: 27446 - DNA, 29 bp, Homo sapiens
  misc_feature 1..29: note = chr2:119602601-119602630
  misc_feature 1..29: note = hyper
  source 1..29: mol_type = genomic DNA
ctcttgtaataaaatcgttcctagtctcc

SEQ ID NO: 27447 - DNA, 283 bp, Homo sapiens
  misc_feature 1..283: note = chr2:119602828-119603111
  misc_feature 1..283: note = hyper
  source 1..283: mol_type = genomic DNA
cgtggctacgttgttcccggccccctgccggaccgggtgtctggagtgctgatcttgggccaaagcttctgccgctctcccagacactgcgggccggggcgtcaggcaggccttggccttctctcccggagcccagctcaggtctcctcctcgggttcgccaagcgcgaggggcacacggaaaagtggtggaaggaaagccgagaaaaacaggcctacggatgccagaagtctgctggatgtgcgggtgaaaaaaggaaagcgccgcgcggggaggatgcggg

SEQ ID NO: 27448 - DNA, 30 bp, Homo sapiens
  misc_feature 1..30: note = chr2:119603388-119603418
  misc_feature 1..30: note = hyper
  source 1..30: mol_type = genomic DNA
ctccgcagaaaatatcgagatggtgtttgt

SEQ ID NO: 27449 - DNA, 277 bp, Homo sapiens
  misc_feature 1..277: note = chr2:119603817-119604094
  misc_feature 1..277: note = hyper
  source 1..277: mol_type = genomic DNA
cttggcgttctggggcggtccgcggggccagaaggcatggcgcagcccggagttgggtactcaccggaggatggacgatccgaataacgtgtgcagtacacccaggcgggccatacgagaggctgctgcgagtcagttttgaccacgggcccgccgttggctgagcccataagtaggatagccgggttgccgtgctccgggtatttggtgccctgcgctccggggctccccgcgccgcctccactgccgccgccaccggtgtccgagggcttggctg

SEQ ID NO: 27450 - DNA, 526 bp, Homo sapiens
  misc_feature 1..526: note = chr2:119604154-119604680
  misc_feature 1..526: note = hyper
  source 1..526: mol_type = genomic DNA
tcccagctttagacgcgcccgcgccggcggcggctggctgggagccgtcgggtgggccacagttcgcgtccggggcgcacaggagcgaggcagcgcctggcgcccgggtgcccaacgggtggacagggtctctacctgcggcagtctggcctctgtcacgctcgacccggcctcctcctcctgcgcctcctctggccgccgcagccaccagaagctgcggtggcggctgctcctttttgcagccgaagtccggcctcaggatgttgtcgatgaaaaagttggtggtgcggtgcagctgggccgctggctgcggctggtgagcaggcgccgcgagatgctgaggcggcgggggcggggggtgtggggggaggtgcgggtggtgggccaggggcggcaggcaaggcgccgcgggcggcgaggggggcgcaggctgcggggacaccggcacgctgtctccatcgctgccgctgccgctgctgccgctggcgcccggactgaggctcaggctgaggccgcccggagtcgc

SEQ ID NO: 27451 - DNA, 162 bp, Homo sapiens; identical to SEQ ID NO: 6349
  misc_feature 1..162: note = chr2:119604689-119604851
  misc_feature 1..162: note = hyper
  source 1..162: mol_type = genomic DNA

SEQ ID NO: 27452 - DNA, 30 bp, Homo sapiens
  misc_feature 1..30: note = chr2:119605356-119605386
  misc_feature 1..30: note = hyper
  source 1..30: mol_type = genomic DNA
ttgcacaaactctctcgcttaaaaaaaaaa

SEQ ID NO: 27453 - DNA, 30 bp, Homo sapiens
  misc_feature 1..30: note = chr2:119605745-119605775
  misc_feature 1..30: note = hyper
  source 1..30: mol_type = genomic DNA
tgggtctgtgagctacgggagcaggggcag

SEQ ID NO: 27454 - DNA, 159 bp, Homo sapiens
  misc_feature 1..159: note = chr2:119606783-119606942
  misc_feature 1..159: note = hyper
  source 1..159: mol_type = genomic DNA
atcttagagctccagcggacctcctcgccctgaacgccctccgcaactgggacagtagagaaaggatccctttggaaatattgtctatttgtgacatgcgaaagaatccccctacctccagttttccagaaaagtcacagagggttaggctaggaggaa

SEQ ID NO: 27455 - DNA, 182 bp, Homo sapiens; identical to SEQ ID NO: 2039
  misc_feature 1..182: note = chr2:119607442-119607624
  misc_feature 1..182: note = hyper
  source 1..182: mol_type = genomic DNA

SEQ ID NO: 27456 - DNA, 15 bp, Homo sapiens
  misc_feature 1..15: note = chr2:119607847-119607862
  misc_feature 1..15: note = hyper
  source 1..15: mol_type = genomic DNA
cgtccccccacctcc

SEQ ID NO: 27457 - DNA, 139 bp, Homo sapiens
  misc_feature 1..139: note = chr2:119610236-119610375
  misc_feature 1..139: note = hyper
  source 1..139: mol_type = genomic DNA
ctcctcttgactccccgcgggaaacggtggaaagatatcaatgatttctgtacattgcacccggtggccaggattcagaaagcgctcctggggccctggtttcctctctgagccccgccggctgtccacaggcccgcgc

SEQ ID NO: 27458 - DNA, 79 bp, Homo sapiens
  misc_feature 1..79: note = chr2:119610540-119610619
  misc_feature 1..79: note = hyper
  source 1..79: mol_type = genomic DNA
cgctgggactgtatcacacagccagacaggcctctggagctgagaattttagacttcgctgctccgggaagcaagagga

SEQ ID NO: 27459 - DNA, 39 bp, Homo sapiens
  misc_feature 1..39: note = chr2:119610901-119610940
  misc_feature 1..39: note = hyper
  source 1..39: mol_type = genomic DNA
tggtccccacctgtccgagtggccgctctcgcctggatc

SEQ ID NO: 27460 - DNA, 183 bp, Homo sapiens
  misc_feature 1..183: note = chr2:119611566-119611749
  misc_feature 1..183: note = hyper
  source 1..183: mol_type = genomic DNA
ctgtctcccccaccccgcccacctccttcctcgtattgaatcggatgcggggggcgggagggggtcactgcaatgccaaggccttctcgggccatcttccctgttcccctgctccagcagaaagctgggaggggaacgagtgtgtagccccgcgcgtgcgtgtttgttcgtgactcagaggct

SEQ ID NO: 27461 - DNA, 59 bp, Homo sapiens
  misc_feature 1..59: note = chr2:119612755-119612814
  misc_feature 1..59: note = hyper
  source 1..59: mol_type = genomic DNA
aagccattccaggcacgtccctcccctcccgcgccgatgactcccgccccaaaattgtt

SEQ ID NO: 27462 - DNA, 738 bp, Homo sapiens
  misc_feature 1..738: note = chr2:119613153-119613891
  misc_feature 1..738: note = hyper
  source 1..738: mol_type = genomic DNA
cttgtcctctgcacccggcgcgcagcggccccttaaacagtggaaccgtgaggccgctctaagccgaagggctggaatctgggtttctcgggttttattttagaccattcggcaccaagcccgagctcccccgccgcaccgcttccagtcccctttctttccatagagcgacccgaagccggcggtggcgcagggagccgagtctgatgagctcgcgggcggctgaaggccggcttccctgtggggaacgcgccacctgtcggcgccagtgagaactgcgtctgtgtggcgccctcggggtattcggggctgcggggagatgtgtgcctgaagccctgcgcttgcggtggggacgtccggcctctttcctggcaattgacccctgaggcgggagagacaacggaattcccacaaagggatccttctcgggatctccccacctcaagacagctaaagctggaggaaaagcccctccggggggtggggggtgcgggtttgccctgcgattccgaaagcagaaaatacccgagccacacagggacgggcgccgcgttggtagtcggggctacgttcctactccctctacctcccccgcgctgtgtgaccctgggcggaaccccgctgctctctgggcctcagtgttcttattcgtaaactgagggcgttggatgagattggtcctctcccaactctgaccttgaaactgatactgaatctgagcagcgtctgtagacacct

SEQ ID NO: 27463 - DNA, 41 bp, Homo sapiens
  misc_feature 1..41: note = chr2:119614130-119614171
  misc_feature 1..41: note = hyper
  source 1..41: mol_type = genomic DNA
ggagagcacccatgtcgtgggtccagcgaggacacaaggag

SEQ ID NO: 27464 - DNA, 976 bp, Homo sapiens
  misc_feature 1..976: note = chr2:119614602-119615578
  misc_feature 1..976: note = hyper
  source 1..976: mol_type = genomic DNA
cgggaagccccggaacggtcctcgccagacatagccggctgtcctggtccttagcttcaggctggcggcgcaaggccagagcggctgccttctaggcacctgggtggaggtctcgcatagcattccctgagaagcgaaactgcccttggggccgcagcgagcctgccacatcgaactggagaccctctgctttcgggatagatgggacgtttctgctctgtccttcttggagtcccggaatcgttctggggccgcgtgctgcctggaggcggtgaatttcagggtcttgagaagccgcgcacacacgggattctgggcgagcgtcccgtctcttaattcctattaagagacgggaaaatcgagggactggaggtcccatcattgtcgcgtgagcagcctcctgaacaccaagcgagacctgagggttccgctggggcctcgccctgacacccgggccctccgtgtggtcgagagtttgcgcccgctcccgctagggcagcgaggtcccacttgcggccggctggggcatggtggcaccggttgtctactccccacttgtgacaccgacagcttccaactcctcagacccaccccgtggaattctggactttgtgagggccgccggggtcctggccctggggtcagctgccatctgactaagccaggacggcggagctccaggccttgctccagcactgccggtgcgtcggggcccgcggagagcccagggcgggagctgtgggctgagccgggtggccgcgtggacacagatgcccggccggactgagcggcagccaagactctccgtccatcccgccgctggactcgactctcccagacccgccacggaacccagatttgagcacgcaagataaagacgccagaggcgagtgcgcggcggagaactggccgcgacacgggaagcttctggggcgcagaacgctggctccgactcgcgcggcgcagaccagcttct

SEQ ID NO: 27465 - DNA, 577 bp, Homo sapiens
  misc_feature 1..577: note = chr2:119615975-119616552
  misc_feature 1..577: note = hyper
  source 1..577: mol_type = genomic DNA
catgcccataccaagcgggaaacgaagcaccgaatatttccccagctcgtaggaagccagatgggggccagttccctcaggagacgctccaagtcgccctgcgggctccaggtggggacaggagttataaccttccctgcccttccccctgcaacacacgcgaggtctcagcgctcccaggcgctccagtggggccgcgttccccgccagggtgggtcaggggaatactctgcctgcgccctctccgagggtccgcgcagagcgagcgcctctttaggtggggcctctggctccgacccctgctcccaacagggatcttcgtttgcatcacccagaggagctggccagagagccgcgccggaggccgcatctccccttgttggtattgttgtcggcttgctttcttctggcttcccagctcagtgaccccggaaagggtcgagcatccgactccggcatgctggttggctgcccccggaggcggaggtagggggccagaaatgctgacctgggcaggcccccagccctgagctcctggggtggacatctcagggtcccgggcctccaagctcatggc

SEQ ID NO: 27466 - DNA, 150 bp, Homo sapiens; identical to SEQ ID NO: 6359
  misc_feature 1..150: note = chr2:119769161-119769311
  misc_feature 1..150: note = hyper
  source 1..150: mol_type = genomic DNA

SEQ ID NO: 27467 - DNA, 40 bp, Homo sapiens
  misc_feature 1..40: note = chr2:119914013-119914053
  misc_feature 1..40: note = hyper
  source 1..40: mol_type = genomic DNA
tccctggccagggcccggagccctccgcttctaggcactg

SEQ ID NO: 27468 - DNA, 370 bp, Homo sapiens
  misc_feature 1..370: note = chr2:119914529-119914899
  misc_feature 1..370: note = hyper
  source 1..370: mol_type = genomic DNA
cgtcctgtgcaatggcgctggcccggacctggggacaagcggtgggagcaggtgagccggggcacctcttcccgcgcctttgctcagcccacaccaggcgcgccactcacgggcctcccgcctgctgcttcagggtccacactcccaccccagctccatgttctctctccaacttagtcaactccttccaggtcccccctcctcctcgcgccgacgagtctgggaaatagggagaggggaagcttcatgaacactgacccagagtggaagggtgggagccaggggccagggccaagaggaaaggaggctgcagggcaagggggcgacctggagagaactaaagaactgaggtttccgagaagcccacgga

SEQ ID NO: 27469 - DNA, 456 bp, Homo sapiens
  misc_feature 1..456: note = chr2:119915151-119915607
  misc_feature 1..456: note = hyper
  source 1..456: mol_type = genomic DNA
ggtcactgacctgcccgttcttgcagaggtccgcccacatgctggtgccgtcgccgccgcgcatgaggatgtggtaggtgaagaagtagatgccgcgtacctggcagctgaacttgcccgtggtggggtcatagtgattgccgaggttggtgaccacgtcatcgaacttcagcacctcatagccttcgtgggggctcttgagacccacatagaaggcgatcttggggccgctgaaggtggcgctcagcgcactggtcacttcaccctcggaatcgccacctaccccggccccgccgcccaccaccccgacgccgctggccgtgcccgccgtcagttgcagccctggcagcccgggccgccccgagtcgcccttctctcccggagggcccctgggtccaggcgggcccggctctccagggggcccccgcggccctggcttgcccggtcgccccgggt

SEQ ID NO: 27470 - DNA, 50 bp, Homo sapiens
  misc_feature 1..50: note = chr2:119916524-119916574
  misc_feature 1..50: note = hyper
  source 1..50: mol_type = genomic DNA
cggctcccaggagccacaagtgggcgcagcgggcgcggtcccaagccggg

SEQ ID NO: 27471 - DNA, 337 bp, Homo sapiens
  misc_feature 1..337: note = chr2:120190015-120190352
  misc_feature 1..337: note = hyper
  source 1..337: mol_type = genomic DNA
gtggacttgctgagtcgcgcggacacctcagggaaaggctctggcgagggaagaagcccgtgtctccgaagatttggcttctccttagcgtagtgcacgatgtttatgttggctaagaacctacacattcctacccgctccctcgggcctgctgctccccaaagggaagtcagtgggtggcggtaccgctgcccagcgggcgaacttcctttccgcgcaactcgcccgctgcagagtctatccgctggactgtctccaggattagagaggcccgttgacttcgtgtacaaacgctcagccacaacactgacctagtagacaccgttctgcccattgt

SEQ ID NO: 27472 - DNA, 150 bp, Homo sapiens
  misc_feature 1..150: note = chr2:120281663-120281813
  misc_feature 1..150: note = hyper
  source 1..150: mol_type = genomic DNA
aggccggagaaagggcgagactgtcgctccctcgggtccccagcctgcagaagggcgcagtactcaccgagtgcgcggcgcaggcgagcagcaccggcagtagtagctgctgcagcggcggcgacaggtggggacgcatggtgcccgcac

SEQ ID NO: 27473 - DNA, 87 bp, Homo sapiens
  misc_feature 1..87: note = chr2:120281814-120281901
  misc_feature 1..87: note = hyper
  source 1..87: mol_type = genomic DNA
ttccccgagggcgccccgacgtccgcctgcccgtgccctctgcccgctcgggagctcagcgccccgcgcagggtcccgggctccggc

SEQ ID NO: 27474 - DNA, 36 bp, Homo sapiens
  misc_feature 1..36: note = chr2:121103048-121103084
  misc_feature 1..36: note = hyper
  source 1..36: mol_type = genomic DNA
ccgcggccgagggctcggcgccgcctgtgagcgggc

SEQ ID NO: 27475 - DNA, 47 bp, Homo sapiens
  misc_feature 1..47: note = chr2:121103883-121103930
  misc_feature 1..47: note = hyper
  source 1..47: mol_type = genomic DNA
gccacccccgccacccggatccccgggtggctcgcaggacacctgta

SEQ ID NO: 27476 - DNA, 394 bp, Homo sapiens
  misc_feature 1..394: note = chr2:121104242-121104636
  misc_feature 1..394: note = hyper
  source 1..394: mol_type = genomic DNA
gtccccgctcgctcccgctctccctctccttgctagctccggctgccaccgccgccaccgcagcccgcgcgccctggggcagcctggactcccggcagagctccttcggccgtggccctgcgcgctccgcccgggttgcagtcctcttcccccaggccgcagacccttgcctgctgcctcaaccccccgccgccgatcgcctggccctccacccctgctctccggaatcgggccccagcgcctctgggcgcgcgtccccctcccggcagatgcgcgcggccctggctctgcgggcacttgcttggtgattgcttaatgtttttgtttcccacgatcggagtgtaggcttagcagtgtggatggagatgtgtgtgcttgttgatatacgtgggcc

SEQ ID NO: 27477 - DNA, 514 bp, Homo sapiens
  misc_feature 1..514: note = chr2:121104696-121105210
  misc_feature 1..514: note = hyper
  source 1..514: mol_type = genomic DNA
gagaggcccctggggccgcttccatcaccggcggcgtgggcttgccaggattgctgaagcctcgctggggagagctaggcaacctctcttccgattgtgtgggcaccggaatcgggcggaaggcaggcttctcaacaggtccatcatttacacagagaaagccgcggttcggggacagccccgtgcctctcggcttgcctggcagctgcagcagacccctcgcccgagaggcagagtcgtagttaacaaagggtatggctcctttctggaatccgcccccccccccggccccagattgcaaatctctaacactgtctaaatataaaaatcagggagagaaaaatctttcggaactttaaaagaaggagaaaaatgtgcccgcgccaaaatgctgcaagtgctttcgactccgctgtccttttcaggacttgaatgagccaggctggcttttgtgcctggagctcggccccatttgtgccgaggggactgcggagaaggtcgcagagggggaagc

SEQ ID NO: 27478 - DNA, 46 bp, Homo sapiens
  misc_feature 1..46: note = chr2:121200039-121200085
  misc_feature 1..46: note = hyper
  source 1..46: mol_type = genomic DNA
aggctgatatcatcccgcacaaatgttcctccgagaggaaggcttc

SEQ ID NO: 27479 - DNA, 30 bp, Homo sapiens
  misc_feature 1..30: note = chr2:121200390-121200420
  misc_feature 1..30: note = hyper
  source 1..30: mol_type = genomic DNA
ggccatgcacgtcgtcgtcatcccatttcg

SEQ ID NO: 27480 - DNA, 180 bp, Homo sapiens
  misc_feature 1..180: note = chr2:121344837-121345017
  misc_feature 1..180: note = hyper
  source 1..180: mol_type = genomic DNA
aaggcctgtcctctgcgaggcttcaggcgcctggaggcagggtgggagggcagggcgcgggggctttgtctgcgcggaaacgccctgcccggcgcccgcacaaaggccgctttgtgcccgcggccggcggaggtgggggccgcgcgtccccggatccccctgccccggcccggcccgcgg

SEQ ID NO: 27481 - DNA, 36 bp, Homo sapiens
  misc_feature 1..36: note = chr2:121412155-121412191
  misc_feature 1..36: note = hyper
  source 1..36: mol_type = genomic DNA
gggcctgggcgaggccgggggcggaatgggctgagt

SEQ ID NO: 27482 - DNA, 498 bp, Homo sapiens
  misc_feature 1..498: note = chr2:121493449-121493947
  misc_feature 1..498: note = hyper
  source 1..498: mol_type = genomic DNA
ggattgcagaagtgccggcgcttgccagccgaggcagcacggctccgcggactttttttcaaactcccatcaatgagacttcgaggaggagcgggcggcggcggcggctgcgactgcgaacgcggaggaaggccaggagccgcaggaggagccggaggaaagagcttgggccgcgcggcgcgccgcagcctcggggagccgcctgctcgccggcggtaggggctgcgcggcgcccgcccgcctctcggtcccctctcttgcctggcccgccccgccccggctggctggagccccggcacaaggcagccagccgagggtcgccgcgccagccaaggtgggatgggggcccacagccaccgcccggcgcccgagaggccacctgcgtgctagaggcaaacttttgtctctctcggtaaagttgcattggccttcttttgcttgcttttcgtgacgaagcgcctcccacctcggccaagcgcgggccgactgggatgctgc

SEQ ID NO: 27483 - DNA, 88 bp, Homo sapiens
  misc_feature 1..88: note = chr2:121494156-121494244
  misc_feature 1..88: note = hyper
  source 1..88: mol_type = genomic DNA
tctcggggtgcacagcgagccggcctccgcgcgccggcgggggtctgttttttcagggggtggagggtgggatcggaggctgggatgc

SEQ ID NO: 27484 - DNA, 30 bp, Homo sapiens
  misc_feature 1..30: note = chr2:121494978-121495008
  misc_feature 1..30: note = hyper
  source 1..30: mol_type = genomic DNA
gacctcgagcccccccgagggtgcctcttt

SEQ ID NO: 27485 - DNA, 44 bp, Homo sapiens
  misc_feature 1..44: note = chr2:122042116-122042160
  misc_feature 1..44: note = hyper
  source 1..44: mol_type = genomic DNA
ctgcccctccgagcccgccgcccgcccctcgtccaaggaagggc

SEQ ID NO: 27486 - DNA, 30 bp, Homo sapiens
  misc_feature 1..30: note = chr2:122042918-122042948
  misc_feature 1..30: note = hyper
  source 1..30: mol_type = genomic DNA
gagcgagcgcgcctccggggcggccagacc

SEQ ID NO: 27487 - DNA, 1072 bp, Homo sapiens
  misc_feature 1..1072: note = chr2:124782333-124783405
  misc_feature 1..1072: note = hyper
  source 1..1072: mol_type = genomic DNA
ctgcaagcaggggagcgcgcacaacgttaaaccttgaaaccagaaatcccgatcctatcgagacccatcagcttttcccatttgggaacgagcgcaggggaaattaaatgcgtaattcaagctctgttttcccctcccctccaaaggtgaggtgggggaacgcgtctcgttagctcattacaaagctttccgtgggaaattccctcttcctaatgcgtctgtcttgcaactcctattagcatccttcgacagcggcctttgaaaatctcctttaaatttcaatacctctactcgtttcccaaatggggggaagggaagagaaagccggggggtagagagaatttccttcccctttccctcccaggtagccaaagcgcaccgcagcggcttggcttcctggaggaaaagcgcccgagcggggcaaagacccgcccaggctgctcttataggcgagcgcggggcgggcctggctgggggcggtgccgcgcggccccgctcgcctataaggagctgtccgccacccgggtgctgattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactgtgagtacgaggagctgggggcgggaaggtgaggtggaaaacgatcgcattcagaaagacaatcaactatctaagcgtactcgattgtgtctgctt

SEQ ID NO: 27488 - DNA, 30 bp, Homo sapiens
  misc_feature 1..30: note = chr2:127534517-127534547
  misc_feature 1..30: note = hyper
  source 1..30: mol_type = genomic DNA
cgccacatctccacccgcccccagccgtgt

SEQ ID NO: 27489 - DNA, 39 bp, Homo sapiens
  misc_feature 1..39: note = chr2:127534774-127534813
  misc_feature 1..39: note = hyper
  source 1..39: mol_type = genomic DNA
ccgcggaggcttccccgagtcctgcgccttcctagagag

SEQ ID NO: 27490 - DNA, 121 bp, Homo sapiens
  misc_feature 1..121: note = chr2:127643980-127644101
  misc_feature 1..121: note = hyper
  source 1..121: mol_type = genomic DNA
acccagagccccaaacgcaccctcgcggcgcttcagcggggtgggcgtggtctggtcgacccggtggtgccgccccacagcgccccctcgcgtgcgccagccagctcggcctcagctcccc

SEQ ID NO: 27491 - DNA, 125 bp, Homo sapiens; identical to SEQ ID NO: 2044
  misc_feature 1..125: note = chr2:127783043-127783168
  misc_feature 1..125: note = hyper
  source 1..125: mol_type = genomic DNA

SEQ ID NO: 27492 - DNA, 412 bp, Homo sapiens; identical to SEQ ID NO: 2045
  misc_feature 1..412: note = chr2:127783169-127783581
  misc_feature 1..412: note = hyper
  source 1..412: mol_type = genomic DNA

SEQ ID NO: 27493 - DNA, 390 bp, Homo sapiens
  misc_feature 1..390: note = chr2:127863488-127863878
  misc_feature 1..390: note = hyper
  source 1..390: mol_type = genomic DNA
ggcgtcagcagctggcgtgatccaattcaataaaccagaggtggcttgggatagacaactgaccgggtgcagacccccgcccctcaatctctgcatttcctgcacgctctgggcaccctgggaggccccggctccatcccccattccagctctccgcgaggaggggtcgggtttcctgtggcgccttccacgcgcctcctccaggccagctccccacccggccgtgggctcccaaagccagtgccgccacccgctccccggccgccggaaacgctaagcccctgctggggcgagggcacctccttgcggggtgcgtagccctgggctcccggtggggccgggctgggcgggagcttccaggccgcaggcacctctcgggaaaggaaaccc

SEQ ID NO: 27494 - DNA, 452 bp, Homo sapiens
  misc_feature 1..452: note = chr2:127976374-127976826
  misc_feature 1..452: note = hyper
  source 1..452: mol_type = genomic DNA
ccagaaataacagtgcgtgctgggccgggcacccggggaggcggacgatgggcgaaggcatcggagggcgccgccgcggctcgggtgcagtgcccctgccacgaagggcgcaacggaggtgggcgtgggaaggacagcactcaggctccaagtgggaagcgtgcggaattcgccggccccaacgccctagcgggtggctgggacccctgggttcctcccacgtccctgcctccagtcccggcgcgaactccaggtgtcgcccccaactccggcttagagcctacggcaccccgagcctccgagcctccgtcccctcttcccccgccattacaaaatacaaaaaggactagaaatgaatacacacggtctcggccacctaaggacaccgagctccgcagagcctagaggagctagggaacctagcgctcccctcgggccggccccaggcagca

SEQ ID NO: 27495 - DNA, 38 bp, Homo sapiens
  misc_feature 1..38: note = chr2:128421812-128421850
  misc_feature 1..38: note = hyper
  source 1..38: mol_type = genomic DNA
ggcctgccctgccgccgcagctttccggccattgtccc

SEQ ID NO: 27496 - DNA, 81 bp, Homo sapiens
  misc_feature 1..81: note = chr2:128421890-128421971
  misc_feature 1..81: note = hyper
  source 1..81: mol_type = genomic DNA
cggcgggctctgccggtgctggcgccgccggtacagccccgacgcggccagcgcacccagccgggccgccatggcgcgggg

SEQ ID NO: 27497 - DNA, 78 bp, Homo sapiens
  misc_feature 1..78: note = chr2:128432415-128432493
  misc_feature 1..78: note = hyper
  source 1..78: mol_type = genomic DNA
gggggacccctgccccgacgggcgctgccgccccggcagctgcgagaatccgacgcgccagggcggagcggggatcgt

SEQ ID NO: 27498 - DNA, 434 bp, Homo sapiens
  misc_feature 1..434: note = chr2:128433069-128433503
  misc_feature 1..434: note = hyper
  source 1..434: mol_type = genomic DNA
aagtccttcccaacccgggctctgctcgccacctcctggattccgggcatagctttccttttaaagggagtaaagttataataaacgcgaacaagcacccccacccccacagccccgccgggacgccccgcccggcgccccctctgcagtccctgggccgccccaaccgcaaacgcgtgcaggagatggtaggcgtgggggcgatgctgagaccacctccctcccgggctttcctagcccggagttcccaccgcggatctgggcactgactccctcccgaggcacccgggaccgccgagtccacgcagtcccgcccccagggaggctaaagccgagaggcgtccctcttcagtcgcaaagctgctttccccgggaaattccgatttcatcccccgttgcgggccatcgccctaacttggcgaaagatatttctt

SEQ ID NO: 27499 - DNA, 15 bp, Homo sapiens
  misc_feature 1..15: note = chr2:130737190-130737205
  misc_feature 1..15: note = hyper
  source 1..15: mol_type = genomic DNA
aaaactgtgttgagg

SEQ ID NO: 27500 - DNA, 182 bp, Homo sapiens
  misc_feature 1..182: note = chr2:130737475-130737657
  misc_feature 1..182: note = hyper
  source 1..182: mol_type = genomic DNA
tactctgccgggaggcggcggcggctgccagtctgtggcgagccctgctgccctccagccgggctcctccagccgggctcctccaccggcccttgcaggggcgcagagagctcggcgcccgcccttccgctcgcctttttcgtcagccggctggaggagcatcggtccgggaggtctctggg

SEQ ID NO: 27501 - DNA, 193 bp, Homo sapiens
  misc_feature 1..193: note = chr2:130763484-130763677
  misc_feature 1..193: note = hyper
  source 1..193: mol_type = genomic DNA
gcagtcccagcgctccgaacgacggtgcctccggttgacagcaacctgagcggacccgcgcctaggccctccgccaggcctgcgctgcctcgccccgggagaggaagactgagcccggctcaggcggctggagcgcgcgggcccgtttcctttcagcgatcagtcccctggcgtcccagcagcgccttccccg

SEQ ID NO: 27502 - DNA, 104 bp, Homo sapiens
  misc_feature 1..104: note = chr2:130763729-130763833
  misc_feature 1..104: note = hyper
  source 1..104: mol_type = genomic DNA
cggcccagacgtgcccgcggacgccgctgacagcgcctgtgccatggggctgcctactctggagttcagcgattcctacttggacagcccggatttcagggagc

SEQ ID NO: 27503 - DNA, 51 bp, Homo sapiens
  misc_feature 1..51: note = chr2:130970991-130971042
  misc_feature 1..51: note = hyper
  source 1..51: mol_type = genomic DNA
gcacgtcttgcccaccgccccgtcgccgaccaccacgcacttgagcatcag

SEQ ID NO: 27504 - DNA, 242 bp, Homo sapiens
  misc_feature 1..242: note = chr2:130971062-130971304
  misc_feature 1..242: note = hyper
  source 1..242: mol_type = genomic DNA
cgctgctgcccgccggcctccgggcatggtccccccggagcccccgccccggtccccgggctcagccccagcccgcctggggagtccgccgccgtcgccgccgctctgcgccgcaggccgccccccgaccggccccatccagcggctcccctcgccggaggggagggggcggcgggcccggggcgctgccgccgcggcggtcgccgccaggatccccgccccggccccggtcgctgcgcctg

SEQ ID NO: 27505 - DNA, 759 bp, Homo sapiens
  misc_feature 1..759: note = chr2:131484847-131485606
  misc_feature 1..759: note = hyper
  source 1..759: mol_type = genomic DNA
taagaccccaaaggccggcgagggtcgttgtgctgggctggacagcagagagaggctcggccttggccctcagccctgcagcacacagggcacccgcgcagagagcgtggcctgcgaatggctctgctgcctctcccggcctggggccgattagaccggtcagagcatctgtaaagtacaaggggcccctagggagtgcaggccagggcagctggggcagggaggcggggtccgccccatggcatcgcggtttctctggaaggggtgatgggctttctcagaaccacctttagtttctgtaccgtaatcggccaaaaaggcgcaggcgctgctgctcctggcagctgcgtaacaggctctcagaggaggacgcggttccgggctgcggcgggcgtggtccggggctgttctgggcgtggtctttggctgtgatgggcgtggccttgggctatggagggcgtggtcccagggctgcgatgatggtggtccggggctgtggtgggcgtggccccgggctgcggcgggcgtggtccccgggctgcggcggacgtggtcaggggcggttctgggcgtggtccctgggctgcggtggacgtggtctcgggctgtgacgagcatggtccctgggcagcagtggacgtggtctcacacccagagtctgaaatttctgcctcttcctggccctaaaaatatcctgcctgttcccacgcggctcctgccttctggagcagtctgccaggccggcggtgggtgttgggc

SEQ ID NO: 27506 - DNA, 479 bp, Homo sapiens
  misc_feature 1..479: note = chr2:131513547-131514026
  misc_feature 1..479: note = hyper
  source 1..479: mol_type = genomic DNA
tgcacctgagggaggcgcagccgcaaccgggtgggaggcagagacacccagaaacagagacggggcgatacgaacagacaaagccggctcgagcgcggcccgagcggcggcgcagggaggcggcagcctggcggagcagcccccaccgcggccggcgcgccccctcgccacccctgcgcgccagcgccggcccgcccctcccgctggcctctggcggcttaaccctcgcctgcccgaccccgcggggcccctggagccgcggtgggtgggtgcgggcgccgggcctccccctcccggccgcggcgcgcggcgccgggagctgaccgtggtgctgagcgcggctcgcgctccgacgcggtgcccgagcctgtcgcggccgcgccctgctgcactgcgggcccccagcggtaagtcgccaaggccccgagaggctgcgttggtcctgccccgcggatgtggacccccggggagggcaagga

SEQ ID NO: 27507 - DNA, 150 bp, Homo sapiens
  misc_feature 1..150: note = chr2:131594772-131594922
  misc_feature 1..150: note = hyper
  source 1..150: mol_type = genomic DNA
ggaaggacggggctccgttgggggcggtagggacggcggcccggggcgagcccctgagagggcaagggcgagcgcctgagccggcctccccgcacctggaccgtcctgggcgcgcggggcactcggagccgctgcctggaccggcctggg

SEQ ID NO: 27508 - DNA, 280 bp, Homo sapiens
  misc_feature 1..280: note = chr2:131594947-131595227
  misc_feature 1..280: note = hyper
  source 1..280: mol_type = genomic DNA
cgcttggcgcagtaccagctgttttgggaaggagggctggtgccggcccggtgggtacgggagaagtggttgctgttgttattccccaggctgagagtacgcgagggcgcagcagcggcaaggggctggaactggggtcggggctgttgggctcctgctcggggtgccccctctctggcccgatttccgggcccgctcaccatccgggacccactcagttgggacgcctccacctcgctgcccccacaggaaccccaagatgggccgggggctccggggc

SEQ ID NO: 27509 - DNA, 313 bp, Homo sapiens
  misc_feature 1..313: note = chr2:131720786-131721099
  misc_feature 1..313: note = hyper
  source 1..313: mol_type = genomic DNA
cggccccttaatcaccacagggtgtgtcctgcccgggctgtcaggagggtcgcaggcgcccggtggtccacgctcaccgtgcgcctggctgagcgcagatgagggtcgtgtcccgtctgagcgcgctccccccgccggcgcgcacgcctgcccgccgggtctctgccctgggccgagcggggccacctgcttgcgtcctcgccctggatggcgtgggaggcgccgccaaccgtctgagctggaatccttgcggtgaaaaagtgggcgcccaccagccctcctcaccaccgcggctgcgacgagcctgggcgtc

SEQ ID NO: 27510 - DNA, 148 bp, Homo sapiens
  misc_feature 1..148: note = chr2:131721437-131721585
  misc_feature 1..148: note = hyper
  source 1..148: mol_type = genomic DNA
cggctgagagcctccttaacggagccccatgatgtcagccggcccgcacgcccctcgccctccgactgcgaccccggcccgggctcgcgcgccccgtcccccggcagccccgcggccgccgcaccgccgcccccggcccagccttccc

SEQ ID NO: 27511 - DNA, 83 bp, Homo sapiens; identical to SEQ ID NO: 2049
  misc_feature 1..83: note = chr2:131721866-131721949
  misc_feature 1..83: note = hyper
  source 1..83: mol_type = genomic DNA

SEQ ID NO: 27512 - DNA, 55 bp, Homo sapiens
  misc_feature 1..55: note = chr2:131722233-131722288
  misc_feature 1..55: note = hyper
  source 1..55: mol_type = genomic DNA
aggatggaagggggccgctggccgagggtggaacggattgcgccacctggctgtg

SEQ ID NO: 27513 - DNA, 298 bp, Homo sapiens
  misc_feature 1..298: note = chr2:131792222-131792520
  misc_feature 1..298: note = hyper
  source 1..298: mol_type = genomic DNA
catccctccccaaagcgccggtgccaggcgttttggcctctgtatctctgaaacgaggaggtcccggggcatccccgagcgcccccgtggccatctgtgccactggccagcccagggccaggactgctgtgccggcgtggagattcccgaccctttccaaggaggtgccaagggcgcagcgcagcgcacgcccgagccgccgcggtccctctgagcctctccagcccgccgccgccgccgcccccgcccgcacagccggcttggttgccagggttgccagggcttggggcctgggagg

SEQ ID NO: 27514 - DNA, 216 bp, Homo sapiens
  misc_feature 1..216: note = chr2:131792531-131792747
  misc_feature 1..216: note = hyper
  source 1..216: mol_type = genomic DNA
cggcgccggcttcgcgggaggagccccaggcccgcgagcgcaggcgccccgcctctccccgggcgctgcgggccaccggctcggccctgtgcggcgggatctcggggccgcacggagcgggaggccgggcgccatggcgagggccccgcagccccggcgcggccccgcggcgcccgggaacgccctgcgcgccctgctgcgctgcaacctgccccc

SEQ ID NO: 27515 - DNA, 164 bp, Homo sapiens
  misc_feature 1..164: note = chr2:131792920-131793084
  misc_feature 1..164: note = hyper
  source 1..164: mol_type = genomic DNA
cggagggaaggcctccttccaccccatgtgctcactaccagggcctggtccgggggtgtcgccgagcgggtgcctgaggggcgtggtggcacgtgtgtcacagggtccttctgtcctctgtgccctgtggggagtgggggctgcgggggcgaggggggaggcca

SEQ ID NO: 27516 - DNA, 49 bp, Homo sapiens
  misc_feature 1..49: note = chr2:132088590-132088639
  misc_feature 1..49: note = hyper
  source 1..49: mol_type = genomic DNA
tcctgacactgcaagcgctccctgaaatccgggctgtccaagtaggaat

SEQ ID NO: 27517 - DNA, 71 bp, Homo sapiens
  misc_feature 1..71: note = chr2:132088785-132088856
  misc_feature 1..71: note = hyper
  source 1..71: mol_type = genomic DNA
cgccaggggactgatcgctgaaaggaaacgggcccgcgcgctgcagccacctgagccgggctcagtcttcc

SEQ ID NO: 27518 - DNA, 207 bp, Homo sapiens
  misc_feature 1..207: note = chr2:132121322-132121529
  misc_feature 1..207: note = hyper
  source 1..207: mol_type = genomic DNA
agcccagagacctcccggaccgatgctgctccagccggctgacgaaaaaggcgagcggaagggcgggcgccgagctctctgcgcccctgcaagggccggtggaggagcccggctggagggcagcaggactctccacagactggcagccgccgccgcctcccggcagagtagccgagcaccgagcgaggcccgcggctgggaagggaa

SEQ ID NO: 27519 - DNA, 292 bp, Homo sapiens
  misc_feature 1..292: note = chr2:132152232-132152524
  misc_feature 1..292: note = hyper
  source 1..292: mol_type = genomic DNA
ggtgcggccctgacccgaaagcggggcaggggtgcggaggacaggatctccgatgtccctgctccgcgggcgcccgcagtgctgagccgaagctcggcggggctgagctccagctgggggcgggtagctgacagcctctaggcccgggctccctccagaggcagcgttgcaccctgaccctaacttccgcctgcggcgttcagatgcggaaagcagggagcctgaacccaaagctgcgatcagagaatcgtgtgtgtgaagggtttcttgtgtcctccgtgttcccctgtgg

SEQ ID NO: 27520 - DNA, 502 bp, Homo sapiens
  misc_feature 1..502: note = chr2:132182751-132183253
  misc_feature 1..502: note = hyper
  source 1..502: mol_type = genomic DNA
ggcgggcgcgggaggcgggcgcgggaggcgggcgcgggaggcgggcgcgggaggcgggcgctggctcggggggcgcgtgagagaagccgccgcgcccggcctcgctcagacgctcagacgcccgcgcctcggcccgcctcgctccccgagccgccgccgccgccgccgcctgccgaggccccctacgccgtgcccctggcagcgagaactcatccaccggggtgtccccgcagcgagcggccgctgaaggctccccgcgcccgctcctcgccgccgcctgacacggctcccgggcgccctcggccctgtccgcgcccaccgcccggctggcgcgcagacccggttccccgcccgcccggcaaccctgtgatgaagttttcacatacgttcatttcattgaaacaaaagtcttgtaggcaccattggcaggggcaagaaacaagcacacaggttatttgcagaagaccacagaactggcaaatgacagcgccaggattcaatt

SEQ ID NO: 27521 - DNA, 282 bp, Homo sapiens
  misc_feature 1..282: note = chr2:132767348-132767630
  misc_feature 1..282: note = hyper
  source 1..282: mol_type = genomic DNA
ggcaaaaagcctaggcggagggggcaaaaagccgcggcggcgggggcaaaaaggagcgggggcaaaaaccccacaaaaacccgcggcgacggggggaaaaaaccgcggcggcaaaaagcctcagcggcaggagcaaaaagccgccgcagtggggataaaaagctgcggtggaaaaaacccgtggcggcaggggcaaaaagccgtggcttcgggggcaaaaagccacagcagcaaaaaccctcagcggcgggggcaaaaagctgtaaaaagccgcggcggcgg

SEQ ID NO: 27522 - DNA, 180 bp, Homo sapiens
  misc_feature 1..180: note = chr2:132767750-132767930
  misc_feature 1..180: note = hyper
  source 1..180: mol_type = genomic DNA
agcggtgacgaaaagccacaggggcgggggcaaaaagccgcaaaaagccccgacggcgggtcaaagagccgcaaaaagccccagcgtcgggggcaaaaagccgcggctgccggggcaaaaagcagcggaggcaaaaacccgcggcggtggctgcaaaaagcagcggcggcaaaaagccgg

SEQ ID NO: 27523 - DNA, 120 bp, Homo sapiens
  misc_feature 1..120: note = chr2:132795879-132795999
  misc_feature 1..120: note = hyper
  source 1..120: mol_type = genomic DNA
gggagcgggggcaaaaaaccacagaaagccgaggcggcgaggggaaagagccgcggcggcagggggcaaaaagctgcaaaaagcagcggcggcaaaaagccgcggcggcgggggcaaaaa

SEQ ID NO: 27524 - DNA, 120 bp, Homo sapiens
  misc_feature 1..120: note = chr2:132796059-132796179
  misc_feature 1..120: note = hyper
  source 1..120: mol_type = genomic DNA
ccgcggcggcggggacaaaaagctagggcggcaaaaagccgcgctaacgggggtaaaaagccgcggcgacaaaaagccgctgagagggggcaaaaagcagcgggagcgggggcaaaacac

SEQ ID NO: 27525 - DNA, 180 bp, Homo sapiens
  misc_feature 1..180: note = chr2:133015303-133015483
  misc_feature 1..180: note = hyper
  source 1..180: mol_type = genomic DNA
agggacgcctggggaagggagggggcctgcggtaccaggaaaaatctgcgtgcggcaaccttgagccttcgcggtctgggcagggggcctggccgctgcgcgtgcgcgcaatccccgaagggccccctagtccaccagcctcctttctcccaggcaaagcacctccaagtaaacccacac

SEQ ID NO: 27526 - DNA, 156 bp, Homo sapiens
  misc_feature 1..156: note = chr2:133015543-133015699
  misc_feature 1..156: note = hyper
  source 1..156: mol_type = genomic DNA
ccccagcccaccgcaatagctcacacggcccgtgcgcagccgccagaggggagcacgggacctgcgctcgccagatcaggcggcacccttccccgcgtgggaggggcgcgtctcactcaaccgcctcgacccccacaccaacgagctccctcagga

SEQ ID NO: 27527 - DNA, 124 bp, Homo sapiens
  misc_feature 1..124: note = chr2:133062361-133062485
  misc_feature 1..124: note = hyper
  source 1..124: mol_type = genomic DNA
cgcaagctaggggcgacattgtttggaatgctgggttgagtcccggctggaccgcgcccctctcggaagtgtagccaggagtaggggtgtaggatgtgcagctgtgacccgtccctgtggactg

SEQ ID NO: 27528 - DNA, 144 bp, Homo sapiens
  misc_feature 1..144: note = chr2:133426223-133426367
  misc_feature 1..144: note = hyper
  source 1..144: mol_type = genomic DNA
ccactcctgggtctccgggtagggctggatgtggctgacaccggcagggggcggcgcgggtacctagggtcctacggaagaaagtggaatagtgcccgccacccctggaccccggctctagacacaaagcgcccatccattacc

SEQ ID NO: 27529 - DNA, 152 bp, Homo sapiens
  misc_feature 1..152: note = chr2:133427110-133427262
  misc_feature 1..152: note = hyper
  source 1..152: mol_type = genomic DNA
caacttggcagggttcgggagatgtcgccccctctccctcgcccagaacccagcaccgctcggaccctccctcctctcaagcccagcttctcccgacggtgcagccggacaagctgcagcccggagtcccgcaaacccgccgctccccgctc

SEQ ID NO: 27530 - DNA, 166 bp, Homo sapiens
  misc_feature 1..166: note = chr2:133427471-133427637
  misc_feature 1..166: note = hyper
  source 1..166: mol_type = genomic DNA
cgcaaaaagttgccgcgatgcctaggacccacattctcccggagtcccggggccgggagagggcaagcgcatcagaggaggcgacagcagcggaggctgccccggctgcagcggctgtggctgccgaggctgctggggcccgcgctgctgccgcggagacgacggt

SEQ ID NO: 27531 - DNA, 221 bp, Homo sapiens
  misc_feature 1..221: note = chr2:133427885-133428106
  misc_feature 1..221: note = hyper
  source 1..221: mol_type = genomic DNA
gaaggctgggacggtcgcttcacatccccacccccttcctgtcttcctcttctcccgcctccgcacgttcctgggaaaggggcgccggggggcgggagagaactggtagttttctgagatggggaggttgggggagcggcgaggagggcgcagcaggtgccgtggggacctgccgggtgcggactagggtctgaggactgcgtgcccggctggcccttcgc

SEQ ID NO: 27532 - DNA, 39 bp, Homo sapiens
  misc_feature 1..39: note = chr2:135475588-135475627
  misc_feature 1..39: note = hyper
  source 1..39: mol_type = genomic DNA
tgaagggtctgcagacgcgccctccggaaacatcaggtt

SEQ ID NO: 27533 - DNA, 506 bp, Homo sapiens
  misc_feature 1..506: note = chr2:135475865-135476371
  misc_feature 1..506: note = hyper
  source 1..506: mol_type = genomic DNA
gttctcccaggcagccggcggagccgcaggggactacggaaaggaggatgcaacgagcctgggtccctccgagctgagtagggcccggagtggcccagaagcgctcgactccgaacgcaaaaaatgcctcccgcaaacttttcccgtgggcgccggagggcctggagctggcggagaggagggcgcgagtccaggcggggtcggcctgaaggcagctggggtctgggcttcgagggaaggaaccgcagccgaggcggtgccggccgcagaaggtggggctgccgctctcggctagcggcgttctcgccgggaagtcggggctccgcgcccccgcgcgctccgagccccgcgcctcgcccagcgcggcccgcgagtggggagaggcgggccccgagcagccaccccggtcgccggccgggtcgggcagctcgcgctcacctcggtcctccagcccgtcgctgaactggccgctctcgctgatccgcacctgccgctcctcctccagc

SEQ ID NO: 27534 - DNA, 183 bp, Homo sapiens
  misc_feature 1..183: note = chr2:135476823-135477006
  misc_feature 1..183: note = hyper
  source 1..183: mol_type = genomic DNA
agagggaggaaccagcgtgaggacccacaggcggccctggcagagcttggctagggcgtagcggggacccgccccacctgcgccgcgggatggtgcccagaggggacccctcccactggattcctctggggtccgcgaagcccgcggccgcgcgtgggtagcagacagcgcccctaatttggc

SEQ ID NO: 27535 - DNA, 148 bp, Homo sapiens
  misc_feature 1..148: note = chr2:136875889-136876037
  misc_feature 1..148: note = hyper
  source 1..148: mol_type = genomic DNA
ctgtttgcgggtggtcggtagtgagtccggagccggacaggacctcccagaggcatttcctaagtttgagggaagcgggatgcgcctgaagacaggtgggaagcgcgggctaggaacgcgtctctctgtggcgcgtccatccttgcta

SEQ ID NO: 27536 - DNA, 654 bp, Homo sapiens
  misc_feature 1..654: note = chr2:136876374-136877028
  misc_feature 1..654: note = hyper
  source 1..654: mol_type = genomic DNA
tagcggtaaccaattcgcgaatagtgctttattatcctaaaagtatgctttattataagagtaatttagcgaccagtactttttgtaacagatcactaggaacttgcacagaatcactcattcattctcacaacaccgtgtgggtattaccatcacagagatgcatttagtccgatatttatagaaggacgaactgcgtgccacgcactgttctaggcgttggggatccagcgtgaaccagacaaggcccgcattcggagaaaccagcaaataagcccggagagatgaaatgccagggatgggcagggattccaagccgggcttgaacccaggtcttcggtccccatactcggcgtcttccacgattttgagcagaggacaagctttggcacgaatcagaaattaggttgaagaactgggcggggcggagtgggggtgggggtcagacgtttaaagcgatctcagactggctgaggtttgcagtgggcgcgcagacagtgctttccccctcgcgccacttccctccggcgcggagactgggtggggcgggggagcgagtgtggggcggggccgagaaactgcgtccgcaggcggggtggccgctgcggagatagctgggaccgaggcgcgtgcgtcgcgacacggaccccagag

SEQ ID NO: 27537 - DNA, 409 bp, Homo sapiens
  misc_feature 1..409: note = chr2:137522341-137522750
  misc_feature 1..409: note = hyper
  source 1..409: mol_type = genomic DNA
gcacccagctcccggcgtttcccggagtcaccacaatgtttccctttctctctcccccacgtatgctgctaggggtactccccagataggattttctttgtcttttctcctagtaacaccgaagccctctcgtgcccggggactgcagaggaacgccagaccatccggaccttgcgggatggctcggtgtgtgtgttttactgtgtgtcggagtgtcgcgcatgtgtgcgtgttggggcgcgttatcaacaggggcctagggcacccccactctttcttgctctcttcccccatcacttcatggacctccgaggcgcaaagcgctcgaccctctcctgggctcagtggcttgggtactccgggctgagctcagctggggagtccccttacccagcccgcaccggcaccc

SEQ ID NO: 27538 - DNA, 34 bp, Homo sapiens
  misc_feature 1..34: note = chr2:137522848-137522882
  misc_feature 1..34: note = hyper
  source 1..34: mol_type = genomic DNA
cgagggtcgtgcgggtgcgcggcagaggcggtag

SEQ ID NO: 27539 - DNA, 29 bp, Homo sapiens
  misc_feature 1..29: note = chr2:137523364-137523393
  misc_feature 1..29: note = hyper
  source 1..29: mol_type = genomic DNA
actttgctctttcctcgccggacagccat

SEQ ID NO: 27540 - DNA, 78 bp, Homo sapiens
  misc_feature 1..78: note = chr2:137523516-137523594
  misc_feature 1..78: note = hyper
  source 1..78: mol_type = genomic DNA
cggggacgccccacgcggcgacctgagcaccgacctcatgcaacgggaccgaaccttgggacccgggcagcaggagct

SEQ ID NO: 27541 - DNA, 886 bp, Homo sapiens
  misc_feature 1..886: note = chr2:139536937-139537823
  misc_feature 1..886: note = hyper
  source 1..886: mol_type = genomic DNA
catatagaacataggcgtatatcaggaggaggagagcgtggcgcctcgcgggaagagagaagagagtgacaacgcgaaccccaaaccacattttaatacgtttcttattcctcagcgcctccgagccacccagaccaggcgggcggtctccctgaaaagacagcttcgagatgcccgagagggggctcctgcgcggagctgggcatgaaagttatatcttgtgtccccagctggcagaaagccccatcccagtccctagcgccagacggaaaacgaagagaaatccaagctgtcccccaaatccgtattttgcctaagttttctcccagcaaggcgccactacctggctctgagaacgaggatgcatgcactatgctgtgctttgggagaagtgtctgtgtgcatctgggcaaaacaccacgtgaaaaataaacaccaccaagcctctcaaactgtgaacaggaggaaggtctttctgccccttctcatcctatcaatttactttccttcctctccttgaccgcttatcaataaaccgcttccttctcccggacctacttcccggccaccttctgcctactttaccccagcgctcaagtcccaacccgtgctaagcccctgagtcgcctgtagatcccgtctattccgttcttcaattcttccctttcgacctctaaggcaacccaaaactccttgccctccgcgcgcccccaaccccacttcccaagcaggcccaggctgggctccaagtcagccgcctgcgcggttttcccgccgaaacgcgtccccggcgtgtgggacggcgcgcgggccgggcactcaccagctgcagcaagccagggaccaccacgaggggcagcggccgcaggcgcatggtgccggctgg

SEQ ID NO: 27542 - DNA, 307 bp, Homo sapiens
  misc_feature 1..307: note = chr2:139537850-139538157
  misc_feature 1..307: note = hyper
  source 1..307: mol_type = genomic DNA
cgcctgcctctcgcgcatctccacttcgcggggcaggactgaggacgccagggacacagcgcggcgcttccctcccggaatccgagcgctgcgccgtgccgcgcagctctggccgggtgggcgggcagggaagggggagggtgggcggaccggaggtgcctctcccggccccccgcgcgcccctcctcggagggggccggcaaagagcctgcggggcagctcgagctccggcacgcggcggggggcttcagtcgcgccttggactctcccgcttggccgggcttggggtgagcgcgtggggcgcctg

SEQ ID NO: 27543 - DNA, 444 bp, Homo sapiens
  misc_feature 1..444: note = chr2:142888097-142888541
  misc_feature 1..444: note = hyper
  source 1..444: mol_type = genomic DNA
cccggtcccggggagcggagctgcaaggacttaagtttcacactcacttatctgcaagcatcgcccagcaggaaagccaaggaagtcaggggaggggagcggggaggtgttctccttacctcggtcggctcccacggtcagcaccctggcaatcggcaataatcccgagagagtgagtaaggcgaggagaaactcggacattgtggtcgcccggtaaggaagcctgcgctggagactgctcggcggcaccttcggcccggcggcggcggcggcggcaggggccgcttggagcctggaatcgagcggcgtcatttacaaatgtcactggaaattcttcagctcaatgagtccagccagtcagccttctcctgcctggagcaggatgtggaaggtggagggatgcgcgcgtgcgggagagaggaggcagagcgtgtgtgagcgcga

SEQ ID NO: 27544 - DNA, 35 bp, Homo sapiens
  misc_feature 1..35: note = chr2:142889151-142889186
  misc_feature 1..35: note = hyper
  source 1..35: mol_type = genomic DNA
cccaaagtcattaaccgttgcgtaagaagggaagg

SEQ ID NO: 27545 - DNA, 224 bp, Homo sapiens
  misc_feature 1..224: note = chr2:144694291-144694515
  misc_feature 1..224: note = hyper
  source 1..224: mol_type = genomic DNA
aaaggtagtaggcatcggtgtttctggttttgcttagtgcgtcttcatcgtattccctcgctgaggactgagcctggccgactcagggaaccgagttcaatgaaatcctcagacgcataaagcacagggtgccggcccaccgagctgcgctcccttcccgggggtgcccgagagagagcacgcgagcccggcgcagccaaacccgggcaggggtgggtccccac

SEQ ID NO: 27546 - DNA, 704 bp, Homo sapiens; identical to SEQ ID NO: 2056
  misc_feature 1..704: note = chr2:144694553-144695257
  misc_feature 1..704: note = hyper
  source 1..704: mol_type = genomic DNA

SEQ ID NO: 27547 - DNA, 67 bp, Homo sapiens
  misc_feature 1..67: note = chr2:144695258-144695325
  misc_feature 1..67: note = hyper
  source 1..67: mol_type = genomic DNA
tacaccacattttccacgtgtcagctgacggccgcgacaaaaggaaacagaacgctggggggtgggg

SEQ ID NO: 27548 - DNA, 463 bp, Homo sapiens; identical to SEQ ID NO: 201
  misc_feature 1..463: note = chr2:145273327-145273790
  misc_feature 1..463: note = hyper
  source 1..463: mol_type = genomic DNA

SEQ ID NO: 27549 - DNA, 431 bp, Homo sapiens; identical to SEQ ID NO: 2059
  misc_feature 1..431: note = chr2:145274080-145274511
  misc_feature 1..431: note = hyper
  source 1..431: mol_type = genomic DNA

SEQ ID NO: 27550 - DNA, 399 bp, Homo sapiens; identical to SEQ ID NO: 2060
  misc_feature 1..399: note = chr2:145274576-145274975
  misc_feature 1..399: note = hyper
  source 1..399: mol_type = genomic DNA

SEQ ID NO: 27551 - DNA, 641 bp, Homo sapiens
  misc_feature 1..641: note = chr2:145274976-145275617
  misc_feature 1..641: note = hyper
  source 1..641: mol_type = genomic DNA
caggctcgatctagcaaccaaacacagcgacaatgtgggcatcgcccgcgcccattgaaacgcgcgcgggccgcccaggggagccgggccagggccccggcgagcacccatccgcgccccccaacgccaaagcgaaacttcggcggccccctccccgccccccacccccagccttggccccgaggcgctttgtgtttgttactgtttggtgtgttgcacccgcgaggggatcagagagacaagaattacatcttcaaaatgagtcataactcctgaccgtatgagggaatgcacacggcggtacagtaagaccgcttgactcagggctaggcggaccctttccttcgaaaagtcctcagcccccggctcgggaacttggggtgaggcgaggttttcttttcgttctcatcttttctcatccccccaccccccaattcccagaggaaacaaacaaacaaacaacgcgaaacagcccctggatgaagcacactcgggcaaattgataatagtaattataggaagcccactcgcccagcgccccctcccctccccttttggagtttatcgaggcactgtctcttcctccccccaccctcgcccccaaattaagatttcccgttttacgccgcaatgataaatat

SEQ ID NO: 27552 - DNA, 39 bp, Homo sapiens
  misc_feature 1..39: note = chr2:145275852-145275891
  misc_feature 1..39: note = hyper
  source 1..39: mol_type = genomic DNA
tttgtacctaaaaatcgagagaggcgctgcattttttca

SEQ ID NO: 27553 - DNA, 457 bp, Homo sapiens
  misc_feature 1..457: note = chr2:145277493-145277950
  misc_feature 1..457: note = hyper
  source 1..457: mol_type = genomic DNA
aaaaaaacctacctgcgaagtcttgtttgtagttttggccagaaatggtgagaagaaaaagcatgaagaagccgcgaagtgtgggggagaaaaaggtggaagcgaagaaacagctcccggagcaaactgtacaaaaacctcgccaagagtgtcgggaggcaggaccgttattcctgcagagcaggttagaactgatctctttcggccactccaggaaacacaaacctggggacggactgacgtgttacgcctcttctaatgacatttttttctttttcttttctgtaggagagagacgagagaccctgaaacacgcgccacctatctttgtggggagggataattgaagcgccctgagcgtgagcatcatgtgaaaacgtgatcgccaagtttctctctgggaaaggatctgggatagattataccttgaagtctccgcaaacgctttagtggaaga

SEQ ID NO: 27554 - DNA, 740 bp, Homo sapiens
  misc_feature 1..740: note = chr2:145281202-145281942
  misc_feature 1..740: note = hyper
  source 1..740: mol_type = genomic DNA
tctagaggaattattcgaccttgtgttgtgactcaggaggtgggcaacttcttttggagttgcaagcaaagggtgataaaggggacccctggactgggtgtgtgtggaggaggtggggggcggcaggggtccaagccaagccaaacggttttctcacgtgcagactcgcaatccaatccattcggagttgagcctaggataggaggggaaagtctattaaaaaaaaaaaaaatcaggagcatctctctgagaagccctttcaaacaaaaccaaaacaggaccagagaagctcagaccgtccctaacatccctgctgcgagacccgcaggctgtggaatctcgcacgtcacctggccccagcagggcggccagctgaggggttgattttattttatttttttgaagtaaaggctgaatctcggcttcagggcttttgccaacgtctccactgacaggaaccagcaaacttcaggacccaaatgagcatcttaatttattgatgctaaacaggtctggttgttgtccccaattttccgcgcgctctgccactcccccccccacacaccccgccccaacccccgccgccagcttcggtccctgcatttgatctccaggaagggccccgctgcacaggcggaggagcgcgtcgcgggggggggcggtgttcggccccctcccaccagaccgccctcccccagacctgtccccgcccgggatcctgcgacccccgcccgccgccc

SEQ ID NO: 27555 - DNA, 36 bp, Homo sapiens; identical to SEQ ID NO: 6423
  misc_feature 1..36: note = chr2:145281943-145281979
  misc_feature 1..36: note = hyper
  source 1..36: mol_type = genomic DNA

SEQ ID NO: 27556 - DNA, 115 bp, Homo sapiens
  misc_feature 1..115: note = chr2:145282041-145282156
  misc_feature 1..115: note = hyper
  source 1..115: mol_type = genomic DNA
gggaggtgatgccgggggctgattaccatgagaaaggctgtgcctggaaaagcctcctccacgcgactgtcaatctcactaaggcttggggggcggggagcggggggggggacgg

SEQ ID NO: 27557 - DNA, 30 bp, Homo sapiens
  misc_feature 1..30: note = chr2:148601319-148601349
  misc_feature 1..30: note = hyper
  source 1..30: mol_type = genomic DNA
cgtgaatatcctgagcgggtggacagccct

SEQ ID NO: 27558 - DNA, 216 bp, Homo sapiens
  misc_feature 1..216: note = chr2:149632642-149632858
  misc_feature 1..216: note = hyper
  source 1..216: mol_type = genomic DNA
atcctgtccttcccccggcaggtagagtgactacaagtcccgggatgcgcagcgctcggagtcgggcgggggccgggcggacctctacggtgacgtcaccgtcccggggcgggccaggggagggcggggcggaggggcgggtctcaaggcggcagagcgcgctggtgctgatgcaggatggctgagcgcgcaggagcccgggaggtctgagccggg

SEQ ID NO: 27559 - DNA, 1169 bp, Homo sapiens
  misc_feature 1..1169: note = chr2:149632888-149634057
  misc_feature 1..1169: note = hyper
  source 1..1169: mol_type = genomic DNA
cgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcggggtaagtggctggggcgtctgccttccctgctgctccgcgccgcagctgggcgccccgacgccccagacgcagcggaggtgtttaggccgccccctcggacattcccgcggggctggcctctcgggtggacctgaccagagacccctcgccccgcgcactatggttccctcccgggcgggtggagaggcggccgggagcggcgggccgggcgggggtggcgggggtggggatggggggcgaagacgggctcggcgccgccattgttcgccgggtgggggcccgggtgggcccattgttccccacgctcgcctcgccgcgtgggtagtgtgttcgggtgaccctcaagccgggtgcccaggccccctttaaagtgtgagctctgcaacccgcaaatgcttctgggcatcaatcaattcgatttaccaaacgccttgcctcttcttctcacgaccctagcaaaaaagaaagaaaaaggggtacaggaaaatttctagtcgcgtctcggagctcccgcggcagtgtagacgcggctccccgcggtgttacacctggctccgcgcgcggaaggcggagggttgggggagtactggtggcctcggtgtcccctggaggcctggtgtgtctcccgcttcctctcacgcctggctgccctggatgtggagtcccggcttgatccctcccctctgggatgacctccctcccatgtctgcagaccctctgatgcgcctcacgctgggtggagagg

SEQ ID NO: 27560 - DNA, 63 bp, Homo sapiens
  misc_feature 1..63: note = chr2:149645496-149645559
  misc_feature 1..63: note = hyper
  source 1..63: mol_type = genomic DNA
aggctggaccctccccgcccctatcactaccccttacccccgcagcaagggctgcgaccccgc

SEQ ID NO: 27561 - DNA, 334 bp, Homo sapiens
  misc_feature 1..334: note = chr2:149645560-149645894
  misc_feature 1..334: note = hyper
  source 1..334: mol_type = genomic DNA
ggtccccgctgagcaccgcagcaattaagtacgtgcaagccatttgcggcagcgggtttgagatgcgttcgtagtgggtgacattgagaacccccagaggcgacacgggcgcctggtctctgagaggtggcatgctgcctgccgccctggtgcctggctgccccggaaggggcccccagtcgccggccccgggaaggtgctccaggctcgcggctcctcgggggtcgcctctgcaggcggcctgtttccaatttccaggcgaggagcgacgccgtgatgcaaatctgccacttaccttctgtcaccattctgtcgctaacgctaggaatgatga

SEQ ID NO: 27562 - DNA, 30 bp, Homo sapiens
  misc_feature 1..30: note = chr2:151343094-151343124
  misc_feature 1..30: note = hyper
  source 1..30: mol_type = genomic DNA
atcccttgggaggggcgcagacggcttgta

SEQ ID NO: 27563 - DNA, 30 bp, Homo sapiens
  misc_feature 1..30: note = chr2:151343607-151343637
  misc_feature 1..30: note = hyper
  source 1..30: mol_type = genomic DNA
cactttccctttccccgcagtctaatcagg

SEQ ID NO: 27564 - DNA, 411 bp, Homo sapiens
  misc_feature 1..411: note = chr2:152954623-152955034
  misc_feature 1..411: note = hyper
  source 1..411: mol_type = genomic DNA
actaacttcccggggcggtgcggagacgccgggacgcgaagacgtcaagagcccaggctagagggagagggactgagcccgagcaccggccgaggccgggaagagacgcgcgcgggcttgacccgcagctcccgcacgtgtgggccacggccggctccaggacccccgcgccgcgcgctcggcctcctccccatcctggtctcccgcctccttctcatacctgtctgaggatgaagctggtcgaagtggtgctgccatcggatcttttcaacctgctcctccgggttgtggtgcctcgggccacctggactcgacacacgggggccagagagaagccggtgaggaccgcagcgcagagcggggcgaccacccccggctggagtccgcctccggacccgctccctggggtcc

SEQ ID NO: 27565 - DNA, 32 bp, Homo sapiens
  misc_feature 1..32: note = chr2:152956018-152956050
  misc_feature 1..32: note = hyper
  source 1..32: mol_type = genomic DNA
agcagagccaccttccgcgacttcactcatca

SEQ ID NO: 27566 - DNA, 382 bp, Homo sapiens
  misc_feature 1..382: note = chr2:154333349-154333731
  misc_feature 1..382: note = hyper
  source 1..382: mol_type = genomic DNA
gcagctacttttcctcgcattttataattccccttccctccgccccccggccccacccgtgggcagcatcccaaagccgcctggctgacgttggttagggtagagacgccctccctaaaggctgtccaagccgtctcttcctttcattagcggtgtaatcctgtgttcccgccggagcctggcacggaagtgtaatcttcccgcgggggcccttctgtcgtctcgcctacctgagagctgagactaaatgaaatataaaatattcacgataagaggaaacaaaggatgctgcctccaggacggctactgtgcctgaggctgggctccttctcagtcatcccagggcctctccgtctggccccaccctcgcccctccagggga

SEQ ID NO: 27567 - DNA, 399 bp, Homo sapiens
  misc_feature 1..399: note = chr2:154334051-154334450
  misc_feature 1..399: note = hyper
  source 1..399: mol_type = genomic DNA
agaaacaactcaccccgttcaaattcgcaggctccccctccccccaccccttctcccacaatgacaaaactgtaactcctcaggcaggcaaacaggccactggggcagaaaaagacttatcaaacatttgtattcaagcaaacaaacacaaaacctcttaaaacggcacgttacaatcaaaggtatttatcgcccctcccctccagggcagggggggagcaggagaagagtgggagcgcacccggacacggatttgtgagaccccatgagtctgctgcgtggcttttaacaggtcactcttccggtcacaaggcgatcagtgccgctgggtctctcccctgcccgccctctccacctgcccccagagcttggcccacctgcgggtggagaagggccttc

SEQ ID NO: 27568 - DNA, 214 bp, Homo sapiens
  misc_feature 1..214: note = chr2:154334451-154334665
  misc_feature 1..214: note = hyper
  source 1..214: mol_type = genomic DNA
caccgtcggtctccccgcattccaagtaagtagcagcttccaaagttctgcgccctaatcgccctcttcttgccactttctgctgagttcagagtctgggcgctctcctccgactgccaggcatgaggactttcagagggcgagggagaaaccggtcgcttctttccgaaaggccgaagtcgagagaaataattgactccgacaggtttgcttc

SEQ ID NO: 27569 - DNA, 280 bp, Homo sapiens
  misc_feature 1..280: note = chr2:154335184-154335464
  misc_feature 1..280: note = hyper
  source 1..280: mol_type = genomic DNA
gtgcgagggctcctcgctctgctttcgaaagtccctgggccgtgggagtttcccaggagcctctccgacgcgcgcagcagctaggctcttctaaagccgtccgctccagccctggtggtgctcgttcccggcgctcgctcgagggggggctgttggaacttggcggggctggaccagcccggccgtgggaggtgcgggccgcggcggctgcagcggcggggtggctgcgctgagcaaacagcggccccttccggccgcaccgccgcgctgcgcgctgctc

SEQ ID NO: 27570 - DNA, 51 bp, Homo sapiens
  misc_feature 1..51: note = chr2:154727941-154727992
  misc_feature 1..51: note = hyper
  source 1..51: mol_type = genomic DNA
ccccgcagcatctctcggctggagagccgacggcaagggtggggttgccgg

SEQ ID NO: 27571 - DNA, 179 bp, Homo sapiens
  misc_feature 1..179: note = chr2:154729082-154729261
  misc_feature 1..179: note = hyper
  source 1..179: mol_type = genomic DNA
gcccaccttctgctctgcttttctggctaccccggtgagttgttggtggcgggggggggggggggagcggctctggccccctctgcgttctggtgacgttcctccgcgggggtggctcggcctccaagcccagacaactttctcgcaccagctgcaggcagccccggctgcgttgcggg

SEQ ID NO: 27572 - DNA, 314 bp, Homo sapiens
  misc_feature 1..314: note = chr2:154729747-154730061
  misc_feature 1..314: note = hyper
  source 1..314: mol_type = genomic DNA
ccttgtccaggctgtcgtggacctgaaggaggggcgcaaggggttagagtggagggcaccgcagcaggctccccttgccgggtccgagggcgctgcgctgctgcgaacctgagcgcactgaggctgctactctggacagcgaaagctgcgcaagcccctcccgcatacccgattctttgactatggttagttgaatttccaggaggagagtctgcctccccaacctttatagccagctgcagaagaacggacagtgagcaggcaaacatagatgctttggggttcagggaaactaacctcgaaagggtgggagc

SEQ ID NO: 27573 - DNA, 156 bp, Homo sapiens
  misc_feature 1..156: note = chr2:155555158-155555314
  misc_feature 1..156: note = hyper
  source 1..156: mol_type = genomic DNA
ccccccacccaggagcgctcgcttcgccccctttcctcccccgcccccacctccttattggtgctagtttgcagcgcccagctcctgcgccttcgcttcgcgtttgaatctggctcgccccttcgtattatgtctgcactccgaaggaaatttggg

SEQ ID NO: 27574 - DNA, 1801 bp, Homo sapiens
  misc_feature 1..1801: note = chr2:157176364-157178165
  misc_feature 1..1801: note = hyper
  source 1..1801: mol_type = genomic DNA
ccgcgggaagataagcgtacaggcggccccaaggcccctacaggcgcagccctgatctggccacttgactagacgctcgctccagcgctcgcaggcctagggctcattacatgcgttgcgaggagacctgaaagcagggcgggaacgcacaatctatcttcagagctttgggtcgtgagcacacgtgtggagcatggttgtggcatgggcgtctgggcccctctcctagacctccacgaggtgcggacgcgcctctgccccgcccttttgtgcgccctcaccactagaaaaagagttttccccagtgtcgcgtgggaggtcgccccagtccagctcagcgttccaagagaccagagactgaccggaaatcgttgggtgcagggagaagcaggagacgcgctccgcctcctgtgctcgtgccctagcgcaacagacgcgacctagaggcgacggcagcctgttgcagccttcgccctgagggtggggggcgggggggtgtagaacagctgaggaagacgcagggagcagctggggaggaaagggagggacaccgaggaaacaaagttcacccaagtgaatgcgtcctaattgctccaaggctctctccgcaaagtctacgactgcaagccgcaaagtcaaactacgtctccaaaacgcagtgggcagagcaggagggcttgtgtctccattttcgccgcagggcggatcgcggacacaagtcctctccagtaattccgaagcctcgaaataagactatgctgggaggaggggttggggggtgactaataagaaggcgtgggggtgggggtggggagtacgcggcaagaaccctgctttctggaattctcccgccactgtctgcagggcccagagcgcacttcgcggctagggaacaaaattgccgctctcttcgagcgcccccagcgtggggtggggccctgctttcccgcgtcaggaccgccccaccaggcgccctccgacggaagctggacttttcctaaggaaaggcaaagtcaaagtcggaggaaagatctttcttgcggccccagctgtcgctcctaatggtctcggggaacatactaaaggaaaatgactttaaatcacagtcttgccatcctaaatagttatgtgcaatattttggtttctagcaaaatttaaaagtaaaatggggatttccatatgttcattttattattaaaaacgaattactaaaaagtgatgacctgtttggaattcatatcttgctttacgagcagtcagccagtatcgactgaacacaataaatgcaggggtgcgaaacgtgattgctcgggttcgagttctgtcggatgcaccgatctaagcagaacctttcccgaagacttggaattgggtgcgcttttttttttaagttgtggctgagccctatggggaagaagggttaactgggcgtcggctgagaccccaaaccctcttcctcctccatgagactccaaaattgagtcagtcccagcccatagttgcctgggaagcttggaatcctgagaaattccggggtgcggccactatgcaagcattcctattctgacagcggggacaaatggagaggggaccttacaacctcctttggagaagaatatatgagaaactcacttccagacctctattcaatagtgaaaataatactgagaaaaagttttaaaatctccaagaatagatactctcctttccccttccaccttgagggaaacggtctccatttttgacctggatttgagagcatcggggcttgagacaagcgcgtcttccacagagagaggc

SEQ ID NO: 27575 - DNA, 142 bp, Homo sapiens
  misc_feature 1..142: note = chr2:157178166-157178308
  misc_feature 1..142: note = hyper
  source 1..142: mol_type = genomic DNA
aggcccaggcagggagccccccagcctttactctcggcacctcggcgctgccgcgcggcggatacaaaaggaaacggacgagcgtgcgacgcgaggcggggaactggtggctcgaagacgcgcaacacgcgcgatgcctaga

SEQ ID NO: 27576 - DNA, 214 bp, Homo sapiens
  misc_feature 1..214: note = chr2:160760685-160760899
  misc_feature 1..214: note = hyper
  source 1..214: mol_type = genomic DNA
aaggtgaccaagggccgaaggaaaagcgagaacgggagggacgggacgcaagagggcagatggggaaccccatactccagcaacattatataagagaggcgacgatggagcagcgcacccggccaaaaaagcctccgtgcgcctactctacggtgcaccgcgtcccctctgcaccagaagggccctgtcctcccacatccaccgcgccctcctc

SEQ ID NO: 27577 - DNA, 317 bp, Homo sapiens
  misc_feature 1..317: note = chr2:160760959-160761276
  misc_feature 1..317: note = hyper
  source 1..317: mol_type = genomic DNA
cggctccagagcccccccgccccaacagcaaagcagccgtgacctgccccaggggcgcagccctgccccaggctggaaggcagcagagctgtggcgtcgaggcacccagcggactgcggggctggcgtgcccgcggttacctgcgcggccagagggctccgcgagatcgaagaaccagaagagcagcatgaggagccccgccgggcggcgaggggtcgcccagcctgtcctcatcctgagctggcgcaagccttccggccgggtcctcgggcgcacgcggctcccgccccgcctgctgagcgcggcctgccccgccc

SEQ ID NO: 27578 - DNA, 50 bp, Homo sapiens
  misc_feature 1..50: note = chr2:160918710-160918760
  misc_feature 1..50: note = hyper
  source 1..50: mol_type = genomic DNA
cttggcccctagcttcgccccttcttcctctccttcgaccaccccgaccc

SEQ ID NO: 27579 - DNA, 30 bp, Homo sapiens
  misc_feature 1..30: note = chr2:161560586-161560616
  misc_feature 1..30: note = hyper
  source 1..30: mol_type = genomic DNA
cgcaagagcttgagtcgtctccgtgacctc

SEQ ID NO: 27580 - DNA, 30 bp, Homo sapiens
  misc_feature 1..30: note = chr2:162094291-162094321
  misc_feature 1..30: note = hyper
  source 1..30: mol_type = genomic DNA
ctcagccccgggttgcgtggttattttacc

SEQ ID NO: 27581 - DNA, 30 bp, Homo sapiens
  misc_feature 1..30: note = chr2:162094680-162094710
  misc_feature 1..30: note = hyper
  source 1..30: mol_type = genomic DNA
agagaggggaaaacacgcttctgacagcag

SEQ ID NO: 27582 - DNA, 128 bp, Homo sapiens
  misc_feature 1..128: note = chr2:162095511-162095639
  misc_feature 1..128: note = hyper
  source 1..128: mol_type = genomic DNA
cgggccaggagcccccgcgcggcccccagcgccggcccggtggagtgcagccccgcgcgggctcgcccgagggctcggcctgcgccgcgcgcccactccccggggcggtggggcgaggacccgcgctc

SEQ ID NO: 27583 - DNA, 541 bp, Homo sapiens
  misc_feature 1..541: note = chr2:162273417-162273958
  misc_feature 1..541: note = hyper
  source 1..541: mol_type = genomic DNA
cgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggtaatactacatttttggctgccgctgctctaggcgcagccggggacaagtgcacctaggctgtgactgccgcggcagcgacgatttggggtcgggagcggagtggaaggcgccctagagttggctagttttggaaagggggaaagtggaagggataaccgccagggtgatgttggtgggggggaccccgttctaggaacatagtgggagagccagtcagtggccagaggaaggcaagaaaaaggaagagccctggccagcggctgggcgatgggagggacgcatcaacactggcatgcacggacaggtggagacgcaggtcgccaacctcgctctccacctggg

SEQ ID NO: 27584 - DNA, 130 bp, Homo sapiens
  misc_feature 1..130: note = chr2:162274308-162274438
  misc_feature 1..130: note = hyper
  source 1..130: mol_type = genomic DNA
ttccttgcggcaaagcggacaccaatgtgcaaggcaagtccttccaattaacacattttcttgacacttatttaggtgagaatgattaattaaagcctttgtggactggctcgagcgacttttaaaacga

SEQ ID NO: 27585 - DNA, 395 bp, Homo sapiens
  misc_feature 1..395: note = chr2:162274832-162275227
  misc_feature 1..395: note = hyper
  source 1..395: mol_type = genomic DNA
ggtcagtggctcaagcgctcgtgttttctctctctctcaccccttcctccctgacatccagttcgtcagtgtaaagcagcatatggaactggatacacgtttctttgcttcattaaaaagacttaaaaattgtatttccaccctccaaatttatattaaatctgtaaagttgttctcattggcaacacctccgtcggcccaattttggagtgcccgaccttcccaagtactaatactgattgattttgagaagaaaccccacaagatctgcaggttgtggaaatctttgttcctccttacaggaggactaggagaagggccctgaggatcgggcggtcggcttcccccttttttccggtgccccggcttatcttcgctcccagaggtgcgaaagc

SEQ ID NO: 27586 - DNA, 128 bp, Homo sapiens; identical to SEQ ID NO: 207
  misc_feature 1..128: note = chr2:162275310-162275438
  misc_feature 1..128: note = hyper
  source 1..128: mol_type = genomic DNA

SEQ ID NO: 27587 - DNA, 330 bp, Homo sapiens
  misc_feature 1..330: note = chr2:162275472-162275802
  misc_feature 1..330: note = hyper
  source 1..330: mol_type = genomic DNA
cggaggacactagccagcccggccgcgtgcagacgttcactttccctgagactcagttcatcgccgtcaccgcctaccagaacacggatgtaaggagacctaggggctgggggcgaggcgggcggcacagacatctctcccaccctctcacattctcccgccatgcaaggctagggtactagcagcgctaacatcagcaacagctggctccgctgtgcgttttaaggcttagggctcggggcctgcccacggcacctttcctaaataccaagccggtgggaaaaagctttctatttgttttcgtcgctggtcacccgggccacctttgag

SEQ ID NO: 27588 - DNA, 15 bp, Homo sapiens
  misc_feature 1..15: note = chr2:162279873-162279888
  misc_feature 1..15: note = hyper
  source 1..15: mol_type = genomic DNA
ccgcaggatctacac

SEQ ID NO: 27589 - DNA, 264 bp, Homo sapiens; identical to SEQ ID NO: 209
  misc_feature 1..264: note = chr2:162280152-162280416
  misc_feature 1..264: note = hyper
  source 1..264: mol_type = genomic DNA

SEQ ID NO: 27590 - DNA, 301 bp, Homo sapiens
  misc_feature 1..301: note = chr2:162280740-162281041
  misc_feature 1..301: note = hyper
  source 1..301: mol_type = genomic DNA
cgcccctgcccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttgctgtaaaccttttggttttcctacttactcttcttctgtggagttatcctcctacaattcccctccccctcgtctttctcttacc

SEQ ID NO: 27591 - DNA, 30 bp, Homo sapiens
  misc_feature 1..30: note = chr2:162282450-162282480
  misc_feature 1..30: note = hyper
  source 1..30: mol_type = genomic DNA
taaggaagactagcccgtccccactccaat

SEQ ID NO: 27592 - DNA, 238 bp, Homo sapiens; identical to SEQ ID NO: 211
  misc_feature 1..238: note = chr2:162283365-162283603
  misc_feature 1..238: note = hyper
  source 1..238: mol_type = genomic DNA

SEQ ID NO: 27593 - DNA, 321 bp, Homo sapiens
  misc_feature 1..321: note = chr2:162283782-162284103
  misc_feature 1..321: note = hyper
  source 1..321: mol_type = genomic DNA
ggcgctgcccggcgctacccgccgccctcgggacagtcaccgtgagcaaaagagtcggtgtcatgtgcgtaaacgaagctcttaggagccgaggatagatttcacaggaacgtagtgccttgttctgaaagacgcgctttggttgatattaggaagtatttttaaaaaattggggaggtcgtttcccttgcagctccgccaccatctgctgcgtggactgagtcagcgtgaggtaaatttgcagcttcgcgctcctctcggaggcattgtgctgtcttgtccctttaaaacatgatcatttctcctcgcttccaagaagtc

SEQ ID NO: 27594 - DNA, 183 bp, Homo sapiens
  misc_feature 1..183: note = chr2:162284325-162284508
  misc_feature 1..183: note = hyper
  source 1..183: mol_type = genomic DNA
ttttcaaaaagaggacgaaagaagaagacgagcgtgcggctagcactgtattctggctcgtgtcttcccgccactcgcaatccgcgccatcttaactaactttcaatgtccctcggggctgagcgtgccggcggcgggtgctgctcgggctgggagatgctgcggcctgggttctcaaccttc

SEQ ID NO: 27595 - DNA, 26 bp, Homo sapiens
  misc_feature 1..26: note = chr2:162930218-162930244
  misc_feature 1..26: note = hyper
  source 1..26: mol_type = genomic DNA
ttctctacccctgcccgggttcgggc

SEQ ID NO: 27596 - DNA, 40 bp, Homo sapiens
  misc_feature 1..40: note = chr2:162930245-162930285
  misc_feature 1..40: note = hyper
  source 1..40: mol_type = genomic DNA
tgcgttctgtgagtggctctccgggacattcaaagctcga

SEQ ID NO: 27597 - DNA, 260 bp, Homo sapiens
  misc_feature 1..260: note = chr2:162930338-162930598
  misc_feature 1..260: note = hyper
  source 1..260: mol_type = genomic DNA
cgtcccttcacctgtcagagggtggccttggggcttccgcctaaggggagtccctggtccggtttcgccagcttttgggccatttggggagtttggcgaagaggtccccacagctcgccccggggacgtacgtggcgcggcactcaccttcatcgtcggcgtctcctcggaagtgagcgttcagagaaggagcgcaggcagaagtcaccgcgggcggcggagacgcgcgtcctgcaccgctgctccgggcggtggagtca

SEQ ID NO: 27598 - DNA, 113 bp, Homo sapiens
  misc_feature 1..113: note = chr2:163694871-163694984
  misc_feature 1..113: note = hyper
  source 1..113: mol_type = genomic DNA
tccccaccttggaagcggtggacgccaagtgcactaacaaggcagaaagcgagggcgagagaagagaacaaacgaacttactttgcccttcaaatttccgaatgatggtcccc

SEQ ID NO: 27599 - DNA, 261 bp, Homo sapiens
  misc_feature 1..261: note = chr2:163695246-163695507
  misc_feature 1..261: note = hyper
  source 1..261: mol_type = genomic DNA
cggactgccgcgggtgagagggtttgggggtggggaacgggaaggaggcggggtgaggggaggtggcgggggagggaaagagggagggagctgtgggggtggggtgggaagggggcggggagtcacaagggcaatcgatctgtttctcttctcccaaacagcgccaatttcccagtgcaaatgggcttaacctggcggttgcccagagcagtaaggaatggctgaggggggatggaagacttgtgccggttttgctggaag

SEQ ID NO: 27600 - DNA, 141 bp, Homo sapiens; identical to SEQ ID NO: 6454
  misc_feature 1..141: note = chr2:164592629-164592770
  misc_feature 1..141: note = hyper
  source 1..141: mol_type = genomic DNA

SEQ ID NO: 27601 - DNA, 125 bp, Homo sapiens
  misc_feature 1..125: note = chr2:164593096-164593221
  misc_feature 1..125: note = hyper
  source 1..125: mol_type = genomic DNA
ctgcgttggagggcccgggacagagccgcgctgctccccggcccgcgggctcttccctgccggttcccggccctctcgacagctgcggcccgtccgcccttccccaccccctctgcgcacgggac

SEQ ID NO: 27602 - DNA, 148 bp, Homo sapiens
  misc_feature 1..148: note = chr2:164593222-164593370
  misc_feature 1..148: note = hyper
  source 1..148: mol_type = genomic DNA
ggatctggtctcgagagcctggacctcaccggcaccctccccggggcccccagcaccagccagaaaacgacttgatctgcttagaagaggcaacttcggggagaaaattcgcgttcgcccagttcccctcccccgcctccctgtgaat

SEQ ID NO: 27603 - DNA, 149 bp, Homo sapiens
  misc_feature 1..149: note = chr2:165478206-165478355
  misc_feature 1..149: note = hyper
  source 1..149: mol_type = genomic DNA
tcctcaggtgggcaccggggcgcgaggctgagcccagggtctgggcggccccggcgccgctggaggcggggacccagccgagcgggcgctcccgctgggcttgccgggaggaccgcaggcgggataggggtccgcgcagccctgaccct

SEQ ID NO: 27604 - DNA, 31 bp, Homo sapiens; identical to SEQ ID NO: 6456
  misc_feature 1..31: note = chr2:167233063-167233094
  misc_feature 1..31: note = hyper
  source 1..31: mol_type = genomic DNA

SEQ ID NO: 27605 - DNA, 35 bp, Homo sapiens
  misc_feature 1..35: note = chr2:168149198-168149233
  misc_feature 1..35: note = hyper
  source 1..35: mol_type = genomic DNA
gggacaaagtcaccccgcggcgccctttcctgcca

SEQ ID NO: 27606 - DNA, 53 bp, Homo sapiens
  misc_feature 1..53: note = chr2:168149503-168149556
  misc_feature 1..53: note = hyper
  source 1..53: mol_type = genomic DNA
cgaggccagagccatcgccggggaagcgcagccgggctcgggtgcttcggctg

SEQ ID NO: 27607 - DNA, 215 bp, Homo sapiens
  misc_feature 1..215: note = chr2:168149776-168149991
  misc_feature 1..215: note = hyper
  source 1..215: mol_type = genomic DNA
ggaccctggctgcagcgtccctgtggcccgcgcgccagcccagcggccggagaccacgcgccccgcgggtaaggttctgtccggcagcgcccgcgacgcccccgggacggctggcgtggtctttgggggttacgaggcgcgtggtggccggggcatcccgacgaaggtgttgggacccggactgcgtgtcccgacgctgggctgtgctactgccc

SEQ ID NO: 27608 - DNA, 898 bp, Homo sapiens
  misc_feature 1..898: note = chr2:168149992-168150890
  misc_feature 1..898: note = hyper
  source 1..898: mol_type = genomic DNA
cgcccgtgcggctccagctggtgcgttctcccttccgcgctcacagactttgacagcgcggggatggcattgtgtgagtgtggatgtggatgcgtgtgtgcgcgcgcgcggcttggggcactttgcagcgagaacagtgggtcccctctgcgtggcccgacgtccttcaaggacccaagctgggctggagtgagtaggatgctgttggctcggcgggaggtagaacgcacggagcgcacgggaaagtccaccgtggctcgtaaagagccgagcaaattgaactttattgcggtgattaaaaggagctgtggacctggcgcgccaggggagaggcgcgttccacgaggctccccaaagtcccactttgccccggggacttcggaggggaagggaagagagggaaaagtaactgttggtccacattgctgaagaaaaggaggaaagagaagttgggggtgggggtgggggtggaggttactcttgggggagtggcgacttttaggtgtctgaagccccgcgtgggaggcttgctacacttttctggagcgcagacttgaggatggagagtcccactctgaggtactggtagcggctcctcctgcctggtggcggcgtagggcgcagcgggacagcttggtggaggcagagcggggctccgacgcccgacggcccggcgtccaggtggggccactgcctccccaggccgctttggcccgctgacctcccaggttgagacccggcctggtgcgcctctggcagctgccaaatgcctggcggctccgctttccgacaaagttcaggcccgctggggtctggtccatcagacctaggacacgttaaccacgcagagtaaccaggttagggtacccagctgcctccagagcgtttttgtttcata

SEQ ID NO: 27609 - DNA, 125 bp, Homo sapiens
  misc_feature 1..125: note = chr2:170218695-170218820
  misc_feature 1..125: note = hyper
  source 1..125: mol_type = genomic DNA
accgggagcagctcccgcgccgccgcccggccctagcccctgcccggacgctctcccctccggcctcccgcggacccgaccctgccacagccggggaagtgggggctccacgagaggctctggct

SEQ ID NO: 27610 - DNA, 298 bp, Homo sapiens
  misc_feature 1..298: note = chr2:170219260-170219558
  misc_feature 1..298: note = hyper
  source 1..298: mol_type = genomic DNA
gtgcacactcacacacgcactcatacaggcgcatgcactcctaagtgtcacaccaactgacacagattcactcatacacgccagtcacacacgcgcgcacattccacagtcacacttcaacgccgacatacacagtcccctttacgcgtgcatacaagagcacactcctgtgcgcacactctcacaggcacactcacacgtgcacacgcgctgccctcgcctctccgcagggtttgccccgcacagaagccggcgaggcggctcacggggaaatctgcacggacgcagttttactaaa

SEQ ID NO: 27611 - DNA, 251 bp, Homo sapiens
  misc_feature 1..251: note = chr2:170219911-170220162
  misc_feature 1..251: note = hyper
  source 1..251: mol_type = genomic DNA
gtgtcatggccagatcgtgcttcttacaagtctgctcattttgaagcaaaattgaaaaagagcgaacgtcttctccatggttccggtacccttttataagaaggagaaacacgagaggttcagggaacccctagcctcccttctttggggccgctttggacaggctggcaaggggcccggaagccaaaagcacaagtggccttacacccgccctcagcgcacgtcctcagcctgtacgtgacatcagagcc

SEQ ID NO: 27612 - DNA, 65 bp, Homo sapiens
  misc_feature 1..65: note = chr2:170220494-170220559
  misc_feature 1..65: note = hyper
  source 1..65: mol_type = genomic DNA
ctgaccccaacagtccggatcgcgtagcttccgtgggctgcagtggtaggcgcagctttaggtgt

SEQ ID NO: 27613 - DNA, 34 bp, Homo sapiens
  misc_feature 1..34: note = chr2:170335909-170335943
  misc_feature 1..34: note = hyper
  source 1..34: mol_type = genomic DNA
aagagctgggcgacgcgcgcgcactctcgcggaa

SEQ ID NO: 27614 - DNA, 366 bp, Homo sapiens
  misc_feature 1..366: note = chr2:171568345-171568711
  misc_feature 1..366: note = hyper
  source 1..366: mol_type = genomic DNA
gcgcaagtgtcactgcgggttcacctaccggcctcttcctctcgcaggtggcatgcagtcggcgctcgccgcccgcccgcaaagaaacggcaatgcaaacttcccagcctgggaaccccgctgcttggagagcagctccgctgtgccagccgccgccaggagactggtattcaacctccccgccccccgccacggttaaagtttgctccacattcgcagctcccaccccacccccatctccgccccgaggcaggaggaccacataggagttcctgggtccaccgtgcgcaaacacacccaccaacaaaagaaagcccattaaatcttccctcctgtgaactcgcgccccaacggatacctctttga

SEQ ID NO: 27615 - DNA, 15 bp, Homo sapiens
  misc_feature 1..15: note = chr2:171570047-171570062
  misc_feature 1..15: note = hyper
  source 1..15: mol_type = genomic DNA
gggagaaggtgggcc

SEQ ID NO: 27616 - skipped

SEQ ID NO: 27617 - DNA, 487 bp, Homo sapiens
  misc_feature 1..487: note = chr2:171570470-171570957
  misc_feature 1..487: note = hyper
  source 1..487: mol_type = genomic DNA
gggagaggcgatccccgcgtccgcagtgccggggcaggacgcgccctgcgccctgggccaggaggaggcaggtggccctcctcggcaggaggtgagccgccagggagggatgggggtcacccaagcccctgcaagcgcgaccctgcccagagcaaagcacgccccgcgcctggtgaggaactttttctttccaaaggtggcaggaacaagtctgtactgacttttctcccgccttcgggatcctctctcgtatgatttgtggtttgtgggaccacaacaaccaggcttcctcgaccgcgccttttttccagtagctcctggtctgccaggcttgcgagagggcgcgctggcttggcggggctccgggcgagaaatcaccagcagcgctggggctttcggccccccacagcccagcccgggcctcctgggtggcctggggagaagggggcgggacagcacagcttcttcccctcgggtgggcatgacg

SEQ ID NO: 27618 - DNA, 44 bp, Homo sapiens
  misc_feature 1..44: note = chr2:171571200-171571244
  misc_feature 1..44: note = hyper
  source 1..44: mol_type = genomic DNA
ggcgggcgggggacacgcggcgggccgggcgctgtcggtcccac

SEQ ID NO: 27619 - DNA, 61 bp, Homo sapiens
  misc_feature 1..61: note = chr2:171571846-171571907
  misc_feature 1..61: note = hyper
  source 1..61: mol_type = genomic DNA
agaccgcgcgcggggcgagcgagcggggcgcggcgaggggcaagggcggggagggccccgg

SEQ ID NO: 27620 - DNA, 230 bp, Homo sapiens
  misc_feature 1..230: note = chr2:171572347-171572577
  misc_feature 1..230: note = hyper
  source 1..230: mol_type = genomic DNA
cgggccagggaggagcgcgaaggcagtgaggacaagagagcttaaaagatgggagggagagcggccggccggcggggttgtgggtgtttcccgactcttactgaccacggagccgggaggggcccgtcggatgcctccccctcccacttcgcgcctgcttcctctaaggctggatggcgtctcagtgcaccaagtagtttagcaagaagcgctcgcgggccccacgttca

SEQ ID NO: 27621 - DNA, 601 bp, Homo sapiens
  misc_feature 1..601: note = chr2:171669846-171670447
  misc_feature 1..601: note = hyper
  source 1..601: mol_type = genomic DNA
aatggaccttagctccgacttaagcagaatgaaaggttaagtaacgcttcccccagttctcgtctcgggagacagacgtttaaccggtgagcactgccattttttttttcctttctggtcataaattagacacttaaaatagattttaaggagccagctgaaacgaaccaataccatggctctaaattacgtttcctggaggctaaaaattctaattgcgtcaaaaaaaattgacgtgtcctgtctactcaccttgactgaccacgttttaggcgtgaagatctccccgcagcccgtttgggcgctccttcaacgcctcacgctcctcctactcacccgtttttccctttgcagaaaaggcttggccccaaatccggttggaatatctttaaacaatcccccacccacccacgacggggaaaggaataaagggcattgtgggcggagggtcgtgttcccaagtcccagcggtggttgacctaaggaaacgttatcctcggcagacagggtggagtagccggggctgcaagctcgcaaatccctaatgccggagagagactggaggggtcgcatatcgccccctccttcttctgcctttgag

SEQ ID NO: 27622 - DNA, 270 bp, Homo sapiens
  misc_feature 1..270: note = chr2:171670471-171670741
  misc_feature 1..270: note = hyper
  source 1..270: mol_type = genomic DNA
cgcttcaaatacaatcgaaacagctgggcggacaccactcccttccgggccacccctcatcaccggttcgagtccccggagaggatatcttttttccacccccattatcccaagaatcctcccccaggaatgataaaagattaaaggaagagtgaaagacataaacaaaaatataggtttcaaatgttgtttagagccgaatgacaaccacggccactcttagttcaaattcctaccggagagaagagcagtgggcgaaatacctcaccc

SEQ ID NO: 27623 - DNA, 484 bp, Homo sapiens
  misc_feature 1..484: note = chr2:171671306-171671790
  misc_feature 1..484: note = hyper
  source 1..484: mol_type = genomic DNA
agattccttctccaacgagattatttcattggctaaaacgttaggggtgttttgaactctggggtcaaaggaggaagtggttggaaatgtctcaatctcgtgccacaggtgaagtaaacgaatcttcctttccagggaatcacgggttttgggaaaaggttgaggcgagcgggcgtctatgctggacaatgaagaacgaggggcaccgggagatgtgttgcctcctccttcctgtctcctgccccgtgcgtcttgaatgatttagcactggcacctggctccctgattggtgcgagcgtctcgtttagggaaggctctaggagggccggtggatggaattccgagcttcacctggttgtatgccgcccacttcaagcagcgcagagcagctgccggttgagtggtttggggggacgtttcctacgtggagcagacacccccagcctgtccagccccaagcctcagtgcccggggctgcagtcac

SEQ ID NO: 27624 - DNA, 52 bp, Homo sapiens
  misc_feature 1..52: note = chr2:171671799-171671851
  misc_feature 1..52: note = hyper
  source 1..52: mol_type = genomic DNA
cgccgtttaggatgttttttgtgtccttaaaaagtgccggggatttcatcgt

SEQ ID NO: 27625 - DNA, 125 bp, Homo sapiens
  misc_feature 1..125: note = chr2:171674091-171674216
  misc_feature 1..125: note = hyper
  source 1..125: mol_type = genomic DNA
ctgtcccggggccttcgggcgccatcgcgccagcgccgagagtcgagcaggggcgccgcgcaagatctttgtccgccgcctcctgcgcgctgcgcgcaagttcgtttccccggtgacgttcccca

SEQ ID NO: 27626 - DNA, 316 bp, Homo sapiens
  misc_feature 1..316: note = chr2:171674698-171675014
  misc_feature 1..316: note = hyper
  source 1..316: mol_type = genomic DNA
tcccccacacccttgcgtcttgtactggccttggacccccaccccgaccccgaccccgcctcgtctcggcgcttcactccaggtcgcgccgatgcaccgccagactcgagagcggcccagggctacgctccctgcgccccagtaccggagctagcgcgcacgtctcctccgctgcccccacccctgcgcacccctaccaggcaggctcgctgcctttcctccctcttgtctctccagagccggatcttcaaggggagcctccgtgcccccggctgctcagtccctccggtgtgcaggaccccggaagtcctccccg

SEQ ID NO: 27627 - DNA, 77 bp, Homo sapiens
  misc_feature 1..77: note = chr2:171675306-171675383
  misc_feature 1..77: note = hyper
  source 1..77: mol_type = genomic DNA
atggggctctgaccccgtccctgccagaggtcattcggctgtcagggacgctaggtgactcccagggcaccggaaag

SEQ ID NO: 27628 - DNA, 143 bp, Homo sapiens
  misc_feature 1..143: note = chr2:171675522-171675665
  misc_feature 1..143: note = hyper
  source 1..143: mol_type = genomic DNA
cggaatgaagagctaggagccccagcaggaataagagttttcagtccccggctttcgttgagccaagatctgacctcctcctttccccctgggctgtgttcaaagtctataatcagcggaaatttcgacgttaattgcagctt

SEQ ID NO: 27629 - DNA, 234 bp, Homo sapiens
  misc_feature 1..234: note = chr2:171677989-171678223
  misc_feature 1..234: note = hyper
  source 1..234: mol_type = genomic DNA
gtcttccccactccccggtctgactgaagagcagccatgcgagcccgatcatctagtcaaatactatttttcacccaattaattcttgaactcttccacgaccccatttcatgccagtttattttaagctgccactaggctggagacccgccaagaaattatgagacgtttcggtcccagatgcctgtgttccctttctgggctgctgtggtcgccctttgagtctgcggggcc

SEQ ID NO: 27630 - DNA, 53 bp, Homo sapiens
  misc_feature 1..53: note = chr2:171678293-171678346
  misc_feature 1..53: note = hyper
  source 1..53: mol_type = genomic DNA
cgaccccacctccggagctgccgggcgggggtcgcttacgggcccggaggggc

SEQ ID NO: 27631 - DNA, 57 bp, Homo sapiens
  misc_feature 1..57: note = chr2:171678980-171679037
  misc_feature 1..57: note = hyper
  source 1..57: mol_type = genomic DNA
cgcgcaagcagctcccacccggtgccgtgcactctgcctgcgcgtcccaaaggtcgc

SEQ ID NO: 27632 - DNA, 117 bp, Homo sapiens
  misc_feature 1..117: note = chr2:172379586-172379703
  misc_feature 1..117: note = hyper
  source 1..117: mol_type = genomic DNA
ccagaaacttgagcccgggcgcgatgccggagcgccgcgcagtcgggccgctgcagcccacgcgccccggaaagtcgcccctgtggaccgagcctgcgcgatcgggggcgcggaaac

SEQ ID NO: 27633 - DNA, 43 bp, Homo sapiens
  misc_feature 1..43: note = chr2:172945124-172945167
  misc_feature 1..43: note = hyper
  source 1..43: mol_type = genomic DNA
tgaggcctgaggagccgcccgaaggtcgcggtgacctggtgcc

SEQ ID NO: 27634 - DNA, 358 bp, Homo sapiens
  misc_feature 1..358: note = chr2:172945896-172946254
  misc_feature 1..358: note = hyper
  source 1..358: mol_type = genomic DNA
cccacccaccccacacgcacgcacgcacgctagaccgtttgctgcactaggaattcgagcttgggccccactcgcccaggtgtgaacagtggctgattagtgggcggtctagtctctaaaatgacccctccccagactggcccttctcgcatcgggacccgcgcttgcacgctgcaggagccgcaaacgtcagctgttctggaaaccgagagggtcccagagagaggagatacgggcgcatttgagagcaagggcctacttggccgggactgaagcttgcgagttgagctccagttcggccggcagttccatcccgcttcaggaacaggaatccaagggcccacgctctgtctgccaa

SEQ ID NO: 27635 - DNA, 30 bp, Homo sapiens
  misc_feature 1..30: note = chr2:172946606-172946636
  misc_feature 1..30: note = hyper
  source 1..30: mol_type = genomic DNA
gaggaccaggtggctcggaaaagagatgag

SEQ ID NO: 27636 - DNA, 141 bp, Homo sapiens; identical to SEQ ID NO: 6475
  misc_feature 1..141: note = chr2:172947773-172947914
  misc_feature 1..141: note = hyper
  source 1..141: mol_type = genomic DNA

SEQ ID NO: 27637 - DNA, 310 bp, Homo sapiens
  misc_feature 1..310: note = chr2:172948183-172948493
  misc_feature 1..310: note = hyper
  source 1..310: mol_type = genomic DNA
ggagttgcctggtggcggaatcattagctggctgttgctacaaagcctcaccgtgtggttcggtgattaagaaaaaaaaaatcttttaaacgttggcaaacccgttattggtttggcgtattgggttttttttgcttttgcttttctttttgctccaaccactctgcctgaaatatttctgcccccagcattgtgcccttaaaccaaaggagaggaattctgcgggcagcagcagctggtacagaagttaaaaaaaaagagaaaccccctctactaatatctgtaacgacagcaccgatgtaatttgttt

SEQ ID NO: 27638 - DNA, 97 bp, Homo sapiens
  misc_feature 1..97: note = chr2:172949186-172949283
  misc_feature 1..97: note = hyper
  source 1..97: mol_type = genomic DNA
ggcctgggtttgctgcgggtttcggtgtcccccagggactcctaaactctggaagtcgcgctagacctcaggaggccggaaaatgaccacctggcgt

SEQ ID NO: 27639 - DNA, 864 bp, Homo sapiens
  misc_feature 1..864: note = chr2:172949348-172950212
  misc_feature 1..864: note = hyper
  source 1..864: mol_type = genomic DNA
cgagtgagcccggggctctccgcgcatggggagtggagaagggagggggaggaggaggaaggctgggagggaaagaggatgtgtgtgttgggggagggggcggtgcagccgcctttcctgggaggagaagcgcgggttcctggctctccacgcgcactgctttaatcagacccgtgcagcctcgagctggagtggccagctgggcctggagcaatgcgagcgggccccagggagcgacagcggcgttggcgcagcggccgagtgagtgagttcgcagggagggcccctaagccccgactccagggatgcggcagagcgtaccggggaggcgcggccggataggcgctgcgctaggcacaaggctcttaggagaacctctgtctgttggccgcctcgggcgcccccagtgcgcgactccgcgctccagaggcagaggtcagtctcctcctgagccgccctagctctgcgccgaactgagtggcagcgacgagaagcggtcccgggtgtccggtgttagggaccgctgaagggtggggacagtggtaggggggcggcggcgcggagccgctggttggttcctggggaggaaagcgcgcgagggaggcgggaggccgatgagccgcgggccgcaggggccccggcgcagacgccgcagcccattgtgcttcctgcccggcgcgctctgttgcagaggagccccggccgggaagtgtggatgcgtcttacccgaggccgggccgcctcgcccgctctagtccagcggagcccgagcgcctcggaccaatccccagtgattatgcaagacagcggaccaatcagctccgccagctcatgaatatttatgaccttcgctgagtcaaagct

SEQ ID NO: 27640 - DNA, 292 bp, Homo sapiens; identical to SEQ ID NO: 6480
  misc_feature 1..292: note = chr2:172951251-172951543
  misc_feature 1..292: note = hyper
  source 1..292: mol_type = genomic DNA

SEQ ID NO: 27641 - DNA, 60 bp, Homo sapiens
  misc_feature 1..60: note = chr2:172951983-172952043
  misc_feature 1..60: note = hyper
  source 1..60: mol_type = genomic DNA
cctcctccttcttaccggttgggggtggggggagatcctttcctccgccctctcacctct

SEQ ID NO: 27642 - DNA, 170 bp, Homo sapiens
  misc_feature 1..170: note = chr2:172952381-172952551
  misc_feature 1..170: note = hyper
  source 1..170: mol_type = genomic DNA
tcggtgttatgcaggcgctgtatcttccgcaggcggtagccacggtcggactgagcccctggcaggctaaggcctggatcccggttctcccctcatcacaactcctccctggctctctgagagctgcccccgtgggctgacggcggcgggaggttcggccttcgagcctt

SEQ ID NO: 27643 - DNA, 88 bp, Homo sapiens
  misc_feature 1..88: note = chr2:172952794-172952882
  misc_feature 1..88: note = hyper
  source 1..88: mol_type = genomic DNA
ctctggagggtagtgcgttggccaacggtcgggccctgtctgctggctccccacccgtgccgcccggctggaaccctaactcttcatc

SEQ ID NO: 27644 - DNA, 54 bp, Homo sapiens
  misc_feature 1..54: note = chr2:172952992-172953046
  misc_feature 1..54: note = hyper
  source 1..54: mol_type = genomic DNA
cgcccgtctccttcttgtctccccggcccaggtccctcccgcctccaggtccat

SEQ ID NO: 27645 - DNA, 323 bp, Homo sapiens; identical to SEQ ID NO: 216
  misc_feature 1..323: note = chr2:172955471-172955794
  misc_feature 1..323: note = hyper
  source 1..323: mol_type = genomic DNA

SEQ ID NO: 27646 - DNA, 226 bp, Homo sapiens
  misc_feature 1..226: note = chr2:172957809-172958035
  misc_feature 1..226: note = hyper
  source 1..226: mol_type = genomic DNA
gtcacccccacccaccgctttcctaccccctccctcatcccccaatcttcgaggattaacacttcctgaaacatcaagtgtttttataaaaaggaaaaaaataatcctgacatcgctgacaagaagttttgatggaagaattagctggtgcatacataatcactcccccaccctcctactcccggagcgggagccacggcggcgggcgcagcgcagccttccaacc

SEQ ID NO: 27647 - DNA, 30 bp, Homo sapiens
  misc_feature 1..30: note = chr2:172958321-172958351
  misc_feature 1..30: note = hyper
  source 1..30: mol_type = genomic DNA
ggcgcctcagagcgccgcaggctttttgca

SEQ ID NO: 27648 - DNA, 107 bp, Homo sapiens
  misc_feature 1..107: note = chr2:172960759-172960866
  misc_feature 1..107: note = hyper
  source 1..107: mol_type = genomic DNA
cttttgacttttgagcgagttcgggggacgccaggagtgggggagttgcactcgagttttactgcccgtaagaacgactttttgagaggggacggggcttcttgctc

SEQ ID NO: 27649 - DNA, 372 bp, Homo sapiens
  misc_feature 1..372: note = chr2:172961325-172961697
  misc_feature 1..372: note = hyper
  source 1..372: mol_type = genomic DNA
gcgggagtacctgggcggcaggcagttggccctggagctcagtgcccgcgttctgcctgagttgggagagccctgccagagggtggagcggagagggccgtgcacccctcactcttcagcttccctccccctgcttcccagcgcttgtcatatcctgtctctggcctgatatttcacgcgagcaattggaaggagattacaatggagatttatgtgtgttctgagcactgctagtttcccagcgtagagagccgagatcgctgcttcccatttccatttttcattcgcgctttggggagctcagtagagcacggggggagcgtgtctgcgcggcggcgggctgatcacaggactccgcgtctccgggcgggc

SEQ ID NO: 27650 - DNA, 82 bp, Homo sapiens
  misc_feature 1..82: note = chr2:172961935-172962017
  misc_feature 1..82: note = hyper
  source 1..82: mol_type = genomic DNA
tggggaaaggcacaccgtggcccggcccgaccctgtcgtcactgggtgccgggtaaggtgactccggcgagtctgtggggcc

SEQ ID NO: 27651 - DNA, 459 bp, Homo sapiens
  misc_feature 1..459: note = chr2:172963633-172964092
  misc_feature 1..459: note = hyper
  source 1..459: mol_type = genomic DNA
agcacggccccgtgtcgttggggtcggcttgcattccagagcagccagccatgcctcccgagggtgactcacagagctctcagttcagtcccgaagggcggtgggacaaacggaggggaaggttcaaagtagggttccgaccctcaggctgctgcagagctcaggtccctgacaggaggtcccccgcggcggctggggtgccgagcctggccatctaggcgggcgcgggggcggtggcgccggcgccggaggggcagggcaggcggaggctggagccgctccgcgctgagtgagtcaccccgccgccggccggagaatccctcgcggggactcgggagggggcggggcgtgaaacccccggtgcggccccacgcccagcgcgcctgtcctctccttgccgcacctcgcggtgtcgcagcctcggaaagatgtaaacgtagctctcggccggctggcttc

SEQ ID NO: 27652 - DNA, 142 bp, Homo sapiens
  misc_feature 1..142: note = chr2:172964747-172964889
  misc_feature 1..142: note = hyper
  source 1..142: mol_type = genomic DNA
caggaaggaaagaagcggcggggccgcccgggtcaaggggccacgtgggggagggcgggcaggcgggaccgggaggtcaataactgcagcgtccgagctgagcccaggggagcgggcgaggagaaagaagcctcagagcgcc

SEQ ID NO: 27653 - skipped

SEQ ID NO: 27654 - DNA, 116 bp, Homo sapiens; identical to SEQ ID NO: 220
  misc_feature 1..116: note = chr2:172965647-172965763
  misc_feature 1..116: note = hyper
  source 1..116: mol_type = genomic DNA

SEQ ID NO: 27655 - DNA, 802 bp, Homo sapiens; identical to SEQ ID NO: 221
  misc_feature 1..802: note = chr2:172966250-172967052
  misc_feature 1..802: note = hyper
  source 1..802: mol_type = genomic DNA

SEQ ID NO: 27656 - DNA, 173 bp, Homo sapiens
  misc_feature 1..173: note = chr2:172970574-172970747
  misc_feature 1..173: note = hyper
  source 1..173: mol_type = genomic DNA
ggatttctctgacttcggcattcttttgctccgcaggaacatagagaacggtgggggtaaataaggggagcctgaagtttctgctctgtgcttgcgtgttcgaatcccatcgctgagactttcttctgctttggatcgcttgtcccaggctgacgccgcgctgcgacctctcc

SEQ ID NO: 27657 - DNA, 420 bp, Homo sapiens
  misc_feature 1..420: note = chr2:172970950-172971370
  misc_feature 1..420: note = hyper
  source 1..420: mol_type = genomic DNA
caggtctccagaagacggcgagctggagaggacaagtctgcgctttgctctcagacccttgccccaccgctagcctggggcaggattccagccttcgcctagccgggcgctttgctctgccgggctattgggcgtcctccgctgcacagaaagccagcccagttgggtattactggggagaggatgcctcctgtcggcagggagctagggtgggcgcccgggtgccctcagtgcgtggcggggccaggcccattttcactctccttcctcactcgggggatgggagggctgcatgcgctgctgctcctactcctcacagtctcgtcgagggtcccggagacgggagtttccgggccgctggtccaagaggcaatgccagtttcggtacctttgtgttttcgtccccgaagtagtagctct

SEQ ID NO: 27658 - DNA, 53 bp, Homo sapiens
  misc_feature 1..53: note = chr2:172971641-172971694
  misc_feature 1..53: note = hyper
  source 1..53: mol_type = genomic DNA
gggccggcaggcagacgcgacccctgactcgggatctgcgtcctgggatttca

SEQ ID NO: 27659 - DNA, 325 bp, Homo sapiens
  misc_feature 1..325: note = chr2:172972930-172973255
  misc_feature 1..325: note = hyper
  source 1..325: mol_type = genomic DNA
cgaccgcgcccctctctccccaaagagagtcctggaaggggggttcccctgggagaggaggaggcccgcccggctgcgcagagggtagccccgggaagattcctgaacagactcgagcctctgcggagagggcgggatgcgggtgccccctggcttggcacgtgaagccaagcttgaggacctgatgttttgttcccgctgggattccgccccaagttatctttgctccctgctggggtgtaagtaaaccccaggggcttgaaccgaaatcatcggttactcgacgcttccagccgtggcctttccgcggcgctgggcttctggt

SEQ ID NO: 27660 - DNA, 30 bp, Homo sapiens
  misc_feature 1..30: note = chr2:172974228-172974258
  misc_feature 1..30: note = hyper
  source 1..30: mol_type = genomic DNA
cctaggtgttctcatcgttgggttgtcagt

SEQ ID NO: 27661 - DNA, 401 bp, Homo sapiens
  misc_feature 1..401: note = chr2:173099696-173100097
  misc_feature 1..401: note = hyper
  source 1..401: mol_type = genomic DNA
cggcgccgggggagccgcgctcggggacagctggcggctcaacggcagcatcggcagcatcgagaaaggtgacgagttctgcaaataacagctgcggagcaatcgttatgtttggacaacgtgggaagggccattgttcacaaattgttctcttcaacaacacctgcatgcacagataataatccattgtcggtctccggcttcaaagacaaaaggcagccgcggagggaggagtcagcagagcctggagataacaggaccactttgcaaccggggagagtgcaaacgaggactccaagtcgcgtcccgggtctgccgcgacggtcgctcaccgcaggggtctccttcctcttctggcagcgagtgcgacctcttttatcctagcaggccaccaccttcgc

SEQ ID NO: 27662 - DNA, 289 bp, Homo sapiens
  misc_feature 1..289: note = chr2:173100098-173100387
  misc_feature 1..289: note = hyper
  source 1..289: mol_type = genomic DNA
gcaacaaacatcatttcctatgcagttgcaaagcatgctcccttgcaatcagcgatcaatactggcaaagtggctccaggataggaaaggtcgcacgtgtgttggtaaatggaaaggtttatgaggcgcaggtggtcgtgctccgcggagattgtggtattagcatgtcaaagacaaaacggaaccaaggtatacaggcacagagtctcttcctggggctccgggaaagcttggcacgaccctcttgagccttcagtttaaaatgaaacgctggcgccagatgtggcca

SEQ ID NO: 27663 - DNA, 454 bp, Homo sapiens
  misc_feature 1..454: note = chr2:173600547-173601001
  misc_feature 1..454: note = hyper
  source 1..454: mol_type = genomic DNA
ggccgcgggagcccgcggggagggcgggcctgtcgcagccgcgctggtcgccaggcgtccgggaggagcggggtccgcgcggcggacgaggcgggggcggaggcgcaggcagagcgagcgcgggaggtcgccgcagccagggacaccgcgcgccgccgctcaacatggtcgctgcgcacgctgcccattcttcctcctctgccgagtggatcgcctgcctggataaaaggtagctcgccgggggccgcagccgggggccgagctctgcggtgctgcccgggccctgagaccgccgcagctccgcacctgggcgcagcgcggccgggctgcgggtggccggggtccccgagcgggggaaggggttgaggtcctcgtccgggagacaggaggacaaggatccccgcctctcgtggggtgccagcggcatgagattattacacgtggtggagaaaat

SEQ ID NO: 27664 - DNA, 1202 bp, Homo sapiens
  misc_feature 1..1202: note = chr2:175190771-175191973
  misc_feature 1..1202: note = hyper
  source 1..1202: mol_type = genomic DNA
gaagaaagagaaactcgcgacaacagagttgccgaaagagaagtgttggcgcctcaaacttgaggatcagcttcttgggccccactccagggtgtcgcgggggtcgggttctttccgccgccccccgaaagattctcagctaaccctttccccgccgagaccaagaggccctcactctgacaccactccgggagccaagctactgtaaggagctgataccacccctcgccggcgcgaaccgcccatctccccagacccgcccaccccctgctgcgaatccctgacgttctagcccggcgaaggtcctcttaaattaggaaacaatagctatttaagaagaagcgcaaataacccgcgctctgcgcgcccaatcgtgggattcttgggagttccccgcgggcaaggaagtctgctgctccccgcagctgcggaggagaggagggagcctgcgtgctggggcagggtgtcgcgaacttggggcaacccacctccagagccccgcccccgctttcccgcctgccggggacctgccgaacgcggaaccaccctccttcctgaggcaaatttgggaggggagaggtccagaagctgtagagtcggggcgccaagcgccagattctgccgctcggaagttgggggcagtccccagtcccgcctcaggcccccgcgctcacagggcgctccgccgagggcgcgggccaggcgcgcggtgtcacctccacgaagtcatttacttgccctgaaggagctggccctcgaccccttggaggatggagattcctcccattccctcctccgcctcccccaggtcggcgaagagacgtggaattgagctggaccgatgattccgcgagctctgtaattatgcacacactgaaatcttcaccgttgacttaagttacttggcgctgcgagggctggggccctgcatattgattaaatgcagcctctatttacctaaacaataaatgtagagattagcaacgttcacttgatcacaataatgggattgacaattaaggggcaatgcatcccagatgtagcggaacctatgggctgcgtgcagcaggcagagggcttctcagagaggggcgctgggcagttgcggcggcggaggtagtgcagagcaggaagcagcgcggaagcacagcgggaggcggagggggacgcccagcctcgtcaaggtcttcggccaccccgcc

SEQ ID NO: 27665 - DNA, 384 bp, Homo sapiens
  misc_feature 1..384: note = chr2:175192084-175192468
  misc_feature 1..384: note = hyper
  source 1..384: mol_type = genomic DNA
cgcttgctgatgcctggccgggaaggaggatggacgccgctggcatgtgccctggtaagtgtgtctgtttgtcatcagtgtacattctgcatgtggcagcagggcgagggggaggcgcacgtgtctaaagtgcacggagccttcctctacccctatgtatatacccttcagtcaatgttccaagaagcgggtcagggcggagggtatccatctggactctggaagggcgtgggtttgacatcggtaggtgtgacaggaaagtccagcctgtcagagttgggctctacagtggccgaaatcaagaaaggatggacgtgtcggcccagggctggcctgtttccggatatgtcacgggggtgcctcgttcctcgaggggagttttag

SEQ ID NO: 27666 - DNA, 109 bp, Homo sapiens
  misc_feature 1..109: note = chr2:175193268-175193377
  misc_feature 1..109: note = hyper
  source 1..109: mol_type = genomic DNA
tttgggcagggaaggcgggcgggcgggggtgggggtgggggcgggggcctgctttgatcgctccagctctgttgtaattttgtcttcgccagatagattagctggaacc

SEQ ID NO: 27667 - DNA, 267 bp, Homo sapiens; identical to SEQ ID NO: 225
  misc_feature 1..267: note = chr2:175193378-175193645
  misc_feature 1..267: note = hyper
  source 1..267: mol_type = genomic DNA

SEQ ID NO: 27668 - DNA, 97 bp, Homo sapiens
  misc_feature 1..97: note = chr2:175193808-175193905
  misc_feature 1..97: note = hyper
  source 1..97: mol_type = genomic DNA
cgggtggttctaagctatgacgaactagaggctgggcccggttcttctccagaacagcgtgtggatgtaaaggagatgaaatcgtcctcccccactg

SEQ ID NO: 27669 - DNA, 298 bp, Homo sapiens
  misc_feature 1..298: note = chr2:175196967-175197265
  misc_feature 1..298: note = hyper
  source 1..298: mol_type = genomic DNA
aaaaaatctgtcagacgaaaaaaatctggacttcctccgaaagatttccttggggccccaccttagagttgaagtggcccgggtgtttgcctgcgttcgtttggaagatttccctaacttttattgtgatgcagacgcgtgtatctaaaggaatatgcgagtgcccacgtctagagtctgacagctggaactacggggaaaacggcgggagggggaggggaggggatccgaggggaggaggagaagaggaaggcgagcagggcgccggagcccgaggtgtctgcgagaactgttttaa

SEQ ID NO: 27670 - DNA, 65 bp, Homo sapiens
  misc_feature 1..65: note = chr2:175197980-175198045
  misc_feature 1..65: note = hyper
  source 1..65: mol_type = genomic DNA
agaggagagaaaacacgggaggcacagttccacatccttgtcacttgcaccggctccgcgacaac

SEQ ID NO: 27671 - DNA, 107 bp, Homo sapiens
  misc_feature 1..107: note = chr2:175199448-175199555
  misc_feature 1..107: note = hyper
  source 1..107: mol_type = genomic DNA
cttcagtccccagcccgccctcgccccccccccgcaagtatcccccactactcccccccacccccgcggccctagctagctgacttgactggcacgcgccgggagcc

SEQ ID NO: 27672 - DNA, 14 bp, Homo sapiens
  misc_feature 1..14: note = chr2:175199921-175199935
  misc_feature 1..14: note = hyper
  source 1..14: mol_type = genomic DNA
ggagaaactgttgc

SEQ ID NO: 27673 - DNA, 269 bp, Homo sapiens
  misc_feature 1..269: note = chr2:175200172-175200441
  misc_feature 1..269: note = hyper
  source 1..269: mol_type = genomic DNA
gaaaacagtcttaatcgttttgcagtccatctagtcacgctaataaacatttacatttccgcggctccccaattcgcccatgactttgaaatctgtctctggccgcttatcctcggattattgttttcataatcgctgtttttgtgtgtatgtaaactttaaaaccaaacgttttctattaaaaaagaaaagtcaagtcgtagccaccctgggagagctgcaagtttcgcccgtccctggcagctgtttcggccgcctccgccctcacc

SEQ ID NO: 27674 - DNA, 144 bp, Homo sapiens; identical to SEQ ID NO: 230
  misc_feature 1..144: note = chr2:175200709-175200853
  misc_feature 1..144: note = hyper
  source 1..144: mol_type = genomic DNA

SEQ ID NO: 27675 - DNA, 267 bp, Homo sapiens; identical to SEQ ID NO: 231
  misc_feature 1..267: note = chr2:175200916-175201183
  misc_feature 1..267: note = hyper
  source 1..267: mol_type = genomic DNA

SEQ ID NO: 27676 - DNA, 183 bp, Homo sapiens; identical to SEQ ID NO: 232
  misc_feature 1..183: note = chr2:175201359-175201542
  misc_feature 1..183: note = hyper
  source 1..183: mol_type = genomic DNA

SEQ ID NO: 27677 - DNA, 54 bp, Homo sapiens; identical to SEQ ID NO: 233
  misc_feature 1..54: note = chr2:175201775-175201829
  misc_feature 1..54: note = hyper
  source 1..54: mol_type = genomic DNA

SEQ ID NO: 27678 - DNA, 120 bp, Homo sapiens; identical to SEQ ID NO: 234
  misc_feature 1..120: note = chr2:175202126-175202246
  misc_feature 1..120: note = hyper
  source 1..120: mol_type = genomic DNA

SEQ ID NO: 27679 - DNA, 33 bp, Homo sapiens; identical to SEQ ID NO: 235
  misc_feature 1..33: note = chr2:175202568-175202601
  misc_feature 1..33: note = hyper
  source 1..33: mol_type = genomic DNA

SEQ ID NO: 27680 - DNA, 78 bp, Homo sapiens; identical to SEQ ID NO: 236
  misc_feature 1..78: note = chr2:175202633-175202711
  misc_feature 1..78: note = hyper
  source 1..78: mol_type = genomic DNA

SEQ ID NO: 27681 - DNA, 30 bp, Homo sapiens; identical to SEQ ID NO: 6510
  misc_feature 1..30: note = chr2:175203142-175203172
  misc_feature 1..30: note = hyper
  source 1..30: mol_type = genomic DNA

SEQ ID NO: 27682 - DNA, 54 bp, Homo sapiens
  misc_feature 1..54: note = chr2:175204150-175204204
  misc_feature 1..54: note = hyper
  source 1..54: mol_type = genomic DNA
ccgtcaaatggccctcgcaggttatttgaatatcagtggcgctgcttctgaaaa

SEQ ID NO: 27683 - DNA, 119 bp, Homo sapiens; identical to SEQ ID NO: 237
  misc_feature 1..119: note = chr2:175204828-175204947
  misc_feature 1..119: note = hyper
  source 1..119: mol_type = genomic DNA

SEQ ID NO: 27684 - DNA, 73 bp, Homo sapiens
  misc_feature 1..73: note = chr2:175206833-175206906
  misc_feature 1..73: note = hyper
  source 1..73: mol_type = genomic DNA
ggactacccggggcccggctggaaccaggccgattcaaacaggccaccaaaccatcccacccccctaccccct

SEQ ID NO: 27685 - DNA, 693 bp, Homo sapiens
  misc_feature 1..693: note = chr2:175206960-175207653
  misc_feature 1..693: note = hyper
  source 1..693: mol_type = genomic DNA
cgggccggagcagccttctgcattgccttcgtcctccggcggacaccccagcccgagtggggcgcggggggcggctgggcaggcaggagccgggccggtcgcgcagggcccccgagggcggcgagaagcccccaaattccccgctcgaggcctccccaaagggtgcgcacaccctcctggagcaaaccgaccccttttgtcctctccttttccctttgaaacccaaatctgaaatcgggtaacagttgggggcgttggccgattttctctcctctcagcgtatcgtcctccccctgccgcccctttccctcctcttccagtccactatctccccgaccccagcccgtcttcatactgcgtggagtgacttcctcctcctccatttttgtgccccccacccccagcgcgtatttattgtattttaatttaaaaagcgacaccttcaaaccctgcgcccgaggcggcggaggcgccgtcacccgcagccgcgagagcccggccaaggcgcctgggtgccgggctccctgaactcgcgccggggagaagcagtgcgtttccggggactcgcagccacctttgcggcgggtaactcggctgggtttgtatttgctgttttaatacaaaccccgccgcactgcctatttcaaagatgtgctaattactacttggatagcagggcgcaaagtccttgtc

SEQ ID NO: 27686 - DNA, 888 bp, Homo sapiens
  misc_feature 1..888: note = chr2:175207981-175208869
  misc_feature 1..888: note = hyper
  source 1..888: mol_type = genomic DNA
cccacccttcccagacgctggagtgtatagaaatatgtatgaggtaaatacatacagacatgcctcccccatatattgttgatgtaaatatagactgtgtgtttgcatctccagttaaggaaagggtttcagaatgtccgtggggacacgtccctccagggccggctgtcgaggacccggaaaaccacagcccctaagagttccagattttccaagacccttatactctcttcctgtagaatttcatactgggggttttgcattgttttgcaggcatgtaaccatttctgggtgattcatttatctataaaggaaatgcaaagtggcagggtgtctgccccagtccgcattctgcttgcagattgctgacgaaagttgatatcttcatgtttgtcccaggagcttcataaagcgccctcttcacctgtggagcccgagcgaccagaaaaattcgctcgctttcctaactgctgaaggcgagtccggcccgcgcgggggactgcgcccgaggcccggcaagcttaggcggggactagcagggccctcggcgggcgggcccccagcgaaaaggcctgagaattgcttctggggggtggcttgggccaacgggggcgagggagccgcgcagagggcaggccccgacccttccccgccgcaccttgtgggtcgggtgttgggcggcctcctggcgcgggaggcgcatctgctaggaagggtgtgcgctccccccttctcggcctccccatttcggtttggggtgttttcgcaaggttgccagacggtgcatccagaaggaaaccaccagagcacgcaggggggcgtcgcctcaggatgggaaggggcgacctcagccaggattcatcccatcaccctactccacccccattc

SEQ ID NO: 27687 - DNA, 139 bp, Homo sapiens
  misc_feature 1..139: note = chr2:175208996-175209135
  misc_feature 1..139: note = hyper
  source 1..139: mol_type = genomic DNA
cggctccggggcagctcgggccggagggtgcgtttcttttcattccaggcagctctccgcgttcgtcccgcacatcttcgtcattactgctacattctgggcattctgggggtgataagtgtggcgtgaagggaggaga

SEQ ID NO: 27688 - DNA, 43 bp, Homo sapiens
  misc_feature 1..43: note = chr2:175351019-175351062
  misc_feature 1..43: note = hyper
  source 1..43: mol_type = genomic DNA
cagagagttcctaaccgaataggctgctcggagagcagctgcc

SEQ ID NO: 27689 - DNA, 1246 bp, Homo sapiens
  misc_feature 1..1246: note = chr2:175546822-175548068
  misc_feature 1..1246: note = hyper
  source 1..1246: mol_type = genomic DNA
tgtctctggagagttcgggggatcaccccccctcaacccccgtccccactccgggcgaaaagcactgaccgggactggagatgtctctaaggtcgacgcagacccctaacgcgcgcgtctacgccgacctggggcgagcgggccgcccgggagggccgggagggaggcgggctggagcgcgggaggggcacggttcccatagacaggcaggcgggcggtgccagaacttgagccggccccaggggatgcccgaacgtccccctctgtcctagctggggtgtaggtgcagccccagggcatcgccgcgaagcccctgctcgagacctacggagatagtgggtcccgagccccacggggcggccccgggtccgcggagtccagcggtgagctcagcccgaggcgcgggacccaggctgtccacggccccttcctccccgggccatcagcgggcagcagaacgcgcgggccgctggcctggaattgcgcccctcccgaggccgcgcgcccgcgcccaccgctcgcaggggacgcggcctcgacgtccccagccgccccacccgcgtcaccggtgccaggcggcacttccgtgccccgccgtcgagcccagcccctcccggcgtctcccccggcccccgggagcccggaacccgggtcgcgccagaggcgacgcgtcccttaccgcgcagcggctccggacgactccgcagccccgcgccgcgctgggcattttttctgggaaacttctcccggggtccgcagggctgagccgggcgggcaggaaaagcgctcagcgccgggaggctgcgaccatccgggaacttcgccgagatgtgggccctcccctccggcgccgccgcccccccgccgccccgccacatgtggacgcgccgcgaggccccgccggcccgcgccctgccctccgcgcgcccgcctgccccgccagcaatggggctctgcgcctgcagcttcggcccgcagaggatcgcggcggggcgggatggtcggggctggagtccgcagtttcctcagtcccgctcccctgcgcggcgaggggaccgaggcaagaggacaggagtttgcagaggggcgggaactggaaggggagtctagcccagggcctttccccccaactcttgaatcttctccaccttcttgcggctgctggcggggggatcgggtgggggtgttccctctgttcgagccggaaggaacgccttttcccacgctttcccgtctgctctcaaaa

SEQ ID NO: 27690 - DNA, 148 bp, Homo sapiens; identical to SEQ ID NO: 2107
  misc_feature 1..148: note = chr2:176940167-176940315
  misc_feature 1..148: note = hyper
  source 1..148: mol_type = genomic DNA

SEQ ID NO: 27691 - DNA, 30 bp, Homo sapiens
  misc_feature 1..30: note = chr2:176940611-176940641
  misc_feature 1..30: note = hyper
  source 1..30: mol_type = genomic DNA
atgtagttttcatgtcgtttctataaaatc

SEQ ID NO: 27692 - DNA, 474 bp, Homo sapiens
  misc_feature 1..474: note = chr2:176943293-176943767
  misc_feature 1..474: note = hyper
  source 1..474: mol_type = genomic DNA
taccaaaatgaaaatcggcaattgagatgataagaacgtggctttcttctgcgaaatcacttcaggtaacagagataacattaaataacatacattctatgcaccaagaacaatgttttatgtaccgagtctcttatccgtctctcctaatgacttcccttagcgggttgttagtacttgacagcaggtctccgtgcggggaacttttctccaattccacattcaaaggaggtccatcagagagcatgattggcaattttcgtcataatctgcacattattagcatcaaacttgacgtggcagttaacactagtgggttttgatgtacctttcttcaagttcaaggaaacccctccagtagccgggttggcagagcgggtctcagcaacccagcggtggctttgcagaggcgaaggcgcaatagacatgcgtgagaaatatgccaagaaccatttcacccgaggaaaaggaaag

SEQ ID NO: 27693 - DNA, 59 bp, Homo sapiens
  misc_feature 1..59: note = chr2:176944083-176944142
  misc_feature 1..59: note = hyper
  source 1..59: mol_type = genomic DNA
ggaccgaaaaggaggcggcgcaacggccaccccttccagcacctcggctttgtccttcc

SEQ ID NO: 27694 - DNA, 59 bp, Homo sapiens; identical to SEQ ID NO: 240
  misc_feature 1..59: note = chr2:176944346-176944405
  misc_feature 1..59: note = hyper
  source 1..59: mol_type = genomic DNA

SEQ ID NO: 27695 - DNA, 391 bp, Homo sapiens; identical to SEQ ID NO: 241
  misc_feature 1..391: note = chr2:176944456-176944847
  misc_feature 1..391: note = hyper
  source 1..391: mol_type = genomic DNA

SEQ ID NO: 27696 - DNA, 132 bp, Homo sapiens; identical to SEQ ID NO: 242
  misc_feature 1..132: note = chr2:176945137-176945269
  misc_feature 1..132: note = hyper
  source 1..132: mol_type = genomic DNA

SEQ ID NO: 27697 - DNA, 765 bp, Homo sapiens
  misc_feature 1..765: note = chr2:176945581-176946346
  misc_feature 1..765: note = hyper
  source 1..765: mol_type = genomic DNA
cgccgcagcctgggttagggagcgccccgtgttcccagctcctgtcccaggacctctgccccttccggacctctgaatggcttggtctacttctctccgaccaagcccaaccccgagtaccctgtggtctcccagctgggaaagtgtggacggcagtgtgtggaccgccgtgggcacaccgtcctcaacgaagagggtcctctcccccgcgtccggctgctgctgctcctcaggcttttattcccttacttcttgctgcacttttttgtcccaatccaacctttcctctccctcccgccacccaccagtgccggtctcgctgagcacccgtctctcaatcccaggatttgtacggggattctgggcagcctttgaagagaggctgccgctcagcttttctgagaggtcgccgcgcgaagtcttgagccctccgaactgcaaggacctgcccctaggggcacgggtccgattttgatattgaagggatgattttgttggaatcgtttgccttaaatgagtgggtagagcaatgtctccataaacggggaaggggacgtttccacccctcccaacactatctaataaagacatcattcgtcacaactctaaattaaagaaagcccgatcaaaccagagggagacttccacactcctcccctaccccgtggagattttttcttttttctgcagtgtcgaacgctccatgaagggctcaccaaatcgcctaacctcccggctatctctcccagacgtataataaaatta

SEQ ID NO: 27698 - DNA, 186 bp, Homo sapiens
  misc_feature 1..186: note = chr2:176946682-176946868
  misc_feature 1..186: note = hyper
  source 1..186: mol_type = genomic DNA
attggagtcaccattcgggggccttcttagatccgtcaggccggacaaccgttcggattcggtggccgggaaataaataagccaattcctttggtgactaccccccgcggatttccagacccttagctaaatctagccacccagaaaggggaaaggggaaaaagaaacaatcaacccagatgcccc

SEQ ID NO: 27699 - DNA, 52 bp, Homo sapiens
  misc_feature 1..52: note = chr2:176947284-176947336
  misc_feature 1..52: note = hyper
  source 1..52: mol_type = genomic DNA
ggaattgatggggtctgtcatgcttacaaattgctgccgttaatggaatcaa

SEQ ID NO: 27700 - DNA, 177 bp, Homo sapiens
  misc_feature 1..177: note = chr2:176947763-176947940
  misc_feature 1..177: note = hyper
  source 1..177: mol_type = genomic DNA
cggctgctgactaggggtctaccggctcgctcgggctcttagacacgagcgcagaaacattttctcggactcaggagcgagggcgggtgggcctggtgttccaggctccgcaggcctgagcctggcgggaaagctcaaggagcagaactggaaggcacggtcccagacatgcgtccc

SEQ ID NO: 27701 - DNA, 74 bp, Homo sapiens
  misc_feature 1..74: note = chr2:176947941-176948015
  misc_feature 1..74: note = hyper
  source 1..74: mol_type = genomic DNA
cccccgcccgtgctagctcggtgtagcttgcctgtggagggtctgagaggggaaaaggcaccgggaaaggctgg

SEQ ID NO: 27702 - DNA, 476 bp, Homo sapiens
  misc_feature 1..476: note = chr2:176948599-176949075
  misc_feature 1..476: note = hyper
  source 1..476: mol_type = genomic DNA
tctaaatattattatcgctttcggagggaggcggaaaaattgtgggatgccagagcgagggaatgactggtcaaaatgacccatacatccttccgatcccgagatgtcattcatcaaaaagtagcgcccgctcgtcattaaggtacgaatgacgctgttcgaataatcatttattgtaacaggtttataagcaaataaatacaccctcctgtcagtgggtaatgaaggcagcttcagagcagacaaatagatccaggtaggaggcgagaagagacaagtgaggaggaaggctccggtcctttgcccgctccgagccagttctgctcgcccgggggtttggcctcgggggtgaaattgacagtctgattaatagagcgcgccgcggcacatttcccccttcatttaggggcatcattacgctctcagtttgctaggttgccccttaggtcctaatcatgcagcgccttcttcatttt

SEQ ID NO: 27703 - DNA, 46 bp, Homo sapiens
  misc_feature 1..46: note = chr2:176949372-176949418
  misc_feature 1..46: note = hyper
  source 1..46: mol_type = genomic DNA
gctctcctcccaccccgggagagagagagagcggaagagagggaga

SEQ ID NO: 27704 - DNA, 321 bp, Homo sapiens
  misc_feature 1..321: note = chr2:176949681-176950002
  misc_feature 1..321: note = hyper
  source 1..321: mol_type = genomic DNA
tttcctgaggggaaacgaactaggctggacgatttgatagcagaattcgacagctaactttaaacacagtggagatttacagcgccatacgggcgctccgaatccacgctcacgttgccagattttcccctccctcctcaaatagaattatttgcggcaaaggcgctggatttcgaggtcaaaagaggaaagaggagacagccttcttcccctacctccccgctgccctcccttcccctttgcttttcttccttctctctttcctcccctcatcaaccccagccccttacctgcggccacaggtattcccagcgttgggtc

SEQ ID NO: 27705 - DNA, 190 bp, Homo sapiens
  misc_feature 1..190: note = chr2:176950074-176950264
  misc_feature 1..190: note = hyper
  source 1..190: mol_type = genomic DNA
cgacaactttgatagtcataatgacgccggtggcaaccattttaacgaagatcaatcttcactccaggccgctcctcatctcccgcggttgcgcccacccttccctgaccctccaagcactgtgcccacccgccaacggcccagccggagagagattcgcggacacaggcggaggcgagggaggacgggg

SEQ ID NO: 27706 - DNA, 352 bp, Homo sapiens
  misc_feature 1..352: note = chr2:176952741-176953093
  misc_feature 1..352: note = hyper
  source 1..352: mol_type = genomic DNA
aagccccgcgtctgccgctgccggagcctggctctcctcttacgcggggggctgcgggcaattggggccgacaacttgcggtcccgccttgggacgcatgcttgctcgagagctggggctgcagggtgcagtgggacagtaggaccgcgaaagcctgggcttcgagcctcgggctccctgtcttcaggcgaagtgcggtttccacgggtgcaggtttcgctgcataagggaagactcagatttcgagccctcggcaggccagcttctagctctctgtcccttccgggtctctccggttgcttctgtctttcctcctcccactcccgtcgcaatcccgcgccccacggaggaa

SEQ ID NO: 27707 - DNA, 487 bp, Homo sapiens
  misc_feature 1..487: note = chr2:176956928-176957415
  misc_feature 1..487: note = hyper
  source 1..487: mol_type = genomic DNA
agctcactcggatttggggtctagaagtcgactaactgagggattcagcaacaggataaaaaaatgggcctgttttcacatcattctgatcatctctgtccttcgtcttcattttgctgtgcaactcggggagccgaggagaggtggcaaaaacagcggttgccgagacaaggcgcaggccttggcgcccgcctcagtcgcagacagggcctgggatgggccgtcgcgcaatcaactcgtgggggtggctgcagcgcgtacgcctgggtcgggggggagggcgggaatgggaggtggaccctgcaaggggcaggagaggggtgggggccggagtgggtgggtccagccaggcctgggccgggagccaggctcccccgcgttcctacccccacgtggccgcgcgcagccaatggcacgcccccggcgggggccctcggggcgggaggcggccccccgaccggcccaggccccctcccaacctgaactt

SEQ ID NO: 27708 - DNA, 53 bp, Homo sapiens; identical to SEQ ID NO: 245
  misc_feature 1..53: note = chr2:176957576-176957629
  misc_feature 1..53: note = hyper
  source 1..53: mol_type = genomic DNA

SEQ ID NO: 27709 - DNA, 529 bp, Homo sapiens
  misc_feature 1..529: note = chr2:176957914-176958443
  misc_feature 1..529: note = hyper
  source 1..529: mol_type = genomic DNA
ggaggctcccccagccaaagagtgcccagcacccacgcctgcagcggccgctgcagcgcccccgagcgctccagcgctgggctacggctaccacttcggcaacggctactacagctgccgtatgtcgcacggcgtgggcttacagcagaatgcgctcaagtcatcgccgcacgcctcgctgggaggctttcccgtggagaagtacatggacgtgtcaggcctggcgagcagcagcgtaccggccaacgaggtgccagcgcgagccaaggaggtatccttctaccagggctatacgagcccttaccagcacgtgcccggctatatcgacatggtgtccactttcggctccggggagcctcggcacgaggcctacatctccatggaggggtaccagtcctggacgctggctaacgggtggaacagccaggtgtactgcaccaaggaccagccacaggggtcccacttttggaaatcttcctttccaggtaggggcgatggagaaaagggaccgacacgagggagggggaga

SEQ ID NO: 27710 - DNA, 363 bp, Homo sapiens
  misc_feature 1..363: note = chr2:176959148-176959511
  misc_feature 1..363: note = hyper
  source 1..363: mol_type = genomic DNA
ctcagctaggtgctccgaatatcccagcctaatttttcttgtgcttttgtttgtatcaggggatgtggctctaaatcagccggacatgtgcgtctaccgaagagggaggaagaagagagtgccttacaccaaactgcagcttaaagaactggagaacgagtatgccattaacaaattcattaacaaggacaagcggcggcgtatctcggctgctacgaacctatctgagagacaagtgaccatttggtttcagaaccgaagagtgaaggacaagaaaattgtctccaagctcaaagatactgtctcctgatgtggtccaggttggccacagacagcttagaagccattcggttgtctccaaaa

SEQ ID NO: 27711 - DNA, 65 bp, Homo sapiens
  misc_feature 1..65: note = chr2:176963189-176963254
  misc_feature 1..65: note = hyper
  source 1..65: mol_type = genomic DNA
agccacccaattggtcgccataactcacacaataaagtggcagcgcggcggtcagtcttgccctc

SEQ ID NO: 27712 - DNA, 376 bp, Homo sapiens
  misc_feature 1..376: note = chr2:176963321-176963697
  misc_feature 1..376: note = hyper
  source 1..376: mol_type = genomic DNA
cgagggtcctgctgcaggctgagactggcgccggtcaccgggtctcccagggtcttgggatcagaggcaggaggggaggacccctagtcctctggccggactaggcaagagggccagcgacggggtctgagcacaccgctcccggctaagaactgctgcctttcccacttccctgtttgtcagacccgtgaactccctatccccggcacccctgggggcgctgaggcaaggaactctgctagccagctgcctccgaacgcccgctgttccccggccaggtggttctggctcttctgcctttccacacccagtcgggggagttcgtcctgctttgccctccacttggtggatggggacacctcggagttctggtttg

SEQ ID NO: 27713 - DNA, 33 bp, Homo sapiens
  misc_feature 1..33: note = chr2:176964082-176964115
  misc_feature 1..33: note = hyper
  source 1..33: mol_type = genomic DNA
ggataagtcgagaggcgccggttaatggaaaat

SEQ ID NO: 27714 - DNA, 253 bp, Homo sapiens
  misc_feature 1..253: note = chr2:176964389-176964642
  misc_feature 1..253: note = hyper
  source 1..253: mol_type = genomic DNA
cggggggatgtaggcggtgctgaaatgaccggctttgaagaacctgcaggcaaagtttcgtccaatcgtctgagcctgtcctcttattcccggttgtaactaaatactgttgcgagcgcagccgaagccctttgttggagatgtgtgagcgcagtctctacagagcgggctatgtgggctcgcttctgaatctgcagtcgccagactctttctacttctccaacctgaggccgaatggcggccagttggccgc

SEQ ID NO: 27715 - DNA, 36 bp, Homo sapiens; identical to SEQ ID NO: 6538
  misc_feature 1..36: note = chr2:176965474-176965510
  misc_feature 1..36: note = hyper
  source 1..36: mol_type = genomic DNA

SEQ ID NO: 27716 - DNA, 358 bp, Homo sapiens
  misc_feature 1..358: note = chr2:176969256-176969614
  misc_feature 1..358: note = hyper
  source 1..358: mol_type = genomic DNA
cggagcggctggctgcgccccgaaggcctggtgcgctccctgcgtttcgggtggggccgcgcaggcaaggacaaggccacagagtcggggtcttcacggtaggttctcgagcgggacgcgcgggtccggaggctgcggttttccctgggtttggggaatgggggtaggaactaggagggagctggggccaaagagccaagcgggctgggactggaatgaaagcgctctgggttgtggagtgggtcggggggcaagggtccgcgctaaggagccgaaaggggccggccgcccccttcccctatgcaccggcgcgccactgcagatggctcaccctcccccgccaaatcgctgctcccgc

SEQ ID NO: 27717 - DNA, 181 bp, Homo sapiens
  misc_feature 1..181: note = chr2:176969676-176969857
  misc_feature 1..181: note = hyper
  source 1..181: mol_type = genomic DNA
cggtcagcaggctccatactgggggcgccgggctgcctgcaccccaccccgtgccgccagtagagagaaggtgcgagaattttgcgaatccccagacacataaagacccgggttgaagtcctcgcagctgccctgggtcctgagctaccgcagggccagtgtgcagcgtccagggagccat

SEQ ID NO: 27718 - DNA, 68 bp, Homo sapiens
  misc_feature 1..68: note = chr2:176970219-176970287
  misc_feature 1..68: note = hyper
  source 1..68: mol_type = genomic DNA
ctctgtctgtccgcacggtgggcagagcgcacagcaccggcactgcagcagcccgggccagggaggga

SEQ ID NO: 27719 - DNA, 30 bp, Homo sapiens
  misc_feature 1..30: note = chr2:176970603-176970633
  misc_feature 1..30: note = hyper
  source 1..30: mol_type = genomic DNA
gagggagtcaggctccgctgagagccctta

SEQ ID NO: 27720 - DNA, 95 bp, Homo sapiens
  misc_feature 1..95: note = chr2:176971337-176971432
  misc_feature 1..95: note = hyper
  source 1..95: mol_type = genomic DNA
tcactccactctgaacgcgctgggcagaaaaatatgtaaatcagggctccctgcgccctggagagtggcgaaattactcccgcccggtgaacaag

SEQ ID NO: 27721 - DNA, 216 bp, Homo sapiens
  misc_feature 1..216: note = chr2:176972742-176972958
  misc_feature 1..216: note = hyper
  source 1..216: mol_type = genomic DNA
cgggggcagtccctgcaccaaggcgacccctggctcggagcccaagggggcagcagaaggcagcggtggcgacggcgagggccccccgggagaggcgggggccgagaagagcagcagcgcaggtaggcaccgggtactgggcaagcggtgggcccgggggccgcgggggagggggggggggcggaggcctccctctgcttgcgcctttttatgtgc

SEQ ID NO: 27722 - DNA, 30 bp, Homo sapiens
  misc_feature 1..30: note = chr2:176974082-176974112
  misc_feature 1..30: note = hyper
  source 1..30: mol_type = genomic DNA
aatggtaaatgcaaacgtcccgttacaatt

SEQ ID NO: 27723 - DNA, 123 bp, Homo sapiens
  misc_feature 1..123: note = chr2:176976065-176976188
  misc_feature 1..123: note = hyper
  source 1..123: mol_type = genomic DNA
ccacccaaggcaagccgaacccgagataccattttccgtttgcaggggcctggagatccacacgagggcgcgctcacgttccagaagccgcgtttgaccaagaggccgcggtaccttgtctgt

SEQ ID NO: 27724 - DNA, 188 bp, Homo sapiens
  misc_feature 1..188: note = chr2:176980750-176980938
  misc_feature 1..188: note = hyper
  source 1..188: mol_type = genomic DNA
ggttcctctgagagccgaagcctcgtgtagccctccggggcgcataggaacccggagccaggcaggaggaccgagcgggaggacaacgcagggaccaacccatccatggggatccgggcccggccagctgcttggcctcccggccctcgcggccctttttgcctccgccctcctagagacaccttggc

SEQ ID NO: 27725 - DNA, 130 bp, Homo sapiens; identical to SEQ ID NO: 249
  misc_feature 1..130: note = chr2:176981376-176981506
  misc_feature 1..130: note = hyper
  source 1..130: mol_type = genomic DNA

SEQ ID NO: 27726 - DNA, 110 bp, Homo sapiens
  misc_feature 1..110: note = chr2:176982517-176982627
  misc_feature 1..110: note = hyper
  source 1..110: mol_type = genomic DNA
cgcccgggcagaggaaaagcttgccggttttatttttcctgagctagacctgaacacaacaaaagagcgcaaaggagacctgcggctcataaacacgaccacagagcctc

SEQ ID NO: 27727 - DNA, 30 bp, Homo sapiens; identical to SEQ ID NO: 6548
  misc_feature 1..30: note = chr2:176983753-176983783
  misc_feature 1..30: note = hyper
  source 1..30: mol_type = genomic DNA

SEQ ID NO: 27728 - DNA, 504 bp, Homo sapiens; identical to SEQ ID NO: 2125
  misc_feature 1..504: note = chr2:176986711-176987215
  misc_feature 1..504: note = hyper
  source 1..504: mol_type = genomic DNA

SEQ ID NO: 27729 - DNA, 916 bp, Homo sapiens
  misc_feature 1..916: note = chr2:176993464-176994380
  misc_feature 1..916: note = hyper
  source 1..916: mol_type = genomic DNA
gctttgggaaaaattcgtaactttgaggcctgcgcgctctctcggcagtaatttcacaggcttggcggaggaagtaggatcgttagcataagatgggccgcctgcagctgcctggaaccggcgcgatctgaacgccggctgggaggctcctggggggaacttgcggtcgtctgccctccgcactcctccgggaaccgcagccggccctggttcgctgcgcgccggggctgagacccgggagccgcgtcctgcccgaggaaatgtcaccctccccagcgcgagccctttttcccgcctcagaacgtttctgtccgctcttctatttactctctcagcaagcctaatgccccctcctgcattcttcagcctccccctgcgcccagggctgacgtctatcaagggtgaaatgatggaaactatattcatgggcatgatttccattaaatatcaattaacctgagagcctcggccaggcttgcggtgcgtcaagggtaaatgtacatctcatttccacagggcccgctcggctggaaaagaaaggctttgatttgctttgataacgccaggatctggggccacactcgcggcttttaattaaaccacttcgatatgccccaactcaaatgcacggtccggtccgtcaacacctcttgtccacgttccctgggctgcacccgcgtgtccagagctgcaaaagccacgggcaacctctgcttttgcagccaggggctcggggaggcagtcatttgctccgcagcctcctgggagtggcctccttggctcccccaagtctaaggctccgccgcggcccctccctgccggctgcgatccgcattcccgcggccccggggcacacggagcccttggcagtgcgtctttatgggccccctttaaggccggcggaggcatctcgggc

SEQ ID NO: 27730 - DNA, 103 bp, Homo sapiens
  misc_feature 1..103: note = chr2:176994497-176994600
  misc_feature 1..103: note = hyper
  source 1..103: mol_type = genomic DNA
cgccggtgcgcaccgggtcggcagcctcggcggcgggggcgagattggcgggaggggggcgcggggggggcgcggtaagaggtggcggcgggcagagggtgtt

SEQ ID NO: 27731 - DNA, 44 bp, Homo sapiens
  misc_feature 1..44: note = chr2:176995072-176995116
  misc_feature 1..44: note = hyper
  source 1..44: mol_type = genomic DNA
ggccgccgccgctgacgccccaatgagttcgtacttcgtgaacc

SEQ ID NO: 27732 - DNA, 337 bp, Homo sapiens
  misc_feature 1..337: note = chr2:176995331-176995668
  misc_feature 1..337: note = hyper
  source 1..337: mol_type = genomic DNA
gggactgggtgcggcggtagggaaggccggggccaggagtacttccaccccggcgggggcagcccggccgctgcctaccaggccgccccccctcctcctccgcatcctccgcctccgccgccacctcccccctgcggcgggattgcctgtcacggggagcccgcgaagttttacggatacgataacttacagagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccac

SEQ ID NO: 27733 - DNA, 38 bp, Homo sapiens; identical to SEQ ID NO: 6554
  misc_feature 1..38: note = chr2:176996261-176996299
  misc_feature 1..38: note = hyper
  source 1..38: mol_type = genomic DNA

SEQ ID NO: 27734 - DNA, 185 bp, Homo sapiens
  misc_feature 1..185: note = chr2:176997536-176997721
  misc_feature 1..185: note = hyper
  source 1..185: mol_type = genomic DNA
gggttacacacattccgcgctgtttaaaaaaaaaaaaaaaaaggccgcaggggccccttctttttcagagaggactggctagtctatcttgctctaaataatcttgctaagatgctctgagagctttgatcctcttaaaggactcaagttgtaggcccagtgggggacaacgcaaagtccatgtt

SEQ ID NO: 27735 - DNA, 43 bp, Homo sapiens
  misc_feature 1..43: note = chr2:177000770-177000813
  misc_feature 1..43: note = hyper
  source 1..43: mol_type = genomic DNA
ggtagctgtggggatcgcttccccagagcgtgagcagtacatt

SEQ ID NO: 27736 - DNA, 57 bp, Homo sapiens; identical to SEQ ID NO: 250
  misc_feature 1..57: note = chr2:177001206-177001263
  misc_feature 1..57: note = hyper
  source 1..57: mol_type = genomic DNA

SEQ ID NO: 27737 - DNA, 432 bp, Homo sapiens; identical to SEQ ID NO: 251
  misc_feature 1..432: note = chr2:177001264-177001696
  misc_feature 1..432: note = hyper
  source 1..432: mol_type = genomic DNA

SEQ ID NO: 27738 - DNA, 267 bp, Homo sapiens
  misc_feature 1..267: note = chr2:177001781-177002048
  misc_feature 1..267: note = hyper
  source 1..267: mol_type = genomic DNA
cgacccccttgggcagctcagtccggctgctcccctacatttcccggggaagtggggggtcgctgtctaagccccttcccccaatcacttcgttcctagggcgtcccctggggcctggggtggagtccggctgggttcagaagtctaagggggcagtattatttcaaaaattctgagatacgggtagccacagacaggatcccactgcctagatggagagcccctcaatcctaccctaggaaagtgtatagacgggttactactgaa

SEQ ID NO: 27739 - DNA, 320 bp, Homo sapiens
  misc_feature 1..320: note = chr2:177003734-177004054
  misc_feature 1..320: note = hyper
  source 1..320: mol_type = genomic DNA
cgatagcatgtccgggccttggtgacgacgggtcaggccatgaactgggcttgagatctctggcgaggaccaggagaaagacgaagctcgaaattataaatgtggccaagcacgagagctgaaaacaaagcgtattttcccgtcagatgtttctacaaataaatttcgccagagttctgttttctgaatcagagaggcaagggaaatcgaacaaagacagtatttcaccctgggctggcaggcagctgttagaggtatttacggccttgccgcagtgcggcggccaggcagccgggtagggtatgcgggggcaccggaag

SEQ ID NO: 27740 - DNA, 48 bp, Homo sapiens
  misc_feature 1..48: note = chr2:177004450-177004498
  misc_feature 1..48: note = hyper
  source 1..48: mol_type = genomic DNA
ggcgtagaagcagtgcgcggtaccttatccgcactgcgcggtgcaagc

SEQ ID NO: 27741 - DNA, 151 bp, Homo sapiens
  misc_feature 1..151: note = chr2:177004555-177004706
  misc_feature 1..151: note = hyper
  source 1..151: mol_type = genomic DNA
cgcatgtgcagtgaaatggcctagcccgggaattcgatcggcaaagcacgggtgtgggggcgggggggtgggggggggcgagtggactcgagcaggaagatacacccgatctttccattctccctccgtcaaggctcgctactcatcttgc

SEQ ID NO: 27742 - DNA, 697 bp, Homo sapiens
  misc_feature 1..697: note = chr2:177004982-177005679
  misc_feature 1..697: note = hyper
  source 1..697: mol_type = genomic DNA
ttcaggccaatccttcggcctgaccattcccggatcttgttatgccagcacagcacattcgagggctctggggggcagcagctcggcgaagagcagtcaaataaataaataaataaacaaataaatgaacggacatataagggcttttcccgcctgggttcgcttaaataatgggggacaagcgcctctgggccacgagcttgttgtttgtcctgggatggggggtaggggatgagaggtggcctcaggtccctcttgctccttccagccgccccaggggacactgtagaaccagcctctggtgcggggagacctccgcctgccggaggaagtcccagcctcaggtttccggggctggtggtctccctgctctgctgtctggcgcctcgtccaggaggaggcgctgtaggacaagcgtctcgccggctgcggcgggccggggagggcgggagcggagggatcggtacccgctcctcccttcccgcgcactctacctccgcgcgccaagtgtgtggggcctcgaacaagggtcgacggtgctgcgccccgtcccccaaggggttcctttccccagactggcagtggaagcagctccgaggcctgggagcctagggccgttccgggttggcgggccacctcgctttctccgcgctcccggagggggcgcgatttcctcgtgctgcgcttgtaggagcag

SEQ ID NO: 27743 - DNA, 224 bp, Homo sapiens
  misc_feature 1..224: note = chr2:177042579-177042803
  misc_feature 1..224: note = hyper
  source 1..224: mol_type = genomic DNA
ctcctctgcaagggtcgagcggaagagtaggtctggtgagctgagctctagggagctggtaccatcttccctcaatccccctcggttaccccttggggcagcaacgacgccatcccagccccttccagagaacacacaaaggaagccccacccgtccttagacctgaggacacgctcgggagcgggctgacgtggaccccgtttcagggcgccccgggcccctg

SEQ ID NO: 27744 - DNA, 86 bp, Homo sapiens
  misc_feature 1..86: note = chr2:177042913-177042999
  misc_feature 1..86: note = hyper
  source 1..86: mol_type = genomic DNA
cggccaggctgcgggcggggtgggctggcgctcctgatccacctggaacacttttgcaaagacagacggtgagttaatcaccctac

SEQ ID NO: 27745 - DNA, 290 bp, Homo sapiens
  misc_feature 1..290: note = chr2:177043266-177043556
  misc_feature 1..290: note = hyper
  source 1..290: mol_type = genomic DNA
ggcgcctgctggggagctgcgcagccaggacagcggtcggcagcacagggcctgggcgcagggcccgccgtcaccacctcacgtcggaagccagcactgctgcccgccagccctgccgcctgccctcggacttcccagggcgcccagggtcctcccaacgcgcctgcacccacacccgcccctgagccacagtgaccttgcattccccgccccctgccacacctcctgcgtgcccgagtgtcacccttaaataccgctctacacccagagagggacgaatacacctctga

SEQ ID NO: 27746 - DNA, 132 bp, Homo sapiens
  misc_feature 1..132: note = chr2:177052963-177053095
  misc_feature 1..132: note = hyper
  source 1..132: mol_type = genomic DNA
gcagtctccaccggccgcgcgtcacgctcccatttaaccttttccatgccgcgacgcccacactccgccctcgagggactagccccccccacgatccagagcagaagcggctcgccccgctgcatccacggg

SEQ ID NO: 27747 - DNA, 100 bp, Homo sapiens
  misc_feature 1..100: note = chr2:177053335-177053435
  misc_feature 1..100: note = hyper
  source 1..100: mol_type = genomic DNA
ccagcgccacgtggccgcccccgccggtatattaggccactatttacctccggctcactcgccatgggttggagagggcagctcgggtagagagggctgg

SEQ ID NO: 27748 - DNA, 85 bp, Homo sapiens; identical to SEQ ID NO: 6564
  misc_feature 1..85: note = chr2:177053618-177053703
  misc_feature 1..85: note = hyper
  source 1..85: mol_type = genomic DNA

SEQ ID NO: 27749 - DNA, 48 bp, Homo sapiens
  misc_feature 1..48: note = chr2:177053906-177053954
  misc_feature 1..48: note = hyper
  source 1..48: mol_type = genomic DNA
cgacggcgggtctcacgtccactacgccacctcggccgtcttctcggg

SEQ ID NO: 27750 - DNA, 364 bp, Homo sapiens; identical to SEQ ID NO: 254
  misc_feature 1..364: note = chr2:177053999-177054363
  misc_feature 1..364: note = hyper
  source 1..364: mol_type = genomic DNA

SEQ ID NO: 27751 - DNA, 42 bp, Homo sapiens
  misc_feature 1..42: note = chr2:177502246-177502288
  misc_feature 1..42: note = hyper
  source 1..42: mol_type = genomic DNA
cagcaaagcgagggccggctgcaaaggcgcaggctggcagtt

SEQ ID NO: 27752 - DNA, 374 bp, Homo sapiens
  misc_feature 1..374: note = chr2:177502526-177502900
  misc_feature 1..374: note = hyper
  source 1..374: mol_type = genomic DNA
gggaagaggggtccccggggccccggatgcgctgaactccggggaggggatgggcaggagagagagcacactcctggagccgcgacgtccaaacccggacgcacttgaacccgcagcgaggcccgtggctcgcggccttcggagagcacccgcgccccgcgcagaccggacgccggccttgcccgatcctcggcatccttcggcggggcggccagtcccagggcgctcgctgagggccacaccctggccccagagtttagcaccgccgcgggcagggcgctccgctcccggaccccgaatctgaaagcggagaccaagggctgcctgcggcaaagctcgacatacacttgattttcttccgatttggagaaaat

SEQ ID NO: 27753 - DNA, 441 bp, Homo sapiens
  misc_feature 1..441: note = chr2:179278428-179278869
  misc_feature 1..441: note = hyper
  source 1..441: mol_type = genomic DNA
cgctccctctgaattcgccgggcagggatacagccgcccggggcctcttgctcgtgcttggttttccggaccttgcttcctaaagggtctttaggggttcccggactcctccgcctgggagcctctatccgcctgggagcctctatgcgccccgcaaagcccccggcagagccgaggggaggcttcattggcgacctggtggggcctcgcggccctgctccctgacgtcagcgccgccgcggtgatttaacagcttttgttttgggcagaagaacctatgggcacaaaaagcaggaacgagtagcggtggctgaagaacgagcaggagcttgaatttcagttttcttatgaggaattttccagaaaagatatcttcactgtgaaataactaaataaatgcccactcagtacagtaagtattgatatcgtcctatagcattt

SEQ ID NO: 27754 - DNA, 487 bp, Homo sapiens; identical to SEQ ID NO: 6570
  misc_feature 1..487: note = chr2:180725172-180725659
  misc_feature 1..487: note = hyper
  source 1..487: mol_type = genomic DNA

SEQ ID NO: 27755 - DNA, 146 bp, Homo sapiens
  misc_feature 1..146: note = chr2:180725935-180726081
  misc_feature 1..146: note = hyper
  source 1..146: mol_type = genomic DNA
gcgcagacgttctcccgcgatctgctgcagcccaggcggtggcggtggcggtagcagcggcggcggtggaggtggcgcgggcgacagctcggcccggcgcggcccctgaactgtccaactcttgcccgcgccgggcttaagcgccc

SEQ ID NO: 27756 - DNA, 30 bp, Homo sapiens
  misc_feature 1..30: note = chr2:180726333-180726363
  misc_feature 1..30: note = hyper
  source 1..30: mol_type = genomic DNA
cactgcagagcctcccgcagcatcgctgcc

SEQ ID NO: 27757 - DNA, 58 bp, Homo sapiens
  misc_feature 1..58: note = chr2:180726645-180726703
  misc_feature 1..58: note = hyper
  source 1..58: mol_type = genomic DNA
catatttggcggagccgggaaggcccggagcgcaagaaggcatcgcagcctcgcagca

SEQ ID NO: 27758 - DNA, 158 bp, Homo sapiens; identical to SEQ ID NO: 255
  misc_feature 1..158: note = chr2:182321397-182321555
  misc_feature 1..158: note = hyper
  source 1..158: mol_type = genomic DNA

SEQ ID NO: 27759 - DNA, 79 bp, Homo sapiens
  misc_feature 1..79: note = chr2:182321759-182321838
  misc_feature 1..79: note = hyper
  source 1..79: mol_type = genomic DNA
aacgaaagaactggacggctccccgccgcagtcccactccccgagtttgtggctggcatttgggccacgccgggctggg

SEQ ID NO: 27760 - DNA, 154 bp, Homo sapiens; identical to SEQ ID NO: 257
  misc_feature 1..154: note = chr2:182322038-182322192
  misc_feature 1..154: note = hyper
  source 1..154: mol_type = genomic DNA

SEQ ID NO: 27761 - DNA, 643 bp, Homo sapiens
  misc_feature 1..643: note = chr2:182322399-182323042
  misc_feature 1..643: note = hyper
  source 1..643: mol_type = genomic DNA
cgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggtgagtagagttggactgatgcgccctcagcagctcagagcggcgtgagaatggcgccctagggattccctgcccgattcaaactttcctccctcccaaggaggcaggagggaaacgctgcgagagccagctcgctggaaatctgccagggaaactaacttatcttggggcggcagcgccccgggtgcgttatggtgcaaggtcttggagcttcgagtcgggggtggtgggcggaggaggaggtggggaagctgccctgctgcggactgcacatctgtggcgacagggagctcagtgggcagcacagctcacgtctgagcgcacgtgcacgtgtctcgctttaggctcctagtgggtgcgcccactgccaactggctcgccaacgcttcagtgatcaatcccggggcgatttacagatgcaggatcggaaagaatcccggccagacgtgcgaacagctccagct

SEQ ID NO: 27762 - DNA, 242 bp, Homo sapiens
  misc_feature 1..242: note = chr2:182521404-182521646
  misc_feature 1..242: note = hyper
  source 1..242: mol_type = genomic DNA
ggtggagcaaaagctcgtgggtgtaggccttgggccggggagagggaggaagcgcggagggaggcgaagacgcttggggccgggcactcacccgccgggcgctcgggctgaatgggccgccaccgcagtgctcgctcgctcagcaccacgtcacaactgtccctcccgatctcgaagatgccccggagcagaatccgctcggccgccgcctccgtctgctgcggggacgttaacagcgccgg

SEQ ID NO: 27763 - DNA, 37 bp, Homo sapiens
  misc_feature 1..37: note = chr2:182542469-182542506
  misc_feature 1..37: note = hyper
  source 1..37: mol_type = genomic DNA
taagcacagtgggttcgtttcccggaaatggtgaaac

SEQ ID NO: 27764 - DNA, 440 bp, Homo sapiens; identical to SEQ ID NO: 2139
  misc_feature 1..440: note = chr2:182542878-182543318
  misc_feature 1..440: note = hyper
  source 1..440: mol_type = genomic DNA

SEQ ID NO: 27765 - DNA, 344 bp, Homo sapiens
  misc_feature 1..344: note = chr2:182543758-182544102
  misc_feature 1..344: note = hyper
  source 1..344: mol_type = genomic DNA
agtgttttataatggcgcgtgcgtgtgccccgctagtacgtaggagtgaggacaggactgggggagggtagtgaatatgtatatgtgtacaccactcacgcatatgtgtttgtatcctagtgattaacttaaatgtgtttatggtggttgcccgacaggataatgtgtgtggaaatgactgtacatttcagcgacttcatgtttatccaaatgtgttcaaagttactcacaactccataaaaaaaaaaaaaagctgtaaaatcacacattctacttccatttctgtcctggcttccagatacttagcgatttaagttgaacagccattgcgtaatttactaata

SEQ ID NO: 27766 - DNA, 30 bp, Homo sapiens
  misc_feature 1..30: note = chr2:182544495-182544525
  misc_feature 1..30: note = hyper
  source 1..30: mol_type = genomic DNA
caaccgcgaagttgccgcttctagtaagga

SEQ ID NO: 27767 - DNA, 751 bp, Homo sapiens
  misc_feature 1..751: note = chr2:182545197-182545948
  misc_feature 1..751: note = hyper
  source 1..751: mol_type = genomic DNA
cctggggcctccggacgccgcgcctcctgcgtgggcgaattcctcgtgtcgtggccgcgcgggcgctcaggttatatagcccagttagtgatgctaagcgcgggcggggccgctagctgaggggctagcaggtctatgcgcctgacgcctgcgcacgcgtccaggctgtgcgctccccgttctcccctcctccccacttctccccacgccttgctcgtctcccgccctcctccgacaaccgctcccctcaccctccacccctacccccgcccctcctccttcctccccggcatgcgccatatggtcttcccggtccagccaagagcctggaaccacgtgacctgcccatttgtatgccgcggagcgctccattccggcccctttgtggccagaagaaagtggcccatctgtcgccagttagagactccgcggacctgtttttacccgcaggagagattaaccctttcaggcggcagaagggacggggatagaggggggaggggatttgagggaaggaagggaaaagctaatgttaactaggtctagatcagagcgagtggcctgctttcgcgccggaagtaggacagaggtgaaagaggcagaagcggggagactgaggcacgcagtgaagagtcctcgctcctttcgatttcttgtcctgacactggcatccagagcagcatgactccttgccctctctgaaaggcccatcccttggcttcttctccttggcagacgctttgatcattgg

SEQ ID NO: 27768 - DNA, 84 bp, Homo sapiens; identical to SEQ ID NO: 2141
  misc_feature 1..84: note = chr2:182546001-182546085
  misc_feature 1..84: note = hyper
  source 1..84: mol_type = genomic DNA

SEQ ID NO: 27769 - DNA, 147 bp, Homo sapiens
  misc_feature 1..147: note = chr2:182546388-182546535
  misc_feature 1..147: note = hyper
  source 1..147: mol_type = genomic DNA
gttccctggccagcccgccctggacggcctcggctctctagtccaggcattgaccacaagtacggtggtggacacctcgccacagccggacctgcgctcttgctcccctcagtctcgggtctgtataagatacttgattcagacaag

SEQ ID NO: 27770 - DNA, 189 bp, Homo sapiens
  misc_feature 1..189: note = chr2:182547199-182547388
  misc_feature 1..189: note = hyper
  source 1..189: mol_type = genomic DNA
acttggctgacaaagcgcataggggaggataaaataattcacccaggagcctgggcccaggatttacccctgtactgtctgtatcttcagtgttgggctaaaactcgagggcgtcggagtactagcccttagaagatagtacacagcccgacgtttgcggcagggccaggttaagtactgcccctcacc

SEQ ID NO: 27771 - DNA, 495 bp, Homo sapiens; identical to SEQ ID NO: 259
  misc_feature 1..495: note = chr2:182547437-182547932
  misc_feature 1..495: note = hyper
  source 1..495: mol_type = genomic DNA

SEQ ID NO: 27772 - DNA, 100 bp, Homo sapiens; identical to SEQ ID NO: 260
  misc_feature 1..100: note = chr2:182548061-182548161
  misc_feature 1..100: note = hyper
  source 1..100: mol_type = genomic DNA

SEQ ID NO: 27773 - DNA, 389 bp, Homo sapiens
  misc_feature 1..389: note = chr2:182548400-182548789
  misc_feature 1..389: note = hyper
  source 1..389: mol_type = genomic DNA
gcgcgcggcgcgggccgggcgtcccggccgttacagcggcagccggagcgcccgcgggaaggggggcgggaggaggcgtgtggccaggggtggggagaggggagtgtggcctgggccgggcggaggggaagggggaggcatgtgggaggatgggggtggggaagggatggaggcgtgtggcccggacgtagggggtgggaagcgtgtggctggaggcgaaagcggggagcgggaggtcgggggcgaagcattcacagggccaagataaagcgcaggggccgggccggcgtccctggcggtgacctgtttctcagggaaacagatgctcgctcttgcaaagggaggtttgcgttcaatgaaaggatcaagtgtggccagggcagcccggc

SEQ ID NO: 27774 - DNA, 207 bp, Homo sapiens
  misc_feature 1..207: note = chr2:182548819-182549026
  misc_feature 1..207: note = hyper
  source 1..207: mol_type = genomic DNA
cgccctgcctaggagtggggtgtcggggcctgggcgcgggagagcggagtgagggggccgggtggctgaggggcccgcgagaccgtggggctcaggggccgcaggaacggagggctgagagctgcaggtcctgcacaggctgggtagctcggaggctcttgagagcttcgggggatgaaggggggttgatgcgggttctgaccagac

SEQ ID NO: 27775 - DNA, 508 bp, Homo sapiens
  misc_feature 1..508: note = chr2:182549037-182549545
  misc_feature 1..508: note = hyper
  source 1..508: mol_type = genomic DNA
cgcctccgccccgggggaggcagttgggctcccgggtcctggcctgaggctggagctgcccaggctcgacaggcaggcgacccgggagagccaagagcaacgagagacgctattaaaatgcctcgccgtcgccccgagcgcaaaacccatcctccccaaatctcctgggcttgcggcataatcttaattaagataattgattcatattgcacctgcgagaacggaaaaaattgatttcaacccccaaccccacaaatcgcttagagctattggatggagcacgacgcgactgtgatttagggagtgatttagtgccgggcttccccagctcggcctgcctgggcctttttatttattatttatgccctcccggtcccgacggggctttggtggctcctttgtcggctcccacaggccttggaaggacttgtctctgattccctgtcaggatccaggggctttccttaaaccatccaacactcagaatcaacaacgtaaaatcaactca

SEQ ID NO: 27776 - DNA, 131 bp, Homo sapiens
  misc_feature 1..131: note = chr2:182549876-182550007
  misc_feature 1..131: note = hyper
  source 1..131: mol_type = genomic DNA
cgcacacctgtttcccggggatcgaggaacagcttgctgtccaaaggggatcgcagggccagggaactgacaagcacacgctatttgccaacctttgccttaatagaaagaagcaagcaaacaaaaatcct

SEQ ID NO: 27777 - DNA, 71 bp, Homo sapiens
  misc_feature 1..71: note = chr2:182550053-182550124
  misc_feature 1..71: note = hyper
  source 1..71: mol_type = genomic DNA
cggcgccggagcgtcgcaagaacaatggttgctgcagtgggttgggagagaggacccggacaagttcctaa

SEQ ID NO: 27778 - DNA, 319 bp, Homo sapiens
  misc_feature 1..319: note = chr2:182819030-182819349
  misc_feature 1..319: note = hyper
  source 1..319: mol_type = genomic DNA
gcgcgcacacacacacaccccaccccaccaccccgacctccacatacattcccccgaccccctccagcagtgaagtctaagagcaccgcgaagtaatttaaattttcgagggaaagcacagcgccatctgtcggacatcatgccaattactcttgttaagttcctacctgacggttactttatactttgaactgctaggtactccttttggcctaaggacacagtgaaaaatgtaccgagaccttggagagccacgaaccaagaaacttcagaaacctctgatatctgatcaagagttaagagacgtcagaatcatcac

SEQ ID NO: 27779 - DNA, 159 bp, Homo sapiens
  misc_feature 1..159: note = chr2:183731173-183731332
  misc_feature 1..159: note = hyper
  source 1..159: mol_type = genomic DNA
tcacaggctgcagcccgagccccgggcacccggagcaggcagagagcagccagggcaagcagcccggcccgcagcagcagcatccctcccgggctgccgcagaccatgatcccggcaggatggggcagggtgcagccgcgcagtggacgccaaaaggcc

SEQ ID NO: 27780 - DNA, 640 bp, Homo sapiens; identical to SEQ ID NO: 2146
  misc_feature 1..640: note = chr2:183731466-183732106
  misc_feature 1..640: note = hyper
  source 1..640: mol_type = genomic DNA

SEQ ID NO: 27781 - DNA, 1157 bp, Homo sapiens
  misc_feature 1..1157: note = chr2:185462639-185463796
  misc_feature 1..1157: note = hyper
  source 1..1157: mol_type = genomic DNA
acaactaccctcccccgaaactatcatcaacacaagcacttacggtatctacaaatgtgtgggagcaggggtgggtggggggcatattttctttcctcgcctttccctaagactgaacagggtaccagcctccataccaaacacacattaaataacaaaatcaaataagccaaacccagtggatagcaattatcttgagaaagaagccgctgctggcaccggcctggattcgctgcagtcggaagcgggtggctttcggtattgaattattaatttatttatccccctcgcccccacccccacgccgactgccaggcaagaaatcgcggcctcttcgcttcctctccgcccccaccttccaggagtctcccacttggcggtggccgtcgcgtccccggccctctgcggcagcggcgccgcgcggggcgctcccactcgcgctcgggctggcgcggccgcgggtcccggcggcggggtgggcgggggaggcagcgggtgacagatgtactcctctgacagctctcagtatcagcccagtggctccctgccattggctcagtgcaatggaccggcaacgccgctcactataataacactcatgcctgccagcagcagcaactccgagtgcaggcgccgagcgcgggggatgctgccgccgccgccgcttctgctgccgcgcgggcggctcccgcagccccgctccgcccggccaccgcgcgggcactgactcccgctcggttccgtttcgccggcccggccccctcctaggctggaatcctcccgcggggctcgtcgtcccgacgcgaatctgaggagaaacaggagcgagagactgaggggagagcgcggcgagcatgcggaggcgggggagcctcggcgctcaccacagaggggtgcagtgagccagtctccagaggacgtgccgggggtggctgcgtgccctcgtggcgggttcccagcccaccgtcgccggccccggcgcgctgcggctgtgggcgcggggtgcgtggaagcggcggctgcggcggaggaggcggcggctgccccatggagtgttactacattgtcatcagctccacgcatctcagcaacggacactttcgcaacatcaagggagttttccggggccctctcagcaagaacgggaacaaaactct

SEQ ID NO: 27782 - DNA, 210 bp, Homo sapiens
  misc_feature 1..210: note = chr2:186603443-186603653
  misc_feature 1..210: note = hyper
  source 1..210: mol_type = genomic DNA
ccctcaggaggccaccgcccttctggggccgctaccattggaagcctggaacgcggggggcggggctgaggtcgttgggctctggccattcctggtcaggtccggacagagggacaacggggtgctagagaaggagagcggggcgggtgaggaaggggctgagggggctgtgccggccatggagctgtacctcggcgcctgctccaagcc

SEQ ID NO: 27783 - DNA, 210 bp, Homo sapiens
  misc_feature 1..210: note = chr2:189156634-189156844
  misc_feature 1..210: note = hyper
  source 1..210: mol_type = genomic DNA
ccgcgtcccagctgccgccagcgccagttttggattcggcggattaggaagaggagggaggggggagagagcgcgaagagggaggggaccgaagctggagggtcccgagtccagcgccgtgttggcgtagagaaactttccctctcggcctcggagacggcgccccggccgtgccggagtggagatcgccaggctcggaggaaccggcag

SEQ ID NO: 27784 - DNA, 75 bp, Homo sapiens
  misc_feature 1..75: note = chr2:190445180-190445255
  misc_feature 1..75: note = hyper
  source 1..75: mol_type = genomic DNA
ggtcatgacactaggcgaccccgctggctcttctgcggctgctatcgctgctgctgctctcgctgaggtgcttgt

SEQ ID NO: 27785 - DNA, 61 bp, Homo sapiens
  misc_feature 1..61: note = chr2:191045133-191045194
  misc_feature 1..61: note = hyper
  source 1..61: mol_type = genomic DNA
gagctcaggagagttcgcagcccagggggccgagaccaggggcagggccagcgaaatgcct

SEQ ID NO: 27786 - DNA, 32 bp, Homo sapiens
  misc_feature 1..32: note = chr2:192015371-192015403
  misc_feature 1..32: note = hyper
  source 1..32: mol_type = genomic DNA
ctcactttcagcctccgcgaggacacacctcc

SEQ ID NO: 27787 - DNA, 307 bp, Homo sapiens
  misc_feature 1..307: note = chr2:193059011-193059318
  misc_feature 1..307: note = hyper
  source 1..307: mol_type = genomic DNA
ggtctgtgctggatacgcgtgttcttctgcggagttaaagggtcggggacgggggttctggacttaccagagcaattccagccggtgggcgtttggcagtcacttaaggaggtagggaaagcagcgagcttcaccgggcgggctacgatgagtagcatgacgggcagcagcagcagccagcaaaagccctcgcaaagtgtccagctgctgcactgccgcggggactcccacagcaccatgactagttcgtgcaactctgcagcagcaaacggcttccgaggaacacaggatcgcgggggccgggcag

SEQ ID NO: 27788 - DNA, 205 bp, Homo sapiens
  misc_feature 1..205: note = chr2:193059344-193059549
  misc_feature 1..205: note = hyper
  source 1..205: mol_type = genomic DNA
cggcagcagaggcggcggcggtggcagtggcacccggcggggaagcagcagccaaacccgcgcatgatctcgagagtttcagcaacatccagggactgggctcagccccggagcgagagggtcgtccgctgagaagctgcgccggagacgcgggaagctgctgccataaggagggagctctgggaagccggaggacaggaggaga

SEQ ID NO: 27789 - DNA, 56 bp, Homo sapiens
  misc_feature 1..56: note = chr2:193059661-193059717
  misc_feature 1..56: note = hyper
  source 1..56: mol_type = genomic DNA
cgtttgggaagcagcaggtcctcagcccgcccggggtcacgtgggaagaggcagtc

SEQ ID NO: 27790 - DNA, 1228 bp, Homo sapiens
  misc_feature 1..1228: note = chr2:193059718-193060946
  misc_feature 1..1228: note = hyper
  source 1..1228: mol_type = genomic DNA
ggctctgattggtggagcaggatgcaggtcccgggagggaggggtcgacgaggaggtgcaaggatgcaaggaggaggcggccgcggaagccacagatgggctcgctcgccaggcgctggcccgagtggggctaggcggggatggctcaaatgagaagctcgggcttcagggtgggctacccgcacactcatataccattcgcctcactctccgctccaggacgccccctaccgaaggcggggtccggactagcgcccctcttccgcgcgtgaccccgggccgcgagtgcgggccgcggctgggtggcgtctctccgagctggagatggtgggggcggaggtgtcagaggagcagcagcagcagggcagagaggggcgagtcggcgcgggagagggcgtcctgctggcgaccggcgctccagcgtgcgggagcgcgccgcctaggctgtagggggatgcaggctgggaatgtcgcggcggagaggccagggacgtttctctagggatttacaggaaagagggtgagaggcgatggtgttagaaccgctcttgccgacctggaagcaacagcagcatctcccacaagagcgtgcaaccccaaggctgctcgccgaggcagctcagccatcccggcaggcgctctccttccttctctcttctcccctctctcctcccaggccccccgcagctccgacccagcccaagcgttcgcaggtttgaatccctctcctcatcacccgctcctctccagcccgtagcctattagtgtgtccacctgggaggtgcggtcagatgtgtttggaaggtcagattggtcgggacaagtggtctgagagaaagagaaaggctcctctgcatacgccgcgggtgggttgccgggagcatcggccgggcagcggcgtccgggaaggggagagcgggctccatttgttggcccaggcagtgaccctgcgttccttactcgggtctttgccggatggccggtgacctggggcgacgagagaaggtctaactcggcaggagtctctggctctgcgcgtttctttcattctctccagcgggaagggcaaacggcatagcgggacccgccttccgtctgctgcattcttcaggcagttagacacactctttagcctaatggaattttagtcgccagtaacgggaccaagagctttcggggacaagggtggagaggaacatctttcttccatgaccggggtcactattgc

SEQ ID NO: 27791 - DNA, 1078 bp, Homo sapiens
  misc_feature 1..1078: note = chr2:197457183-197458261
  misc_feature 1..1078: note = hyper
  source 1..1078: mol_type = genomic DNA
agacctctgcagtctcgcgtcctcggaaacgtctacgtctaaatctgcagccccagtttgctccaggccccaagctccagcagaggatgttcacggcacattcccaaccaaaaaggaaatgaagcgtcctctccctcaactgatgctcaaatagaccccaaagtcccagtttccctggagaaccaaaccatccaacacatcctgggcagcggaaaccgaaatggcaaatgaatgaccgcgccggggcgcaagggaggaaaaacaaagccacctcccgccgtccgctacctgcggcgagggccgcgcgctcacctgggctttgcgcccgtcgccacaagctgcgggtggggacccggccgcggggcgggagggcgcccccaaagtcgcccggacccgcggccccggcgccctgcggccggtccgtgcgcgccgaggagaaagcaggcggccgggggcgccgccgcgcgttgcatgcagctcacggctgctgcggccgctgccacggagccgagagtctctgcgctgcagtccccgaccccgagaccgcgagaagcgcccggagagacgcggcgcaggggcagagcgcgctcggcgcgcccctcagcggctcttcccgccgccctccgcagcgggctgggtctcggctcgcctttgtgctggcatcttcctagctcccagcgacacccagagctctcgaggcggctccgcgccgccacccacccccgggttacgccacggcccccgcgcgacccgccgattgtgtcgagtcagcagcggcagcggggacgcgcgaagccatggctcccgcccgcgctcgggagggcgccgggggtcctgcgcctccgggaggtttgtggccgagcgcggcgcggccccgagcggccccgcagcgcccggctccccgccgctcgctctccaggcgccgacccgcctgcgtcgccaccctctcgccgctccctgccgccaccttcctcccgcccgggtgccgggcgtccgctccagccgcggtgccccggtccgcggagagcgaagagtccggcctcctcacctccagccgcgccggcgcccttcccgctag

SEQ ID NO: 27792 - DNA, 90 bp, Homo sapiens
  misc_feature 1..90: note = chr2:198651504-198651594
  misc_feature 1..90: note = hyper
  source 1..90: mol_type = genomic DNA
agcgggtcccggccccgctgagcacctccagcagtggcacagcctctggaggggtccgggacgaagccacccgcgcggtagggggcgact

SEQ ID NO: 27793 - DNA, 35 bp, Homo sapiens
  misc_feature 1..35: note = chr2:198670222-198670257
  misc_feature 1..35: note = hyper
  source 1..35: mol_type = genomic DNA
ctcagctgtcagccacgagacgcacaagtgacttt

SEQ ID NO: 27794 - DNA, 60 bp, Homo sapiens
  misc_feature 1..60: note = chr2:200321938-200321998
  misc_feature 1..60: note = hyper
  source 1..60: mol_type = genomic DNA
tccgcctgcattccccgacttcgcggtccgagaggccgagagcggcggggaggggacttc

SEQ ID NO: 27795 - DNA, 29 bp, Homo sapiens
  misc_feature 1..29: note = chr2:200327423-200327452
  misc_feature 1..29: note = hyper
  source 1..29: mol_type = genomic DNA
ggaggtagagactgtggaggtcctcctcc

SEQ ID NO: 27796 - DNA, 219 bp, Homo sapiens
  misc_feature 1..219: note = chr2:200327575-200327794
  misc_feature 1..219: note = hyper
  source 1..219: mol_type = genomic DNA
cgagggtctggggctagtggggccgaccgttcaggagccgggtgggcgggaagggaattgccaaggtcggcccaggagctgcctcaggcgaggacggggagctttctgcactgggcttcccggggtaggagatgggcgtcgggtgtgggcactgcctgccctgggggaagaaagcgaggagataggtttcagagctgggggagtcgttggtgggagatc

SEQ ID NO: 27797 - DNA, 133 bp, Homo sapiens
  misc_feature 1..133: note = chr2:200328171-200328304
  misc_feature 1..133: note = hyper
  source 1..133: mol_type = genomic DNA
ggcccaaggtggctgcgaagagccccgaggcctcggcttggcgtcaatgtcccgccaccctcgagcccgggtcactgcccgggtcccggcccggagccccagcgtcctctcccgacagcgccaccgcgtgggc

SEQ ID NO: 27798 - DNA, 18 bp, Homo sapiens
  misc_feature 1..18: note = chr2:200328667-200328685
  misc_feature 1..18: note = hyper
  source 1..18: mol_type = genomic DNA
gaggctatgggcccacgc

SEQ ID NO: 27799 - DNA, 365 bp, Homo sapiens; identical to SEQ ID NO: 2153
  misc_feature 1..365: note = chr2:200329029-200329394
  misc_feature 1..365: note = hyper
  source 1..365: mol_type = genomic DNA

SEQ ID NO: 27800 - DNA, 313 bp, Homo sapiens
  misc_feature 1..313: note = chr2:200329432-200329745
  misc_feature 1..313: note = hyper
  source 1..313: mol_type = genomic DNA
cgcctactcccttattattggctgggacctgttcctttccaaagtgtgatgcccggtgtcctaccctaggccacgcggagctctctcccggcgtgtcgggccctgcgcccctgcccagtggctcacctcggctcgctgcgcccgccttcgccccaagtgcccaggacggagcgaggggctgtgggtcggcgcagggacgctggctgctcacctccaggagccgacagaaggtgccttcggcgtcacgcgtccaaccctggggctgatttaaataactaataagctcagagaaattttacgaggggaacttttc

SEQ ID NO: 27801 - DNA, 15 bp, Homo sapiens
  misc_feature 1..15: note = chr2:200333744-200333759
  misc_feature 1..15: note = hyper
  source 1..15: mol_type = genomic DNA
gtctgcgtgcctcac

SEQ ID NO: 27802 - DNA, 34 bp, Homo sapiens
  misc_feature 1..34: note = chr2:200333800-200333834
  misc_feature 1..34: note = hyper
  source 1..34: mol_type = genomic DNA
cgagaaagggcccacatctcgagtctccagtctc

SEQ ID NO: 27803 - DNA, 30 bp, Homo sapiens; identical to SEQ ID NO: 6604
  misc_feature 1..30: note = chr2:200334190-200334220
  misc_feature 1..30: note = hyper
  source 1..30: mol_type = genomic DNA

SEQ ID NO: 27804 - DNA, 184 bp, Homo sapiens
  misc_feature 1..184: note = chr2:200334978-200335162
  misc_feature 1..184: note = hyper
  source 1..184: mol_type = genomic DNA
tcgcagcccctgccgcggaggatccccaggaagatgctggggacgctctgagcatcggcctttctttacccccgactccctggagcttggtctcgggatgccaacttggggcacggaggcgacgggctgctccgaagctggagggtttctgcttgggtcagagggatcacgacctcagcagagc

SEQ ID NO: 27805 - DNA, 15 bp, Homo sapiens
  misc_feature 1..15: note = chr2:200335437-200335452
  misc_feature 1..15: note = hyper
  source 1..15: mol_type = genomic DNA
acaccagtgggtacc

SEQ ID NO: 27806 - DNA, 361 bp, Homo sapiens
  misc_feature 1..361: note = chr2:200335591-200335952
  misc_feature 1..361: note = hyper
  source 1..361: mol_type = genomic DNA
cgtgtaagcaacctcccactttgaaactaattcgcacccgggtctttcaccccaaaggactttgctgcggacgctgctctgacccaagacgcgggagagaagtcccaaaggctacagccaggggctgggggactcctctgctcaccttagtccttgatttcgaaggccccaattaactatctgttgtgtcagaatcggcgagtgcaaagtagctgcgccccgctgacgcgctctctcctgggtccgggtatcccagggcatccggagctggggagggttgtgcggactacccaaggcacgcgcagataccgggcagggaagaagggctccgtgttccaaggatggtcgtttacctctcctg

SEQ ID NO: 27807 - DNA, 82 bp, Homo sapiens; identical to SEQ ID NO: 6607
  misc_feature 1..82: note = chr2:200336264-200336346
  misc_feature 1..82: note = hyper
  source 1..82: mol_type = genomic DNA

SEQ ID NO: 27808 - DNA, 81 bp, Homo sapiens
  misc_feature 1..81: note = chr2:200524136-200524217
  misc_feature 1..81: note = hyper
  source 1..81: mol_type = genomic DNA
attgtgggaacggcccgcggcccgttttcgggaggaggcggagggcgcgaagcgagctggtggatccgtaaagaacccagc

SEQ ID NO: 27809 - DNA, 253 bp, Homo sapiens
  misc_feature 1..253: note = chr2:201450490-201450743
  misc_feature 1..253: note = hyper
  source 1..253: mol_type = genomic DNA
caatgtttgctaagacgcaagagggtgtgacacagacgctaagcgccactggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccccgccccactcggc

SEQ ID NO: 27810 - DNA, 178 bp, Homo sapiens
  misc_feature 1..178: note = chr2:201450744-201450922
  misc_feature 1..178: note = hyper
  source 1..178: mol_type = genomic DNA
ggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgagcgcccgcgggcttcctctgcccccagacctgcggccagggc

SEQ ID NO: 27811 - DNA, 65 bp, Homo sapiens
  misc_feature 1..65: note = chr2:201451013-201451078
  misc_feature 1..65: note = hyper
  source 1..65: mol_type = genomic DNA
cggctttgccttcgcattcccacccctgcctccggggcagctaaaggctgcgttttcagggactg

SEQ ID NO: 27812 - DNA, 253 bp, Homo sapiens
  misc_feature 1..253: note = chr2:202899715-202899968
  misc_feature 1..253: note = hyper
  source 1..253: mol_type = genomic DNA
gccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatg

SEQ ID NO: 27813 - DNA, 30 bp, Homo sapiens
  misc_feature 1..30: note = chr2:206546689-206546719
  misc_feature 1..30: note = hyper
  source 1..30: mol_type = genomic DNA
agctgccgaccggctcgctaccccaaacac

SEQ ID NO: 27814 - DNA, 30 bp, Homo sapiens
  misc_feature 1..30: note = chr2:206550029-206550059
  misc_feature 1..30: note = hyper
  source 1..30: mol_type = genomic DNA
cagctccccaaaatgcgatctcaagccgtg

SEQ ID NO: 27815 - DNA, 429 bp, Homo sapiens
  misc_feature 1..429: note = chr2:206550262-206550691
  misc_feature 1..429: note = hyper
  source 1..429: mol_type = genomic DNA
actgagcaaataacacggcggtcgcggcgcgcggcaccttgggctggcgcgtggctgggaggccgcatgggcgacgcgcaccaggctgcccctctcctcactgcgccgcctcgccagaccgcagtgcagccgctagcctgcctccctccctgccccgggcgcccccgccagtcccctgcgctccgctctgcgcggcaggctcgccgcgacccctagagagacggctttgagtggcgggaggccgaggccggctggcttgggaatccaagcgctggcccaactaggtgagaggaaactggggtgggatttcggagaggagggcggagagaggcgggaaggaaccagcttgagccccaggaatgcgcgcaacttgcacagcctctagaagcgccgcgcgcccagcgcccgccggtgcgcaggaacaggtga

SEQ ID NO: 27816 - DNA, 42 bp, Homo sapiens
  misc_feature 1..42: note = chr2:206550973-206551015
  misc_feature 1..42: note = hyper
  source 1..42: mol_type = genomic DNA
ccagggaaaagcctgcggcatttcttcaacgctgccctatgc

SEQ ID NO: 27817 - DNA, 292 bp, Homo sapiens
  misc_feature 1..292: note = chr2:206551071-206551363
  misc_feature 1..292: note = hyper
  source 1..292: mol_type = genomic DNA
cgccggcgagttcccgcctcccctccccagccgcctcgctctttgcttttccacgtgagaaaaagaaatgttcacggccgatgcttcattttcactgattgatttctttttaatatcaacacaagttaatggaggcaaggcgcgctctgattgaagggctgcccccgcccttcgactcgggctggctgtgccgggggtctttcccaccgggtcgcaggcgtccagcggctgggtggcgggcgccggtagccctagtgtttggaggtgggggagggatttggaatagacttgt

SEQ ID NO: 27818 - DNA, 24 bp, Homo sapiens
  misc_feature 1..24: note = chr2:206551450-206551474
  misc_feature 1..24: note = hyper
  source 1..24: mol_type = genomic DNA
cggcttctgcggctccggctgaat

SEQ ID NO: 27819 - DNA, 105 bp, Homo sapiens
  misc_feature 1..105: note = chr2:207139050-207139155
  misc_feature 1..105: note = hyper
  source 1..105: mol_type = genomic DNA
tagctctcttagccccgttttcttttctacattcatacgttgctttgaattggcaagcagtttttatttggaccctcaaacgctaaaaccttggtctctacttcg

SEQ ID NO: 27820 - DNA, 606 bp, Homo sapiens; identical to SEQ ID NO: 2158
  misc_feature 1..606: note = chr2:207139217-207139823
  misc_feature 1..606: note = hyper
  source 1..606: mol_type = genomic DNA

SEQ ID NO: 27821 - DNA, 120 bp, Homo sapiens
  misc_feature 1..120: note = chr2:207140044-207140164
  misc_feature 1..120: note = hyper
  source 1..120: mol_type = genomic DNA
gggcacctgtggggccgagatcccgagccacctgtccacacacccccttcccccagtgccctgcgttgggtccagctggccccagacctaggcctttcccagcctcgggcgattatagtt

SEQ ID NO: 27822 - DNA, 15 bp, Homo sapiens
  misc_feature 1..15: note = chr2:207307463-207307478
  misc_feature 1..15: note = hyper
  source 1..15: mol_type = genomic DNA
tctgtattgcttccc

SEQ ID NO: 27823 - DNA, 1373 bp, Homo sapiens
  misc_feature 1..1373: note = chr2:207307547-207308920
  misc_feature 1..1373: note = hyper
  source 1..1373: mol_type = genomic DNA
cggcttcttgtgctttcctcaaagaccccaggcaccggcagggaggacacaggccggggcagagcgcccctgcgcgggggattcctgccactccgcgccagcctgcggcgcaaacgctcttctcagccgcagtcccacccgctgctggcaatctgaatgaggagccgcgctatttttacctccccggctgcaatcctttatatttacatgcaggaagcaaatatataagggattaagaaggagatgcgtggccttagtttatccagagcaggaagaggttggaataggagagggtatgtgaagtctggggtggtggaaaaggcaggtggacttcggctggttgttttctcccgatcatccctgtctctggcctggaaacccccgtactctctttcttctggcttatccgtgactgccggctccccctccaccgcccccatcttttgaggtaccacccgtcacctccgatgctgcttgggctgctgcatcactctgctgctttacccccttccccgccccccaacaaagcatgcgcagtgcgttccgggccaggcaacagcagcagcacagcatccagcaacagcatcagcacccgaagccccgctcgggcgcgctctcggggggcggggcgcacgcccgctccgcgcgtccccgcgccgctcgctcccgcgcgtccccgcgccgctcgctcccgcgcgccgcctcagcatcctcaggcccggcggcagcccccgcagtcgctgaagcggccgcgcccgccgggggagggagtagccgctggggaggctccaagttggcggagcggcgaggacccctggactcctctgcgtcccgccccgggagtggctgcgaggctaggcgagccgggaaagggggcgccgcccagccccgagccccgcgccccgtgccccgagcccggagccccctgcccgccgcggcaccatgcgcgccgagccggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcggtgggtatggccccgtgccctttgcgttggctttcccgcggggccctgcagaggaaagcgaagggcgcgcgggtccgtgtgctccgggcttgtccccggctcggcctttccttccc

SEQ ID NO: 27824 - DNA, 30 bp, Homo sapiens
  misc_feature 1..30: note = chr2:207309199-207309229
  misc_feature 1..30: note = hyper
  source 1..30: mol_type = genomic DNA
tgtttcctcaaatttcgtatccggcgcatt

SEQ ID NO: 27825 - DNA, 440 bp, Homo sapiens
  misc_feature 1..440: note = chr2:207506716-207507156
  misc_feature 1..440: note = hyper
  source 1..440: mol_type = genomic DNA
ctcatgtccctcctccgaccccaagagtccacagtcttccctcacacccctttattctcggacgaggcccgtgtggtgagcgggaacccctgctgtcccctggaccagcgcggagctgggccctaactttgcagttcccgccgcatcggcacgcacccgcgaggtgggagcgggaagcccagccgcattagaggctcaattccggcaggtgcagagtgggtgcgggtcaaggccaatgagagtgtgtgtggccaagcccgctggtttcctgaaccgaaattctccggggagggagagaagaggagggtgcgggagacggacttggaggcgagaggtggcggcagtttccaggagctttgacgtagacttggagaggcgccgagcactcccactgcttaagtagaggcacggtagcctccaggacgcggaagctggggaca

SEQ ID NO: 27826 - DNA, 60 bp, Homo sapiens
  misc_feature 1..60: note = chr2:208030115-208030175
  misc_feature 1..60: note = hyper
  source 1..60: mol_type = genomic DNA
cagagcccacaccaacgcagcccctgcgtctccgccgccaccacacgatttacacaagta

SEQ ID NO: 27827 - DNA, 87 bp, Homo sapiens
  misc_feature 1..87: note = chr2:208546197-208546284
  misc_feature 1..87: note = hyper
  source 1..87: mol_type = genomic DNA
cgccgcggagccgcgcggagcggagccggcgagctaacccgagccagccggcgggcgtcccggaggcggcggcgcagggaggagccc

SEQ ID NO: 27828 - DNA, 30 bp, Homo sapiens
  misc_feature 1..30: note = chr2:208633276-208633306
  misc_feature 1..30: note = hyper
  source 1..30: mol_type = genomic DNA
cctcgtcctgcgtgtcgtggttgaactggt

SEQ ID NO: 27829 - DNA, 131 bp, Homo sapiens
  misc_feature 1..131: note = chr2:208635643-208635774
  misc_feature 1..131: note = hyper
  source 1..131: mol_type = genomic DNA
ctggcacatagtagccgcccaaatggcaaccctgggattcgaacccaggtagttggtcagcggcactcaccatcgtagccgcccctccccccatactatcgcagcctccctggcttcgacctttacttttg

SEQ ID NO: 27830 - DNA, 15 bp, Homo sapiens
  misc_feature 1..15: note = chr2:209271322-209271337
  misc_feature 1..15: note = hyper
  source 1..15: mol_type = genomic DNA
gaagcagaaacattg

SEQ ID NO: 27831 - DNA, 48 bp, Homo sapiens
  misc_feature 1..48: note = chr2:210636334-210636382
  misc_feature 1..48: note = hyper
  source 1..48: mol_type = genomic DNA
gagtgcagctcggagcggggaaagccgaattccgggggctgaagaggc

SEQ ID NO: 27832 - DNA, 261 bp, Homo sapiens
  misc_feature 1..261: note = chr2:210636429-210636690
  misc_feature 1..261: note = hyper
  source 1..261: mol_type = genomic DNA
cgtacccctgcggctcaagctgccccggattcgcttctccggccgtgcagcccggcgcgggccgctgtccacagtgggaggtgctgaaagcagggagcgggtgcgggggcggcgaggcggaccgctgctccgagcgcccccctcctcgctccgcggctcctccagccctcccctcctcccgcagccatgttccacgcgcggggaggggtggggggaggggagaggcacgggggatcagggcggagagagccggctctgcct

SEQ ID NO: 27833 - DNA, 140 bp, Homo sapiens; identical to SEQ ID NO: 6623
  misc_feature 1..140: note = chr2:210636737-210636877
  misc_feature 1..140: note = hyper
  source 1..140: mol_type = genomic DNA

SEQ ID NO: 27834 - DNA, 31 bp, Homo sapiens
  misc_feature 1..31: note = chr2:210636933-210636964
  misc_feature 1..31: note = hyper
  source 1..31: mol_type = genomic DNA
cgctcctggggccgcccgggtcgccgctgcc

SEQ ID NO: 27835 - DNA, 170 bp, Homo sapiens
  misc_feature 1..170: note = chr2:211089565-211089735
  misc_feature 1..170: note = hyper
  source 1..170: mol_type = genomic DNA
caaaacgcaggctcccgggtcccactgcaggccgctgaactagacgggttggattggggctccggaatgaacttctggagaaatctttcggctttccccgacgtgggctcggcggtctgttctcggggcggcacggctgacacccctttttcctccgcccagatgctggt

SEQ ID NO: 27836 - DNA, 30 bp, Homo sapiens
  misc_feature 1..30: note = chr2:211090029-211090059
  misc_feature 1..30: note = hyper
  source 1..30: mol_type = genomic DNA
ggctactcggcgactcggggcagggtcccc

SEQ ID NO: 27837 - DNA, 330 bp, Homo sapiens
  misc_feature 1..330: note = chr2:213401235-213401565
  misc_feature 1..330: note = hyper
  source 1..330: mol_type = genomic DNA
ggaacaacaatggcacgctaatcctcgcgctctaaatgggctcacttgtgggtctgacaattcgcccagggaaacgagaagagacgaagcgagggcgcgagctagtgtcgcctgagacgaggaagaggacagctgcagaactaatttggattacattccttgcagaaattctgaaaagggcttttcggcatagctcaactcggagccgcacagttaataccaaattgctgcggactcggagcggggtcccccagtggcagaggctgaaccagacagcccccagtaggtcgcctcgtagaaattcctctcggctaagcctgcatgtcggtc

SEQ ID NO: 27838 - DNA, 381 bp, Homo sapiens
  misc_feature 1..381: note = chr2:213401566-213401947
  misc_feature 1..381: note = hyper
  source 1..381: mol_type = genomic DNA
ccaatgcctttgaatgggtcaatgtgcataatcaacccattgagggaaaatatgaagggactcgaagtggggagggagataaaaagagatgtatctaagaggccgcttggaatgtcaagtccgtgttggtgtgattccggaggtggctggagcgcgggacctggtatgcgtgaagaatttcggagtaattgggagggtgcaaacggccagcacaaacgcctcacatgtgccattcgaaggtcattttgaaagactcgataattgtaacttgttatttactaggcaaaggaggcggcggcggcggcggcggcggagcgggaaaactacagctagccgttttcttggtgaggtcagaaggacaccctccgggggcctaaagcg

SEQ ID NO: 27839 - DNA, 887 bp, Homo sapiens
  misc_feature 1..887: note = chr2:213402687-213403574
  misc_feature 1..887: note = hyper
  source 1..887: mol_type = genomic DNA
cacaggtgcaaagcccgattttctgagcgccgctctccaccgcccttcgggctcggctcgggagaggcccagccagcaccgccccaggaccgcggccccggcggtgcgggttctgccctcggggacccgacagggacagaagagtctcctctgactggggatttgggtctcccatgtcccgaacaacaggcgccaccagaagggatcccgcttaggctcccaaacaaaacgctcgggaaagaaaagcagggggttaaggagagaaaagagggactcagagtgatttttcacgataaataaagcaaacgcacacatacagggtaagtttcaaatggaaagaggggtgaccgaaagcccagggaagaggccccggtcaagcggtccctccacgcctcccgggatgggtgaagagggcaggggagccactcgaggcagccccgccggcggctgcaggttcggcgaccggagtgccagaaggaacccacctgactgagaatcgctgggctggacggtccccgccgccacgagaaggctcacccagacccaaagtcctgtcgccggcttcattttttggaagtctcagatcccgtgctgacaattacatgtccaaatggcatatccccctttcgggcacgcggaggagatcccccagccgggcgcgcgtgggggtgcgaggggggcgggcgcggcgcgcgcggtgtggcgactcccagggcgggcgaccgagtccgcgcccgcgggtccagggccggggcccgaggagggggcgagtgtgagcgcgtgtgtgcgcgtgtgggagtgtgctcggtgtgtgcgcttggcgctctgggccggactgtgcagctatttccccgcgtgagccttcgcttgctcgctccctcctcact

SEQ ID NO: 27840 - DNA, 88 bp, Homo sapiens; identical to SEQ ID NO: 6628
  misc_feature 1..88: note = chr2:213403913-213404001
  misc_feature 1..88: note = hyper
  source 1..88: mol_type = genomic DNA

SEQ ID NO: 27841 - DNA, 81 bp, Homo sapiens
  misc_feature 1..81: note = chr2:216300213-216300294
  misc_feature 1..81: note = hyper
  source 1..81: mol_type = genomic DNA
agcgtgctcaaaactcggtccttttgtgtgcacagctggtttctctcagtaaagcgcgcacacactcgcacacacgcgcgc

SEQ ID NO: 27842 - DNA, 261 bp, Homo sapiens
  misc_feature 1..261: note = chr2:216301526-216301787
  misc_feature 1..261: note = hyper
  source 1..261: mol_type = genomic DNA
gcttctactaagtaccgggagttccgcggggcgctttgcagatcccggggaagttcagagaatgaagttttcttttgcaaggacaaagtaacagtttacttttttacacatgcaggaaagccttcctttcctggggatgggacgcccgtttccactgaaagtgaaatcactgtgaacaacctgaaaattggaaagttggaccagctgtggggagagaaaggtcttcgtgtcctttcccacgttcaccgtgccagttacaca

SEQ ID NO: 27843 - DNA, 55 bp, Homo sapiens
  misc_feature 1..55: note = chr2:217236010-217236065
  misc_feature 1..55: note = hyper
  source 1..55: mol_type = genomic DNA
cacccctgctgcagtcggcaaatccgtggcgccctcccctcggttccatcaaagg

SEQ ID NO: 27844 - DNA, 69 bp, Homo sapiens
  misc_feature 1..69: note = chr2:217237047-217237116
  misc_feature 1..69: note = hyper
  source 1..69: mol_type = genomic DNA
ctgcattcagcaccccgggcgagtggacagctcccacccagaccccgcgcgtcacgctcgtgggggcct

SEQ ID NO: 27845 - DNA, 182 bp, Homo sapiens
  misc_feature 1..182: note = chr2:217497788-217497970
  misc_feature 1..182: note = hyper
  source 1..182: mol_type = genomic DNA
cggccacaggggaagcgcgcaaacgaagtcctcgcgaactgaactgagagcagacaaaagcacgcgctcttctccaccgccacgccggtcctacccaaacccgcgagttatccgtattctccttcaggagtcatagtcaggccagaagagtgcggagggacggggcccgggaagagcaggga

SEQ ID NO: 27846 - DNA, 71 bp, Homo sapiens
  misc_feature 1..71: note = chr2:217557250-217557321
  misc_feature 1..71: note = hyper
  source 1..71: mol_type = genomic DNA
caccttacgttctttcggtgtgactggattgttacccagggcggtggctcccaagccgggaaatcaattaa

SEQ ID NO: 27847 - DNA, 620 bp, Homo sapiens
  misc_feature 1..620: note = chr2:217558904-217559524
  misc_feature 1..620: note = hyper
  source 1..620: mol_type = genomic DNA
agtagggggagggggcgggcaacgtgtgggtaggaggaaggagaaagagcgaaagctgggatagactcggctagacagttcccccgggtagcaggatcctccagggctccaattccggggtgcaaggaccctccccgactactcccgagctgcaccccagctcgaagccacttgctgcgcaaagcgcgcgggcccagccggtctcgtgtcccccgcccgtgcgccgcgtaactgactggcacactgagcgcgctcaccgatcttgacttgctcgcggtagctcttttcgttgaggcaaaccccgcggccgtgcagcagggcgtgcagcggcttctcctcgtcctgccgggggaggcagcgcagcccctgggcgcagcgctcggtgtagacgccgcacgactgcccctcggccagggcgcaggtcatgcagcagccgcagcccggctccttgaccagctcgcagcccagggggctgggggggcacatggagagggctttctcgtcgcagggctcgcagtgcacgaaggagcccaggctctgggccggccccgcataggcggccagcagcaggaggaccgcggtgagcaacaccatcttctcttagtcgccccctttacctc

SEQ ID NO: 27848 - DNA, 155 bp, Homo sapiens
  misc_feature 1..155: note = chr2:218806147-218806302
  misc_feature 1..155: note = hyper
  source 1..155: mol_type = genomic DNA
ggaagcagctgggtgcggacctggtaggcagttgagccacgggtgtgagggaggggcacagtgccagggcagagcgtcgggctcttggttccttacacattggcaggaaggagggggcccctgcgagtggtctgcgcccacgccccaggccagag

SEQ ID NO: 27849 - DNA, 30 bp, Homo sapiens
  misc_feature 1..30: note = chr2:219232829-219232859
  misc_feature 1..30: note = hyper
  source 1..30: mol_type = genomic DNA
agcgtccctggctagcgtctagtgtctcgg

SEQ ID NO: 27850 - DNA, 30 bp, Homo sapiens
  misc_feature 1..30: note = chr2:219723919-219723949
  misc_feature 1..30: note = hyper
  source 1..30: mol_type = genomic DNA
tcaaggagaggctgacgaaggggcatgagg

SEQ ID NO: 27851 - DNA, 301 bp, Homo sapiens
  misc_feature 1..301: note = chr2:219724722-219725023
  misc_feature 1..301: note = hyper
  source 1..301: mol_type = genomic DNA
cgccccctgcccacccgggcggccgtagggcggtcacgatgctgccgcccttaccctcccgcctcgggctgctgctgctgctgctcctgtgcccggcgcacgtcggcggactgtggtggtgagtccggctgtcctggcgcggctctggaccctggagggtggggaccccgggacccaggacagactggggtgttccgcagcctcccggctctacctgctctccgagcccagctttctggcctcggccgggggcgtttctgaactccacttcgacgttcctaaccctcgggaacattctatt

SEQ ID NO: 27852 - DNA, 73 bp, Homo sapiens
  misc_feature 1..73: note = chr2:219735785-219735858
  misc_feature 1..73: note = hyper
  source 1..73: mol_type = genomic DNA
atctgcaggaaggcacggcggctggccgggcggcaggccgagttgtgccaggctgagccggaagtggtggcag

SEQ ID NO: 27853 - DNA, 470 bp, Homo sapiens
  misc_feature 1..470: note = chr2:219736117-219736587
  misc_feature 1..470: note = hyper
  source 1..470: mol_type = genomic DNA
ctggggcagccctcccgccgcaggtttcaggtcccaggccccagctgaccgccccagcccgcgctgattgcacctgtctgcattcacagacattcgggagacggccttcgtgttcgccatcactgcggccggcgccagccacgccgtcacgcaggcctgttctatgggcgagctgctgcagtgcggctgccaggcgccccgcgggcgggcccctccccggccctccggcctgcccggcacccccggaccccctggccccgcgggctccccggaaggcagcgccgcctgggagtggggaggctgcggcgacgacgtggacttcggggacgagaagtcgaggctctttatggacgcgcggcacaagcggggacgcggagacatccgcgcgttggtgcaactgcacaacaacgaggcgggcaggctggtgcgtacgggcaggatggagtgagtgtgtgcggaaatgtgagtgt

SEQ ID NO: 27854 - DNA, 142 bp, Homo sapiens
  misc_feature 1..142: note = chr2:219773737-219773879
  misc_feature 1..142: note = hyper
  source 1..142: mol_type = genomic DNA
caacctcaaccaacacgtaggcgaggatgcccagggtgagcgccagcggcgagaagacgcgctatcgcgagatcggtgggacctacgcgtttacaggccggaagtgaggggcgggcctaagggggcgcgctccttttgaaac

SEQ ID NO: 27855 - DNA, 56 bp, Homo sapiens
  misc_feature 1..56: note = chr2:219823921-219823977
  misc_feature 1..56: note = hyper
  source 1..56: mol_type = genomic DNA
gaggagccagtgcaacgcgacccatctgggacctgggcatccggtgagggcactca

SEQ ID NO: 27856 - DNA, 69 bp, Homo sapiens
  misc_feature 1..69: note = chr2:219824277-219824346
  misc_feature 1..69: note = hyper
  source 1..69: mol_type = genomic DNA
atcaggagtgcaactcgggagcggattggccgcgtgaggcggggcacggcgcgacgaaaaaaggggccc

SEQ ID NO: 27857 - DNA, 307 bp, Homo sapiens
  misc_feature 1..307: note = chr2:219824786-219825093
  misc_feature 1..307: note = hyper
  source 1..307: mol_type = genomic DNA
aggtgacacccaagccggcatccacgggccccgaccccctggtccagcaacgcaaccgcgagaaccttctccgcaagggccgggatccccccgacggcggcggcaccgccaagcccctggcggtgccagtgcccaccgtgcccgcggctgccgccacctgcgagccaccgtcggggggcagcgcggccgctcagccgccgggctcgggcgggggaaagcctccgccgccgcctcccccagccccgcaggtggcgccgccggtgcctggcggctcgccgcggcgggtcatcgtgcaggcgtccaccgg

SEQ ID NO: 27858 - DNA, 419 bp, Homo sapiens
  misc_feature 1..419: note = chr2:219825130-219825549
  misc_feature 1..419: note = hyper
  source 1..419: mol_type = genomic DNA
cgctgctatcgcctcaaggagctgagcccgggcgagctggtgggctggttccgcggtgtggaccgctcgctgctgctgcagggctggcaagaccaggccttcattacgcctgcaaacctggtgttcgtgtacctgctgtgccgcgagtcgctgcgtggggacgagctggcgtcggccgccgagctgcaggccgccttcctcacctgcctctacctcgcctactcctacatgggcaacgagatctcctacccactcaagcccttcctcgtggagcccgacaaggagcgcttctggcagcgctgcctgcgcctcatccagcggctcagcccgcagatgctgcggctcaacgccgacccccacttcttcacgcaggtctttcaagacctcaagaacgagggcgaggccgccgccagcggcgg

SEQ ID NO: 27859 - DNA, 30 bp, Homo sapiens
  misc_feature 1..30: note = chr2:219826854-219826884
  misc_feature 1..30: note = hyper
  source 1..30: mol_type = genomic DNA
ataaagcgctggaagcgcctgcagatggtt

SEQ ID NO: 27860 - DNA, 466 bp, Homo sapiens
  misc_feature 1..466: note = chr2:219846405-219846871
  misc_feature 1..466: note = hyper
  source 1..466: mol_type = genomic DNA
ccaagtgcgaggctgcggccacggccccgaagggcccgggcgggggctgcaagctgggactggggtagagcgcggcggtggcggcggcagcggtggcggcggggcccgggcccggccagtaggagaagccggcgggcgcgaccccggccgaggcggccatgaggttgagtttggagaggccggggaagggcagcggggcgaggccggcgggcagcttgtagagcgcgccgtcctgggcggccgcggcggcggcagcagctgcggcggcggcatgagcgtgcgcgggcggcggctggcaggcctgcgccaggccctggaagtcgaagcggtaggcgtagcgcttgccatgcaccttgctcatgatgttcttgtcgtagtagtagcgcagggcgcggctcagcttgtcgtagttcatgttgggcttgctcttgcgctcgccccaccgccgcgccacctcgtccgggtc

SEQ ID NO: 27861 - DNA, 295 bp, Homo sapiens
  misc_feature 1..295: note = chr2:219846894-219847189
  misc_feature 1..295: note = hyper
  source 1..295: mol_type = genomic DNA
cgccctcccacgcgatgcagccggcgttcgcgcggtcagccagcagctccagcagaaactgccacagctggatctgtccgctgcctgtggggaggggggcggtcagccacaggcgggagcggggaggcgggaactggggaagagtgctggcgggaaactgacccaccccggcaggaaccggcactgggggaggaaaagtgcaagtcaaactgcagctgcgttcggcgggagaggccggccccggaggggctgatcagcagagtggtgtgtagccttaccgcgcttttgcacaatg

SEQ ID NO: 27862 - DNA, 83 bp, Homo sapiens; identical to SEQ ID NO: 6640
  misc_feature 1..83: note = chr2:219848809-219848892
  misc_feature 1..83: note = hyper
  source 1..83: mol_type = genomic DNA

SEQ ID NO: 27863 - DNA, 542 bp, Homo sapiens; identical to SEQ ID NO: 6641
  misc_feature 1..542: note = chr2:219848935-219849477
  misc_feature 1..542: note = hyper
  source 1..542: mol_type = genomic DNA

SEQ ID NO: 27864 - DNA, 276 bp, Homo sapiens
  misc_feature 1..276: note = chr2:219849996-219850272
  misc_feature 1..276: note = hyper
  source 1..276: mol_type = genomic DNA
ttccagctaaggggccgcttggaaccctccggcccccgcgcggcccggggccgcaatttccgttttaattaaagcgctgccgcctcggcccccaggaccccgcccccgcccctcttatcgtcccatcgcaataaagtctccaacgcgccgcgccacagccaagcgcacccggcagccccccgcgccccgcagccggggagacgcgcgggggatgggcccgggccatgtgccctgatgggagcctagagcgcgtgtcttttccgcctccctgactct

SEQ ID NO: 27865 - DNA, 30 bp, Homo sapiens
  misc_feature 1..30: note = chr2:219850482-219850512
  misc_feature 1..30: note = hyper
  source 1..30: mol_type = genomic DNA
ctgtcgctgcgcgcccggccctgcagccgt

SEQ ID NO: 27866 - DNA, 343 bp, Homo sapiens
  misc_feature 1..343: note = chr2:219857780-219858123
  misc_feature 1..343: note = hyper
  source 1..343: mol_type = genomic DNA
cgcgctcgcagacgttcgcacagtcgcttagcagccgacagcgacggccctggaagtcctcctcgtcccagagcgtgaggctggcgggcgccgggcccggcgcgggggcgctgctcatgccgctgcggacaggaagggtggcaccacgcgctcagcgtctcaagagccccgtttcgagccacacacagcctgcccaacctgggtagcggatgaagaacccgggggctggacccggcctagctctggacccggctgccaggggctcgcagtcttcccgcgctcccctcccttccccaccccagcagagggcattcaccgggtgggtgagcgcggcacgcgaggg

SEQ ID NO: 27867 - DNA, 76 bp, Homo sapiens
  misc_feature 1..76: note = chr2:219866496-219866572
  misc_feature 1..76: note = hyper
  source 1..76: mol_type = genomic DNA
ctcagtgctgcacagcgccccgctagcctccgccctcacctgaacgcatctgcggctgacacgtcggcggccgcgg

SEQ ID NO: 27868 - DNA, 224 bp, Homo sapiens
  misc_feature 1..224: note = chr2:219867715-219867939
  misc_feature 1..224: note = hyper
  source 1..224: mol_type = genomic DNA
cggcagcagcgtgtccggggtcagactcctggaagacaaaaagtcccaggtaggcgtgggggcgaggcttcgggcagagcctggctgcccccgtggcccctctcgcgcggtctgcgcggccgctggtcccggcgcccttacctgggcacgcagaacggcggcagggcgatgacgcgtggccgcgaggtgagtaccacctccccgcggctcgcctccaccaggat

SEQ ID NO: 27869 - DNA, 30 bp, Homo sapiens
  misc_feature 1..30: note = chr2:219924566-219924596
  misc_feature 1..30: note = hyper
  source 1..30: mol_type = genomic DNA
tacctccgggtgcagcgtctggctgagctg

SEQ ID NO: 27870 - DNA, 59 bp, Homo sapiens
  misc_feature 1..59: note = chr2:219925148-219925207
  misc_feature 1..59: note = hyper
  source 1..59: mol_type = genomic DNA
aggcagaagtgcagtcggggccggagccgggcgggagacatggccggggagcccggggg

SEQ ID NO: 27871 - DNA, 69 bp, Homo sapiens
  misc_feature 1..69: note = chr2:219925544-219925613
  misc_feature 1..69: note = hyper
  source 1..69: mol_type = genomic DNA
cgggctgcagggccccgcggttagcaccccggcccggcggtcaggcggctcgggcggagcgggagctgc

SEQ ID NO: 27872 - DNA, 97 bp, Homo sapiens
  misc_feature 1..97: note = chr2:219926046-219926143
  misc_feature 1..97: note = hyper
  source 1..97: mol_type = genomic DNA
ctacggtgtcccctgcggggaagcaaacccaaaaggcaggaggccactcataacctggtgccccaccctggcccgggcgacgcgccctttcagcttg

SEQ ID NO: 27873 - DNA, 38 bp, Homo sapiens
  misc_feature 1..38: note = chr2:220173999-220174037
  misc_feature 1..38: note = hyper
  source 1..38: mol_type = genomic DNA
gcagccggagacccccggatcccccgagacccccaggc

SEQ ID NO: 27874 - DNA, 285 bp, Homo sapiens
  misc_feature 1..285: note = chr2:220174059-220174344
  misc_feature 1..285: note = hyper
  source 1..285: mol_type = genomic DNA
cgagctccgggcgctcgctcccgggccggagccgcagcgacgctggcgggagcctgccagaggggctgaggcggggcttgccgctccccacctccctacgaggcggggtctacatgcccctctcgctgcaacgcggccaaccgcaggcgggtgctgacgacacctccacccccggctcgtaagctaatttgcgtcacatatggcgtaagagccctgtcggagcgggggacctacctagcccatccctcctccatcaaatagtaggcgcctcgctagaattcccac

SEQ ID NO: 27875 - DNA, 280 bp, Homo sapiens; identical to SEQ ID NO: 2164
  misc_feature 1..280: note = chr2:220196354-220196634
  misc_feature 1..280: note = hyper
  source 1..280: mol_type = genomic DNA

SEQ ID NO: 27876 - DNA, 344 bp, Homo sapiens
  misc_feature 1..344: note = chr2:220197187-220197531
  misc_feature 1..344: note = hyper
  source 1..344: mol_type = genomic DNA
cccacttctcaggatcgctttcttggccctgcccgcaccccccagggttcctcctgaccgtgggcactagtgtcgctgcagccccccgggcagctgttcagcagcaggaagcagacaagcagctggagcccctcggagctcccaggccacagtgggtgctgtatcctcccaggctcggcgcgctcactccccggccaagtctcagtgaaggtagcggccacggccgaggggctgagcggggctgcagcttcccaccagcccgcgactccgaatctgtttaaccctcctcggcagttcagccaatcgtgagcgggccctgcccctgcggtcgcctccccagctcc

SEQ ID NO: 27877 - DNA, 753 bp, Homo sapiens
  misc_feature 1..753: note = chr2:220222947-220223700
  misc_feature 1..753: note = hyper
  source 1..753: mol_type = genomic DNA
ggacccacacagcggcggggtttggtttgacgtggctcccaaaggcgagggcggagctggggaaggtgagagcacccaggcatccgcacaggcgtgaccctctgcccaccaggcaccctgcccacacagcgcgccgcaggaagccctccgcattggtgtccaagctcgagcaccaggtggaggaacccgtggccatcgggtgtggggtgtgcagggtgcggagaaggctaggattcctcccaatcctctgctgcgccctcccccagccgcctccccaggttgaggggaggccccggcccaggactgggctcttcccgaggtggggactggatgcccgcgctccggactcctgccggagatgccaaccccccagcgctgggcaccttgccttgacccctcagcgcgtctcacatggcccggatctcggtcccttgggcactccctcttgcccaactccgaattggagttcttgtagttctagtttccaccccgtcttccgacgtttaagaccccgcttccaagacgccctctggctttctcttcccatcccgcacacttccctagcttctgagctgtgtgcacccaccaacccgcagccctccctcaggatcgcccctgcccttcccccaggtttcctcctgacggtggggactaatggcgtcccagccccccgggcggctgctcagcagcaggaagcagagaatcagaggcacccccgctgggccccgagccccatgcgcgcgcaggggcccc

SEQ ID NO: 27878 - skipped

SEQ ID NO: 27879 - DNA, 118 bp, Homo sapiens
  misc_feature 1..118: note = chr2:220283172-220283290
  misc_feature 1..118: note = hyper
  source 1..118: mol_type = genomic DNA
cgcgccgtcaccatgagccaggcctactcgtccagccagcgcgtgtcctcctaccgccgcaccttcggcggggccccgggcttcccactcggctccccgctgagttcgcccgtgttcc

SEQ ID NO: 27880 - DNA, 264 bp, Homo sapiens
  misc_feature 1..264: note = chr2:220283362-220283626
  misc_feature 1..264: note = hyper
  source 1..264: mol_type = genomic DNA
cgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagc

SEQ ID NO: 27881 - DNA, 27 bp, Homo sapiens
  misc_feature 1..27: note = chr2:220283711-220283738
  misc_feature 1..27: note = hyper
  source 1..27: mol_type = genomic DNA
cgacgtcgagcgcgacaacctgctcga

SEQ ID NO: 27882 - DNA, 158 bp, Homo sapiens
  misc_feature 1..158: note = chr2:220299477-220299635
  misc_feature 1..158: note = hyper
  source 1..158: mol_type = genomic DNA
cctccacggctccctcgcaacccgagccggggggcctaaaaatagcccccaggcgcaatcgccggccgccccggtgaccttctgggtagcacaggccgaaggcgggcgggcagcaggaaggcaggccgccggccccccagacttgtctcctagggcac

SEQ ID NO: 27883 - DNA, 212 bp, Homo sapiens
  misc_feature 1..212: note = chr2:220299885-220300097
  misc_feature 1..212: note = hyper
  source 1..212: mol_type = genomic DNA
cgggtggtggtgagcgggacgccccagcccagcctccgctggttccgggatgggcagctcctgcccgcgccggcccccgagcccagctgcctgtggctgcggcgctgcggggcgcaggacgccggcgtgtacagctgcatggcccagaacgagcggggccgggcctcctgcgaggcggtgctcacagtgctggaggtcggaggtaaagggca

SEQ ID NO: 27884 - DNA, 743 bp, Homo sapiens
  misc_feature 1..743: note = chr2:220349054-220349797
  misc_feature 1..743: note = hyper
  source 1..743: mol_type = genomic DNA
cgagaagcgcgtgccctcagccgggggtcccccggtgctagccgagaaagcccgagttcccacggtgccccccaggccaggcagcagtctcagtagcagcatcgaaaacttggagtcggaggccgtgttcgaggccaagttcaagcgcagccgcgagtcgcccctgtcgctggggctgcggctgctgagccgttcgcgctcggaggagcgcggccccttccgtggggccgaggaggaggatggcatataccggcccagcccggcggggaccccgctggagctggtgcgacggcctgagcgctcacgctcggtgcaggacctcagggctgtcggagagcctggcctcgtccgccgcctctcgctgtcactgtcccagcggctgcggcggacccctcccgcgcagcgccacccggcctgggaggcccgcggcggggacggagagagctcggagggcgggagctcggcgcggggctccccggtgctggcgatgcgcaggcggctgagcttcaccctggagcggctgtccagccgattgcagcgcagtggcagcagcgaggactcggggggcgcgtcgggccgcagcacgccgctgttcggacggcttcgcagggccacgtccgagggcgagagtctgcggcgccttggccttccgcacaaccagttggccgcccaggccggcgccaccacgccttccgccgagtccctgggctccgaggccagcgccacgtcgggctcctcaggtg

SEQ ID NO: 27885 - DNA, 48 bp, Homo sapiens
  misc_feature 1..48: note = chr2:220361419-220361467
  misc_feature 1..48: note = hyper
  source 1..48: mol_type = genomic DNA
gtttaggggtctggccggtccagggggcaggtaggagatggtgcgctc

SEQ ID NO: 27886 - DNA, 76 bp, Homo sapiens
  misc_feature 1..76: note = chr2:220361826-220361902
  misc_feature 1..76: note = hyper
  source 1..76: mol_type = genomic DNA
tcctcgtggaaggtacgcgcgccccgggcgcagcgccagggcgcagaccagcaccactcagccagagcccgcagcc

SEQ ID NO: 27887 - DNA, 105 bp, Homo sapiens
  misc_feature 1..105: note = chr2:220361983-220362088
  misc_feature 1..105: note = hyper
  source 1..105: mol_type = genomic DNA
cgccgcgccagccaagtgcgtccttccctacctcgggatccagctccacccgggctgagcagtcagctgtggacttccatcacgcggctccgggtccccaaggtc

SEQ ID NO: 27888 - DNA, 53 bp, Homo sapiens
  misc_feature 1..53: note = chr2:220379221-220379274
  misc_feature 1..53: note = hyper
  source 1..53: mol_type = genomic DNA
cagcagaggcagcagcggcagaggcagcaccagggctgcggagctgctgggag

SEQ ID NO: 27889 - DNA, 1347 bp, Homo sapiens
  misc_feature 1..1347: note = chr2:220416340-220417687
  misc_feature 1..1347: note = hyper
  source 1..1347: mol_type = genomic DNA
ggctgtgggtggggccgtggctgcgcatctcatacttatctcccgggcacagctcggccccctcccgcagccagcacacgtggccccccgagcgggacacagtcacctccagcaccgcccggcggcccaccagaacggtcttctcgcgaggggggtggcggcacatctggagaggcaatgctgggggtagggggcgggggcttaagttaatagggacacgcatggcccccaggaggagagatgcatcttccctccctgaagtctccactcctggccttagccctctatgccaccagtccgttcccttgcacctcagacccaaagtctcctcttgccggggaaacgcgctgccctctgtgacccggcccaggagagcccctcggggggaagggaagagagaggcagcgttcttggggccagccccaagtccgtcagtcccatggcaggagagacaggatgtacactctctgtcgctcccaccccaggtgcttaccctccacttccagtagagccagggactgggcgggccccgcctggaagcggacttcaccggcgtcctcggcgcgcagctcgctaagcaccagaatgtgtttcttccctgggggtgagggggtcgctagcgaggccggagccacctctgaggagcgttggggacgaaggtgggggcccagcaggcccctgggtcggttcggacgccgttagtgtatgctagggtgggcggaacagggatgcggagcgggaagcctagaggtccgggactaggggctgggggcgggggaaagaacagggacgaggctcacagggccgtggggcggggcccgtcggagccaggggcggggcttgtcccggtggggcgggatctgttcgagcctgggcggggcagcgaggggcccgaaagggtaaccaggcgggcagaccttcctgtcggatgcggacgcgggctccgggtctcagcgggcggcctccgagctcccagcgccccgtggtctcgacctccgacacggtgcactcgaacgtagcgccgtcgccttcgcgggcgctcaccgaccgcagctcggagagtaccgccacagtacgctctggggcggagcccggggcgtgagcggggcggggcagagggcagttaccggtcacgccccctccacgccccctttctagaagcacgcgcggtcatcagggtccggggaagacagctccgcaagtctcgcgcccaaagcagtgcccagcctccacatcaccccgtacccaccgcgcacggtcaggcggaccggtccggcgcgggccgtccccaccgcgcagctgtaggtcccggcgtccgaggggccgcagcgtcgcagctggagaagg

SEQ ID NO: 27890 - DNA, 492 bp, Homo sapiens
  misc_feature 1..492: note = chr2:220435486-220435978
  misc_feature 1..492: note = hyper
  source 1..492: mol_type = genomic DNA
ctcggggaggccccccgcccggcacgtcagcaccacctccgccccccgcagcacccactgggatcgaggccccgtgaggaagaccggggcgccctccccggaccccggcgatggcagcgggcgctcggcgggctgcagctcggggtcggaggccggcggctccagcacggtgacggcggccgccgcgtaggcctcgccggccgcgttgcgggcgcggcacacgtagacccccgcgtcggtgggcagtgcggcggtcagcagcaggccgtgctccgcgccgtccgccgggaagctcaggcgttccgaggccgccagctgctgcccgcccttctcccacaccactacaggcggcggctcccccaggaccacgcacttgagctcggcctcggcgccacttaccacccgcacaggccgcgggaagcgcaggaagcacggggggctcccctgatcccccgagctcgccttcatcgcggcggccgaccgcctgcagcg

SEQ ID NO: 27891 - DNA, 103 bp, Homo sapiens
  misc_feature 1..103: note = chr2:222435773-222435876
  misc_feature 1..103: note = hyper
  source 1..103: mol_type = genomic DNA
cactcaggacatctgcgcacagacatacaatcctccgcgtccgcttccacgcaggcattcgcgcacctacatacacgcagttgcacgcgcgcgcacacacaca

SEQ ID NO: 27892 - DNA, 462 bp, Homo sapiens
  misc_feature 1..462: note = chr2:222435996-222436458
  misc_feature 1..462: note = hyper
  source 1..462: mol_type = genomic DNA
tcgcctctccctgggtttctcagaaactaaatgatcaccgcccccccgccccgccccacctcccgacacagacacacaggcacatacaatcctcccagcacgtccgaacggatgcacagaaaactgagcacccagacgggtcccgtcgaccccgcacgttagctctaaactgtgtgcaattctggggcgaaaagctaaaactcgactgcgttcaacttgccggcgggttccccaagtctgcggggcgaagagctcgggcccctcaggcccgcaatcgcaccctcggggcgctgggcttggcgaggagaaaggtgtctgactccgggtgctagaaatcaggtcactggcgcctgacgagcggcgccacgaccgctgcgctgcggagcaggccccgcagcccggtcccgagaagcgcagggctcgggaaactttgcagaaaccagagctcgaaaggctttcgct

SEQ ID NO: 27893 - DNA, 41 bp, Homo sapiens
  misc_feature 1..41: note = chr2:222436920-222436961
  misc_feature 1..41: note = hyper
  source 1..41: mol_type = genomic DNA
aatcccgaagagacacgaaaatagggcgaaatagaaaatcc

SEQ ID NO: 27894 - DNA, 36 bp, Homo sapiens
  misc_feature 1..36: note = chr2:223104874-223104910
  misc_feature 1..36: note = hyper
  source 1..36: mol_type = genomic DNA
ggttatgaatatggccggccacgggggcagtacagg

SEQ ID NO: 27895 - DNA, 366 bp, Homo sapiens
  misc_feature 1..366: note = chr2:223155822-223156188
  misc_feature 1..366: note = hyper
  source 1..366: mol_type = genomic DNA
cccagcccattgtggcggcgcccgcgggcccgctaggccgagccgggggaggaacagaggcgcccattgagcggccgctgcgcagggcggtgcccacagccccggatgcctcggccaggacttggctcccccggctgcctctgctccagtctcagcgcgggccaggggctagggggattggggatagcgggcggggttcgtgttagtgaaccgcccagccctctcctttctcctgggctatggagctggagggatgtatccagcaagggtgcatcatgcttagcgcgcgcccgttagggagcgcgggcctgagcgcaccagcaccgctagcggctcagctcttgaattgagcgagggaaaagggaa

SEQ ID NO: 27896 - DNA, 1076 bp, Homo sapiens
  misc_feature 1..1076: note = chr2:223158730-223159806
  misc_feature 1..1076: note = hyper
  source 1..1076: mol_type = genomic DNA
ctttcagttccatgtcgttactcaggcgcagagacaccgcgcatgaagggaccttgatccgagctgggcttggctgccgtcagatcaccaatgtcagctagccgatgccctccaagtcacccagcaagtgcgccgcccaaggcgccaccgcttacctcgctcgctcaggatgccgtcgatgctgtgtttggccttcttctcgctttcctctgcctccttcctctccaagtcggcctcctcctcttcacctttcccgaatttacttctcaggatgcggctgatggaactcactgggggcgggaggaggaaggaagcaagggagcgcacatggttgagacaagcagggctgtgcgggaaggaccccccacccccaaacaccagccagggccctagagccgctgccctgcactgctcgcgggtgtctcctcctgcatctctggacatcctcatccttctccagccctctcatcctgccactcaaacccccctccctattatctgtatctcggtactgaaagacggaggctgggaaaaccgtgcctccaagttagggccggatgccatctttgtccctcgattctgggcaggaagcatttcccttcctggactccgaagaccgggctctaggtctgcaatctaagagaattctcccaccagcccaccgggtaccctccttcctccccacctgaatgcatggatcctgcggttcgccttaagggaggaagaaccaaagccgacttgtccgcgcccccccccacccccccgtaaatcaagtttcttttttttcctttcttcccttttttttttttttttaaggctataaagggtttaaatttcaactgcagaatcgtttcctattgtaaaaatcaaaagaaaatgcactctctcccacttattttttccagattccagtctggtaaacaaatccatgctctgaaatatgtttctcacagagggaaaaagggagtttccttttaattaaaaacaaaccctcccgtgcgccctctcgctggccccgtgcttgcccctcttctccctccgcctcccccaggctgccgtggcggggggctccggac

SEQ ID NO: 27897 - DNA, 248 bp, Homo sapiens
  misc_feature 1..248: note = chr2:223159868-223160116
  misc_feature 1..248: note = hyper
  source 1..248: mol_type = genomic DNA
cggcaaagtccctcccggcgcgggccccatctcccttcggttggggttaccaaaacatttgtttctctttaaaagggaacatcaatattaataaacgctctgcctccgcctcacgtttcctgccctgcctcctcgacagaaatcttctttggggcgtcctcagcggtggtctcgccaccctccgtccccaggacaagcagctcacccctccctccataaagtgccaagaacaccgggttggcaaatat

SEQ ID NO: 27898 - DNA, 37 bp, Homo sapiens
  misc_feature 1..37: note = chr2:223160342-223160379
  misc_feature 1..37: note = hyper
  source 1..37: mol_type = genomic DNA
caattttcttctccacgtcaggcgttgtcacctgctt

SEQ ID NO: 27899 - DNA, 30 bp, Homo sapiens
  misc_feature 1..30: note = chr2:223161247-223161277
  misc_feature 1..30: note = hyper
  source 1..30: mol_type = genomic DNA
gggggagactgagggcggggtttgggagac

SEQ ID NO: 27900 - DNA, 159 bp, Homo sapiens
  misc_feature 1..159: note = chr2:223161526-223161685
  misc_feature 1..159: note = hyper
  source 1..159: mol_type = genomic DNA
cagggcgcgtgcacacgtacacacacacacgcgcgcctttacgcaccttcacaaacctcagaaataactcattggagagccccagatgtcagccgttaccccccgcccggtcttccccaacacaggggaccacagtctgggagccaggagggcaaggcc

SEQ ID NO: 27901 - DNA, 257 bp, Homo sapiens
  misc_feature 1..257: note = chr2:223161806-223162063
  misc_feature 1..257: note = hyper
  source 1..257: mol_type = genomic DNA
cgcagggccggatgccgtggtgggccatctccacgatcttgtggcggatgtggttgggcagcggcctgccgttgataaaaacaccgccgagctggttgacgcggccctggccgaggggagtggacactgtgggaaggtgaaaaagagaagcaagggaaaagtcactggaggaaaataaaaagcaaagaacagcagcacgtaatttcgcagtcttctgtcctatcctcatgttacagcaccgacgctgaaactgctcg

SEQ ID NO: 27902 - DNA, 326 bp, Homo sapiens
  misc_feature 1..326: note = chr2:223162565-223162891
  misc_feature 1..326: note = hyper
  source 1..326: mol_type = genomic DNA
gaagggagtgggtggcgggggcgatgagcatctctgctggggcgccctaacctggaaaaccattgaaaacggctcaggcttgcaagacttcctgcctccccgggattcccagaatcttcaagtggacggaaaggcgattcctaaacaagttatagaaacttctagatgctatttgagatacatagaattctaatttatttaattattctaaaaattccaatcacaatggcgcggcgttagccaccacaactttgcagggcaaaaaaaaaaaaatacttcctgaactaacatatgtttcacaagtgtgggcgcagccgggacaattt

SEQ ID NO: 27903 - DNA, 297 bp, Homo sapiens; identical to SEQ ID NO: 270
  misc_feature 1..297: note = chr2:223162928-223163225
  misc_feature 1..297: note = hyper
  source 1..297: mol_type = genomic DNA

SEQ ID NO: 27904 - DNA, 337 bp, Homo sapiens; identical to SEQ ID NO: 271
  misc_feature 1..337: note = chr2:223163472-223163809
  misc_feature 1..337: note = hyper
  source 1..337: mol_type = genomic DNA

SEQ ID NO: 27905 - DNA, 193 bp, Homo sapiens; identical to SEQ ID NO: 272
  misc_feature 1..193: note = chr2:223163810-223164003
  misc_feature 1..193: note = hyper
  source 1..193: mol_type = genomic DNA

SEQ ID NO: 27906 - DNA, 210 bp, Homo sapiens
  misc_feature 1..210: note = chr2:223164407-223164617
  misc_feature 1..210: note = hyper
  source 1..210: mol_type = genomic DNA
ttcttttgtcttctccgtccgcaagcggggctaatgtgaagcacaggcagccgtcgctaggcccaagcactcgttagttgaaggctgggggtatgggggagggtgcagaaaaaaacctggctcctcttcttggtgtaaaaaccgctctggcaagctgcggttctaaatctctacatatagatccccgatgcgtcgacagagatgtgtctg

SEQ ID NO: 27907 - DNA, 69 bp, Homo sapiens
  misc_feature 1..69: note = chr2:223165434-223165503
  misc_feature 1..69: note = hyper
  source 1..69: mol_type = genomic DNA
attttctttttaaggcgttggggccaccaaagcctgtgtccgtacgttttaagccacttctcagcgata

SEQ ID NO: 27908 - DNA, 223 bp, Homo sapiens
  misc_feature 1..223: note = chr2:223166003-223166226
  misc_feature 1..223: note = hyper
  source 1..223: mol_type = genomic DNA
gaatcaggaggcgactcattttctctcctttccggcctctttcttttctgccgagcgctctgagattcatatgtacccagatgatcagcccggcccttctcaccggccagtggccagaggtccctggacacccggagaggggtgggagggcacccttaggctctggacagctgggccacatccaaagacttaatgaatctaaatttcttgtggcctgtgtccc

SEQ ID NO: 27909 - DNA, 557 bp, Homo sapiens
  misc_feature 1..557: note = chr2:223166293-223166850
  misc_feature 1..557: note = hyper
  source 1..557: mol_type = genomic DNA
cgccgccaaacctaacccggctcagagccgtgactccgcagaacagggcgcaacaggtctcaggaatgccgggtgattccagccactctttctctgtctccgagtcttgggcctcccctttatttctttctgaagtctctccggagcccaagccaccccacacccaaaccccgcagctggatgggagtccaggccacttccctatccgcagccggtgggccaaggagtcctggtgccaaatttggccgcggtacaggcgctaattggtaaagggatgacccagcggtggggcttggaaggcgagggcccgcgccctgcatccttgaaccctggtttgggaggcagtgacttttacctgggctaacaaattacccagaaagcatcagtgggactctccacaacggtgttgtgaacgagtgtagggtccactcacgctctgtgcacgttcgaaatgaaacgggagccttgaagacgatatttggataatttgacaaaaaaaaaaaaaaggtgggcgggggagatagcttctattgtcccctctgcgcctctgcccccag

SEQ ID NO: 27910 - DNA, 347 bp, Homo sapiens
  misc_feature 1..347: note = chr2:223167226-223167573
  misc_feature 1..347: note = hyper
  source 1..347: mol_type = genomic DNA
gcaggctgacacggtcgagcagagaagttcctggccacccgcccggccccaggcgtgattctcaggatgcagtaaaagttgggcaaacgccgagaaaccctcaatcccacagaaaggctgccgggggctcacggggaggacatcaaaacgccaggttcgtgatcatgagcttccggtccggatgtgatgatacaggattggtgaatgcccgggttaaacccgtggtccttcgcagccgctgcctcagtgacagtcattaggccccccgcagttatttgtcaaaagcattggcgccgctcttctccccatcgaaaaatcagtcgggatgagttcggattaagggacta

SEQ ID NO: 27911 - DNA, 395 bp, Homo sapiens
  misc_feature 1..395: note = chr2:223168437-223168832
  misc_feature 1..395: note = hyper
  source 1..395: mol_type = genomic DNA
aacaggtctttctttcgctcggatcaggactggactccttctgactccacgcggccccagctcctgaaccagcgcagtgagcctcagccgcttctcaaactgggtctcagaaaatttctcctcgagatggatttcagcggcaggaaagaggggccagtgacgcgaggagcaagaaaagagtaacatgggagatgaatgttcaaacccagatctcctcgctgagcctggaagctcgccaccgtgggatcacgggaaccagaggcaagaggctgcgaatgagtccaacacccgcgttcctcgagttttaaaagcacacctggggccagagactgcacagccaactaaacggagtaaacgcaacaggtggaggaggcagagttgtcaggggccaagcc

SEQ ID NO: 27912 - DNA, 972 bp, Homo sapiens
  misc_feature 1..972: note = chr2:223168916-223169888
  misc_feature 1..972: note = hyper
  source 1..972: mol_type = genomic DNA
cggagatatccaactccacccgggcgtctcctgagagcgcacagtccacagaccccgggagggctgcccgccctaggacacgtactctcccgacccctcactctttcaaaattggggaagaggcggaggagatgaaaaagaagaaagagagaaagagaagaaaagagagaaagaaggaaagaaattttaaaaaataataaaaggagggaagaatggaggtaaaacgcgggggagagaagaggggagaaactctcctcaccacaaccaaagcaggaggcctaagcttcctgaatttctacacatgacttgcattaagttccttcctagaacttaaactttttcatctcccgtcacccaagaaaacacccatttcctcttttaaataaagtttctttttctggagatgaacctttaaataagtcgtacgtttgggagcgagggacaggagaataattttgatccagaaccttggagattggagaagcaggtggaaaaattctaaaaagatgaaaactgaccatctccgacacagaaacccatcgaaaggggccaccgagacccgttgattagctggagggagcatgcggcagaagtgcagacccctcgctaacccgccaacctccaagagccctcttgcagaaagctgcccggctccccacggtggccctgcgcgcgcaccatcctcgcggtctcgcttcttcgccccggaaaactctatgaggggcaccccagcctcagccgggttaagacaagtagccccaagaggaaggagcctcagagagcctttcttcctgttcttcttcgtcttcttttttttctaaacgaaatctaatactatctggctgcaaaaatatattatcaccggctctcagcctaagagactaacatttggatatgtaggaaatgtaatctgcatggctaattgattctcagcgtatcagtttaaaggataaagatcgatatctacatgat

SEQ ID NO: 27913 - DNA, 1010 bp, Homo sapiens
  misc_feature 1..1010: note = chr2:223170354-223171364
  misc_feature 1..1010: note = hyper
  source 1..1010: mol_type = genomic DNA
cttctttccatccctcggccccctcccagagggcagcgacgaaagccctggccgagcacaaggatcggtgatctgggctcctggaggtaccctctagatggggtaaggacggggaaggatcaagaggttctgcgggaagtgtgcggggctggggggcgggggtgcccgccaatgtccgcagaaggcaaggaggcccactcgaggagggctggatggagacagacttgagtcgggccctgagccccagggagtgcggcccggtagatctcggggcgaggggaacaggatcgggtacacttgatccggaacaagaacgcctcggcctggcggttgcccgttagtcccggatcccagcggccgcttcaccactgagcccgagccgccgagggaattttccaaatgcaaatcaaacacccttggcgccccgcttcttcattaattaagaggaacgtttcgacaaaaccggcgtaatctttattaattacgcagcccttagcgcgccgttcgcatcaatcacgcccaaagcgaaagtgcagggggcgcctaatcccttcccagagcgcgtttggagaaggagccgcgtggccggcgtttccaccgtgacttccacctttctgggctcgcctggcactggctgctcagccggcgcgcagggaggcctttccggaaacaccggctggctgcgcgctagcaggaccgctctagatcccctgacaggccggaaaataacccccactcactatttgggcacgcgctcgtacgcagaaactcgcacagggactcgcgtggacactttatggcccatttcctccgtcccctcacccttaggctcagtggggaccacgcggttctcagtcctcctcttccctaggaccctctaaaaaggagcctggggcgaaatgacagagggaggcagaaaacctcctgttgccccaggacgccccgaaaaactgctctgggggatggggcggggaagaccttagaagttgtcagggcgaccaactcctccc

SEQ ID NO: 27914 - DNA, 218 bp, Homo sapiens
  misc_feature 1..218: note = chr2:223171861-223172079
  misc_feature 1..218: note = hyper
  source 1..218: mol_type = genomic DNA
cgggcgcccttggctcgagggcctttcggagcctccgcgggaagcagaaagtcgcacctcacactgagcctttccttcgagcgctctgccgggagctactgagccccagcacgcagccttgggcacccggtggcgggcgaaggaacctgccccattgtgctgctgggctgcactagcggagacgagagtgcgtgtgggagtggcccactagcaccacc

SEQ ID NO: 27915 - DNA, 185 bp, Homo sapiens
  misc_feature 1..185: note = chr2:223173045-223173230
  misc_feature 1..185: note = hyper
  source 1..185: mol_type = genomic DNA
gagcctcctcccttccggtgatcgtggctcaaaaatccaggatggacctgggcctcttcatctagcccccatcggctgaaaagtgcatttttatttgacagaaaatgacagcgcgccttcttggtgtccagatccccactctacaggacctgtcactcccatttcccatacgagaggaaactccc

SEQ ID NO: 27916 - DNA, 416 bp, Homo sapiens; identical to SEQ ID NO: 273
  misc_feature 1..416: note = chr2:223176096-223176512
  misc_feature 1..416: note = hyper
  source 1..416: mol_type = genomic DNA

SEQ ID NO: 27917 - DNA, 489 bp, Homo sapiens
  misc_feature 1..489: note = chr2:223176719-223177208
  misc_feature 1..489: note = hyper
  source 1..489: mol_type = genomic DNA
cgtgggcatcttggaatattaaaaacgtcatccggttgtaaataacctactccccagcccttgaaatccgggacgtcacaggtgaggctgaataccaggttcgcacaaaggcaaaccaaactcagccgggatgccgagtgatggggttggcaagatagtgtggcctctggttccctccacgcgtgataagtgggatcatgacagcgtccttgtgccttcgatttgtccccaagccctcctctgcctttccgatctcaaactaacccgtaatggagctggcaagtgggacgaacgggacagcctaaagcgtcgttggcccggccaagaggggctcaacgcctgtcaccccgggcggccttgggtcctttgcagtcggagaggctgcaggggaggaggaagacccagccagctccagggtgcaggattctgcccttccacccgagagcctcccccggtgtcccagtggcagtggctgccccgggctgcggt

SEQ ID NO: 27918 - DNA, 410 bp, Homo sapiens
  misc_feature 1..410: note = chr2:223177244-223177654
  misc_feature 1..410: note = hyper
  source 1..410: mol_type = genomic DNA
cgccctgccccttgggctcagctgcgagccaccgccggcgtgcgcacccacaaggagagaaatggaggtaatcccccgcttcccaccgactgccggaagctcggcctctgtgcaaaccgaagtatacctgcacccaagagcgtggaaataatttacacgctgaatggctactattaaaaaggatctttttaacagatctcctggcgagtattttaaaacaggactctgcgctagatcagctcgcccgtcggcagctgtcagcgaccagccgacaagctgagattcccctttcagctgtcactggcgatgacacccacatctatcactggcgatgttttgttaatttaacctcgagacttccctgattatccgcataatccgtcctcaaatcccctcgttgtcactgcatt

SEQ ID NO: 27919 - DNA, 41 bp, Homo sapiens
  misc_feature 1..41: note = chr2:223185352-223185393
  misc_feature 1..41: note = hyper
  source 1..41: mol_type = genomic DNA
accagtgatgtaatgcgggacccgcgcggggaggggaaacg

SEQ ID NO: 27920 - DNA, 133 bp, Homo sapiens
  misc_feature 1..133: note = chr2:223536428-223536561
  misc_feature 1..133: note = hyper
  source 1..133: mol_type = genomic DNA
ggcacttcccacaggcgccgcagagcagcgtgggtgcaggctgcagtggctggcgccgtcctcgcccggccaggccatgaaggtagagtttgcaccgctcaacatccagctggcgcggcggctgcagacggtg

SEQ ID NO: 27921 - DNA, 45 bp, Homo sapiens
  misc_feature 1..45: note = chr2:225906010-225906055
  misc_feature 1..45: note = hyper
  source 1..45: mol_type = genomic DNA
ttccggtccaccaaacgcaggccaagagcgcggctgctgagcccc

SEQ ID NO: 27922 - DNA, 375 bp, Homo sapiens; identical to SEQ ID NO: 6682
  misc_feature 1..375: note = chr2:225906404-225906779
  misc_feature 1..375: note = hyper
  source 1..375: mol_type = genomic DNA

SEQ ID NO: 27923 - DNA, 572 bp, Homo sapiens
  misc_feature 1..572: note = chr2:225906790-225907362
  misc_feature 1..572: note = hyper
  source 1..572: mol_type = genomic DNA
cgctgcctcgctgaggtggcgccgggggagcccgcagaggcggcgggggagggagtgcggaggagaggacccgtgagctgcggggacctgggcccgccgagcttttggggaagctgggctccgttccccccgggcgcctggggcgcgcgggaaggcgcggaggacgcgccgcactcacccgctgctgctgccggctgctgactgccaccgcggcggcggacgcggcgctgtgccggagctcggccgcctgcccaggtctcaacaggctccgggtgaacctgcgggtccgctcaccggccatcgccggtcacgccaatcgcgccgcgggcccggggcgcgcctcccgccggtcttccccgcgccaaccttctctatccacccgccgttcaggaagcggaactcggagccttcccccccctcttcctcgctcaactcgcaagaggcgggtttttctctcttgcacccccactcttcccacccccttccctcctctgaagcttctcgaagactttccaaactctgcgctcccccgggcgcgcgcggccaactcggctggcggccgggccctgcag

SEQ ID NO: 27924 - DNA, 128 bp, Homo sapiens
  misc_feature 1..128: note = chr2:225907439-225907567
  misc_feature 1..128: note = hyper
  source 1..128: mol_type = genomic DNA
cggccggggctgtccacgccgcccgggggaactgcaggctgcgggggagggcggggggcggccgccgaggggctccgggcggggcctgtccaaggccgtcgcctgtccaaggccgtcagcctcatttg

SEQ ID NO: 27925 - DNA, 174 bp, Homo sapiens
  misc_feature 1..174: note = chr2:226896159-226896333
  misc_feature 1..174: note = hyper
  source 1..174: mol_type = genomic DNA
ttgtgagagaggctgcggatgcgacccagctccggctcagctgcgcgcgtttgcaaatgcggctgcgtccagacagggcatggaacacatttccaagctcacgtccccgtttcttgtttacagctgagattataagcaatctatgtgccctcttatcatcgtgtcaggcaatga

SEQ ID NO: 27926 - DNA, 85 bp, Homo sapiens
  misc_feature 1..85: note = chr2:227663424-227663509
  misc_feature 1..85: note = hyper
  source 1..85: mol_type = genomic DNA
gaagccatcgctctccggagggctcgccatgctgccaccgccaccaccaacgctgagcagagggaggctccgaaaaacaaccggg

SEQ ID NO: 27927 - DNA, 67 bp, Homo sapiens
  misc_feature 1..67: note = chr2:228029415-228029482
  misc_feature 1..67: note = hyper
  source 1..67: mol_type = genomic DNA
cgcccaggctctgagcgcgcgcccaccatgagcgcccggaccgcccccaggccgcaggtgctcctgc

SEQ ID NO: 27928 - skipped

SEQ ID NO: 27929 - DNA, 15 bp, Homo sapiens
  misc_feature 1..15: note = chr2:228582819-228582834
  misc_feature 1..15: note = hyper
  source 1..15: mol_type = genomic DNA
cgtccagacctttca

SEQ ID NO: 27930 - DNA, 134 bp, Homo sapiens
  misc_feature 1..134: note = chr2:228736154-228736288
  misc_feature 1..134: note = hyper
  source 1..134: mol_type = genomic DNA
tagctcctctgaggtcgcccttagtgaggacacgaggtgccctcacctctttcactctagacacctccagaacactcgccccccgcgcgccggagccccgggtcgccaccaaccgcccgcggagccagacctcc

SEQ ID NO: 27931 - DNA, 385 bp, Homo sapiens
  misc_feature 1..385: note = chr2:229046118-229046503
  misc_feature 1..385: note = hyper
  source 1..385: mol_type = genomic DNA
ccagcgaggctgggccggacttatttacaagtgcagtgacccctgtctcctcgctgggagccccgtgcaaaccgaagcgctctggggcaagttggtgagcgactcacaacgcggaacggagtttgatcgacatggtattgggcatagaaagaagcgggtcttaccttggtaccgagagcagggagttgccatccattgttggtgggcgcccagagaagaaagacggaaagtgcaggcgaaggataagtctgtggtgctaggacccagctcccagagtgccagactggcgcgcgccaggagagaggcgcgcaggctggggcggcggcggcgcccacggagactagctcctccctggccagcaagctctgtgcgctgcgaccgcccg

SEQ ID NO: 27932 - DNA, 15 bp, Homo sapiens
  misc_feature 1..15: note = chr2:229046730-229046745
  misc_feature 1..15: note = hyper
  source 1..15: mol_type = genomic DNA
ccctgaagttgttca

SEQ ID NO: 27933 - DNA, 593 bp, Homo sapiens
  misc_feature 1..593: note = chr2:230578129-230578722
  misc_feature 1..593: note = hyper
  source 1..593: mol_type = genomic DNA
ccggtgccctgctcacgccccggctgccagccccaagcgtgcgccccgtggagcgtccggcaggaagggcggccctgccagcgccacgtacaatgccccctcgaatgcctccgactgttccaacactgctcctaagcttagagagggctggtcgcaggccgaggggaggcagctgccctcctcgtcctctggctgctttgtcacagccctcaagggcgtaggaagagaaggagaaagtgccccaccacctggcacggggcccaccatcacctgcctcccacaccgcacaccctttacacacacagggtccagccggacgtggagcgtggaccacctggacattgaacacctcgccggggacgctcggagccggctcctccgcgctgccaaggcgggcaccgctcaagtggttcttggctcggcccggcctggaggggcgcgccactcagtggccaaccggagcgtctagagccccgcgcgagaagtgccgagccccggagcggcacaccccgagagcccggctggccccgcccgggaaccagggcgggtaagggaatcagggtcggcccgggggtccgcgtccacgcgggcca

SEQ ID NO: 27934 - DNA, 34 bp, Homo sapiens
  misc_feature 1..34: note = chr2:231191860-231191894
  misc_feature 1..34: note = hyper
  source 1..34: mol_type = genomic DNA
ggtgagtcagtctgtcggccgacttcctgctccg

SEQ ID NO: 27935 - DNA, 87 bp, Homo sapiens
  misc_feature 1..87: note = chr2:231693406-231693493
  misc_feature 1..87: note = hyper
  source 1..87: mol_type = genomic DNA
cgccccagggctggggccttggagcctgggaaagcaaccgggggtctctggggagtcctgagcgcaggcgcccgcccacggccaaga

SEQ ID NO: 27936 - DNA, 46 bp, Homo sapiens
  misc_feature 1..46: note = chr2:231714930-231714976
  misc_feature 1..46: note = hyper
  source 1..46: mol_type = genomic DNA
ttatgttctcaagtgcgccccctggcggctgcggggagaacagcct

SEQ ID NO: 27937 - DNA, 132 bp, Homo sapiens
  misc_feature 1..132: note = chr2:231903040-231903172
  misc_feature 1..132: note = hyper
  source 1..132: mol_type = genomic DNA
cctagagccaggcctcgcagctagcggagagcgggccgtgcgtagcggatcgagtctgtcccggaagggtccggagtgcacgggagatgcctagggggcgtgggaaagctgaggggccgagtagaaggcaga

SEQ ID NO: 27938 - DNA, 82 bp, Homo sapiens
  misc_feature 1..82: note = chr2:232394940-232395022
  misc_feature 1..82: note = hyper
  source 1..82: mol_type = genomic DNA
ccccggtggcggggacggggggcaccccgacggagccctcggacccttcccgccctaggacgaccctgcccgcaccgagccc

SEQ ID NO: 27939 - DNA, 365 bp, Homo sapiens
  misc_feature 1..365: note = chr2:232395054-232395419
  misc_feature 1..365: note = hyper
  source 1..365: mol_type = genomic DNA
cgcctgcgcacctaccatgcggcccgcggcccgcgagaccccggcttccaccctccgagcgacggacacagacgcggcgcgggagccagtggactgactgacagcggccccagcccgcgccccgacgccccgcctgtccggccgggaacgccgccagggggcagtgcagtccccgcagcccgggcggcgccccctcccgcactggcggaggacgcggccgttggaggcgacacctccacaagcagcgtggaggcgacacctccacaagcagcgttatctgacggaaccctcacaacaacccgttttacagatgagaaaactgagcctcagagagccgcagaggaggagcccgagagacctggggc

SEQ ID NO: 27940 - DNA, 41 bp, Homo sapiens
  misc_feature 1..41: note = chr2:232526765-232526806
  misc_feature 1..41: note = hyper
  source 1..41: mol_type = genomic DNA
aagagggcccagctgcgccattagcgcgtgcgagggaaaat

SEQ ID NO: 27941 - DNA, 32 bp, Homo sapiens
  misc_feature 1..32: note = chr2:232527207-232527239
  misc_feature 1..32: note = hyper
  source 1..32: mol_type = genomic DNA
ctccgccgcgtctcccgcgtctggggcgcggc

SEQ ID NO: 27942 - DNA, 499 bp, Homo sapiens
  misc_feature 1..499: note = chr2:232791530-232792029
  misc_feature 1..499: note = hyper
  source 1..499: mol_type = genomic DNA
cgcagccctgcttgtcgccaaactcttccctgggcacctgacagccgcgggatggcattgcagctccgcctttcacctgccggtcagggcgggagcgcagaccacagcgacgtcgttaggttggggaggcagaggatggggttggaggactggggtgggaggcgcagggagagcggggttcgcctgggccgcaggggggagcgcaagtcttccacactggagagtgcaggggtgtcgccagcctgagtgtttgagcgcaaggcgggaacgaggggactgcgagcgcggaaccaagatattcatgctcatgcgtgtgctccgcggcatcgtatgctcgccagttactgctctaggttcacgttcagccggtttcggccacacagaacgtcccggggtctgactccgctggtgaactccctctgtgggaacaatgcgcacctgaccttgcctgcacccacgcgaggatccgctgctgggggaagcccgctccagtatcctg

SEQ ID NO: 27943 - DNA, 30 bp, Homo sapiens; identical to SEQ ID NO: 6692
  misc_feature 1..30: note = chr2:233283450-233283480
  misc_feature 1..30: note = hyper
  source 1..30: mol_type = genomic DNA

SEQ ID NO: 27944 - DNA, 63 bp, Homo sapiens
  misc_feature 1..63: note = chr2:233283709-233283772
  misc_feature 1..63: note = hyper
  source 1..63: mol_type = genomic DNA
cggccgctggctgggcgctcgggaatcgcactcaggcggatgacgtagcgcgaggagttcctg

SEQ ID NO: 27945 - DNA, 30 bp, Homo sapiens
  misc_feature 1..30: note = chr2:233285064-233285094
  misc_feature 1..30: note = hyper
  source 1..30: mol_type = genomic DNA
agacgcttcgcaaaacggccaaagaaccaa

SEQ ID NO: 27946 - DNA, 66 bp, Homo sapiens; identical to SEQ ID NO: 6694
  misc_feature 1..66: note = chr2:233285777-233285843
  misc_feature 1..66: note = hyper
  source 1..66: mol_type = genomic DNA

SEQ ID NO: 27947 - DNA, 277 bp, Homo sapiens; identical to SEQ ID NO: 275
  misc_feature 1..277: note = chr2:233350263-233350540
  misc_feature 1..277: note = hyper
  source 1..277: mol_type = genomic DNA

SEQ ID NO: 27948 - DNA, 436 bp, Homo sapiens; identical to SEQ ID NO: 276
  misc_feature 1..436: note = chr2:233350843-233351279
  misc_feature 1..436: note = hyper
  source 1..436: mol_type = genomic DNA

SEQ ID NO: 27949 - DNA, 319 bp, Homo sapiens
  misc_feature 1..319: note = chr2:233351415-233351734
  misc_feature 1..319: note = hyper
  source 1..319: mol_type = genomic DNA
cgtggccgccggcctcctcgtgggcctccgcatggccctggggccgcagctgcgggaagggcggaagcaggctcaggaggcgccgcagccggatggggctcagggtcaccgcgaggagggacacaggcctgggtgcagaggccccagccgcgggcctcattcactgcggaaaccagggactatgagggttcggcggggccaccacccccgggtgcacagtggagtcttcccccctgtcccctccctgcacacacttgagggccgcagggttgggagggctcttattggaagcaagaggcgccaggcaaggggcctggca

SEQ ID NO: 27950 - DNA, 218 bp, Homo sapiens
  misc_feature 1..218: note = chr2:233351789-233352007
  misc_feature 1..218: note = hyper
  source 1..218: mol_type = genomic DNA
cgacctgccccagccaaggccgggtggagtgggggaagaagcggaggctggagtgaggaggtgcggtcaggggcgcgtctatgcgacactttcagctctccgcgctggacccagacagacgctccgcaaagcggccaaagaaccaaactttgtcctcgcggaagtccgcgggatcgaccacgccaaccccgctccctggctccttctgctcggtggcc

SEQ ID NO: 27951 - DNA, 351 bp, Homo sapiens; identical to SEQ ID NO: 278
  misc_feature 1..351: note = chr2:233352101-233352452
  misc_feature 1..351: note = hyper
  source 1..351: mol_type = genomic DNA

SEQ ID NO: 27952 - DNA, 257 bp, Homo sapiens; identical to SEQ ID NO: 279
  misc_feature 1..257: note = chr2:233352506-233352763
  misc_feature 1..257: note = hyper
  source 1..257: mol_type = genomic DNA

SEQ ID NO: 27953 - DNA, 150 bp, Homo sapiens
  misc_feature 1..150: note = chr2:233352775-233352925
  misc_feature 1..150: note = hyper
  source 1..150: mol_type = genomic DNA
cgagtgagggcagcgagtactcccgtgaagggtcccctccgatccagtgtccccactcccagccgcccaccagccggctggaaaggggctggagctggagatgaggagccgaggactcctccgaagggctgggggcggtgtcagtagtgc

SEQ ID NO: 27954 - DNA, 38 bp, Homo sapiens
  misc_feature 1..38: note = chr2:233367784-233367822
  misc_feature 1..38: note = hyper
  source 1..38: mol_type = genomic DNA
caaacacgcactctgcggaaggccggggcgggcctggc

SEQ ID NO: 27955 - DNA, 152 bp, Homo sapiens
  misc_feature 1..152: note = chr2:233368141-233368293
  misc_feature 1..152: note = hyper
  source 1..152: mol_type = genomic DNA
tataggtcaatgtcccgctcagcctccctcccccagcaccgtgaggaccgaggcctggggcctggcgcccgcctggtggacctcgggggcaggctggggaccgggcccctgcgggacgcggcgcggcaggacgctccccgcgcctttctttc

SEQ ID NO: 27956 - DNA, 451 bp, Homo sapiens
  misc_feature 1..451: note = chr2:233388723-233389174
  misc_feature 1..451: note = hyper
  source 1..451: mol_type = genomic DNA
gctccgactcctgtccggtccgcagagctgcgctcgctggcgcacacgctgctgggcctgctgcggaacgcgcaggagctgctcgggcctcgtccgggactgcggcgcctggcccccgccctggctctccccgctccagcgctcagggagtctcctctgcaccccgcccgggagctgcggcttcactcaggtaccccgcgccctccagcccagcccagccctggcccggccccacccgcgcggcacagccactttctccgccgaggcggtaccctaaccctgtgcctccccaggatcgcgggctgcaggcactcggttcccgaagcggaggccggagccgcgcggagaagccaacggtaatgacgccccctgccgaccttcaggaggggataggctgagggcctggacgaggtcggaagcgcttctactgcagctccggaaagggcttacc

SEQ ID NO: 27957 - DNA, 182 bp, Homo sapiens
  misc_feature 1..182: note = chr2:233498345-233498527
  misc_feature 1..182: note = hyper
  source 1..182: mol_type = genomic DNA
cgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcc

SEQ ID NO: 27958 - DNA, 303 bp, Homo sapiens
  misc_feature 1..303: note = chr2:233498571-233498874
  misc_feature 1..303: note = hyper
  source 1..303: mol_type = genomic DNA
cggagctgagcgcccagctgagccggcggctggacatcaacgagggcgctgcgcggccccggcgctgcagggtcttcaacccctacacggagttcccggagttcagccgccgcctcatcaaggacctggagagcatgttcaaactgtgagctcccgctgcgcgcccttcgcccccgggaccagggagggagcgggagggctttctggtccgaagtcccgggccctgtttgtgtggggaggggtcccggggtgcaggtagcatttggcccaacgcagccagatcttgcgtgctcgggtctatct

SEQ ID NO: 27959 - DNA, 385 bp, Homo sapiens
  misc_feature 1..385: note = chr2:233498895-233499280
  misc_feature 1..385: note = hyper
  source 1..385: mol_type = genomic DNA
cgaagaggggggacaccaggagcaggagctctccgggacggagcccaaaagttctcggcggctgccgggcccgagttccaggtcccccaaccccgaccactggtcccgccccctccgcccgccagtccggagatttgctccgaaagcaacttctaggaaagggagccgtcgccgcgcctcacctgccagctttcactgtatccccccaagggaaaaattagcccctgttggccttttatcttttaaaacaaaaggggaaagttaatccttggctgcagcgcggggtctgatgaatgagcggaggccgagaacggggagtttggtaaagtcgttgtaagagattcaggactttcctggagcaggcgcggcccgggagcctcctggg

SEQ ID NO: 27960 - DNA, 621 bp, Homo sapiens
  misc_feature 1..621: note = chr2:233740929-233741550
  misc_feature 1..621: note = hyper
  source 1..621: mol_type = genomic DNA
ggtgacatggtcctccgtcctccgcagggtcgctggggcccggcgctatcgcggccatcgtgatcgccgccctgctggccacctgcgtggtgctggcgctcgtggtcgtcgcgctgagaaagttttctgcctcctgaagcgaataaaggggccgcgcccggccgcggcgcgactcggctgcactcctcacgcgcctgtatgtccgcgcgtgcgtgtccgcgcatgcaggtgtgccagagcgtgagcgcgcgcaggcgagcgctcagggcgggggtgcgcgcggggccgagggtgggtgccgtgcacgcgcgcgggtccggaggcgcgcccgaattccccgcaggggcgccggggcgtgcgtgagcgcacagcatgtccgagcccgcctgcgtgtggcgtgcacctgagcgcgcgcagggccgcgcggctcggcgtccccgtgcaccacggctggagtgcctcaggagcgcgccgcatgtgcgtgcccggtgcgcgtgcgccggggccgccagggcatcggagcgggtgtgcggccagcggtcttagcccgtccgggggcaccgtcacggtcagggccacgccacgggcggccccttctcccggcgccgcctcctctgcctg

SEQ ID NO: 27961 - DNA, 67 bp, Homo sapiens
  misc_feature 1..67: note = chr2:234475179-234475246
  misc_feature 1..67: note = hyper
  source 1..67: mol_type = genomic DNA
ccgaaaccactgccccgactccaggagagcgccgcgtcctcaggcaggcctgggcagcctctcgcct

SEQ ID NO: 27962 - DNA, 30 bp, Homo sapiens
  misc_feature 1..30: note = chr2:234475473-234475503
  misc_feature 1..30: note = hyper
  source 1..30: mol_type = genomic DNA
cgccggcccctcgcacggggccttatggga

SEQ ID NO: 27963 - DNA, 117 bp, Homo sapiens; identical to SEQ ID NO: 6710
  misc_feature 1..117: note = chr2:235404416-235404533
  misc_feature 1..117: note = hyper
  source 1..117: mol_type = genomic DNA

SEQ ID NO: 27964 - DNA, 19 bp, Homo sapiens
  misc_feature 1..19: note = chr2:235404550-235404569
  misc_feature 1..19: note = hyper
  source 1..19: mol_type = genomic DNA
cgcgggttctcgctcatcc

SEQ ID NO: 27965 - DNA, 273 bp, Homo sapiens
  misc_feature 1..273: note = chr2:235404629-235404902
  misc_feature 1..273: note = hyper
  source 1..273: mol_type = genomic DNA
ctccccggtcgctccgggcgcattaccgcttcttcttctgcttgagggacttcctgcgtttcaggatcatctcatagagcttgtccatgccctcggtgaggccctcgccgatgatggcgcacgccggctggacgtgataggtggtggccgggataagctcgtgcagcgccagctgcttctcaatctctgccaccggcagcgacttgggcaggtcctgcttgttggcgatgaccagcagcggcgtgccctggttctcggcgaacttggtcacct

SEQ ID NO: 27966 - DNA, 30 bp, Homo sapiens
  misc_feature 1..30: note = chr2:235860068-235860098
  misc_feature 1..30: note = hyper
  source 1..30: mol_type = genomic DNA
tttatgattttcagccggactgccttccct

SEQ ID NO: 27967 - DNA, 52 bp, Homo sapiens
  misc_feature 1..52: note = chr2:236402749-236402801
  misc_feature 1..52: note = hyper
  source 1..52: mol_type = genomic DNA
ccgcggcttgcaaggcgcctgcgactcggtcccaggtcggcgggcggcgcac

SEQ ID NO: 27968 - DNA, 155 bp, Homo sapiens
  misc_feature 1..155: note = chr2:236403151-236403306
  misc_feature 1..155: note = hyper
  source 1..155: mol_type = genomic DNA
cccgcgggccagccccgcgcctgctccgcccgcgcctttcttctcgcgcctcctccgcccgccgccggcgggcccggctccccgggggctgcggcgccccgggctcggcggcccgcgggccccggggcgcggggcggcggcggcggggggcgcgc

SEQ ID NO: 27969 - DNA, 30 bp, Homo sapiens
  misc_feature 1..30: note = chr2:236403854-236403884
  misc_feature 1..30: note = hyper
  source 1..30: mol_type = genomic DNA
caggccaggcctgggcgtcttgctggacgt

SEQ ID NO: 27970 - DNA, 89 bp, Homo sapiens
  misc_feature 1..89: note = chr2:236577966-236578055
  misc_feature 1..89: note = hyper
  source 1..89: mol_type = genomic DNA
gatgcctcatttaaacgcgcagcaggtgagacatgcccctcgttttgttcttgcaggccaagccccagagtgggcgtggttttagggtg

SEQ ID NO: 27971 - DNA, 44 bp, Homo sapiens
  misc_feature 1..44: note = chr2:236579046-236579090
  misc_feature 1..44: note = hyper
  source 1..44: mol_type = genomic DNA
cagctggaactggggcggctccggccgtgcgcacgcggcctgga

SEQ ID NO: 27972 - DNA, 163 bp, Homo sapiens
  misc_feature 1..163: note = chr2:237068390-237068553
  misc_feature 1..163: note = hyper
  source 1..163: mol_type = genomic DNA
ttgggggtgggtgcccggagtgacgtccgcccccccaccccgggcccggccctgcctcaggcttttgcctcgggcccaggccgctctcgagccgtgggcgcgccctcggggctcggcccccggtttcggtctcaggcccccgggagtatcaggagaacaaggt

SEQ ID NO: 27973 - DNA, 21 bp, Homo sapiens
  misc_feature 1..21: note = chr2:237068626-237068647
  misc_feature 1..21: note = hyper
  source 1..21: mol_type = genomic DNA
cgcagccgggcctcctgcctc

SEQ ID NO: 27974 - DNA, 16 bp, Homo sapiens
  misc_feature 1..16: note = chr2:237068925-237068941
  misc_feature 1..16: note = hyper
  source 1..16: mol_type = genomic DNA
gcggtggaggctaggg

SEQ ID NO: 27975 - DNA, 357 bp, Homo sapiens; identical to SEQ ID NO: 281
  misc_feature 1..357: note = chr2:237072641-237072998
  misc_feature 1..357: note = hyper
  source 1..357: mol_type = genomic DNA

SEQ ID NO: 27976 - DNA, 16 bp, Homo sapiens
  misc_feature 1..16: note = chr2:237072999-237073015
  misc_feature 1..16: note = hyper
  source 1..16: mol_type = genomic DNA
ctcacactcgctggcc

SEQ ID NO: 27977 - DNA, 440 bp, Homo sapiens; identical to SEQ ID NO: 283
  misc_feature 1..440: note = chr2:237073056-237073496
  misc_feature 1..440: note = hyper
  source 1..440: mol_type = genomic DNA

SEQ ID NO: 27978 - DNA, 28 bp, Homo sapiens
  misc_feature 1..28: note = chr2:237073564-237073592
  misc_feature 1..28: note = hyper
  source 1..28: mol_type = genomic DNA
cgcttgcctcctccgggcacccacctcc

SEQ ID NO: 27979 - DNA, 55 bp, Homo sapiens
  misc_feature 1..55: note = chr2:237075130-237075185
  misc_feature 1..55: note = hyper
  source 1..55: mol_type = genomic DNA
ctttctccttcccaccgtcatttggacattccgcgccccccgccccccacccttt

SEQ ID NO: 27980 - DNA, 47 bp, Homo sapiens
  misc_feature 1..47: note = chr2:237076012-237076059
  misc_feature 1..47: note = hyper
  source 1..47: mol_type = genomic DNA
tctcccgcgggaacccggcgctggcccgcccccgcctcctcccgccc

SEQ ID NO: 27981 - DNA, 34 bp, Homo sapiens; identical to SEQ ID NO: 6720
  misc_feature 1..34: note = chr2:237076602-237076636
  misc_feature 1..34: note = hyper
  source 1..34: mol_type = genomic DNA

SEQ ID NO: 27982 - DNA, 91 bp, Homo sapiens
  misc_feature 1..91: note = chr2:237076656-237076747
  misc_feature 1..91: note = hyper
  source 1..91: mol_type = genomic DNA
cgccgcgccgccgccgggaagcccgccggacgccgggagcaccgccgggagcgccgggcaggggccgagcgggacccggagagcagacgcc

SEQ ID NO: 27983 - DNA, 171 bp, Homo sapiens
  misc_feature 1..171: note = chr2:237077033-237077204
  misc_feature 1..171: note = hyper
  source 1..171: mol_type = genomic DNA
cgcgctcctctttctcattcacattttgcctgccgcctggcccggctcgcctcacgtggggctgggcgcctctggccattggctgagcggggcgggggtggggcgaaagcggggccccgccctttccacccaagctggcctcgagcgggctgcgggcgccaccgtcggagc

SEQ ID NO: 27984 - DNA, 200 bp, Homo sapiens
  misc_feature 1..200: note = chr2:237078315-237078515
  misc_feature 1..200: note = hyper
  source 1..200: mol_type = genomic DNA
ttaaaaatcagctcacgccgaggagctagtggttggggagttggcccgtgttggacgtgtgttatgtatcacttacaagcacatttaattgggagataaagataaatcgatctttatgaatttatcgacccgattctttgaagctcttttttcgcgttcttcctctttctctcgctctagccccaaggccccccggggga

SEQ ID NO: 27985 - DNA, 30 bp, Homo sapiens
  misc_feature 1..30: note = chr2:237079095-237079125
  misc_feature 1..30: note = hyper
  source 1..30: mol_type = genomic DNA
ttacgtggctacagccggggcccttccggc

SEQ ID NO: 27986 - DNA, 121 bp, Homo sapiens
  misc_feature 1..121: note = chr2:237080173-237080294
  misc_feature 1..121: note = hyper
  source 1..121: mol_type = genomic DNA
cagcccagcccaatccggaggaggaagcaccgcgaatggcgcgcttcgctgccgccgccagagtcgaggtaacgggtggtcgtggagagggtacggtgtggccacccgtggtctcggagga

SEQ ID NO: 27987 - DNA, 245 bp, Homo sapiens
  misc_feature 1..245: note = chr2:237081182-237081427
  misc_feature 1..245: note = hyper
  source 1..245: mol_type = genomic DNA
cagaaacaaaacaaccgcaaaatagaaatgtgaaggggaggggcttttcttcttcttcatttcctcctgggagttgaaaaatgttatccgcaggcctgaaggctgggaaacgtgacccttcacacctgcgccgccctctccactccagcgacgaggaacaggaggagccacagccgctcggcccgcgaggcgagccctcgtggcatctgggaatgggagggtgggggtggaatgctacacagccc

SEQ ID NO: 27988 - DNA, 18 bp, Homo sapiens
  misc_feature 1..18: note = chr2:237081536-237081554
  misc_feature 1..18: note = hyper
  source 1..18: mol_type = genomic DNA
ggccgggatccagatgtc

SEQ ID NO: 27989 - DNA, 377 bp, Homo sapiens; identical to SEQ ID NO: 285
  misc_feature 1..377: note = chr2:237082343-237082720
  misc_feature 1..377: note = hyper
  source 1..377: mol_type = genomic DNA

SEQ ID NO: 27990 - DNA, 49 bp, Homo sapiens
  misc_feature 1..49: note = chr2:237086349-237086398
  misc_feature 1..49: note = hyper
  source 1..49: mol_type = genomic DNA
acatttcacaacatacgacgcctctcctgggaagggagagctcgcgagc

SEQ ID NO: 27991 - DNA, 107 bp, Homo sapiens
  misc_feature 1..107: note = chr2:237086399-237086506
  misc_feature 1..107: note = hyper
  source 1..107: mol_type = genomic DNA
cctctactgggtgggcgcagcgccatccccattgcacgaaccgagacggaggtgcggaggccgtgtctggccctggagagtcctccctctgtcgtctgctctcagca

SEQ ID NO: 27992 - DNA, 340 bp, Homo sapiens
  misc_feature 1..340: note = chr2:237086712-237087052
  misc_feature 1..340: note = hyper
  source 1..340: mol_type = genomic DNA
cagagttttgaacaccgctggagatggcgggggggaggggggcgaatttggaggcgggacccgaactgccggccaaggaccaagggctggcctcgcccttcgctcccactgggcaccgttctcgccgcgggaccttgccttgagcgcgccccctgcgggccgcggtggggattggccccttggaaagagggaaataggctgcgcgcgccggggcgggagaggcgctgcctccagtcctcccgggtgggggtctcccctccgagatccccgagggaacccgtcccgtgcactaccggatttccggtctctgaccagctggggcttcatttctacgcgtgct

SEQ ID NO: 27993 - DNA, 30 bp, Homo sapiens
  misc_feature 1..30: note = chr2:237087461-237087491
  misc_feature 1..30: note = hyper
  source 1..30: mol_type = genomic DNA
gccccccaactcccccgcctccccggcctc

SEQ ID NO: 27994 - DNA, 200 bp, Homo sapiens
  misc_feature 1..200: note = chr2:237088039-237088239
  misc_feature 1..200: note = hyper
  source 1..200: mol_type = genomic DNA
attaggacttcaaatcgcatttctgattgggatcgctctgccgccgtcctcccagcgcctttcaaaccccagcgcttggctttcaaaacatctttttgaatttaaagcctcacatccttttgtcttccgacgccccctcccgccccacccctcccggcggctgcaagctcttcgggcctccttcccggggcaacagccct

SEQ ID NO: 27995 - DNA, 301 bp, Homo sapiens
  misc_feature 1..301: note = chr2:237145136-237145437
  misc_feature 1..301: note = hyper
  source 1..301: mol_type = genomic DNA
tgtacgccttaaacacgtgccgcttgctgaatgtcaatcacacctcggtaaagctgcttttaaagagcattgctagaaccttgtttccttcctctttctcaagactggcgggggtccacgtggccccctgatcccccctctgaactcaaatgacctttcttaggtgggtcccctgcctgagtccctgaatgcccagcagtcccgcctgcctgcgttgctgcccctgctgggcaggacatccaggcaactttgacagtcggtggagaagcagcaagggcgatgcggtttctgagagagccgc

SEQ ID NO: 27996 - DNA, 33 bp, Homo sapiens
  misc_feature 1..33: note = chr2:237145438-237145471
  misc_feature 1..33: note = hyper
  source 1..33: mol_type = genomic DNA
cgggttcccagcactaaacgtgggcgactttcc

SEQ ID NO: 27997 - DNA, 26 bp, Homo sapiens
  misc_feature 1..26: note = chr2:237145723-237145749
  misc_feature 1..26: note = hyper
  source 1..26: mol_type = genomic DNA
ggcctccctagaggccggcacagctc

SEQ ID NO: 27998 - DNA, 38 bp, Homo sapiens
  misc_feature 1..38: note = chr2:237145963-237146001
  misc_feature 1..38: note = hyper
  source 1..38: mol_type = genomic DNA
cgctaattaaacccgcgggggccggggccggggcgcgg

SEQ ID NO: 27999 - DNA, 291 bp, Homo sapiens
  misc_feature 1..291: note = chr2:237146260-237146551
  misc_feature 1..291: note = hyper
  source 1..291: mol_type = genomic DNA
tctcgtggggggaggcgggcgtctggtctcggggcggggcggacgccgcgggcctgtcccgaggtccttacccgagcgaggcggccgtgcggcagaggtgcagaggcgccaggccctcggcgctgagcaggtcggggtcggcgcggtgctgcagcagcaggcggacgcaggcggtgtggcccccgaggcaggcctcgtgcagggcgccgcggccgccggggctggcgtctgggtctgcgccgcggccgagcaggtgtcgcacgcaggcggtgtggccgtgggccgcggcga

SEQ ID NO: 28000 - DNA, 325 bp, Homo sapiens
  misc_feature 1..325: note = chr2:237416070-237416395
  misc_feature 1..325: note = hyper
  source 1..325: mol_type = genomic DNA
cgggcaggaaaaggtgaggccgggtttgcttcgcaggcacggagcgcgcaggcgcagagaggtgtttcactccttcccgtcgcgacccagagactcgcgaacctcacttcggccactcaggtgggcgcgacgcggccctagcaacggaaacgccgcgcctgcgcattgccttccgcctgccccctccccccccccgccccccgcattccgcgcctgcgccaccgcgggaggcctgggtgggcgcagctgtgggagccggtcggagtccgagcgctccgtcgcggggcccggccgcttggcgagcctgctccgggccccagcactt

SEQ ID NO: 28001 - DNA, 321 bp, Homo sapiens
  misc_feature 1..321: note = chr2:238395134-238395455
  misc_feature 1..321: note = hyper
  source 1..321: mol_type = genomic DNA
tgagcacccaaaggccggccctagagtccaggagaagagcgcagcggcgcggagctcccaggcgttccccgcagcgcgtcctcggtcctggaaccaccgcgccgcgcgtcctggcttccacatctgccccatttgcccgcggatcttgactttttcttggcgggcaaggcctcggtctcctccccgcagcagggctgcccgcggctgcgggaccctcctggtcctgatgcctggcagaatcgaaggggtgagggtacgctctctgcagcagaaagccctgggcttaaagtcctatttattatttggcgttgccacttactg

SEQ ID NO: 28002 - DNA, 41 bp, Homo sapiens
  misc_feature 1..41: note = chr2:238395845-238395886
  misc_feature 1..41: note = hyper
  source 1..41: mol_type = genomic DNA
gcggggcgcagcccacgtggttcgggcgggaggcgccggga

SEQ ID NO: 28003 - DNA, 30 bp, Homo sapiens
  misc_feature 1..30: note = chr2:238535948-238535978
  misc_feature 1..30: note = hyper
  source 1..30: mol_type = genomic DNA
cggtccctcaggtcccgcgtgcccggccct

SEQ ID NO: 28004 - DNA, 505 bp, Homo sapiens
  misc_feature 1..505: note = chr2:238536208-238536713
  misc_feature 1..505: note = hyper
  source 1..505: mol_type = genomic DNA
ggccggggccggggccgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggtgagcgctccgggagggcagccggggggcgccgggcgggcgcgggggccggacggctgtcagggtctctccggcgtccgtctgtcccgctgtgcgtctgtgccactgcgcgtccggctccaggcgggtgggccgggcaggcgcgcgccggggcgctgatccccaggcgctgcgccccggccccgatctccgaggcctgcggaccccgcacccgttctccagccccgggcccagcccgcgacgctgcgcgccctcccccaccccggccaccgtcggccgctgcgccctcgggagaggagccgggcgccgccagcgcgcgaggtggcccgg

SEQ ID NO: 28005 - DNA, 43 bp, Homo sapiens; identical to SEQ ID NO: 2193
  misc_feature 1..43: note = chr2:238864588-238864631
  misc_feature 1..43: note = hyper
  source 1..43: mol_type = genomic DNA

SEQ ID NO: 28006 - DNA, 573 bp, Homo sapiens
  misc_feature 1..573: note = chr2:238864726-238865299
  misc_feature 1..573: note = hyper
  source 1..573: mol_type = genomic DNA
cgcggcccgggtaaccaggtcccatgtaaccgcagcctggtgaagccgtgcgccctgggcgcggctacttggccctcacggcagggcggagatgcgaggccccagggttcggccccgcagcgccgctgagtccaaggaccgagctgggagtgggggcggagccaagaaggggcgcccctgcgcccacaagccgcagcgcccaggaatcccctgggcgcctccgcgtcccccgcgggctgtcccggcaggcaggcagcccaccccagggctcccctcgtggaaggacacccctgctgaccctggccctggttctggcggtgtctccactcagccctcggagggacgcccacctcccgcggagctgggggactgtggcttcctcctgcgcggggaggtcggtgggcgccgtggacccgtcccgcccctgtctgaggagccgagtcggccacagaggggcagcagactagggagggctgatgggccgtgcacttagctccctccgggctgctggccggggcccttgaacggacagatgccaactggcagatgagggggctgcgtccacccccaccc

SEQ ID NO: 28007 - DNA, 106 bp, Homo sapiens
  misc_feature 1..106: note = chr2:239072183-239072289
  misc_feature 1..106: note = hyper
  source 1..106: mol_type = genomic DNA
gagggaaacgggagccgctgcagggtcaggacgcaaagactccgaggcccttcaggccgaggggacgtcgccctcgccccacccctgcgcccggcaggcccctggt

SEQ ID NO: 28008 - DNA, 267 bp, Homo sapiens
  misc_feature 1..267: note = chr2:239140138-239140405
  misc_feature 1..267: note = hyper
  source 1..267: mol_type = genomic DNA
cgggggctgcagagccttcatctcttcctccgtcccgggatgtcggagagacggcagcccagcctccgccaccgcaaagctgcttaacgggcagcgcgagtccctcgggcaccgttggaggccgttgctcaccgttgggcaagtgctttaagaagcacgaggatgtcgagtgtcaaatgcggcaaagggctcagagctcgccgccaaggggcgtggcctccgggccgcggcggcctctgggagttgtagtcccgcctcaacttgtgg

SEQ ID NO: 28009 - DNA, 46 bp, Homo sapiens
  misc_feature 1..46: note = chr2:239755121-239755167
  misc_feature 1..46: note = hyper
  source 1..46: mol_type = genomic DNA
ggagggcggtcaggccgggtggggctgggtgcggtggctctgcaga

SEQ ID NO: 28010 - DNA, 30 bp, Homo sapiens
  misc_feature 1..30: note = chr2:239757311-239757341
  misc_feature 1..30: note = hyper
  source 1..30: mol_type = genomic DNA
cgcgtggtccatgtccgcctcccactagcg

SEQ ID NO: 28011 - DNA, 127 bp, Homo sapiens
  misc_feature 1..127: note = chr2:239757604-239757731
  misc_feature 1..127: note = hyper
  source 1..127: mol_type = genomic DNA
gaccggtgactcccccggcgggttctgaagatacttagacagatggtcgcagttttcattctcggtggtgtgtgggtgtccgtggttggcggtggaaggagcgagcatcagaaaaacctcctggggc

SEQ ID NO: 28012 - DNA, 163 bp, Homo sapiens
  misc_feature 1..163: note = chr2:239757898-239758061
  misc_feature 1..163: note = hyper
  source 1..163: mol_type = genomic DNA
cgcgcctggggtccccggccgtcggcgccctggcctgcccagtgggcgtagaggtgcgggcctgcggctccagggtttgcctggggaggacgggaggaaactgccctgcgcttcggggccagagcagccacagggccgggtgtgcccgagaagggccctgggc

SEQ ID NO: 28013 - DNA, 330 bp, Homo sapiens
  misc_feature 1..330: note = chr2:239758125-239758455
  misc_feature 1..330: note = hyper
  source 1..330: mol_type = genomic DNA
cgcccgcaggcaggtggagctgacctaggaactgggagccctgagtcccaaccttgaccctggagtacccgggaggggccccgcccatccagccccgcagggatgggcgaggggtccaggctgggaaacgggtctgggggacagggaggctgtgcgcgccgggccctgcgcgaggagaaggctcgggggacacagctgccaggagcactccaagttctggtttcctctggaagagcgattagggcgtcctgcaccgggtccttttcaccagacaccttccaagtccctttagacaagctcgagccacggaggcgccgtccttaggctctg

SEQ ID NO: 28014 - DNA, 138 bp, Homo sapiens
  misc_feature 1..138: note = chr2:240874074-240874212
  misc_feature 1..138: note = hyper
  source 1..138: mol_type = genomic DNA
agagtcatcctagagcggtagagggcgctggacctcattcgtcctgtcagctgcgattgtctgtcctttgacaggtctcagcgcagcgttctcactgtgacctccgtgcagcatcaatcacttcgttcctttctctgg

SEQ ID NO: 28015 - DNA, 26 bp, Homo sapiens
  misc_feature 1..26: note = chr2:241393141-241393167
  misc_feature 1..26: note = hyper
  source 1..26: mol_type = genomic DNA
agacccctgcgcacccgctccggctg

SEQ ID NO: 28016 - DNA, 252 bp, Homo sapiens
  misc_feature 1..252: note = chr2:241393198-241393450
  misc_feature 1..252: note = hyper
  source 1..252: mol_type = genomic DNA
cggctggcgactggcatcggggcgcccgggacccccagggcggcgacgctgccgccggtgccgccgagcctttgttccgccgccggggccggtttcacgcctgtcgccctcgcaagcagccgcgggtgacaggagccttagccggcctggggcgcggaccctcccacccggggcagaggtgtccctacgacgcccctcggtttcgggtcgcagtgcgcggcggaggttctgcggcggcggaggggctccttg

SEQ ID NO: 28017 - DNA, 684 bp, Homo sapiens
  misc_feature 1..684: note = chr2:241758324-241759008
  misc_feature 1..684: note = hyper
  source 1..684: mol_type = genomic DNA
cttggaaagggctgacgcttggggaaggggtcctccagtctctgggggaaagtccctattcccggggacgtgggcgcgcatcgggtccgcgccgggcgacgtcgcgctcgcgcccagcaggccccatgacttggcattccctccttcccctccccctcccgcccctgcggccggcagggcccccccaaccccacctaccggcgcccagcgccccgctcctgcggaccctccctcccggcggggatgctgccccggcccttcccagcgagagggcagcgcggctggtttgggggaagtcagcgtgaggagcggcttaaagcgggagtgcgaaggtcttcgcggccactgttccttcgtgtcatccgagcccgggcgccgggggcgcgccgccagcctagaccctgcggccccgcagcccctccctcgccgccgggccacacctgttacaggggcgctggctgctgagacgcaggcagtgctcgccggcggcccctcccaggtgctgggtctttctggaagggagctggggtctctggcgtgggagggggtgatgggcaggccggccgtgcaacgaagcgggtggccaggccccaacgccgcagcccccgccccgcccgcctgttttgctcccggctccagcatccgccctcccccaccccgggaaccggagcagctgcccgcgcc

SEQ ID NO: 28018 - DNA, 821 bp, Homo sapiens
  misc_feature 1..821: note = chr2:241759042-241759863
  misc_feature 1..821: note = hyper
  source 1..821: mol_type = genomic DNA
cgctgcagccgcgcaccctcccaggtgcggcgtcagcgtcctcagccccgctcaccatccctcccctcccccgccgtctgggcgcagcccctcccgcagccccgccggtggctcctctccagggaagcggaatagccggggaagggcgggggtatcccgatcccgccggccgggcgagccctcccgagggcgacccccgcccgcctaagccgagggtcccgctgcagccgagatcgcggcaaagggaccttttccagcggcacctgaagggcggacacccctgaatttcccccattgttctctgcggagatggaggaaggtctggaagtgaaggggcctcgcagtgcctgcgctttgggcggcaacaagggcgccgggccggagctccccgccctgggcgcagtgggtgcaggtgcgggctgcgggcgcgggctgccgggcgcaggtgcggggcgaggggcgcgggcgcgggaggccgggcgggcggcggccttacctctccggcgtcactggcggcggccccgcatgggcactggcatgggcgcgggctctcgagcccggagctgctgccgctcgccggctgctctgcgctgtgacggcgccgccgcgtgacgggctgcgcgcccccggcccggaccgccccgcgcccctcccgaggcgctggttggctgcgcgcggcgtccgagctccagtcgccagctggtttgtcgcgcggggagagggacgggcgacgcggccgccgcggggatggggctggggacggagggggccggggccgggctgtgacgtcaccgctgacaccgcggcgggccccgcggagg

SEQ ID NO: 28019 - DNA, 572 bp, Homo sapiens
  misc_feature 1..572: note = chr2:241760224-241760796
  misc_feature 1..572: note = hyper
  source 1..572: mol_type = genomic DNA
ccggatgatgcaacccgcccgcggacccgccgcctcgcctctaccgcggctcgtggggaccccccgccctcctctcgccccacctctccaggcccccattgtcctcaccccagcctgtccagtttaacttccttggacccccaagtcacacgccgctcgggggccaccccggcaaaccccagcctgcgtcacccgcccccagccgccttcctagttccaggggctgactggtatctctgtgcgcgccaccgtcctccctccaccgtcccagggctgggcaacttcgacaaagcctctgggcagctcgcccatgggaacctccccgcactgcggtgcgggggtgcacggatttcgggccaccctgaaccccggggctgggtcccctccagcccagcccctgccatcgagcccctgccatgggcatcctggcgtcgcctggctaagcctccctggcgcccagcaggggcctgcgctgccctagcggcctcgccgttaaccatttcatccacactcctgggagagccggcttcacctcagtcccgacagctgcgtgcgagcgccttgcaggtggc

SEQ ID NO: 28020 - DNA, 234 bp, Homo sapiens
  misc_feature 1..234: note = chr2:241771123-241771357
  misc_feature 1..234: note = hyper
  source 1..234: mol_type = genomic DNA
gggatgcgcggatggcgggggtgccgaggtgggcaaagggatcacctggggtcagtgcggggagctctgtggacaccaggatggcaagtcaggaagacgctgcccgccacggtccccctcgggcctgggaagcctggaaggtcagggcctggaggggagctgggtccaggcagggaactcacagcagagacgccccgagggtggggtcgggccaagagccgcagccaggggatg

SEQ ID NO: 28021 - DNA, 137 bp, Homo sapiens
  misc_feature 1..137: note = chr2:241771622-241771759
  misc_feature 1..137: note = hyper
  source 1..137: mol_type = genomic DNA
gaactgcaacagccccgcagtctggaaagaagccgccagcagcccgcgcggccccgcggttccacggggcctcgtccccgcccctgccccgctgtaggccccgcctgctataggccccgccccgctgtaggccccgc

SEQ ID NO: 28022 - DNA, 53 bp, Homo sapiens
  misc_feature 1..53: note = chr2:241772052-241772105
  misc_feature 1..53: note = hyper
  source 1..53: mol_type = genomic DNA
tggggtagactatggcggctgggcgcgtgcggcctgtgcggggcctccccggc

SEQ ID NO: 28023 - DNA, 43 bp, Homo sapiens
  misc_feature 1..43: note = chr2:242550007-242550050
  misc_feature 1..43: note = hyper
  source 1..43: mol_type = genomic DNA
ctgcttccccagccacggggtcttctcccggcccctcatctac

SEQ ID NO: 28024 - DNA, 490 bp, Homo sapiens
  misc_feature 1..490: note = chr3:238226-238716
  misc_feature 1..490: note = hyper
  source 1..490: mol_type = genomic DNA
ggagggggtggggggcgtttcttttaaatgtcgcttttgcagataaacgagcagggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgc

SEQ ID NO: 28025 - DNA, 120 bp, Homo sapiens
  misc_feature 1..120: note = chr3:239006-239126
  misc_feature 1..120: note = hyper
  source 1..120: mol_type = genomic DNA
gggcgcccgaatccgccgggtcccactcacgcccgccggccgccggtaggttggccctcccgcttccagcctccgccaccccatccctcgctgctctctgaggaggattccagacccccc

SEQ ID NO: 28026 - DNA, 711 bp, Homo sapiens
  misc_feature 1..711: note = chr3:239158-239869
  misc_feature 1..711: note = hyper
  source 1..711: mol_type = genomic DNA
cgaggtctagctggtctgggggtcagtcccggcctctgtctcccaccgcgcccctcgctcccctggacaccgcctggtgtgtggggctcagacccccccagtccactgcccctgtgtggctcctcctctcaggagaggattctagatcccagcccggggggggttccgaaaatgccgccagcctggagcggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttggggagcagggattggagccgggaggctggggaaagccagcccctccgttcccactctccgggctcgctgcgagccacagtgtctcagccaggggcagggccggggaactcctgcgaaaaaccacgggccggaggagcagcagccgcgcgggcccaggtacccccgccccagacggccagcagggtggagcgcagggtgggcgtttgggctgctgggcgggaaggcgggcggggaaggggtgggaggccgg

SEQ ID NO: 28027 - DNA, 153 bp, Homo sapiens
  misc_feature 1..153: note = chr3:240109-240262
  misc_feature 1..153: note = hyper
  source 1..153: mol_type = genomic DNA
gggctcgctctaggcggaggctcccgggacgcccacgtggcttcgaattccagctccaccatcactgtgatgcgtcactctggactaggcatttaactacgtgcctcagtttccctttctcaataatacggagattatcgataccctctatac

SEQ ID NO: 28028 - DNA, 32 bp, Homo sapiens; identical to SEQ ID NO: 6753
  misc_feature 1..32: note = chr3:2139944-2139976
  misc_feature 1..32: note = hyper
  source 1..32: mol_type = genomic DNA

SEQ ID NO: 28029 - DNA, 158 bp, Homo sapiens
  misc_feature 1..158: note = chr3:2140277-2140435
  misc_feature 1..158: note = hyper
  source 1..158: mol_type = genomic DNA
cgcctctcggccgcgcggggcaggtgctgcgtccccagcgctcgcctcctccggccgcgcactgagcatgcgcgggctccgggcctccggcgcgtctccccgtccccgctcgtctcccgcccgttcccacccgcccgcgcctctccccttccccgagc

SEQ ID NO: 28030 - DNA, 169 bp, Homo sapiens
  misc_feature 1..169: note = chr3:2140827-2140996
  misc_feature 1..169: note = hyper
  source 1..169: mol_type = genomic DNA
ggggccgtccagctcagagcccggaagccctgcagggtcggggagcgggagctgaacgcctgagcgcggaggactcagggccccgacgacgccaccgtcaccccacagcgacccttcttctccttctcagccggaaaataagtttgttgcgctgcgaggcagccacaaa

SEQ ID NO: 28031 - DNA, 579 bp, Homo sapiens
  misc_feature 1..579: note = chr3:3840498-3841077
  misc_feature 1..579: note = hyper
  source 1..579: mol_type = genomic DNA
tcaaagtttcagaaacgttttcggaaagcctcctccaatgggaagcgacttcgccgctgagttaagcgtccgaatcctccttcccgcggcagggacaccggcccgggccaggtctgcggaggacgcccccgggcgcgcacacacagcccgaggacgcgccctgtattttaagacgcagggtcggatttcaccccgaaacttggctcccacagccccaggccgaactgtgtctggttctcagcccccgagcccgagttctacgccgcaaagagatggggccccattgtgcctagctggcctcctagcacggacgtgtattttcttttggtctgtcttttgctaaaaaccggcagtgcgcttcgcctccctgcccagccgcagcctgccgtcccctagacaaaaagcggcgaccgcggcccggccacccgagccccgccgcgctgcgcctttgttgggcggtccacagatggtgcccagcacggggccgcgccgagggcgggggcgggaggccgcgaagagggtcgggcgggaggggaggagacggcggagcagccaatccgcgcgcggcccatcagctga

SEQ ID NO: 28032 - DNA, 430 bp, Homo sapiens
  misc_feature 1..430: note = chr3:3841494-3841924
  misc_feature 1..430: note = hyper
  source 1..430: mol_type = genomic DNA
cctcctcctcctcctcgtctttctcctcctcctgctgctgctgccgccgccgccgccgtgggtgccgggtccgcgcgcaccccaacacccccaccagctgggcctcggggtaagtccctggccggccgcgccgcggcaggaggtgtgggaggcagcgaggggaagtcgaggcaaacttggtggcgtgggagaccctacggggtctggggaacctcagggtaagatcgcgggcctgagggggacgagggggcgcggctcacggagctggggaaaatgacgaagtcgggaaacgagaatatagtgccccgtttccccccgtcccccttgccaaaaaaaaaaaaaaaaaggtgtgggagagcgatagttgggaaggcaggccagatagaaacaggcaaaaaaaggcagtgaccggagccgagcctgctggatt

SEQ ID NO: 28033 - DNA, 422 bp, Homo sapiens; identical to SEQ ID NO: 6759
  misc_feature 1..422: note = chr3:3842186-3842608
  misc_feature 1..422: note = hyper
  source 1..422: mol_type = genomic DNA

SEQ ID NO: 28034 - DNA, 262 bp, Homo sapiens
  misc_feature 1..262: note = chr3:4910288-4910550
  misc_feature 1..262: note = hyper
  source 1..262: mol_type = genomic DNA
gcctcctgtagggagcgcgggaccctcggctggcgcgggcacttcccagcccagcccggggcgccggcttcgccgcgtgcgcgtgcgcatggtggggtttggctggctgcgggatgcggtcgaggccgccgaggccgcaaactccagtgggaaggcggcgtgccgcggccggcttcggtggaggagggggcgtttccccggaaaaggaaggaagtgggtgtcacgggcctcaatacggcccctttgacgtcttgagtgggaa

SEQ ID NO: 28035 - DNA, 104 bp, Homo sapiens
  misc_feature 1..104: note = chr3:5018985-5019089
  misc_feature 1..104: note = hyper
  source 1..104: mol_type = genomic DNA
aatataaacaggaagcgggagctctccaaggcgacctgaaggaaatacactgccagtttggtcaacttgtgaatgccagttctctaggtcgtcaagggcactgc

SEQ ID NO: 28036 - DNA, 220 bp, Homo sapiens
  misc_feature 1..220: note = chr3:5137799-5138019
  misc_feature 1..220: note = hyper
  source 1..220: mol_type = genomic DNA
gaagcccctgcagtgcgccccgcgaccaccagctggaaccaaaaggcggcgcgcaggcgcggagcccacggggagcccaggctggggcgcgtgtcagctccgcctgacctgccaccttccctaggcagcggggggcgggggtggggggtggtgcggggagtcacatgcgtcccctccgaagctgggctggagttcatttacagctcgcttttctaggcct

SEQ ID NO: 28037 - DNA, 305 bp, Homo sapiens
  misc_feature 1..305: note = chr3:6902321-6902626
  misc_feature 1..305: note = hyper
  source 1..305: mol_type = genomic DNA
tagctagggtcttcccgcgcccctccctcactggtttctctgcccctgcctcgctttctcccagagctaagagcctaggctccggacctagggtttgggagcagtcagcacgacgtcctcgccccatcccgcggctgatgacacccgtgcccagaacgtgggtgtgggtagggaggcttccacagtgagttagggtcgagagctaggctctcgcttgctccccgcaatccctagattccctggggaccacgaaactcccattccgaggaaacctccccccattccccagccgcccacccgtttcc

SEQ ID NO: 28038 - DNA, 130 bp, Homo sapiens
  misc_feature 1..130: note = chr3:6902969-6903099
  misc_feature 1..130: note = hyper
  source 1..130: mol_type = genomic DNA
gcccctgggctttcccggaggagctcgccctgaagggcccggacctcggcgagcccaccaccgttccctccagcgccgccgccgccaccgcagcagccggagcagcatggtccagctgaggaagctgctc

SEQ ID NO: 28039 - DNA, 86 bp, Homo sapiens
  misc_feature 1..86: note = chr3:6903624-6903710
  misc_feature 1..86: note = hyper
  source 1..86: mol_type = genomic DNA
cacagtggctacctgcgcccttaaccctaaaagctggcttggactccggtggtgcgggtcaggtcagccttcgctcatttcctccc

SEQ ID NO: 28040 - DNA, 65 bp, Homo sapiens
  misc_feature 1..65: note = chr3:6904142-6904207
  misc_feature 1..65: note = hyper
  source 1..65: mol_type = genomic DNA
ctcgggctgatttcccgacctgtagccagcctccgcgagagcccagggcgcgaggtgctgggacc

SEQ ID NO: 28041 - DNA, 318 bp, Homo sapiens
  misc_feature 1..318: note = chr3:8809397-8809715
  misc_feature 1..318: note = hyper
  source 1..318: mol_type = genomic DNA
gcgagcactgccaggcggtcggtgcggcggcgcagcgagcgcagcggctggcagatggccaggcagcggtccagggacatgagcagcagcaggtaggtggaggcgaacatgcccaccacctgcaagtacttgaccaggcggcacagcaggtcgggcccgtagaagcggaaggtgatgtcccacagcaactgcggcagcacctgaaacactgccaccaccaggtcggcgatgcttaggtgcttcatgaagaagaagaggcgcgagtgcttctggcgtgtggtgcgcagcgccagcagcacacacgcgttcccgctcagc

SEQ ID NO: 28042 - DNA, 132 bp, Homo sapiens
  misc_feature 1..132: note = chr3:8810151-8810283
  misc_feature 1..132: note = hyper
  source 1..132: mol_type = genomic DNA
cgccaccccagaaatccccgttggaggtacctcctctgagccactgcaaatgagcgggaatcctctaccggccacaagcccagagcccccagcgtgccagttcctcgggatgttcagcggcttccactgggg

SEQ ID NO: 28043 - DNA, 97 bp, Homo sapiens
  misc_feature 1..97: note = chr3:8810791-8810888
  misc_feature 1..97: note = hyper
  source 1..97: mol_type = genomic DNA
tctctcggaacaccccgagctcctccaggaacaaggagtgcgaggcaccccaccacctccactcgggtcccgatggctccaccggccctagccatcc

SEQ ID NO: 28044 - DNA, 302 bp, Homo sapiens
  misc_feature 1..302: note = chr3:8811111-8811413
  misc_feature 1..302: note = hyper
  source 1..302: mol_type = genomic DNA
gatgggtacaggaggcgagcgaggagcgcctcccaggctgcgcgcgcggacagcgtctggatgcggcgctgtgcgctggggctgaggctgcactatcgcacgggtccgctagggggcgggcgaggccagccgcgcagacccctccggagcggagctggttcgcccagcgttggtcccagagccttaacaaatgggtttattttgcagtggtttaaaactgcgagagggagggaactcgtcaataacccgcccgtttcttcctttcttggtttagaagctcttgactccgagacacataggag

SEQ ID NO: 28045 - DNA, 135 bp, Homo sapiens
  misc_feature 1..135: note = chr3:9177995-9178130
  misc_feature 1..135: note = hyper
  source 1..135: mol_type = genomic DNA
cgcccagcgccggggctggaggcagcagatgccgggccggggtcagccgccgcgcgccgttgccacggcaaccgtcgctgggaccccccccccccccgaccgccccgccccgccccgcgcgccacgtgcagcagc

SEQ ID NO: 28046 - DNA, 360 bp, Homo sapiens
  misc_feature 1..360: note = chr3:9541700-9542060
  misc_feature 1..360: note = hyper
  source 1..360: mol_type = genomic DNA
tctccacctctgccccgtctctctcgatctctcctcctcgcgctgtttctctgtgcctgtgcgtccccctcgctccttctccaatcatctctcatctccctgtctctgcacccctcttctcctcaccccagtgtcttctcccattcccagtcgcttgctgcgcccctcccctcactctctcctaactctgctctccccctccaacgctgggcttggtttgcatctttgaggaactccctcctaccccaactccctcccacggggctcccgcatcctcccgcatttaactcggaccctctgtcccgcagcgcccctaccccaggccgactggactgtccgggaaggcgccggcggggaagg

SEQ ID NO: 28047 - DNA, 33 bp, Homo sapiens
  misc_feature 1..33: note = chr3:9542307-9542340
  misc_feature 1..33: note = hyper
  source 1..33: mol_type = genomic DNA
cgaccctctcccctccgccgaggcccgaggcgg

SEQ ID NO: 28048 - DNA, 57 bp, Homo sapiens; identical to SEQ ID NO: 6770
  misc_feature 1..57: note = chr3:9593979-9594036
  misc_feature 1..57: note = hyper
  source 1..57: mol_type = genomic DNA

SEQ ID NO: 28049 - DNA, 42 bp, Homo sapiens
  misc_feature 1..42: note = chr3:9594366-9594408
  misc_feature 1..42: note = hyper
  source 1..42: mol_type = genomic DNA
gcccggaggcggggccggcggcggcggcggctggcgggggcc

SEQ ID NO: 28050 - DNA, 108 bp, Homo sapiens
  misc_feature 1..108: note = chr3:9595395-9595503
  misc_feature 1..108: note = hyper
  source 1..108: mol_type = genomic DNA
gggactggcacggcctaggcgccgcggctcggcgctcccagcagcggctgcctcggcccaggcggcggcctctgcgcggcctccatcttgctcgggttctccccgggg

SEQ ID NO: 28051 - DNA, 83 bp, Homo sapiens
  misc_feature 1..83: note = chr3:9595598-9595681
  misc_feature 1..83: note = hyper
  source 1..83: mol_type = genomic DNA
cggggaagggtgctcctggttctggcagttggggggaagggtggccacgatacctggggtcccccagccggggcagcaagcac

SEQ ID NO: 28052 - DNA, 125 bp, Homo sapiens
  misc_feature 1..125: note = chr3:9745353-9745478
  misc_feature 1..125: note = hyper
  source 1..125: mol_type = genomic DNA
caccccagagacttgcgcagggcagactctaccaaggtgtgggttggagttgggagtcggggtgaggttccccgctggctccaggctgctccaatggggcgggggccgcccgcagggccgggcgg

SEQ ID NO: 28053 - DNA, 30 bp, Homo sapiens
  misc_feature 1..30: note = chr3:9745793-9745823
  misc_feature 1..30: note = hyper
  source 1..30: mol_type = genomic DNA
agccccagccagccgcggggctcagcctgg

SEQ ID NO: 28054 - DNA, 428 bp, Homo sapiens
  misc_feature 1..428: note = chr3:9904233-9904661
  misc_feature 1..428: note = hyper
  source 1..428: mol_type = genomic DNA
tcgcgtccaggcaggcggcacttaggaaggacaaactccaaaacccagggatccaaaggatccatgggaagatcgggtggctcaggggagtgactccccggcttggtcggcgctttgaggccccggggacccagcggagagggctcgggtgaggcatctggaggcgctgaatggggccgggagccgcgggacccgcagagggcgcctgtccgtgtgggcgcagcagcgcctagagggaggcggccccggcagcccgcaggggtcaggctctgctggagcaggggcgtccctgtctccgcttcccagcgcaggctgggtggggccgatggccattaaagccccgccccccgcggctcaccgccgcctggccccgtccccgaggccagaaaagaggagacccgaggccgtcagaccgcctgtcaagggct

SEQ ID NO: 28055 - DNA, 823 bp, Homo sapiens
  misc_feature 1..823: note = chr3:9956827-9957650
  misc_feature 1..823: note = hyper
  source 1..823: mol_type = genomic DNA
gcgggggcggagaggcgagcaccctacggtatcccgagagggtggggagaagagggctgagcagtccctcagccgcccagccttcatctgttgcttcccgccaccaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagccc

SEQ ID NO: 28056 - DNA, 25 bp, Homo sapiens
  misc_feature 1..25: note = chr3:9993908-9993933
  misc_feature 1..25: note = hyper
  source 1..25: mol_type = genomic DNA
ccgtgcaggcctggtcgcctgcgcc

SEQ ID NO: 28057 - DNA, 64 bp, Homo sapiens
  misc_feature 1..64: note = chr3:9993964-9994028
  misc_feature 1..64: note = hyper
  source 1..64: mol_type = genomic DNA
cggggtcccgccatcgccccctccctgggccagctcctcacctgcgcgccgcagcccccgtgtt

SEQ ID NO: 28058 - DNA, 280 bp, Homo sapiens
  misc_feature 1..280: note = chr3:10206828-10207108
  misc_feature 1..280: note = hyper
  source 1..280: mol_type = genomic DNA
cagcgggtcccgatccgagggcgtgcgagctgagcctcctggaccgggtccgccgcggacctcggcctgtcacctgaaggtgccgcgtggtctctgaggacgtctgtcgacgagcaggggccgccgccactgcgctctgagtccagagaacggtgggtacgggggccctcctgtcagcgctgctggctcggtgacgtccccaggtggcctctcatccagcccacaacagcctgcaaagtgcgagcctcgaccctgtagggacccacggtgctgtcacttc

SEQ ID NO: 28059 - DNA, 32 bp, Homo sapiens
  misc_feature 1..32: note = chr3:10547210-10547242
  misc_feature 1..32: note = hyper
  source 1..32: mol_type = genomic DNA
tgcggcagctggtgccgcggctgagcccagcc

SEQ ID NO: 28060 - DNA, 694 bp, Homo sapiens
  misc_feature 1..694: note = chr3:10749237-10749931
  misc_feature 1..694: note = hyper
  source 1..694: mol_type = genomic DNA
aatagggggttctagcgtcccggacgcccccccagctccggggctgctccgagcccggaaagttttcgcgcagcaggcgcaaggcgcgcccccttccctcacccgcaggcgccgggtccgcggacgcccaccccggcccgccccgcccgccgcctggtgcccgctcaaggtcactgctgacaaggcgcctgcctccgcggggcgaagggaccaagacacgctccggctcacgctcccgccctggcccggcgggggtctccggggccgagcgcccgcggaagggaagccagcagggaaagtgacaagagaccgagcgagaggggaagaggcccagagcccgggcccggccgcccctgcctcacctgcgccggctccgagagcgagatgctgccgccgccgctgccgccgccgctgccgctggtgcgcgcccggcccggcccggccccgctgcggctgcggctcctctgccgcggctgccccgcgctcgcctgccccgcggccccgccgccgcccgcccgcctccctccctccgccgccgcctctgccaccgctgcactgcgctctgcccgcctccccctcccgccctccctgctcactcctccccgcgcgctccccctcggccctccccaaactcctcacggagagcgccccgcgggaccggagcgcgcggtcccgcccgcgtcctcctccgcgc

SEQ ID NO: 28061 - DNA, 92 bp, Homo sapiens
  misc_feature 1..92: note = chr3:10857625-10857717
  misc_feature 1..92: note = hyper
  source 1..92: mol_type = genomic DNA
ggagccggcctaggccggaatgggcgcttccactcttggcccagcaggccagtgggcagggccgcgggaaggacgggcgctgcaggggctcc

SEQ ID NO: 28062 - DNA, 40 bp, Homo sapiens
  misc_feature 1..40: note = chr3:10858369-10858409
  misc_feature 1..40: note = hyper
  source 1..40: mol_type = genomic DNA
ccacctgtgccagtgcgcacgcgcacgtgccaattcgcac

SEQ ID NO: 28063 - DNA, 62 bp, Homo sapiens
  misc_feature 1..62: note = chr3:11034439-11034501
  misc_feature 1..62: note = hyper
  source 1..62: mol_type = genomic DNA
ggaagaccgagacagcggagaggttgcgggtgagctgcgctgagcccaggagccgaggagtc

SEQ ID NO: 28064 - skipped

SEQ ID NO: 28065 - DNA, 637 bp, Homo sapiens
  misc_feature 1..637: note = chr3:11034716-11035353
  misc_feature 1..637: note = hyper
  source 1..637: mol_type = genomic DNA
ggggggcggacacctcgagattcaagcccccgcgccgcaccttccctgagccacatgaaggagcagaggcgccgctcggaccccgacgtgcgcccaggccatccgtcccctgggacactcgggaggcaggagggctggaacagaggcgagagttgcatgccccttccctcccgcggtgccccactggccccgcaagttggcactggattctgctggagccgtcgaagctccctattcattccccagggcatggaggggacgcggagtgaatgacacgagcagcgttggggggccgtgcgccactttcccaatcctggggtcagctgagccgagttagagctatgcccctcatttgttctctgcgggctacggcggggtcgggtgcgacttgaggatgggacgtctctgggacagcccgagctctcagaaacgttggcttaaaagcacaccggggcttgggctgagtgcaccggagctaagcctagtgcaccagagctcgcgccgcgctctcccagccccgactttctccaagagatgtggggtgcgggcggtcccttagagggctggaggacggtgcctccttgctgcttcgggaactgcgctccccttcttgcttttggtctctgcgtgtactccc

SEQ ID NO: 28066 - DNA, 52 bp, Homo sapiens
  misc_feature 1..52: note = chr3:11035382-11035434
  misc_feature 1..52: note = hyper
  source 1..52: mol_type = genomic DNA
cgggcagtgcccattgggttctgagcacacgtccccacgggtggcacccaca

SEQ ID NO: 28067 - DNA, 84 bp, Homo sapiens
  misc_feature 1..84: note = chr3:11196531-11196615
  misc_feature 1..84: note = hyper
  source 1..84: mol_type = genomic DNA
gtccgtctttgagctcgggcgagcagagggggagcctcgttttctttgagcctccccagggtctgagttcgctgctaaccgtag

SEQ ID NO: 28068 - DNA, 365 bp, Homo sapiens
  misc_feature 1..365: note = chr3:12045988-12046353
  misc_feature 1..365: note = hyper
  source 1..365: mol_type = genomic DNA
ccccgtagccccgcgcgcccccagacctttaagccagatgatgaacttcctgcggcgccggctgtcggacagcagcttcatcgccaatctgcccaacggctacatgaccgacctgcagcggcccgagccccagcaagcgccgacgccgccgccccccggcccgggcgccgcctcggcctaggcggcgcccccgaccgcctcgccgggaccggagcggacgccgccggccgcctaggcgcccgcgccgtaagacgcgccgaagaccgcgcccccccccccgcgcgaacaccgtcggtgggcagcagcttattcagctcgctgtcccaagcggtaaagcagacggccgcctcggctggcctggtgga

SEQ ID NO: 28069 - DNA, 222 bp, Homo sapiens
  misc_feature 1..222: note = chr3:12046377-12046599
  misc_feature 1..222: note = hyper
  source 1..222: mol_type = genomic DNA
cgccaggaaggccaaggtgctgctggtggtcgacgagccgcacgccgactggtaggtgccgggcgccttcgccctcgggggtcggggtccgccggcagccgcaggccaggagaggacggtcccaggtcgccgaggaaacgtttcagaccaataaaaaggagggtccccgaggtcccgctgggaggaggtgcgggctgagcgcgcgcgcgtttgcggggtgag

SEQ ID NO: 28070 - DNA, 301 bp, Homo sapiens
  misc_feature 1..301: note = chr3:12329724-12330025
  misc_feature 1..301: note = hyper
  source 1..301: mol_type = genomic DNA
caggacccggactgacgggtcgcgggcgggcggctcacgggtgaccgggtgaaggggtcttgggctgagggcacccgggctgagggtcgcgtctaccggagcgcgcactaggggcggagggcgcgggcacagagagccgcggccggtgccgactcgagtggacgcgagccggtgcgtcccggcttccaggacagcccccctcgggagagcgccgggtgggcgcggagccggggacacggggacctccgcgtccccggcggaggtgcgcaagcgtcgggagccgctccgggggaactttgga

SEQ ID NO: 28071 - DNA, 79 bp, Homo sapiens
  misc_feature 1..79: note = chr3:12838044-12838123
  misc_feature 1..79: note = hyper
  source 1..79: mol_type = genomic DNA
agccaggcccaggcccgcccgcctcccgcggccgccacggccaaggcgtgagcacggggcggggcgggagctgctattt

SEQ ID NO: 28072 - DNA, 94 bp, Homo sapiens
  misc_feature 1..94: note = chr3:12917599-12917693
  misc_feature 1..94: note = hyper
  source 1..94: mol_type = genomic DNA
cagggccgggagccacgggacccgcagagggcgcccgtccgcgtgggggcagcagcgtctggagggaggtggccccggccgccctcagaaatca

SEQ ID NO: 28073 - DNA, 590 bp, Homo sapiens
  misc_feature 1..590: note = chr3:13323439-13324029
  misc_feature 1..590: note = hyper
  source 1..590: mol_type = genomic DNA
gcccgaaggtccacacggtgaggctgctccgggtttcgacaccgacactcatgggaggcaaacgggaacccggctggcgggctgcgagccggtagggacgctggggtccagggctgctggacagccccgccctgtacctctccccatccctcacttaatcctgggtccgaaatagccccgggtaatcccagggcgaggcagtcgggaattaaccccagccttgaagtaagagacagaggcgtccacagaagagggctctgcgcgtcccggactggacacagcgcagagtccattccagggacaccgcaacccgcaagcgacccaggcccgctccagggcgggatccgcgcggcccgcgacccctccctaccggtctcgggatctctgggtcggaagttctcgccctgctgctccgagacctaggtccgctccccggacagacctccgcccggctcgtccgagccccgggggtcgccaaccctgagtccgcgccgcagcgcagagccaggccggcgggagcgctgagcagctccctggagcccttttccagggaacccagtccccacccgagatcgagctccggatctggg

SEQ ID NO: 28074 - DNA, 114 bp, Homo sapiens; identical to SEQ ID NO: 2205
  misc_feature 1..114: note = chr3:13324234-13324348
  misc_feature 1..114: note = hyper
  source 1..114: mol_type = genomic DNA

SEQ ID NO: 28075 - DNA, 255 bp, Homo sapiens
  misc_feature 1..255: note = chr3:13324419-13324674
  misc_feature 1..255: note = hyper
  source 1..255: mol_type = genomic DNA
gatccgggtcagctcctgcaggtactcggccgcctggccggggggctcggcggcgctggccatggccccccgcccggaggccggccgcgcctcaggcgagcgggcggcggggcggcggcggcgcggccatggctgcgcggcggggacggcggctcggcgcggcgcggggctgccgcggccccgcctcggctcccgcctccgccggcgccgcccccggggcccccgcgcctcctgctccccgcgccgccgcgctcc

SEQ ID NO: 28076 - DNA, 198 bp, Homo sapiens
  misc_feature 1..198: note = chr3:13324740-13324938
  misc_feature 1..198: note = hyper
  source 1..198: mol_type = genomic DNA
gaggagttttgcaaagtgccggccgcggcgcgggaagagggcggggagggcgccgcctgctgggaccgcccctgggtcccgcgcccccgcaccaggcgtcgggggacagctccatccttctccggccgcctcgggcgccttaaatcggaagcgattccgtgaaatacatctcgaatccatcagcggacgattttagga

SEQ ID NO: 28077 - DNA, 194 bp, Homo sapiens; identical to SEQ ID NO: 290
  misc_feature 1..194: note = chr3:13590447-13590641
  misc_feature 1..194: note = hyper
  source 1..194: mol_type = genomic DNA

SEQ ID NO: 28078 - DNA, 78 bp, Homo sapiens
  misc_feature 1..78: note = chr3:13590973-13591051
  misc_feature 1..78: note = hyper
  source 1..78: mol_type = genomic DNA
cgggttcccccaccccaggtccgcagcttcctccgctctgggtttcacttctcccccctgggccggctcccaccagtc

SEQ ID NO: 28079 - DNA, 125 bp, Homo sapiens
  misc_feature 1..125: note = chr3:13696641-13696766
  misc_feature 1..125: note = hyper
  source 1..125: mol_type = genomic DNA
gagtgtccctgatcccgggtggtcgctctccagcccgccaggctctccgacgggctcaacccgcagcccctggccggggctggggccgggacgccaggcccctgtggggacggttccctccagca

SEQ ID NO: 28080 - DNA, 1064 bp, Homo sapiens
  misc_feature 1..1064: note = chr3:13919665-13920729
  misc_feature 1..1064: note = hyper
  source 1..1064: mol_type = genomic DNA
gggaggccgcggcgccggcgggagggcggcccgcgggcgggcggggcggccaggggaggttattttctgctgttttccctttctgtctcccccgccacccgtgtccctcctccccgtttctaattaaaaaggagataaagccgcacgcggcccgagtcaatcggctcgagccaatcggccctactggcttcctggatgctgaatgtgcgcggggcggcggggcgcgggccaagatgaagattaaagcaggggaaaaaaaggaaagccacccagacgcgggcgaatcaataacacttaaaacacaccggcaggctggcggtactggcgcgagccccgcagccgcctctccgccgctggtcgggctggcggcccctggtcggctctgcacgcacctgctagcggccgcggccggacaacttgcgaaatccccgctccagagacgtggactggggaagtgacggggtaggggggtagtagtgacaaaacacaaagggtctgccacgcacatcccctcgccgcagcccctgcggtccacccctcctcaaaagggatggtaatgggttcactgctgggggctggaggggcagggtgtgtgagacctaccaagcgggcccttcagcgccagaacctctatccatgcccagatccccccgcccccacaccgctccgagcctcacacgcgttgtcttaagtacaaagggtgaccggctttgcacaagcagctccaggacgcgtcccgagctgccccctcccaccttccagccagagcgcccccgagccccacctccacagaaacgctaggtgaagccggagggctgctcgcgcgcccggccgcctctgctgcccagttccagggggcggggtgtcccgcctctctctagcgcttgtctccctctgtgtctcagaccgcctctcgtcccacctttgtgtgtgtttgttgggggtgggacgtgctgtccccttggcccgggaaggggctctgggagtctaagggcccctggaaattgggtggtgccaaggctccgagcggcggtttatgtttttgccagcgaatgtccttcctc

SEQ ID NO: 28081 - DNA, 804 bp, Homo sapiens
  misc_feature 1..804: note = chr3:13920980-13921784
  misc_feature 1..804: note = hyper
  source 1..804: mol_type = genomic DNA
ctggagcgtccctaccggctgtctctggtcctgggggattccagactcagacgtcctcaggatggccagtccccctgcctatatctcctggggtgtcctgcggggggcctttgtgcgtccaccgctcccacaccgcacccacccggcctctcagagaagctgtggaagttggccggcagaggctcgcaggcggcacacctccctccccgggccgtgccaactttgtcgaaacacgcgcggaaagggcgcaggcagcccttacccgatccggaggtagaccatgcccaggctgagaaagaggtggcccaggcagcgccgcgctttccggttcatagtcccgattggccgccggggccgcgggccgggctgtgctgatcccgcgggccggccccggcggggcaatcaacatagcccgcccgggaggcgcgagccgaggcgtccccggggccgtctgtcggtgcgcccgtccgcgcgctccgcgcctgagcctcgccaggagcacgggagccacggagcgggaggagggagggaggagcgagcgcggcgtggggcgacgccgggctgcgcgcgagcgaccggtgcaagtgtgcgagacgcggggagtgcgggggcgctgctgcctccagcccccgcccctccctcctttcccccgtccctcccccgccccctcccccgcccgcctccccggagcgcccgcccagcgcccctgcgcccgcgggacagggccgcctgcacaaggcgcgcgctcgcgcctttccatgcgcgctcccgggggccccctccctgctccggggtgcaggtggc

SEQ ID NO: 28082 - DNA, 757 bp, Homo sapiens
  misc_feature 1..757: note = chr3:14643752-14644509
  misc_feature 1..757: note = hyper
  source 1..757: mol_type = genomic DNA
gtcagacaacaggtacgcggggagcagcccgggcggccccgcgcaggggttgagccgcagcgctgctgtgcaggggcaggcccgggcagggggcagtgcggcgagtcagccccctccctggcctcctcgcaactttgagtaaccgcggactccggggtcggcatgggggtggcgccgggcgttcaaaggaaagttgggtgcgacggaccgcagcctcgggggccaaaggacccccaccgtgagcgcggccacctcccgacacccggcgggctggctggagggagcaggtgaggcacgtggccgcctcgccaagccagggctccctccaggagcccgacccgccggccgggccggtggatgccccctcgagggctcagacccttcgctccagcccccggcgggcgccctgccccgggtcccacactcccgcgccccgtgggccccactgctggctttccgggaccaggctccgctccgcagctcgcgtcctgaggtgatcctccaggctccccactttgggaccccctcctgcgcctcgggtgccggcgcctgtcttcgcctcccgcggggaccctccccggcgccccaggcgtgtgcgccccgggccagctcagctctgggtccgccctccgcaccccgcgccgcgcgcgcgctcaccggccgggcagcggccgcgtcttaccttcgtccggcagccgctgcaggcagagcgcgaggttcctccgccagccccgcatccccgcggccgccctgcggc

SEQ ID NO: 28083 - DNA, 102 bp, Homo sapiens
  misc_feature 1..102: note = chr3:14851825-14851927
  misc_feature 1..102: note = hyper
  source 1..102: mol_type = genomic DNA
aactcgctgagttctcgtccttcgaacccccagcgcctcccgcggtgcccatggccacggcccctttaaatgtgcgcagggacgccccggccctcgcctccc

SEQ ID NO: 28084 - DNA, 35 bp, Homo sapiens
  misc_feature 1..35: note = chr3:14852170-14852205
  misc_feature 1..35: note = hyper
  source 1..35: mol_type = genomic DNA
cggaggctcgcggctcgcgcccccactgccctgcg

SEQ ID NO: 28085 - DNA, 298 bp, Homo sapiens
  misc_feature 1..298: note = chr3:14852212-14852510
  misc_feature 1..298: note = hyper
  source 1..298: mol_type = genomic DNA
cggagtccgaggcgcgccggggccgggcgggcgccagggggtgcgggccccgcggggcggccgcggagggaggcggtgtgcggagtcgcactgggacccgcggacggactgaaacgccgacggcggcccgggccccgcgcgctgaagatgaacagagcaggtaggaggcccggcgacctccggcgccgaggcacgagcgcgagggaccccggccgggcgctccaagttggagctcccggggagcccggggctagctgcccgaaatcctccgaccttccagtgccgctcggcctcggcc

SEQ ID NO: 28086 - DNA, 136 bp, Homo sapiens
  misc_feature 1..136: note = chr3:14852735-14852871
  misc_feature 1..136: note = hyper
  source 1..136: mol_type = genomic DNA
ccctccattccccagcgtcccggaccggtccttgctcatctctcaggggcaacacctgacccacggggcccgtcccggagctctcttcgactccgggaccagttcccagcccttcagtactcggcataccggaagg

SEQ ID NO: 28087 - DNA, 414 bp, Homo sapiens
  misc_feature 1..414: note = chr3:16554052-16554466
  misc_feature 1..414: note = hyper
  source 1..414: mol_type = genomic DNA
acagacagcagggagcgtgcctggttctacaaccttggcctccacgcggttcttgctgccaaaggcagcgacaccggaggtgaagggcaccagccctggcctaggactggggtgcgcgtgcctgacaacggggcttcccgaaatacacaaccacctcctcctcgcccagacccatatccatcctggcgtcccttgagtctagagaagtgggttaagacaagggaagaaaatcccttacagaagaggagatccccgttttcagtgctggggactctcggcacccgcgtccctgtgcttctggtggttccggcgcttcctcggagcgcgcggcatgtctgctcctacacgtccagcacctctgtccccagagcaaacccacctcccagggcacacgcagaggggcagtcaggcacc

SEQ ID NO: 28088 - DNA, 443 bp, Homo sapiens
  misc_feature 1..443: note = chr3:16554467-16554910
  misc_feature 1..443: note = hyper
  source 1..443: mol_type = genomic DNA
cctccaccctgccccacccaggccgcgcgcaccccggaaacctggactccgcgaccagctccctcctgttcttttccgaggaccccagcggcagtgtgtcctggacccacctgtagcctccaagctcccccacctctgcgtccttcctaggcgcttctgagcctgcagagcctacgacccccaacaggctgctccgaagtgcctctccctacatcgctccaggaatgactcccctacacccgttccccgcaaaaaaaagttggcccaagatccaggcgtcccaaggatcagcccaggtccccatccgacgcgggccagggggtgctgctctggcagctccggagccccggcaaagagcaacctgcagggaggcgccacgcgcggttcccactacccgccagagacccggtccatggggccaaacggaggggcctgtgccggtc

SEQ ID NO: 28089 - DNA, 450 bp, Homo sapiens
  misc_feature 1..450: note = chr3:16554911-16555361
  misc_feature 1..450: note = hyper
  source 1..450: mol_type = genomic DNA
acaccccaagccctgtcgcgccccccccgccgcctaccgtatgggaccggcggaggagaaggcgcggtcgcgggctccctgaggcagcgtgttccgtcccgggaggaaagtttgtgccatacagaggaggcggcgcggggaggacttgggcgccggtgggtggaggcgtgggcggtggcgccgcgtggtcgtgtgtctgtccctccggcgatcggtgcgtctgtccctcgccggagcccgcggccgccgcgctctcgctcgctgcgcccagcgcccggcgcgctccggctccagccccgacgcgcccccgccgccgccgccgcgcgtccgccggctacacttcctcttcctctgaactcatgtgcaaaatatgctacgctgcatcttcagggaaagcctcgcggcccctgacagcagccgctggagcggtgggcccgcccagctctcccc

SEQ ID NO: 28090 - DNA, 30 bp, Homo sapiens
  misc_feature 1..30: note = chr3:16925675-16925705
  misc_feature 1..30: note = hyper
  source 1..30: mol_type = genomic DNA
cgaggagggaccacgcggcctgtagggggc

SEQ ID NO: 28091 - DNA, 475 bp, Homo sapiens
  misc_feature 1..475: note = chr3:18485177-18485652
  misc_feature 1..475: note = hyper
  source 1..475: mol_type = genomic DNA
tggtttcccaaaccccggttctgccggcccgggagccttagcactggagcaataggaaaaggccaccgcgctcgggtctggacagcaggagggaaacacggtgtggactgcgaggctgcacctgtgatgtcccggcccctgctaagaggacggccctttcttctgcctcttgcccaactccaaacccacattcacgccagcagcctctccaggaccggcctcgctacagccagcgagggctcgaaatgaggagtgccgcggctttcaaactccgggctccaacttgagcgccccggcgcccgagtagctcccgggatgcagaagttgccacaaacttcccaggcccctcttcgccgatgcttacaatcagccgcgcaggcagggagcggagggaggcggagatggaccgggaaaggatgctgagcagactcgcgatccggtgggggaacattaccactcccgcagcccactcctc

SEQ ID NO: 28092 - DNA, 231 bp, Homo sapiens
  misc_feature 1..231: note = chr3:18486970-18487201
  misc_feature 1..231: note = hyper
  source 1..231: mol_type = genomic DNA
cggcgcggttctcgtcgcccgccaaccctgccccctcacctctccgggggcccccaacacgcgcactcctcctcttgtcgcctgcggcttcctcttgttgcttgttgtttggctgggttttggggggtgagtagagggggttactgtagtgtgtgtgcaggcggaggaggaagtcaggtgagaggccgcgaagcacccccaccccaacccagcctgcgtggggtgtatgct

SEQ ID NO: 28093 - DNA, 133 bp, Homo sapiens
  misc_feature 1..133: note = chr3:19189373-19189506
  misc_feature 1..133: note = hyper
  source 1..133: mol_type = genomic DNA
tcggggccagtttcccggactaaaagaccctggtgactggggatgggcctcacaactaactcgggctgccctgcccctgtcgcgtgggctcgcaatggcaagtgctccggaagggggccgcctccccgtgggg

SEQ ID NO: 28094 - DNA, 394 bp, Homo sapiens
  misc_feature 1..394: note = chr3:19189778-19190172
  misc_feature 1..394: note = hyper
  source 1..394: mol_type = genomic DNA
cccagaccccagagacgtcggtcagggcgcggcgccccgggccactgcgggctctttccgggcgggcgacgtggggggcgaggcaccgcgcggcggcgcctggcgggcactgttgcccgcggagggacggtgggggggtttcagcagctggcgggggtggagggggcgggagagggagcctgcgccgggctgagcctggaggtgcggggcgggctcggggagcgctcttggggctcctcctgccacagccggggcggctggaactctctccctttctccctccatccttccacttcccctgctcggccccgccgtcaggccgggtcccccttccctgccgtcatcaggttccccttctcccttcttggcactttcctttcgaaccatccttctg

SEQ ID NO: 28095 - DNA, 247 bp, Homo sapiens
  misc_feature 1..247: note = chr3:22413664-22413911
  misc_feature 1..247: note = hyper
  source 1..247: mol_type = genomic DNA
gagaccctccagctccgcgctcttcactctggccccgcaacctcacatctcttctccttggcaccgagaagaggctggggtgtgtggaccgatagtgcgggataccgaaaaggtggtccaaggtctgggcggtgcgaacgcccattccgcgccccccatgcgagccccagcccctcgcgcctggtatcccgcaggggcgcaaccctagctccttgcccggcgccccaacgaactccgccacctgaac

SEQ ID NO: 28096 - DNA, 119 bp, Homo sapiens; identical to SEQ ID NO: 6806
  misc_feature 1..119: note = chr3:22413959-22414078
  misc_feature 1..119: note = hyper
  source 1..119: mol_type = genomic DNA

SEQ ID NO: 28097 - DNA, 116 bp, Homo sapiens
  misc_feature 1..116: note = chr3:24535479-24535595
  misc_feature 1..116: note = hyper
  source 1..116: mol_type = genomic DNA
cagaggaagatgctgcgccaagagaagcaaagcgaaggagcgcgacccaggaggctagcgaaatccccgccaagcccccaggaggcggagagaagcccagtcgccaggcaccggcc

SEQ ID NO: 28098 - DNA, 203 bp, Homo sapiens
  misc_feature 1..203: note = chr3:24870641-24870844
  misc_feature 1..203: note = hyper
  source 1..203: mol_type = genomic DNA
ggcagcagtagcaggcgcggccgccgccgcctccggctcagctcacgcggaaaccccactgggccgtcgtggctccgcgcggttgcgggccagcgtggagaggcgggacgtggcgcccgggggcggggcctggcgccagggggcggggcgcagcgagccgggctcccgctgtctgctctcagcggcggcggcaggggctgagg

SEQ ID NO: 28099 - DNA, 15 bp, Homo sapiens
  misc_feature 1..15: note = chr3:24871162-24871177
  misc_feature 1..15: note = hyper
  source 1..15: mol_type = genomic DNA
ttgctattgtcttag

SEQ ID NO: 28100 - DNA, 97 bp, Homo sapiens
  misc_feature 1..97: note = chr3:24871789-24871886
  misc_feature 1..97: note = hyper
  source 1..97: mol_type = genomic DNA
aaaaggtgtgcacgccgatgtcttgtaggtggactcccggaggtgggggtgggggtgggtacgagggataagttttacctagagctagagctggcgt

SEQ ID NO: 28101 - DNA, 156 bp, Homo sapiens
  misc_feature 1..156: note = chr3:24871946-24872102
  misc_feature 1..156: note = hyper
  source 1..156: mol_type = genomic DNA
ccgtggctaaggatgctcgggtgctggaccgcccgctgtgcctccacacccctccgccccgcccccttccagctctcagcgcggggtgagtttccctgacactccccgccggaggcaagcaggcagaggcgaagtgatggtcgcggagtggaacag

SEQ ID NO: 28102 - DNA, 44 bp, Homo sapiens
  misc_feature 1..44: note = chr3:25469358-25469402
  misc_feature 1..44: note = hyper
  source 1..44: mol_type = genomic DNA
ggctggggggcgaggcggtgggcgggaggcgagcgggcgcaggc

SEQ ID NO: 28103 - DNA, 55 bp, Homo sapiens
  misc_feature 1..55: note = chr3:25469403-25469458
  misc_feature 1..55: note = hyper
  source 1..55: mol_type = genomic DNA
gaacaccgttttccaagctaagccgccgcaaataaaaaggcgtaaagggagagaa

SEQ ID NO: 28104 - DNA, 51 bp, Homo sapiens
  misc_feature 1..51: note = chr3:26664089-26664140
  misc_feature 1..51: note = hyper
  source 1..51: mol_type = genomic DNA
acctcagctggtctccggcagccaacgctcagcccccgcctcctctctcca

SEQ ID NO: 28105 - DNA, 893 bp, Homo sapiens
  misc_feature 1..893: note = chr3:26664739-26665632
  misc_feature 1..893: note = hyper
  source 1..893: mol_type = genomic DNA
ccgcctgttgcttttcgcagagcgcgggatcatccctctgcccgggtacctaggccgtccctccaaggaacaagtagaggagaactattacaccagttctaagccgtgcctgtctaagcctccctgatcccttttgcgcagaccctgggagagacctcctcctggagagagagagtcgaccctcttcgctcctgttcagccggctgctatacaatagtctgcaaacttttgtgaccccttccctgcgcggtgctcaccccgtgctgtgcaacttgcaggtttagttcttgcccttcccccagcccctcttgccatatgcatctgcccatttctctctgtgtgttcttgccagtcgacttttcactccccgcagctctggctcctgaggcgagggtttgggacccagcagtgctcgtcctgcctctaggagctgggtagggacagagaaggtgaaataagagaggtgggacatggaggatggctgcggccacccctgaagcttcgtccagcgcgatgggagtcagtccatccttgcacacgccacccccaactcggcaatgaaacctttggagtggcttgcggctgtgcgccgtgggaactgcaagtgcagatatgggtgggtgaagtaagtggctcagggagggaaaggctgctcgtgcggtggaggaggaagctgagggtcgggtagatctgcccacggttgagggaaatgaaaaggtactgctaatgtgggcgagcggccagccctgagaggccatctgacgaagaggaaaagggatttgagtccggagggcgctggcctgggtatgtaaatacagatgggggaggggctgggtacctgggggcgcgtggagacaaggaatggagccccggaatgccgggcccttgggtac

SEQ ID NO: 28106 - DNA, 170 bp, Homo sapiens
  misc_feature 1..170: note = chr3:27410909-27411079
  misc_feature 1..170: note = hyper
  source 1..170: mol_type = genomic DNA
caggccaccaaccagcgctggccaggccaatgccgacaattcttcctccgccacctggggcgcctcagccaatcgggagcagccatgctgcgcagtgcagaacgccatagcgacggatgacgcctgccggggaatcgccgtagcaaccagagacgcgctagatccaccac

SEQ ID NO: 28107 - DNA, 411 bp, Homo sapiens
  misc_feature 1..411: note = chr3:27754121-27754532
  misc_feature 1..411: note = hyper
  source 1..411: mol_type = genomic DNA
ctccatacgtgccctcggcgacacacagaggactcccagagttgaagaagggggtggatgtgtgtgtgcgcactcgcccacgtctcgtgttttacttttcatttaagtcgtaataaggagaaattcgatgaccagcaaggctggagtcccatcgtcttgttgggggagaggggggagaagaaaaaggtgcctgtaacttcagactgtccaagatatcgcttagctcctgcgcccggaagaaaatccagcgcaggtcgggttccggcgcgcggaagccctgcgaaccccaaatgtgtgcgctgagccgaggcctctaagcggtaggagagaatctgacctccgacattcttttcaagacacgcgccggtggaccgggtcctgggattggcttactcccgggctggaccttgg

SEQ ID NO: 28108 - DNA, 114 bp, Homo sapiens; identical to SEQ ID NO: 6813
  misc_feature 1..114: note = chr3:27754814-27754928
  misc_feature 1..114: note = hyper
  source 1..114: mol_type = genomic DNA

SEQ ID NO: 28109 - DNA, 120 bp, Homo sapiens
  misc_feature 1..120: note = chr3:27756087-27756207
  misc_feature 1..120: note = hyper
  source 1..120: mol_type = genomic DNA
ggggtgtggggaaggcgctgaccaggataggggggctatgagtctcccttccggaatctaaatcagtcatccacagtacatatatcttaaaaagcacatcttcaacgcttttgtccttgg

SEQ ID NO: 28110 - DNA, 30 bp, Homo sapiens
  misc_feature 1..30: note = chr3:27756685-27756715
  misc_feature 1..30: note = hyper
  source 1..30: mol_type = genomic DNA
ataaacggaactaagcgcaaggtgaactgc

SEQ ID NO: 28111 - DNA, 30 bp, Homo sapiens
  misc_feature 1..30: note = chr3:27762343-27762373
  misc_feature 1..30: note = hyper
  source 1..30: mol_type = genomic DNA
aactttctcgcgcaccgaacccgagccagg

SEQ ID NO: 28112 - DNA, 1461 bp, Homo sapiens
  misc_feature 1..1461: note = chr3:27762701-27764162
  misc_feature 1..1461: note = hyper
  source 1..1461: mol_type = genomic DNA
gcaccctgcaagagccgccggggcactgacacagagggacaccgcattggagatgcggtgtctacggagatttattgcgcgcggtgaaacactctaagcaccgcgcggaacaactgggttcagctccctcatcccggaccttccccaggaccacacgtcaccctttatccccgaacccaggggcccctccacgctgcgctcacctgccctgtttcgtaatgatcatctcagtttggtggcggtggaatttgagccacagaggccggttgcacaggtagacgtgggcacggaagccagaacctggaacccccaggccccccagtcctccgcaagatcccgccgctgcggctccagggtacggcccgtagagcggagccccctggctgtactgataggtgcccgggccgccgcccccgccgctgctaccgcccgcgccactgcccgcaccggctcctgggccgaactgcgccctcccgggtgggcacacagccgcggggaagccgccggggggcagcatggagccgtaggggtagcgcgccccgttaggagccgggtacacaggtccgtggggcgccccagccgccgcctggtacgggaagagtgagcagggcgcagccagctccgacccctgaggaccgggggactggaggtagtaccgctcggagctcaggctgtccatggagtagcgcgcagtggccgcagccgcggcggcggcggcggcggcggctgcagcggcggagggcagctcctcctccccgcagggggagcccttgcggccgtccgggggccccggcttggccactgccgcagcgctggcaaatgcgtccccggcgtcggtgtcactaagcatggccgcgggggcccctgcgctggcggctgcgggctccccgctcaccgcctcgcaggagagactgccggaaaacttcttggacgctttgtctaagtccaacttctgaggagagggggccgcgctggggaggtggccagcgctcccgccgctgccgcctcgcgcactctccagcgggtagaagtgcgcgccaggcaggttcactgagctcaccaagagctgctcccctaactgcatgctttgcaaagcgcagacggcagctggctgcttcctctcctccggtggccttattataaaggcaggatgggggagccagcgccctcttccgaggggaaggtaacttccccttcctcccgcgccggggctacccacctgccgactcgcgggccgctactgcgcgtactggcgcgccctgaatccagcgtcctttccggaaggaaagcgccgtgagttggaaagcaggaggtggaaactaacccagaagccctctccttttccttcctcgtacctcttgctcctcaggacccccaccctcctcccaggctcacacgctggaagaaggtgacttagatctttgtccccatccacccactagcccgcgcctttctgccctt

SEQ ID NO: 28113 - DNA, 49 bp, Homo sapiens
  misc_feature 1..49: note = chr3:27764423-27764472
  misc_feature 1..49: note = hyper
  source 1..49: mol_type = genomic DNA
tctgtaatttcgccggaatttagggggacaaagtttggggtctccatag

SEQ ID NO: 28114 - DNA, 257 bp, Homo sapiens
  misc_feature 1..257: note = chr3:27765105-27765362
  misc_feature 1..257: note = hyper
  source 1..257: mol_type = genomic DNA
tgcgcctctgctctgcggcaaatacagaaggtagaataattagtgaaataatcagtttgatattgaattaaactccagctgcttgtttcttcgctgcgtttcctcagatagattcaagagcggggccgtcatattttatcgtttcattattacggaagcggggggcacgtttcgttgcggataaggagaagcctgaatattcgctgttaataagcaattacagacgccgccagtaatcgctccgggagcgcattttc

SEQ ID NO: 28115 - DNA, 507 bp, Homo sapiens; identical to SEQ ID NO: 6819
  misc_feature 1..507: note = chr3:27771497-27772004
  misc_feature 1..507: note = hyper
  source 1..507: mol_type = genomic DNA

SEQ ID NO: 28116 - DNA, 1213 bp, Homo sapiens
  misc_feature 1..1213: note = chr3:28616731-28617944
  misc_feature 1..1213: note = hyper
  source 1..1213: mol_type = genomic DNA
ttcctcctaccccatcgaccctctgttgccgacctttacgccaaactccggcgcgccgcgagactcgcgtcctcgctgtccccgaggggccccaccccttcccggttctaacctgcgacctggccagaggcaagggtaggtcgacttcctgcccggaatttgccgttggcttctccttctctactccagttctttagtgcagggctgtgcggcgcggagccgccagcggcagaacagaccccggagcggagctctgggatacacacacgcgcagcccggagggactgaccccggaggcgcgctcggccgggagagggaggggaccagggccagcgcggaggcgggggtcacctggggttgggggtgggcgcaccagccctccgcacgctcctctctttctagtcctcgccgccaccacctcgcacaggtcggagatccctcctttccttggctcctttgcgttggggagggggtaaggctgagggtcggcgcttggtcagcgggcggggaaggtagatttcacttgcacctgagagtccctattcttgccagcttcgccgggcaaagcccggcgaccaggttggttcttccagcaactttgttcagaaggttggtagggaggagaaacgccaaggggccccaagagacgctggaaagcggctaggagcgtgggccgggctggagagcaagtacccaagcggccctgaggctgggagcgcggctgggaggcgccgccgccgccgccgccgccgccgccgggatgcgctctgcttagcgggactgccgggggcgcctgaaggccagcgctccaaggacacgcggccacccgctcctcgcgcaccccggcccagacgccgccagggccggagccaagcaggcgagcggagctgcggggagcgggggcgaagggtggcagaagggagggcgcgcgggaggcggcccctcctcggcgagccatgcgtgccacgggcagctgagtagctgccgggcgccgctgccaagtctccactccgcttttgtcttgccctccagtgaatgggaagatggagatggatgttgagggagtttctccgcgcccggagcccatcccccgctcccagggggctggcggagcctgccaggcgccgccacagccgccccagccccagccgccgcctcagcagctggctcaggatgaactgcccggcgagagtgcaggcgctgaggacagcga

SEQ ID NO: 28117 - DNA, 30 bp, Homo sapiens
  misc_feature 1..30: note = chr3:29322482-29322512
  misc_feature 1..30: note = hyper
  source 1..30: mol_type = genomic DNA
ctggagaggctctctcggttccacccaccg

SEQ ID NO: 28118 - DNA, 168 bp, Homo sapiens
  misc_feature 1..168: note = chr3:32433865-32434033
  misc_feature 1..168: note = hyper
  source 1..168: mol_type = genomic DNA
ggcaaagttccttttcgtctttcttcctcttctctgggccgcgccgcttcgaacccgagccgggggtggaagagtcgcccaggcggcggcgctgagggagcgaaacccgacctcttccccgtccacggcctcctctttcctccgaacccagcgcggcagggcttccct

SEQ ID NO: 28119 - DNA, 294 bp, Homo sapiens
  misc_feature 1..294: note = chr3:32443174-32443468
  misc_feature 1..294: note = hyper
  source 1..294: mol_type = genomic DNA
cctggaagcctggctcggccgccgcccgcgcacgctggccttctttgttactactttggctcagtggtttcctgggctcgctgctcattccctggcagggctcgcggcgtccgcggcgactcctgggatcggcaggggcctggcttccagcccagcgccggcagcagcccgggggctgcggagcggaaagggggctgggacgcggtcactgctccagccacccggcgctcctgggcggaaatcgcgagcagagcccttctcagcctcctgcagaaaacgcgcctcacctgactt

SEQ ID NO: 28120 - DNA, 1241 bp, Homo sapiens
  misc_feature 1..1241: note = chr3:32857718-32858959
  misc_feature 1..1241: note = hyper
  source 1..1241: mol_type = genomic DNA
gagttctttaaaaaacgtaaaaagaaaaaaagaaaaggtgggtaaaaaccgagatctcccgggcagtggatatgtctcggttgagccagggattcagaatgaaatcttttcttttcttttttaaataaacggaagagtcgttctctgctcctcgctcagaaggtttcaaaggtcgtcacactgaagcccgggggcgttcatctccccagcggccgggagaagggaggaggttggagggcggagggagggagcacacaaaagcgggccgtgctgagagggctaatgtttcctgtttgcctggagccccctcccctgcctcccctcccccagccccctcccagcactcgggcggaagtgagtttgctcctttggagattaaaaggattccgaattccgatcagtcccaataaccggcgtactgaagagaagaggaggaggaggaggaggcagaggcggcaaagcagagaaagagggggcgcgcgcgcgcgcacgcaacccgaactgggggagttgtgcaaagccccaggaggccggggcacggcgggagcaaagctcggtaggcgcagcgcggccgaggccacccgcgtccggatcggcgactcctttcagaaagaagatgacgcgggcgcgagccggcggcgttggccacgcggctcccgagctcgccgcgcggggctgttgccggttccactgattccagcgcgcccgagaggagcctccatccccgaggctcgggatcggaggggggaccaaggcgagggcgaaatggcccgatgacaaaggaaatgtgatcccccttctctgccaaggtttcagagaggacggacgtgaggaggaggaggggcgcagggcgcgcgcggagctcggatagcattgcacgacggcccgcgcggagcgggtacatctaatatcttcctgccgatgaataattcagggcggcccgcggggacctgcggccccgcgcgctaagccgaaggggaaggagcgtgcgtgaggcgcccaggccaggcgaggcgggggcacgagggctccgggccgcgtggggcgcgcgtgcgtgttaagcgcgggcagccgcggcccggctgggcaggcgcgcggaagactcgaggcgcgtgggacgcgcgtgcgtactgcacgcgtgcggccgcggctgggccaccacgagctgcagctgctgcggggcccaccgccctgcaggggaggccgtgcctggctgtgcgcaagccccaagcgcagcacgc

SEQ ID NO: 28121 - DNA, 30 bp, Homo sapiens; identical to SEQ ID NO: 293
  misc_feature 1..30: note = chr3:32859255-32859285
  misc_feature 1..30: note = hyper
  source 1..30: mol_type = genomic DNA

SEQ ID NO: 28122 - DNA, 846 bp, Homo sapiens
  misc_feature 1..846: note = chr3:32859417-32860263
  misc_feature 1..846: note = hyper
  source 1..846: mol_type = genomic DNA
gggcagcgctgctctggtgccggctcccggattgcaggcctaatcgatgcatttttctgagtgagtcggtgactcccccacccacctcgtccgctctctcctcctcctcctcctcttcctctctggtctcctccctcctccgggctgggttgcaaatggcttcgttccccgagaccgatttccagatctgcttgctgtgcaaggagatgtgcggctcgccggcgccgctctcctccaactcgtccgcgtcgtcgtcctcctcgcagacgtccacgtcgtcggggggcggcggcgggggccctggggcggcggcgcgccgcctacacgtcctgccctgcctgcacgccttctgccgcccctgcctcgaggcgcaccggctgccggcggcgggcggcggcgcggcgggagagccgctcaagctgcgctgccccgtgtgcgaccagaaagtagtgctagccgaggcggcgggtatggacgcgctgccttcgtccgccttcctgcttagcaacctgctcgacgcggtggtggccactgccgacgagccgccgcccaagaacgggcgcgccggcgctccggcgggagcgggcggccacagcaaccaccggcaccacgctcaccacgcgcacccgcgcgcgtccgcctccgcgccgccactcccgcaggcgccgcagccgcccgcgccttcccgctcggcacccggcggccctgccgcttccccgtcggcgctgctgctccgccgtcctcacggctgcagctcgtgcgatgagggcaacgcagcttcttcgcgctgcctcgactgccaggagcacctgtgcgacaactgcgtccgagcgcaccagcgcgtgc

SEQ ID NO: 28123 - DNA, 1077 bp, Homo sapiens
  misc_feature 1..1077: note = chr3:33259719-33260796
  misc_feature 1..1077: note = hyper
  source 1..1077: mol_type = genomic DNA
cccactcatctttcacgtcttcccggaccaagccaaaatatccgagggagttttctaaccatcggcggtgtcctcaggggcacattaatagacgttgagaaactgagggacggcggaaaatcaccccttagcagaggaggttctagggcaccttagaggtgatttcattcgagctttcttggagaccttaggaaagccagcggcgggactgcgggacctacgcgctcggcgctaagggagggtccaggcaccaggcgggcgtttgggcgcacgggcacgcggagacttggtgggccaggagagggatgctgggtcgcaggaccgcggctcgttcgttcctctcaggcttgcgcttgccgcttgccgggccggtcagagggagcagccccggcgagctacgccctccctgcccggaccccacgctccaccccccgccccgccgcctcccgcacactcaccatccgcccgcaccgaaaggcgcggcagaccgagcaggagcagcgccgccgcccagagcccggggaggcgtctgtgccaacgggcaggcgggctgggtccctcggcagtcatggtccgggagtgcgcgggccagcggactcgggtgagggctctggctgcgtttggggttgcccaggccactgcccagcgtgcgccactcggctctgcgctctgcgctcggctcacgaatcgcaggcttcgcgccgggcgcgccgagagggaggagcgcggagagccgggggaggctcgggacgcagagccggagcgcctgggccgccgaactcccgggggtcttctctgtggcgccgaggaggcggctgtaacccggctccgccttcgcgctgggcacctggaaacctcggtgccaaaaggggctgcgctgggccgcgcgctctgcgggtacagcggggcggagggcgagggcgcagggaggcggggagagtagctagccggccgcaaggagcccccgcccgtctgggggacccttggcgagagggtgacgcagtctgacaggcggagcccctccggcagggccgttagacaacgagtgtctaactctgtcctcggcctctacttttc

SEQ ID NO: 28124 - DNA, 48 bp, Homo sapiens
  misc_feature 1..48: note = chr3:33318917-33318965
  misc_feature 1..48: note = hyper
  source 1..48: mol_type = genomic DNA
ggggcgcctggctggcgtcaccaggacaacgggcgtcgccggcgccgt

SEQ ID NO: 28125 - DNA, 767 bp, Homo sapiens
  misc_feature 1..767: note = chr3:35680814-35681581
  misc_feature 1..767: note = hyper
  source 1..767: mol_type = genomic DNA
cgtccggctgccgccacctcccgggtgtggcgggtctggggcccggggtctccggccagagcagctgtggagccacgtgcaacacgcgcgttgccctcagcccgggcggggaccggacgcatccggagctgcggggaggagccgggcgccgcccccggcggcagtgccagccgcgtgggagggcacggaccggcggaggggcagacgacggaggcggccaagctggaggaacgggaccgagggatcgaccgaggctggctggctaggggtgggactggcagagctacggacaggtgggagcagtcagacagcctgagagagggagaccagaacgcaaagagagcgagagcattaagtaggcagggagaggcacacagaaagatagacagcaacactcgcgtgctccctccctccacacgccctcctcttaccgagcgaagcggccaggggcacagagtgggagaggactgtgggcacagaagaccggaagagggacgctgcattgctggtgggacggagggattcggacggacggacagaccagcgcacagactggcagcctgcgagagtggcagctttgagagcagagcgcagcaaagcgagaatcccgcgccgagctgctagtcggacccacagacggtcggactgacagacgtgcagacggacagaagagcagacaggaggcgggggcgcgttcactcccggcggccagccggccagagaaggcggcggtggcaccttctgagcgcgtccggagcagagaccag

SEQ ID NO: 28126 - DNA, 30 bp, Homo sapiens
  misc_feature 1..30: note = chr3:36421872-36421902
  misc_feature 1..30: note = hyper
  source 1..30: mol_type = genomic DNA
ctgtgaggtcgccggcgaggtggccgcggg

SEQ ID NO: 28127 - DNA, 529 bp, Homo sapiens
  misc_feature 1..529: note = chr3:36805601-36806130
  misc_feature 1..529: note = hyper
  source 1..529: mol_type = genomic DNA
gcgaatgagtcctcccgcccccgccaaggtggcgcccagaacgggtcggtgccggagcgcacggtactcacccggggcaggccgcgccgggcaggctggggctggccgggccgggggcggcggcggctgcggggctggagtggcggcgggcatggcgcggcggcgggctcggggagagcctggagcagaggtggcagcgcggggacgcggctcgacggtcgagcaggcgcgggaaggcggggcgagacgagcagccacgagcccgcgccgactctccctcttctctccctcccgccgcccgccgcccgcctgccagccccgcgccgcgcagcgcccggcgacagccaccgggaacgtctccgggggcgcgggacttagcaaccgcgcaccagctgcagccgccctctctgcgccggtcccgccatgcgcgccgctcctggccctggaggccgggcggggccgggctttgaacttgctcccacaccccctgcttctccagtgagcgcccaaaggcggtcccgcctctccc

SEQ ID NO: 28128 - skipped

SEQ ID NO: 28129 - DNA, 44 bp, Homo sapiens
  misc_feature 1..44: note = chr3:36986351-36986395
  misc_feature 1..44: note = hyper
  source 1..44: mol_type = genomic DNA
tccctgtgggcagggcgcggcgggcagtgcggaagcccgaaagc

SEQ ID NO: 28130 - DNA, 57 bp, Homo sapiens
  misc_feature 1..57: note = chr3:36986663-36986720
  misc_feature 1..57: note = hyper
  source 1..57: mol_type = genomic DNA
aaatggtatggctctcggccgcctttgaataaacgagtgcttcgaaccctttaccag

SEQ ID NO: 28131 - DNA, 438 bp, Homo sapiens
  misc_feature 1..438: note = chr3:37493692-37494130
  misc_feature 1..438: note = hyper
  source 1..438: mol_type = genomic DNA
gcccgctcagcccgccgtccgcgccccggtggcgggcccgacgcccgcattccgcccgtgtccaggcgcagagctcccgccccggggagcttcctggccgtcggcgggccccgcggcccgcgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctggtgagtgcccgcccgactccgcgaccctggcccgcgcggccaccgccccggcccccaggccagcgccgccgccgcctttc

SEQ ID NO: 28132 - DNA, 301 bp, Homo sapiens
  misc_feature 1..301: note = chr3:38035773-38036074
  misc_feature 1..301: note = hyper
  source 1..301: mol_type = genomic DNA
cgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatgtgagtgcgggggcgaccggggcaggagggagccgtggaggcggtgccttggctggggcagtcttgggatggccatcgtccacatccctgaatggggcaagccgggaggggttgggt

SEQ ID NO: 28133 - DNA, 83 bp, Homo sapiens
  misc_feature 1..83: note = chr3:38070745-38070828
  misc_feature 1..83: note = hyper
  source 1..83: mol_type = genomic DNA
cgtaccgcccgcccacccaccccccgggctagatctcggacaagcctggaaacgcccagggtcgtgcccggcagtcccaccca

SEQ ID NO: 28134 - DNA, 474 bp, Homo sapiens
  misc_feature 1..474: note = chr3:38071100-38071574
  misc_feature 1..474: note = hyper
  source 1..474: mol_type = genomic DNA
ggtccgagcggagtgcggtgcagggacctgaatggaccgcggtgggaggaggccgggggtggtcccgggacaccgccccgcccccgctgccctgcgcccccgccccctgagcccgccaaccctcgtctctccccgcccccttctggggacgcgagagggagggcagagctgggggcccggaggactggccaaccctggcccgggccagcgggcgcgccccgaccagaaatagccagattcctccagcttcctccgccgccgccacccacgggccgcgggccctgtcattaccgcgggcggccgggccccacgccctgttgtgggcgcctcgctggggtcggggtgatgctggaaagaatccggcgtcatcccggggaagggatcgtgtaaggtccgacgcccagccgggctgctgcgctagggagacgcggcgtccaggcttccagccgcagctcccagcgttcgcattccctt

SEQ ID NO: 28135 - DNA, 383 bp, Homo sapiens
  misc_feature 1..383: note = chr3:38080626-38081009
  misc_feature 1..383: note = hyper
  source 1..383: mol_type = genomic DNA
agcgatgacgggatccgagagaaaggcaaggcggaaggggtgaggccggaagccgaagtgccgcagggagttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccgg

SEQ ID NO: 28136 - DNA, 133 bp, Homo sapiens; identical to SEQ ID NO: 6836
  misc_feature 1..133: note = chr3:38081153-38081286
  misc_feature 1..133: note = hyper
  source 1..133: mol_type = genomic DNA

SEQ ID NO: 28137 - DNA, 211 bp, Homo sapiens
  misc_feature 1..211: note = chr3:38690516-38690727
  misc_feature 1..211: note = hyper
  source 1..211: mol_type = genomic DNA
cagagaaagggggtgcgtggcttcctcccccatatccagccctgctcggtcagcccccgcaaaccccgctctctggaaccacattcatggcgcgcctagtcgccgctctgaccttggggtctccggcctccggtatccgggtcccaatcccagaccctccccgagcctgcgccagggatggccgggaagctggggccgcagctccccctcc

SEQ ID NO: 28138 - DNA, 26 bp, Homo sapiens
  misc_feature 1..26: note = chr3:38691468-38691494
  misc_feature 1..26: note = hyper
  source 1..26: mol_type = genomic DNA
cgacccggcgacgcttcaccacagat

SEQ ID NO: 28139 - DNA, 120 bp, Homo sapiens
  misc_feature 1..120: note = chr3:39851235-39851355
  misc_feature 1..120: note = hyper
  source 1..120: mol_type = genomic DNA
gcagcccagctttagcgcgcagaccgacccgcgccccttcttcgccgccggcagcctctaatccacgcggcgcgttgcggcaggtgccctgggcgtactgaggcgcggtggcctgagccc

SEQ ID NO: 28140 - DNA, 57 bp, Homo sapiens
  misc_feature 1..57: note = chr3:39851638-39851695
  misc_feature 1..57: note = hyper
  source 1..57: mol_type = genomic DNA
atcgcctctttctctcgctgctggggtgggagctcgcctctgcgtttccctcgcgtt

SEQ ID NO: 28141 - DNA, 30 bp, Homo sapiens
  misc_feature 1..30: note = chr3:42305003-42305033
  misc_feature 1..30: note = hyper
  source 1..30: mol_type = genomic DNA
ggcgcctcctctgcccgctgcagcccggag

SEQ ID NO: 28142 - DNA, 30 bp, Homo sapiens
  misc_feature 1..30: note = chr3:42305329-42305359
  misc_feature 1..30: note = hyper
  source 1..30: mol_type = genomic DNA
gaactcctcacccagcgccaaggggcagag

SEQ ID NO: 28143 - DNA, 534 bp, Homo sapiens
  misc_feature 1..534: note = chr3:42543046-42543580
  misc_feature 1..534: note = hyper
  source 1..534: mol_type = genomic DNA
tggtccacaagaagacgcgctcccagggcgcagagctggtgaccccgctccccatgccagggacgaataaacgagaaaaggggctgacccggtgtcacccagcggccgagcagccgccccttggaagctcagcaccaaaggcaggcggccagggtcctggcccctctctggaccccagtatccccagctgtaaaatagggaatgcaggaggaggacgacgtctgtggatcgttttaggtcagctgcggagtcggcctgcgggctgggagcagacctcgctccccacgcgagggcgctggcacttcagcccagcctccctggggaggtgccctggacgagacccgcgagggtgcggacacctcatcctccctggagcaggtctcccgaggcttgaagggccagggcacccaacaggtgctgagcgcgccccaccaggtcacccgggagcagggaacaccaaggaacccagagtcgggcctctttcgagccctcgcttcctctcgcctggcttcttcggcgcgaaggatgaattgg

SEQ ID NO: 28144 - DNA, 860 bp, Homo sapiens
  misc_feature 1..860: note = chr3:42814258-42815118
  misc_feature 1..860: note = hyper
  source 1..860: mol_type = genomic DNA
gggaactgggagatgcggaagtgcacgccgtcgggtcgcatctttcagtgcggtgcgagagggcccagtggcagaggcccagcaaacagcgcttgtcaggcggacctgagttcgagttctgactgtgccatctacgctatgactttggggcaggcgacccaccctctgcgcctcattaacccatgtactgcatggaaaataagcgtctgcctgggttagaagagggctgtgtgtgaagattcaaaggacgaaggggaagagtcctcgctgggcgcccagcacgcggtgagcgcccggccagtggcagcgcgctcgggctggggttgcgctcgggctcggttccgcgcccccggcagctgcgggctttcccagctccggcccgggcccttccgctctccccggcacttacagcggtctctctccacttctcccttctaggaccgcggcggctaggtcacctcctccggacgccgacacgcgctgccctggcaaccgtcaccagggaaacaagcgacgtcacttgcgcgttttcaacgctactctacgggggccgagggggcgccaagagttctgaaagtgacagaggcgctgatggcgcgctgggctggatccaagcgagcacgatctcgagtgcgctggagattttaaatcttctggagtatatttttaaaaaagttttgtggaccaaacgttctgcacagagatgcccattccgctctcctgttggggagttaaaaagcgaacgatctcaccatgaaatttaaagtagccattcagatatatttgaaaaatgtaaaacagtgtggggaaaggccatgttatgatggtgagtgaaggaagcaggacgcaatatagcaatg

SEQ ID NO: 28145 - DNA, 303 bp, Homo sapiens
  misc_feature 1..303: note = chr3:42947369-42947672
  misc_feature 1..303: note = hyper
  source 1..303: mol_type = genomic DNA
gtctagtgaagtacccgctacctcctatcagcaaatatctgtccacctagggtgcagcgagctggagaggaaggggtggcctagagcgcaggggaaggattcctccccagccgcctgcacccctaccccggtagcggtccctgggatcgtccgtgtctccaggagaaccggaccgctctcccctccctccccgagcgagaaaggaggaccacagagatgcggcgccctccgccgtcctagagcaaccggagcggcccgagccccggcctcccggatgctggggcctggcgggtgtggagcacg

SEQ ID NO: 28146 - DNA, 36 bp, Homo sapiens
  misc_feature 1..36: note = chr3:42947925-42947961
  misc_feature 1..36: note = hyper
  source 1..36: mol_type = genomic DNA
cgcgccgggtgagtgcggggccggagcctggaagca

SEQ ID NO: 28147 - DNA, 498 bp, Homo sapiens
  misc_feature 1..498: note = chr3:43020926-43021424
  misc_feature 1..498: note = hyper
  source 1..498: mol_type = genomic DNA
tgtgcagcgatctcccgagagttggcgcagggccacttggctgcagagaacgtgtgcaccttcagtccgggaaacccgccccagccgagtagccgcgcatcctgggaagcctggcgagccacggcgccgggggcggccaaggggaggcgggatgagtctgcgagccggctgagcgcgccgaggagccggccggggcaccgccggggacatggtaggactcgcgggaaggaacgcgcgagcggagggtggggcgatcaccaggacaggtggctgcagtcaacgcgcagcggcccagggcgcgcgcagcctgcgcggcctcccgaggccggagttgttccccgaaagttgcatggggcggcggcggctttcatttctgcaccagagctgggggcgatcggctttcctgccgctcttagtggggcggaccgtaataagggggcttttattactaatctgcactccttgacctaaccgtaacccactcgcaactctgcaatc

SEQ ID NO: 28148 - DNA, 330 bp, Homo sapiens
  misc_feature 1..330: note = chr3:43935852-43936182
  misc_feature 1..330: note = hyper
  source 1..330: mol_type = genomic DNA
caagcccacaggcaacgccagcgcgctcccaaccgctggagacagaaacaatgtgcgcgcgcacacggcccacgtgcacgcgcgcacgcccacgcggcatacaggcgcgcacgtgcacacgcgcgcctgcacagctctgcggctctgctccggccccacaggcccatcttaaagtgtttcgtgctctaacttaccaaacacgtggcagccggcagaacgaaaaggaaaataaatgaactgcgacgaaataaagcaggcctttccgcagtcggccacgtccaacagccacttggttcctagcgctttctcgttacccggcttgggcaaagc

SEQ ID NO: 28149 - DNA, 895 bp, Homo sapiens
  misc_feature 1..895: note = chr3:44036233-44037128
  misc_feature 1..895: note = hyper
  source 1..895: mol_type = genomic DNA
ccggtcctggcctctcggtgttcaggtgtgtgtataggtgggcgttggtgtgagaacgagcgagagaaagcgggagcaagagcgagagctatgcctcccttagtgtcagggagggtggccggctgatgaaggtgctgtgcagaaagccggggaagggcttaaagagggtgctggcgcctcgggaacgccctcccgctgcaccctacaggaggtcgtgggcggtggcttaacagccccagtgcagagcttgaaccccaccgtccagaaggaaaggtgagtgggggacccgggcgggaggtgaggcctgccggcagcggccctcaggcgtgctgggcagcacggctagcagaggcggcgcctggtcttggatgctgcagcggagacgccaaggagactgaatgcagggagcgaggcgtagcggccgcggagggtggggccgcccggaaatccaggcggcgccagccttgtagcatctgcaggccgggggcgcgcacacgaggggcacgtgggtgtggaggaaccggcgcggcggggcctccttcctgcagcgccgcggcggtcgagtgcccgtgctggaggaacggcgagtggggtgcctgccccgcgcaggcggtacccgccgccccagctccgcacacagcaggcacggccagggaccgggaccgtggcccagcgcctggaggcgctctccacgcgcatctttcccgatgccggggcgggaagccgagtggctttgtccggagatgccaggggatgtgggcaggggacgaagaggtttcccaactggccaaaccctggcttgaggaaagactgaggtggtcattgacccgtgggagcgccctggggcttcgagggaacggcagccgagcccgggagactggtgttgggtacccgc

SEQ ID NO: 28150 - DNA, 1765 bp, Homo sapiens; identical to SEQ ID NO: 2221
  misc_feature 1..1765: note = chr3:44037129-44038894
  misc_feature 1..1765: note = hyper
  source 1..1765: mol_type = genomic DNA

SEQ ID NO: 28151 - DNA, 602 bp, Homo sapiens; identical to SEQ ID NO: 2222
  misc_feature 1..602: note = chr3:44039424-44040026
  misc_feature 1..602: note = hyper
  source 1..602: mol_type = genomic DNA

SEQ ID NO: 28152 - DNA, 1094 bp, Homo sapiens
  misc_feature 1..1094: note = chr3:44040056-44041150
  misc_feature 1..1094: note = hyper
  source 1..1094: mol_type = genomic DNA
cggcttcctgggaaggatcggggactgcagctcccgcgacgcctcctcctcctgcgcagggagcaggcctgagttcctccacgtaatgacctgggagacctcaggcatcccggggcctggtcggagggtcttcgggccctggagctgggcggtgtctgcagtgcaccgccgtgagtttctctcgggtacaatgtgctggtgtgcagagaggaggaaaggaaaaaaaaaaaacccaacaccactcttaagtggcactggcatctatgaagtggcagtggtctacactgagcgtgcccttgcctggaggtgtagggggcggttactgcagccgaggggagggtactgcggccaagggcagggcgagaggacagtcaaggccggctggccgcgtgggagcctttcctctccgggttcagcggccggaatcaccagcactgcggctaaaggggctggtaggctctcctgcaccccgcgtgctcctccgccttctctgtgtcccccggcttttccaggaggaagatggggtgcccatcgcgaatggggcgcgccgggccgcctggccgggcggtcacgtgtcccccctcccccgccactgcggcgggagttccaatcagagcgcgccagggggctcctcccgggcaggaaccacccggctcggcggcggagggtgggccgccgtcacctgaccgcccgcccccgccccccgcgagtaaggggcggtggtagcgtctgctcggttacaaatggcccctcccgcccggctcgcccgctcgctcgggctcggcgcggacccgcctgggcgtgctcctcccgccggctccaggcgtcccaccgccctgcccggcgccagcccgcggtcccagccactcctgagggcgcgccgggcacccagcgcgtaggctcgcccacggaggtcgacacggaagtctggaccgccgaggcgtgtggctcgtctaccggcaggtgagcgtgcaccgcgggcgtgggatgctgtggggacagtgcgggggacgtgtggggtcttcggatgcgaacgcgagtccgtgcgatgcccaggtcaagtttgcagagagagtctgcggtgtctgtctcct

SEQ ID NO: 28153 - DNA, 551 bp, Homo sapiens
  misc_feature 1..551: note = chr3:44063340-44063891
  misc_feature 1..551: note = hyper
  source 1..551: mol_type = genomic DNA
ttgatttttggcccccgctgcagcaagttgggggctggtgaggagtgtagcggtgactgggggcggagtgcggactcgcatccgctgtaccaggagcccactgccacctcgggattttttttttaacttggaatttccatatgacaaaaaagaaagaggtttctcctcaatctaacggagccattaacatctattaataacgccgacagggtaagtaacggagccgcgctcctcggggtggtcaccgggctgcgtggtcctcggccggcctcctgcatccgctgcccctgtgcgctccgggccggatgcgcaagggcggcgcggggaccaagcctggctgccggccgcctactcctccccttccctaaggtaaggggtcgttttcacactcaccagagctcctgcgggctgagctcgccccctcccccgacttctttgcggggcattttctcttgctggtgtattacgtgtcatttctcacggggcattgccggccgcttttctgcaactgtcctttcggatttggtgatctggtccggcacagaggctct

SEQ ID NO: 28154 - DNA, 207 bp, Homo sapiens
  misc_feature 1..207: note = chr3:44481337-44481544
  misc_feature 1..207: note = hyper
  source 1..207: mol_type = genomic DNA
gcttcagtgaaaggacgaacaagtggctctggtttttgttgtggttatgagagctcagtgcatttgacagtcagggtttgcacagtttgaacttcccctctgacgcaaagaggaagtggctgggctttcttatcagcttgtccagatccaggcaaactgagggggagagcttgaatgctattagcagacaaacgtcaaacatgggga

SEQ ID NO: 28155 - DNA, 567 bp, Homo sapiens
  misc_feature 1..567: note = chr3:44596464-44597031
  misc_feature 1..567: note = hyper
  source 1..567: mol_type = genomic DNA
ggtgtagagctgggacgcgtctggatcccccgactatggcctgagagcgggatgtgagtggcctgggccctcgcgagaccccgaccccgcccgcggcaggtggccgggcacagccgagaagtaagccctgccagctctcccgggtgcggggacgcgcgcgcccaccttcgcaaacgagacttccgggatcccggagggggcggaagtcgaggcctctctcgcttccggctcggccattgtttttggtctaacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggtagatcgctgttttcccagc

SEQ ID NO: 28156 - DNA, 101 bp, Homo sapiens
  misc_feature 1..101: note = chr3:44626437-44626538
  misc_feature 1..101: note = hyper
  source 1..101: mol_type = genomic DNA
gctgggagttgctgacgcagttccttctgcgctttgttcaagatgtgggtctggcgctttcggtgaggggtgctctacagtctggcgtggggggtcgggcc

SEQ ID NO: 28157 - DNA, 182 bp, Homo sapiens
  misc_feature 1..182: note = chr3:44626539-44626721
  misc_feature 1..182: note = hyper
  source 1..182: mol_type = genomic DNA
ggttctgggagcgtgtgggagacgcaagccaggaggccagggctcctctgcggctgcccgctgctgagatgggcgcggcagccaaggggtcgttgtgggcctcccctttctctcgttcagtgctgcccctttgtcttgggtccagtctctgactcctcgtagctgctcgcttggaccaggct

SEQ ID NO: 28158 - DNA, 225 bp, Homo sapiens
  misc_feature 1..225: note = chr3:44726844-44727069
  misc_feature 1..225: note = hyper
  source 1..225: mol_type = genomic DNA
tgggtataaatatgaccgcaaaactgcccttcaagcagttgacgagcgactttccccttacatcaagtgcacagtaagcccaagcgccggggccgcggggattcccgccagtcactcccgccactaccgccacccggccccgccgccagcgcagcccgcagccccggcaagcctgcgcccgctcggccccggtctctttcgctcaccagaggctacggggcgccc

SEQ ID NO: 28159 - DNA, 177 bp, Homo sapiens
  misc_feature 1..177: note = chr3:44727070-44727247
  misc_feature 1..177: note = hyper
  source 1..177: mol_type = genomic DNA
gccccgcacacccaagaaacactgccaccgcgacgcgcctgcccccaggatcctctcgcgagcttcagtacccaaggaagatgggccgtcccggaagtgcggccggggcgacttgcaggcccctcgccgaccgctctaggaatctcggaggtcttttgacctcgacgcctccttacc

SEQ ID NO: 28160 - DNA, 40 bp, Homo sapiens
  misc_feature 1..40: note = chr3:44754372-44754412
  misc_feature 1..40: note = hyper
  source 1..40: mol_type = genomic DNA
gtagggcactcctagcggctcggcccgcccagcctgcagc

SEQ ID NO: 28161 - DNA, 110 bp, Homo sapiens
  misc_feature 1..110: note = chr3:44770966-44771076
  misc_feature 1..110: note = hyper
  source 1..110: mol_type = genomic DNA
tggtgccggcttaaccggcgcagcaccgaaacccgtagctgcgtgcgggaaggaaccaccgagcggaagccgctcccaccttcctagagaggagacggtagtggttatta

SEQ ID NO: 28162 - DNA, 632 bp, Homo sapiens
  misc_feature 1..632: note = chr3:45837540-45838172
  misc_feature 1..632: note = hyper
  source 1..632: mol_type = genomic DNA
ggttgggggcttggccgcccccgggatggggcgaggggttcccgagggcttgggagggcggcttgggagagagctccggctccggaacgaggtgtcctgggaacactcccgggtctgtaacttcggacaaatcacgctcgctttcccggcctcagtgtgccgttctgtaacttgggtctaaccccggctcgcacacacggcggggacgcgcacagagttgggctggggccggggcgcggtgggcactcacctccgccgtacatctggcacaggtacgggaatcgccacacgttgcccaggcccacggcgtacgagatgcaggcgaacacgaactgtagcgagttggcccacagcggccgcgctttctccatggccccggcctcggcgcgctcggctccggctcgggggtccggcacggcagtctcagtgcgcggtcgccaggcgcgccgtcccaccccggctcggcttgggggtggccccgcgcctccgccgccgacgcagctagctggtttttaaattgctaatctcattaacggcgcgcccgtccgagaggcgaggctggtaaatggatgacggcgagccccaccccgcccgatcgtcgcggccgggaaggcacccgagattgcagagga

SEQ ID NO: 28163 - DNA, 30 bp, Homo sapiens
  misc_feature 1..30: note = chr3:46607744-46607774
  misc_feature 1..30: note = hyper
  source 1..30: mol_type = genomic DNA
gaggctgtttacacccgctgagcagcacgg

SEQ ID NO: 28164 - DNA, 229 bp, Homo sapiens
  misc_feature 1..229: note = chr3:46923250-46923479
  misc_feature 1..229: note = hyper
  source 1..229: mol_type = genomic DNA
ctcggggctggcagccgagcggcctccccagggaccccgacccggcccgaacgggagcccagtggactgacagcgtcgcggccgggggcgcgcgggggtaccgggcagcctcctcaggggattcgcccatgatgaaagagggctcgcttctcggctcagggtctctattcgccagcgggggccggatgatcaagggaaaaaaaatttaaaagcccgtgctttccagaag

SEQ ID NO: 28165 - DNA, 325 bp, Homo sapiens
  misc_feature 1..325: note = chr3:46923931-46924256
  misc_feature 1..325: note = hyper
  source 1..325: mol_type = genomic DNA
ggggccgcggcggcgcgctcggagtaagtcggggctggggacccgcgccgaggggaagtggccggagtcggggaggagcgactccgggcctggccggagcagccaggctgctctgtctcggtgtcagtcggcggcgcctcctcggaacccgggggagtcgccagccccgcgccgctcggctcggtggcttttttggaaacttgcaaatgttttcgtagagagaaaagggggagggagggagcgagggagtgaccgaaacggagcttggggccgctggaagaactgaggccaaggccgggggagctagagacggactgacagacag

SEQ ID NO: 28166 - DNA, 39 bp, Homo sapiens
  misc_feature 1..39: note = chr3:46924989-46925028
  misc_feature 1..39: note = hyper
  source 1..39: mol_type = genomic DNA
taccaccaccagggccggcggcggcggctgccccgaggg

SEQ ID NO: 28167 - DNA, 427 bp, Homo sapiens
  misc_feature 1..427: note = chr3:48693274-48693701
  misc_feature 1..427: note = hyper
  source 1..427: mol_type = genomic DNA
tgtcgcgaacctgggcggggtgggagggggttgcgggggtgggagcgtcaggagcagggtaccacttcacacccaccatccctgcgaggagaaggggctggggcgagagaggaagcgacgagggacggcgggaccgaccggggggacgcgggtgcagcgaggtcaggagaccccgggcggggcgtcaggggaggggcggtgtctcatggggatgccaggacggggcagtcaggaatctgagtcagggcgggtaggtgggggcggcggggaggcgctcagacacggggcgggcacctacgagagggacagcgtaaggtggaatcgctgccgcaggccgcgaaacatgacgaacgaactgggcgggaaggagcgcgcagccacctcgcagcgcgggccctcgaaggcgccgcctgccgggcactggcag

SEQ ID NO: 28168 - DNA, 31 bp, Homo sapiens; identical to SEQ ID NO: 297
  misc_feature 1..31: note = chr3:48693851-48693882
  misc_feature 1..31: note = hyper
  source 1..31: mol_type = genomic DNA

SEQ ID NO: 28169 - DNA, 272 bp, Homo sapiens; identical to SEQ ID NO: 298
  misc_feature 1..272: note = chr3:48693883-48694155
  misc_feature 1..272: note = hyper
  source 1..272: mol_type = genomic DNA

SEQ ID NO: 28170 - DNA, 201 bp, Homo sapiens
  misc_feature 1..201: note = chr3:48698810-48699011
  misc_feature 1..201: note = hyper
  source 1..201: mol_type = genomic DNA
caccatcgtggtggccgagaggcgcggcgacccgtggtcctgcgcggtcacacgcaggtagtgacgctccatgctctcgcggtccagagctgccgccgtacggataaggccgctctgcgggtcgatgctgaacagctccagcgagcggctgttcatgagtgccgccagcgagtagactaggcgcccggcctcgccggcgtc

SEQ ID NO: 28171 - DNA, 597 bp, Homo sapiens
  misc_feature 1..597: note = chr3:48699376-48699973
  misc_feature 1..597: note = hyper
  source 1..597: mol_type = genomic DNA
ggggggctgtcctttctgctccggatgtcgtggctctctcgccctgacccttgctccctgttgcccataattccccacagcagcgcgcggtgcccactcttttgcgggagcctgtcccagcgttccgctgggaggacaccggcttgggaccgtggtgccgaatcaaaaagtctgaagggaggggcgagctgttccccgagcccgggacccctgaggacagagcccctggtgacagactacctctttgcaaaggtcctgtccgcccgcaagaggagacctctgggcgccagtataacacagaccctggtccctgtcctgtctctcgttcgcggctgcccaatggctggacgccgtgttcaatccccagctcctcattcggctgctcagggggccctcgactattccgggcgctttgccttctccctcggagccccacgaagataggctccctgacccccaggccaggccccccatcctcccggaccccggaagactccggacaaagagctaaggctccgccaccgatatgcgcccttggccccgtagtggcagctaagcctgggtcccagccctggtgcccaccgccccccagctcct

SEQ ID NO: 28172 - DNA, 154 bp, Homo sapiens
  misc_feature 1..154: note = chr3:48700273-48700427
  misc_feature 1..154: note = hyper
  source 1..154: mol_type = genomic DNA
ccaccacagcatccccgacgctgctgccgcctcccgccgctccaacatggctcccggccgccccgatggttcgctccacctctgccccggcgcccgaaacacggtggtacaacccatcgcgcatggcagctctgaggaccgaagatgttgccgc

SEQ ID NO: 28173 - DNA, 41 bp, Homo sapiens; identical to SEQ ID NO: 6865
  misc_feature 1..41: note = chr3:49851326-49851367
  misc_feature 1..41: note = hyper
  source 1..41: mol_type = genomic DNA

SEQ ID NO: 28174 - DNA, 321 bp, Homo sapiens
  misc_feature 1..321: note = chr3:49907032-49907353
  misc_feature 1..321: note = hyper
  source 1..321: mol_type = genomic DNA
caaatctgcaaagcccgcgcgctctgaccccgccaggacctcgagccctcgctgcgcccccgcgcactctgcatcccgcacctcgagccagggaaacaatcccccaaggccccacaacctgcgttcgggaagcgcccccagcccggcccgccccgcacctgcagcgccggttggtcacagggaggaagtgatcgcgggctcagcggggcgccgagggctccggggacggcgggcagaatccgctccgagcacgcggggcagacgcggcgccagatgcagccgcttcggctagcgaacctccagcatcgccagccgcttgcc

SEQ ID NO: 28175 - DNA, 108 bp, Homo sapiens
  misc_feature 1..108: note = chr3:49941331-49941439
  misc_feature 1..108: note = hyper
  source 1..108: mol_type = genomic DNA
gggcgccgggctgggcgggcggagtcgggccgtgggggcggggccgcgaggaaggcttggcctagcccaggccctccgcccatccgactcttccggcccttggaggcc

SEQ ID NO: 28176 - DNA, 41 bp, Homo sapiens
  misc_feature 1..41: note = chr3:50232113-50232154
  misc_feature 1..41: note = hyper
  source 1..41: mol_type = genomic DNA
ggcgcccccgccccacgatcgcggcgcgcaccccccgcacg

SEQ ID NO: 28177 - DNA, 566 bp, Homo sapiens
  misc_feature 1..566: note = chr3:50242954-50243520
  misc_feature 1..566: note = hyper
  source 1..566: mol_type = genomic DNA
tggggacctgccagtcgggactcagcgccgagcttaagcagggccctgggggtaccgggagggacacgtcgtcgccttagggcctctcggcggggctgcgaggtacagcaggaggtcggcggcacccggggctgggaccacaggacgccttgttgggggctcgggcggcacaccacaggcttcctgaggcagggcccatggggcaggctggagagggcccgaggggaggacccaagaggggcctggagcagtccctggagcgctgccccgacgggcgcctgacaggcagagcagcccggctggcacgatgggaatccgggtatatttatctcggctgctccggacaagggcttgagggcagatcgggccgggccgcctgaggggccgcggggtacatgctggtcccagagccggtgccatttgcagaggagccagcgggcacagcgggcgcagggcgcgagtggctccctgacctgaggccggggcgccgtgcgagctcctccccacctggcgctgggtagggtgtaagttagagcccgcgcagcgcacggcggagagaaggaacc

SEQ ID NO: 28178 - DNA, 30 bp, Homo sapiens
  misc_feature 1..30: note = chr3:50375451-50375481
  misc_feature 1..30: note = hyper
  source 1..30: mol_type = genomic DNA
ggcctggcggtgaggcggaggagctccagg

SEQ ID NO: 28179 - DNA, 850 bp, Homo sapiens
  misc_feature 1..850: note = chr3:50402170-50403020
  misc_feature 1..850: note = hyper
  source 1..850: mol_type = genomic DNA
gcagggagaccaggacgcccagcgacggcgggaaggaggccccgcggccacagtctgaggtatcttcctgcggggagagacaaggagctggtcggcctgggcgggcgcaaggccgcgggatttcgggtccaccgccccctctcctcactgtcgcgttgtagtcgaagcagatgtgcgggcctctccggtatcgcggtctctgcactagctcacactgctccgggccgtccgctgggcatgggtggggagtcaaggaggcggacggcggcggcggcacggagggggcgcgcggggcagagggggagcgggcggcggggagggcgggggcaggatacagtgcgtctccttctgcagcagccggccagcctcgcactggctgcacagcggcttctcggccaccacaaagagaagattggtgttggtcagtctctgcgcgtggaacagcctgcgggcagcccggaaaggcggggcgttgagtttgccccgccctgacccacccccatcctgcggccccgcccccggccgctcggaggccccgccccttccatcctcccgagcgtctcgccccgctcacaggttccgcccttggcctctggtcccgccccactgccagcacctggagcagtttccgcagtcgatgatggcgttgtaggaggcgtttaccgagccgaagtagtactgggtctgtttcatgacgcagctgctctcgcgcgtctcggggctcccctcggcctccgcggggtctgcgagggcccagagcgcctcagctccgcccacagaccctggcaaggtctccggcctccctcagtcgtagaccccaccctccccatggagtcgtcttagctcagat

SEQ ID NO: 28180 - DNA, 147 bp, Homo sapiens
  misc_feature 1..147: note = chr3:50540350-50540497
  misc_feature 1..147: note = hyper
  source 1..147: mol_type = genomic DNA
ctgacaagctcggaccgcccccccccaactcctcccggggcttgaagatcttgccttgcctcattcgggggatttgggggaagcaggggcaccgcggggaagtttcgcgacgcagccagagcgccgggaccgcggctgccagccttc

SEQ ID NO: 28181 - DNA, 30 bp, Homo sapiens
  misc_feature 1..30: note = chr3:50567928-50567958
  misc_feature 1..30: note = hyper
  source 1..30: mol_type = genomic DNA
ccgcgcatgtgcacccgtccaggtggccct

SEQ ID NO: 28182 - DNA, 124 bp, Homo sapiens
  misc_feature 1..124: note = chr3:50605238-50605362
  misc_feature 1..124: note = hyper
  source 1..124: mol_type = genomic DNA
cgcccagaattggaccgttcgcttgtcgctcgggtctggctccacccccagagggagcctagaacctggtcgcagtttttagagactaccctcaccccgtggcctgcgccgaagttgggcggag

SEQ ID NO: 28183 - DNA, 274 bp, Homo sapiens
  misc_feature 1..274: note = chr3:50712086-50712360
  misc_feature 1..274: note = hyper
  source 1..274: mol_type = genomic DNA
cactggaagcggaagcgagtggggagtccgggtagagggagtcgcccacctgaccggcttcgccccctccggggtttgctgcagctgagggccccggaccagcgattctagaagccggtccggggccgggcagtccaatagcttctcgcggatttccctccgctggcgcgcagcagcggcgcgtggattcgcgcgcgggctcgggacggcgcgagcccgggcagcgcgagcccctgcgcggcagggagtggcgcatgcgcgggcgtcctgcgag

SEQ ID NO: 28184 - DNA, 105 bp, Homo sapiens
  misc_feature 1..105: note = chr3:51990011-51990116
  misc_feature 1..105: note = hyper
  source 1..105: mol_type = genomic DNA
gcctcatcgtgcacccgctgcggccaggctcgcggccgccgcctgtgctcgtgctcaccgccgtgtgggccgcggcgggactgctgggcgcgctctccctgctcg

SEQ ID NO: 28185 - DNA, 52 bp, Homo sapiens
  misc_feature 1..52: note = chr3:51990429-51990481
  misc_feature 1..52: note = hyper
  source 1..52: mol_type = genomic DNA
gctgccttatggctgcgcgtgcctggcgcccgcagcgcgggccgcggaagcc

SEQ ID NO: 28186 - DNA, 42 bp, Homo sapiens
  misc_feature 1..42: note = chr3:54154759-54154801
  misc_feature 1..42: note = hyper
  source 1..42: mol_type = genomic DNA
tggaaagggctggcacgcttcctcaggcggagggtatgcaca

SEQ ID NO: 28187 - DNA, 269 bp, Homo sapiens; identical to SEQ ID NO: 6870
  misc_feature 1..269: note = chr3:54155224-54155493
  misc_feature 1..269: note = hyper
  source 1..269: mol_type = genomic DNA

SEQ ID NO: 28188 - DNA, 554 bp, Homo sapiens
  misc_feature 1..554: note = chr3:54155524-54156078
  misc_feature 1..554: note = hyper
  source 1..554: mol_type = genomic DNA
cgagaaggcgcctcctccggcgctcactgcctcctgcccagtgcggtgggcgccggagtggggagcaggcaatcccccaggctcggagaaatcttttatcccgaaatccagggtgtcccccggtcaggatcgactcggcgccgcgttggcttcctcgctcaaccctgacatcccggtccccaccagtcaccgcagccgggcggactccgaaggcagcggccgctggggagccccggggcctgggtcgggcgcgcagggggccgctgcgctgcggccggatgccgggagccccgcgctggtgcgcccaagccgtggtggcagcaccgccctccgtgctttcccctgtcgggcgccgcggccggaggagcagctgcgggcggtcacgcagcgctgccctagccagagccccgagctcccacccagtcccatccccagcccgatccgccccgcgtgcgatcccgcctgccgccgcgagcctgtgctcctttctgagatttctgcttcttccccagctccctccccgcaggagaatcgcgcggcgggggcggagggcg

SEQ ID NO: 28189 - DNA, 273 bp, Homo sapiens
  misc_feature 1..273: note = chr3:54156356-54156629
  misc_feature 1..273: note = hyper
  source 1..273: mol_type = genomic DNA
gagtttccgagtccccgcccgcgcggcgcctcctgccccgccgccctcccgccgcggcccgccggactccccggggccgccgaggcggggccgggcggctgctgctgctagaggcgcgtctcgctgcctcctcccccgcccgcctccctccccacctctcctccctccctccccacctctcctccctccctctcctctccgccctccccgccccccccacccgctcctttttctgctccccaagtgagccgggcgcgcgagaggcaggcgggg

SEQ ID NO: 28190 - DNA, 420 bp, Homo sapiens
  misc_feature 1..420: note = chr3:54156654-54157074
  misc_feature 1..420: note = hyper
  source 1..420: mol_type = genomic DNA
cgcgcgctcgcccaccgcccgctccgcgcagctccccgcggccgctctcgtcgccgccgcagcgggcgcgtcggagggagcccagcatggccgggccgggctcgccgcgccgcgcgtcccggggggcctcggcgcttctcgctgccgcgcttctctacgccgcgctgggggacgtggtgcgctcggagcagcagataccgctctccgtgtaagtgccggctcctgcgccgcccggggaggggaccttgccgcctgcgacccactgtgcccaagtttgggcgcctgcaggtgcggctgggcaggacccgccgcgggcgtcggcctcgccgctcgcacctgcctttcgggacccgcgtcgggcggcgaggccggggtgggatgctctggcccctgcccgcaggttgccgagtgagatctgga

SEQ ID NO: 28191 - DNA, 488 bp, Homo sapiens
  misc_feature 1..488: note = chr3:54157315-54157803
  misc_feature 1..488: note = hyper
  source 1..488: mol_type = genomic DNA
gcattcttaactccgcgacccccctcgggccccctcccgcgctgcgctttgcagttttggtgctggcagtttctaccaagccgctttttctatcttttcttcttttaaaacatgttacatcgcactgctccttcagccatagtcccatgtgtgcgtgtgcgtgtgcgtgcgtgttgactgtgacacgggtgttacatatcttcctgtgccccttctccctgtagggtgaagctctgggcctcggcttttggtggggagataaaatccattgctgctaagtactccggttcccagcttctgcaaaaggtaaggtttctgtggtggcaggaagcgatgatttttccggcacagaaaatggaggcagatttagttttccaaacaaacgtgagccccgagcagcatcagttatcggaggactctctgatccccgggtttcttggcattgtactatgcagtgacttcttcctaccaaccggttatttttagat

SEQ ID NO: 28192 - DNA, 209 bp, Homo sapiens
  misc_feature 1..209: note = chr3:55520384-55520593
  misc_feature 1..209: note = hyper
  source 1..209: mol_type = genomic DNA
tgcgcgctggccccccgccaggcactcttaaaggcaaaggggcctgaagcgctcgagttactcggccaaggcaagcctacaatctggcctccgtcggtgcgggggggtgtcggggaaggtgtacgccgctctggagtagttggcccctagttcctctgcgggttctctcaaccaaggagtccctttccccatcccgagccccggccaca

SEQ ID NO: 28193 - DNA, 355 bp, Homo sapiens
  misc_feature 1..355: note = chr3:55521035-55521390
  misc_feature 1..355: note = hyper
  source 1..355: mol_type = genomic DNA
gaggaagtcgccacccgagcgagcgcagccgaggaatccgagcggagcgaccgggttaagcctggggggacggtcaggagcagggctgcggagtcctccggcgcgcgtccggcgggcgcagtgaaccggagctgaagcgggcactggcgcccgggcctggactcccgagttggggcagagctgggatgcgcccaggaatggagggggcgcggacgcgcgcgagccggcagcaagggcagggcctggtcggggcgcaactagggagccgccggtccggcgagggcgcgcaggcaactgttccacggagaggcgctccgtttccaacgtccatcagcgacggcggtaattagggctt

SEQ ID NO: 28194 - DNA, 204 bp, Homo sapiens
  misc_feature 1..204: note = chr3:55521754-55521958
  misc_feature 1..204: note = hyper
  source 1..204: mol_type = genomic DNA
gcatggctttttctccgggagatgccgctgaaaacgcacaagtcgccatctgagctgcaagagtcagccccaaattgtgtcctttcattttagggttcggcaaaaacggggagcaaaataggtgaaagtcgccccggaacttattgctgtgcggtgagctggaggggtgcgactaacccaggggagacgcgggctccccccccc

SEQ ID NO: 28195 - DNA, 695 bp, Homo sapiens
  misc_feature 1..695: note = chr3:55522595-55523290
  misc_feature 1..695: note = hyper
  source 1..695: mol_type = genomic DNA
gcaggattttaaagccgtactacgggctggggtgccgggaggcggggtacactctccttgtctccccttctctaagttccccatcccccgcggcatctgctgaaagagagaggtccactccgcagccgctgcctgcctgccgcctggttgtctgcgctccttccagagccaccgaccggcgggaggctgaaccccaacttccccgcctggaccccttggctcgcccgcgtatcccagaccgctcccactggggctccacggagactgctgccttgacatggaacctcatgggggacctcctcattcttacctctgggggaggatacttaagcactggggctgatggatagggttaggcgctcacctcctgcaaagtccccagagtagtagggacttgggtagtgggatgcatgattgctcatctggctccggcccagagcatgaggcgcgatgcgtggtcctgccacggagatcttggcgggtgccctcaggtgaggagattgcgaagtttggcaaaaccgggttccgggcaccggaatttctagacgcttccagatgcccgtggttttggggactccggaggggcagggttggtggatttgtgtccgctacctccagcacgccgagggccccaccccacaaacagtgcctcacactggagcgtaatagttattttccgccgtctgcattctcca

SEQ ID NO: 28196 - DNA, 179 bp, Homo sapiens
  misc_feature 1..179: note = chr3:56502587-56502766
  misc_feature 1..179: note = hyper
  source 1..179: mol_type = genomic DNA
gggcccccacccggccggccggcacgctcgcccgctcgcagaggccctgactcacattcccagcattcccgaggagccgctaggggggacggggctggggcccgggcgcctccgctgggggcagcagaaagcgcccggcatgggcgggggtcttcgcagcgcctcctcccggcaggccg

SEQ ID NO: 28197 - DNA, 28 bp, Homo sapiens
  misc_feature 1..28: note = chr3:56502800-56502828
  misc_feature 1..28: note = hyper
  source 1..28: mol_type = genomic DNA
cgacgccccttcccgggtacccccctcc

SEQ ID NO: 28198 - DNA, 30 bp, Homo sapiens
  misc_feature 1..30: note = chr3:57204154-57204184
  misc_feature 1..30: note = hyper
  source 1..30: mol_type = genomic DNA
cccagagacccagggcggcggacaacagaa

SEQ ID NO: 28199 - DNA, 30 bp, Homo sapiens
  misc_feature 1..30: note = chr3:58571373-58571403
  misc_feature 1..30: note = hyper
  source 1..30: mol_type = genomic DNA
agagggtagctggcccgtgagcccaagtcc

SEQ ID NO: 28200 - DNA, 91 bp, Homo sapiens
  misc_feature 1..91: note = chr3:61548917-61549008
  misc_feature 1..91: note = hyper
  source 1..91: mol_type = genomic DNA
cttttgcaggctgttcgcggctggcagacccagtctcgctcctttctggccaggttaagacaggaacaatactggccgttgataagaataa

SEQ ID NO: 28201 - DNA, 30 bp, Homo sapiens
  misc_feature 1..30: note = chr3:61550498-61550528
  misc_feature 1..30: note = hyper
  source 1..30: mol_type = genomic DNA
ctctggggctgcagacgcgccttggcgcga

SEQ ID NO: 28202 - DNA, 74 bp, Homo sapiens
  misc_feature 1..74: note = chr3:62305019-62305093
  misc_feature 1..74: note = hyper
  source 1..74: mol_type = genomic DNA
tgcattaattggcctcgttgcaaaaggaaaccgagaggaaggcggcaagacttggcctgcgggtgatgttagcg

SEQ ID NO: 28203 - DNA, 561 bp, Homo sapiens
  misc_feature 1..561: note = chr3:62353488-62354049
  misc_feature 1..561: note = hyper
  source 1..561: mol_type = genomic DNA
gtttgtggcatccaccgagatttcggagttaaatctgcatattcctctgggtcccaatctcccctaagcgaactgcagccagaacgagctaacatttaaattccccctcgcttcctcttcccccctcccctggctgcgtcttcctagacttgaggggaggaggggaggaatacaaaaaaacgaggacgctctcctttcaggaaatggaattctaatgtacgcgttcctatttctgaatcggaggtactaaaaatacccccgcgacagcctgaggaagctgtcgccgtcctctgtgcaaacaaaatcgacaattctccttccccgcgcaatgggtctgcgaattgggcggcgggcggggacagaaccgttggctgaccaggacacaacctccatcctgccccagagcgtctttctccgagccccaaccccgagattcttcctccactgaagcgcaggcctcctaaaacccccggagttcgaattcctgctctaccaagcctggtgaccccaggcatgtcacatagttcatctctgcctctatttctccgtctgtagagtggg

SEQ ID NO: 28204 - DNA, 136 bp, Homo sapiens
  misc_feature 1..136: note = chr3:62354249-62354385
  misc_feature 1..136: note = hyper
  source 1..136: mol_type = genomic DNA
agggggtgccctttgcgttaagcatctttcccttcaaatagtcgcctcccgccgtggaaatacgcgtggggtcagctcccagccacactcgccccctcaatggggaggttgcgtggaagcgcactcccgggccccg

SEQ ID NO: 28205 - DNA, 348 bp, Homo sapiens
  misc_feature 1..348: note = chr3:62354445-62354793
  misc_feature 1..348: note = hyper
  source 1..348: mol_type = genomic DNA
cgcggatattaaaagtgtgtgtggggggaggcccggagcgacgcgccagtaatccgagctcttgattatccagattcggatcaaacggggcggcggcggccggccccctcctgggaatgattagatgattaatgtaatgctgtttgaagggtctctgttttctctcttaatttgggtcattacttagaaagcaagcgtgagatcatttcatcagcgtgctcggcagcagagatagctattcaggaaatgggctaacggagcggtaatcaggacccaggaggcggcggcggcggcggcagcgagctcggggagcccgggcgcgccctccggcggcagggctcagggcac

SEQ ID NO: 28206 - DNA, 157 bp, Homo sapiens
  misc_feature 1..157: note = chr3:62354899-62355056
  misc_feature 1..157: note = hyper
  source 1..157: mol_type = genomic DNA
cggtggttgccctccttaggtctcccggagaaggggacgcgcccagaagctctccggtggggtagggcgtagatcgcttaccctcgcggggcgtggcgctttgctcaaggacgctcccaaaagctgctccccaacacccagtcgcttttaacccttt

SEQ ID NO: 28207 - DNA, 920 bp, Homo sapiens
  misc_feature 1..920: note = chr3:62355300-62356220
  misc_feature 1..920: note = hyper
  source 1..920: mol_type = genomic DNA
ttgctgagctgacctcgccgcgaggggagagggggaaaaaaacgcgcactaatgattctgtttattgagttatatatgtatatattccgtgttcgcttgtacaggaggatttacatggctgtataaagatggctaggggcgccgcgctcttctggggcgctcacggtgacaggctggggttaaaactggctgccccaggagaagcggaggcctggaattaaatacgtttcggcgcactggatttaaataagtttcctgaatatacaaaggtgggggccacgagtttgctgccagtcatcgaggaaacatttagctttccaaaaatatgctggtttcgataaatagattttagcctctctgctatagtttttttttcttttaattttagaaataagtttatatgtgtgatctgttttcaggtggtacagggagggaaggaagggcaaggcagtagctctcagctctgcactgtcctagtcaggtcctttgcggagggggcagcagggcccacgctgtcgtggagtttgcgcacatgtttctttaagtcaaagtttctgcaaaaccctttgccgcaagtggcgcacgtgaaaggcttcttgtcgttgtgggtgtgcatatggaaggttaggttgtagacctggtggaaggccttgttgcagatggtacatttgtactgcttctcgccgctgtgggtcagcttgtggttcttgtagttccctacaacagatcaagaacaaaaaacgtgggggtatggagtagaatggtggggaggaagaggcgggcgtcccaggggcagcccaggtgcctgctcaaaaaaggcgacgcttggctaggcgggcgcgacctcttcgagtgaagaagttgtcaaacttcgtaagcgtcaagccgggtgctctcccgacaagaccgagactgagtcc

SEQ ID NO: 28208 - DNA, 279 bp, Homo sapiens; identical to SEQ ID NO: 303
  misc_feature 1..279: note = chr3:62356366-62356645
  misc_feature 1..279: note = hyper
  source 1..279: mol_type = genomic DNA

SEQ ID NO: 28209 - DNA, 367 bp, Homo sapiens; identical to SEQ ID NO: 304
  misc_feature 1..367: note = chr3:62356792-62357159
  misc_feature 1..367: note = hyper
  source 1..367: mol_type = genomic DNA

SEQ ID NO: 28210 - DNA, 176 bp, Homo sapiens; identical to SEQ ID NO: 6889
  misc_feature 1..176: note = chr3:62357495-62357671
  misc_feature 1..176: note = hyper
  source 1..176: mol_type = genomic DNA

SEQ ID NO: 28211 - DNA, 382 bp, Homo sapiens
  misc_feature 1..382: note = chr3:62357735-62358117
  misc_feature 1..382: note = hyper
  source 1..382: mol_type = genomic DNA
cggagcctcctggcagcttgctgtggcccttgacgcctccgcgctcggcagtcagggccgagttttccttcagtacctgctccagcggcgccggcaagcgctccttatggggatagggagccgggtgggggaacttgtccgcagccaggccggccagcttggcgttctccagcagaaagagcttggggtgagcagccagggcggcgggggcctgcgcattgaggaggccagacgggaagaggtggccgctgaggagctcagacggcgggtacgcggtcgagtccaggtagttgaagtagtagagcgagccgctggccggcagccccacagcctggttgatgacctgcggcttgatgaccctgcccgcgggcagcgcggacgg

SEQ ID NO: 28212 - DNA, 239 bp, Homo sapiens; identical to SEQ ID NO: 6891
  misc_feature 1..239: note = chr3:62358336-62358575
  misc_feature 1..239: note = hyper
  source 1..239: mol_type = genomic DNA

SEQ ID NO: 28213 - DNA, 534 bp, Homo sapiens
  misc_feature 1..534: note = chr3:62358858-62359392
  misc_feature 1..534: note = hyper
  source 1..534: mol_type = genomic DNA
gcccttccctggacccgggcctctgccacgcgtgctgggagctggacagtgaaggggcaaagttaaagaggaccggagagccacctcgcatttacctctttcccccaccaccaaggagatgcgttccgagccatgcagcgtgtctcttctgtcacattttgatggcaaacatcttcccctccgcgtgagatcactgtcttttacattcagctgacatcacatgaagtcacttgaagtggaatgacatgggcggcggcgcggctcccgtagcggcccctgtgttcccccgcgcctgccggccgccgccaccaccgcccctcaaactttaaaaggaggcaactggcgcccgcgctcctctcgggaaagtgcgagcggtttgcgaatagggaaagagggaagagacgggagggggagggggaggaatcgtgatggttttgccggtggaaggaaagggggggggggacccaaacccaaacctaggcagagttccgtgcgtgattcacaactttggaggcctgcaggtttgggggacgc

SEQ ID NO: 28214 - DNA, 1132 bp, Homo sapiens
  misc_feature 1..1132: note = chr3:62359393-62360525
  misc_feature 1..1132: note = hyper
  source 1..1132: mol_type = genomic DNA
gggagggcggagggtcccggacgcggcgcccccaaagggcccctgggtatcagtctagtagccgaagtatcccttagccctccgcagccgagctgggcatcgtgctaataaactgccatttacccacggaaccggcgccagccccgaacacgcgcaaatgataattacctcattaggatgtggcgcatggacgcgggcgccgcgtttggaggggggaacttgttaatggggaaatattaatttatgcaaaagcaatgagctcgccttggctggcgtcggaggtcgggagaaagctcccactgactaaggacgaccccgaagcgtcacggagagcaaggccgctcgccggcatctcgggggcctcggcgccgcgcaggtgcgcctccagctttatggccagctctgggtctgaggctgggggagactaaaccgagagctggaagactttcggagatcctaatagatcagaattgttgatttatgatcgggtttctgaggcaaagccgagttctgcttctggtttagggctgcgtgcggggaggattcggagggcagctctcccagctgatgggtacttactgtttgtataattgagaaggtcccatctccacctgtttaaggagcagattgaaacagcagaacctccccctggatcctattaaaacgtttttcctcctaaggccattcagtcgaaccaattttccgaagtgattcatagagctgaattctgccaaggcagctctttcacttttagccactaaagcaccgcgtggaaccgggttttgtgtttttctaaaataaagagaaggattatcagagaggagagggagggggcctgaagggggacgggcagagacttagtgtggccagaggtacaagcagagggaagaaaagacccttttctagacaggccccaagtaagttcggaggaattcagcgttttgtgcctggcgcacaaaagcagcgcgctccgcgcttggtttggaggggctgaattcatctgtttgcagaccattccacctgcgtatcacaacaaactgctcaaagacgctccagcactttcaacaggccgggtgctcttggcgacaacaaaagtggtcgaggctgagggttcttacggaggggggtggtg

SEQ ID NO: 28215 - DNA, 25 bp, Homo sapiens
  misc_feature 1..25: note = chr3:62362712-62362737
  misc_feature 1..25: note = hyper
  source 1..25: mol_type = genomic DNA
ccgggcgcccaggcccgtggccttc

SEQ ID NO: 28216 - DNA, 101 bp, Homo sapiens
  misc_feature 1..101: note = chr3:62362816-62362917
  misc_feature 1..101: note = hyper
  source 1..101: mol_type = genomic DNA
cgaggcctcagccccaggcctatttcacttggagcgcctcagcctagagccggacgctttggcttcttcgccatctggccctaggttgggcctcaaactcc

SEQ ID NO: 28217 - DNA, 581 bp, Homo sapiens; identical to SEQ ID NO: 2239
  misc_feature 1..581: note = chr3:62363596-62364177
  misc_feature 1..581: note = hyper
  source 1..581: mol_type = genomic DNA

SEQ ID NO: 28218 - DNA, 36 bp, Homo sapiens
  misc_feature 1..36: note = chr3:62364279-62364315
  misc_feature 1..36: note = hyper
  source 1..36: mol_type = genomic DNA
cgcccggcccactgcacccggcggctgttttgcagc

SEQ ID NO: 28219 - DNA, 424 bp, Homo sapiens
  misc_feature 1..424: note = chr3:62364702-62365126
  misc_feature 1..424: note = hyper
  source 1..424: mol_type = genomic DNA
atacttatatactatcggcaacccatcactagaaatgctatttaattaggaatctgatccaatacccgcgtgcagcaatttgccagcagacgtgtcattttgtaaggcgcagtgagggaaggaagtcgtctcgcctacctgggttttccacttgctacgcgattttggtgtgcaacccaaaggaaataatcgtttatagagaacgatgatgatgtatttttatatatgatataacacacacatccgtgtatgcatatttgaaattaaaaggcgttttggtgactgactggccctgcgtagttgagagatgtcggtttccgactccctgggaagacggcttaggatcctccgcgttatttaacttggcagctggttaaactccgcggtggagcctgcccaaaggtattagcgttaagtgctgaga

SEQ ID NO: 28220 - DNA, 407 bp, Homo sapiens
  misc_feature 1..407: note = chr3:62860194-62860601
  misc_feature 1..407: note = hyper
  source 1..407: mol_type = genomic DNA
tcccattgttcaccccgcccgcctggcgacgtccgggtgctgctccctgggcctcccaggcgcacctaccttctgctgccggcgagccatgtcggtgggctgcttggcattaaaggggtaggcgatgcagcgcatcacgaacacatacagctgcagcctcttcttcctctcctcctcctctttctgcagccgctccaactcttccttctccttctcgctcaccaccgacgggctggggctggagggccggccgccgccagcgcggctgctgggttgcagccccccggccccgccgccgctgctcgcgccgctgcccccgccgccgcctgcacccaccccggctccggcgccggcgccgccgccccccagcccggcgctgccggccgagccctcgctggtacggctgg

SEQ ID NO: 28221 - DNA, 32 bp, Homo sapiens
  misc_feature 1..32: note = chr3:62861293-62861325
  misc_feature 1..32: note = hyper
  source 1..32: mol_type = genomic DNA
ccccttttcccctcccgcggacaaaaagttct

SEQ ID NO: 28222 - DNA, 54 bp, Homo sapiens; identical to SEQ ID NO: 6897
  misc_feature 1..54: note = chr3:62861840-62861894
  misc_feature 1..54: note = hyper
  source 1..54: mol_type = genomic DNA

SEQ ID NO: 28223 - DNA, 46 bp, Homo sapiens
  misc_feature 1..46: note = chr3:63263792-63263838
  misc_feature 1..46: note = hyper
  source 1..46: mol_type = genomic DNA
gacccaaagtttccccggagccagagggcaccgggcgcacggctga

SEQ ID NO: 28224 - DNA, 586 bp, Homo sapiens
  misc_feature 1..586: note = chr3:63264254-63264840
  misc_feature 1..586: note = hyper
  source 1..586: mol_type = genomic DNA
gctgggagcagggggcgggggatgccgcggcttgggagaggcgcccccagccccttcctcacgctttgctttctctctctcgcctcattcccccaaagctggcctctgcgggcaccttccgggtgctgaaggagccccttgccttcctgcgagccctggaattggtgagtagcagtgtgtgtgcagggaggggcgccaggcagccagctatcaggtgaggagaggtcggatggggtgctccctgctcagttctgctccaagccggagattcaaccctcaagccggggatttcaatcctgccccctcctaagatgccgttccaaggtggtgaggacaaaatcgaggcaccctgcttggaggcgggagtgtggacgcatttttgcaggggcttagacaagtgtcgtctcacctcaccgcttgcagacgcgcaggggctgtggaaagaaacctcccccttgggagataggggaggggggcgcatggaagggctgccgctgggttctggcccctcacctggaccttcgtggggatgaggggatgggtggagggacccatagttgagcggaggagccgggaagacttggcc

SEQ ID NO: 28225 - DNA, 335 bp, Homo sapiens
  misc_feature 1..335: note = chr3:64430570-64430905
  misc_feature 1..335: note = hyper
  source 1..335: mol_type = genomic DNA
cagttccctggagtccgcaagaagcgagcatcgggcgcccgccctagaccgggctggtgctcccggaaagggggcagcagaggacaccccaaaagacggccctaaagtccccgctagagctccaagtggctggacgctggagctttggtgctgggattccgatttgcccggagggagggggctttccagggatcccccagactgtgaccctgagggccacggttcgggtctcactgtcgcccagccggggggtcggaacttaacccctcccgcgccttggagcgctctctcgcgccctggacgcgccccgcccgcggggccggcttacctggggc

SEQ ID NO: 28226 - DNA, 232 bp, Homo sapiens
  misc_feature 1..232: note = chr3:64672181-64672413
  misc_feature 1..232: note = hyper
  source 1..232: mol_type = genomic DNA
taagtcttctagaagcgggcgaggaggcggaaggggagaggaggtggcgcgcgcccacttaccattcctgagcagaggctgatgacggccgtgtgctcggagttggtattgacatagcctttgtagaaacagtgcttgagttccgcttcctcttcggaataaaacttggtctgattcaccccgggcgtcccgaggagggtgacagtgaacagtggagcgataaatccggcat

SEQ ID NO: 28227 - DNA, 26 bp, Homo sapiens
  misc_feature 1..26: note = chr3:65535077-65535103
  misc_feature 1..26: note = hyper
  source 1..26: mol_type = genomic DNA
gttacctgcgggccccggagcggccc

SEQ ID NO: 28228 - DNA, 254 bp, Homo sapiens
  misc_feature 1..254: note = chr3:68056926-68057180
  misc_feature 1..254: note = hyper
  source 1..254: mol_type = genomic DNA
cagcgtctacgccctcgcctttccctggctcctcagtcggcctggacaccgatactaggctcttctgtacagccctccagcaataccttccggggccccgcttgctgcctcctggggctcagcttccctgctgggggcaggcatgtcagagcgcggatgcagcccagggtcctcccgcgcgcctgcaccaggctgcagcgagcgcgcaagcctgctgggtgctggagctcgggccgccccgggagaaggggtgg

SEQ ID NO: 28229 - DNA, 167 bp, Homo sapiens
  misc_feature 1..167: note = chr3:68980780-68980947
  misc_feature 1..167: note = hyper
  source 1..167: mol_type = genomic DNA
tcccgcggaaagagacgcaacttccagacccgctccagttctccacttgggcgggaagctttgcgctcccagctggaagacgcctcccaagcgctcgctgcgcccttcaagcaagatcctagcaaccagagcttcagggtgggggtgggggcggggggacgctgacc

SEQ ID NO: 28230 - DNA, 355 bp, Homo sapiens
  misc_feature 1..355: note = chr3:68980948-68981303
  misc_feature 1..355: note = hyper
  source 1..355: mol_type = genomic DNA
gctcccacctgcttgctcctagaaagatcctagctcagattaaagggatgaagcgctaaggtcgacttgtccagaaaagagctcacggtgagttcaccaccccctataccaattcatcgagtggcctcctccgcatcagcagagcacccccggggattctgtcagacatgaaccccgaaactggaagcggccgctgcctctctccagccacacatccttacttcggagtgccccttccaacttcgggttgcacgccgacctcagcacaggcactctccccggcgccccagagagccgggatgaggggagctgcaccgagctgagttaactcggtaccagccgagaggcagcggct

SEQ ID NO: 28231 - DNA, 189 bp, Homo sapiens
  misc_feature 1..189: note = chr3:68981626-68981815
  misc_feature 1..189: note = hyper
  source 1..189: mol_type = genomic DNA
ctcccgatgtttgcccgcagccgcgcgcgcagtcggtgcgccccgtccagggcggcgcgcagctagcagtgcggagccgagcccagctagcgcgctgaccaggaggggccgggcccgccgcggaacgcgctgattggccgggccgcccggctgctcctgtccctgcctggccccgcggtccacgtgggc

SEQ ID NO: 28232 - DNA, 15 bp, Homo sapiens
  misc_feature 1..15: note = chr3:68981851-68981866
  misc_feature 1..15: note = hyper
  source 1..15: mol_type = genomic DNA
cgcgcccccactgcc

SEQ ID NO: 28233 - DNA, 181 bp, Homo sapiens
  misc_feature 1..181: note = chr3:68981867-68982048
  misc_feature 1..181: note = hyper
  source 1..181: mol_type = genomic DNA
gcctccaggcgcctctcccgagcgcctcgctgtggccaccactccgcaggtgctgagcaaaaggtattcttcctgaatacctgagagtcgcgttgagctccacataaggaagacggatttagggttcggctctcactcgaaaccattctccacgcaggacccaaagcggtttgcaagcagg

SEQ ID NO: 28234 - DNA, 507 bp, Homo sapiens
  misc_feature 1..507: note = chr3:69435151-69435658
  misc_feature 1..507: note = hyper
  source 1..507: mol_type = genomic DNA
cgctctgaacccgggcgtcccggctctcgtacgtgcagccccgaccccagcggcctgcccgcctgggctcccgacgccggcttctgctggcagccggggggtcaagcctgccaccaaactcgtctttcaccgtgcgtcctggccaggctccggcggcatgccctgggattgggtgcccgccagccaacggctgcgactggcacacagaagcccagtgtccacccccgcccgctcgcagcgccgagcaagctgtgctaagctccaccaagctggccctcgatgctcccggggcacgggaagccctggccggcgaggactccccctggcgcttccccagggcgcggggcagggacggaagcggagcaactctttgcaggcagagaggggagctgcatttcagcacacttggcttccacgtcttgcgcgcgcgcgaacacacacacacacagacacacaccccccacaccggacgagtggtctcctaatctgcctcggggaacaccttac

SEQ ID NO: 28235 - DNA, 239 bp, Homo sapiens
  misc_feature 1..239: note = chr3:69590888-69591127
  misc_feature 1..239: note = hyper
  source 1..239: mol_type = genomic DNA
aaaagggcagccaaacgaaacccttagtgtcctctgctaactccagggatttcccccccctcttttcgctgccttttagaagtatctctgggggccagatctgggcttcatcagcttttctcccgacctcccacgaacgcgcggcaaccgaagcacgcggtccccggcggcgcgtttgcaaaccccaccaacgccaacgcctcgaaaccgccaaacttcctgtctccataccaccaaag

SEQ ID NO: 28236 - DNA, 105 bp, Homo sapiens
  misc_feature 1..105: note = chr3:69591310-69591415
  misc_feature 1..105: note = hyper
  source 1..105: mol_type = genomic DNA
cgccctggcagcacgcttggggagcccggggcggtcgcccacctacctgctccgccacctcctccctgcggcgctccggggctgtagacggctactttattgtct

SEQ ID NO: 28237 - DNA, 199 bp, Homo sapiens
  misc_feature 1..199: note = chr3:69591779-69591978
  misc_feature 1..199: note = hyper
  source 1..199: mol_type = genomic DNA
cgccgcctctccgggggctggggcggccgctgccaatgaggctcggctgatgcgctgttccggcccagtcattgtatcgggagggaaggaaggggagggggagagggaggaagggagggggcgccctcggcccccgccgcacggggctgcgggctgggctagccttccccggcagagaaagggcgccggtgccaggagg

SEQ ID NO: 28238 - DNA, 102 bp, Homo sapiens
  misc_feature 1..102: note = chr3:71179297-71179399
  misc_feature 1..102: note = hyper
  source 1..102: mol_type = genomic DNA
aaaaagaaggcaacacgaaacaatgtcacagtaagcagagagaggttccaatctacgtttagcctataaaactatcctgacaccacccggctgcttacttag

SEQ ID NO: 28239 - DNA, 187 bp, Homo sapiens
  misc_feature 1..187: note = chr3:71802609-71802796
  misc_feature 1..187: note = hyper
  source 1..187: mol_type = genomic DNA
ttacctggggccaaacgcgacttgtcgccaccttgcgtcctgggccctgcctccctcccggccgcctcccgaccccgcggctgctgcggaggcgcccccagcccagccgggcccaggcggtgcgggatgcctcggcggggctggcggcggcggccgcgctgcgcgctccggcggaggggagggggct

SEQ ID NO: 28240 - DNA, 516 bp, Homo sapiens
  misc_feature 1..516: note = chr3:71802856-71803372
  misc_feature 1..516: note = hyper
  source 1..516: mol_type = genomic DNA
gcagagccaagaggcgcggcggcagcagcggaggagtaggaggagacggaggaggatgcggggggctgcggacggtggcgaggccctgtccgcagtgaagcccgcggcgcctagggcgcagggagtggccgcctcctcctgcgcgcaccattcctgagatggcggcggcggcacagcggcggctcggggagcccaggaggggccggccgggagcgggctgagccccgcaggacggggagctcgcccagggccggcggagcggcggagctcgggccgggcggcctgcgggagcggcgaggcaggggacggccccggggcggagcgcacggcctggtgaggccgcgatggcgaacgcgagcgagccgggtggcagcggcggcggcgaggcggccgccctgggcctcaagctggccacgctcagcctgctgctgtgcgtgagcctagcgggcaacgtgctgttcgcgctgctgatcgtgcgggagcgcagcctgcaccgcgccccgtactacctgctgc

SEQ ID NO: 28241 - DNA, 130 bp, Homo sapiens; identical to SEQ ID NO: 6910
  misc_feature 1..130: note = chr3:71803654-71803784
  misc_feature 1..130: note = hyper
  source 1..130: mol_type = genomic DNA

SEQ ID NO: 28242 - DNA, 183 bp, Homo sapiens
  misc_feature 1..183: note = chr3:71803826-71804009
  misc_feature 1..183: note = hyper
  source 1..183: mol_type = genomic DNA
cgaccgccgcaagatgcggcccgcgcgcctggtgcccgccgtcagccacgactggaccttccacggcccgggcgccaccggccaggcggccgccaactggacggcgggcttcggccgcgggcccacgccgcccgcgcttgtgggcatccggcccgcagggccgggccgcggcgcgcgccgcct

SEQ ID NO: 28243 - DNA, 30 bp, Homo sapiens
  misc_feature 1..30: note = chr3:71833673-71833703
  misc_feature 1..30: note = hyper
  source 1..30: mol_type = genomic DNA
ggcacttggggaattcgtcttggtcctttg

SEQ ID NO: 28244 - DNA, 494 bp, Homo sapiens
  misc_feature 1..494: note = chr3:71834231-71834725
  misc_feature 1..494: note = hyper
  source 1..494: mol_type = genomic DNA
aggcagttgggggcgcggggcccgggtgcgctgggtggagcgcggagcggcgggcggacgggcgcggcggctcccgcgagcctccgggccgttataaaggctagccccgccgtgactcacgccggcgcccgcccggcagcacacgcggggggcacggcgcgggcacacaccccacgccccacgcgcacacgcgcgcccgcctcggcccggccggctcccagacgagcacgtgctatgcgcggccccccgcgcccccgcctcgggcgccacgcaggcagcgctcccggcggggcgccccgctctgcgccgttccctccgccgtcgcccagccaccgcctttcgcacgcgccggaaccgcttttgtggtctccgagacactcatttgctgtcctggtttccaaagctccacgtgctcagcgccgaaaacttgcaaatcatttgctgtacagatgtttaggggtcgcctactacgtgcggggcgctgtggacacata

SEQ ID NO: 28245 - DNA, 30 bp, Homo sapiens
  misc_feature 1..30: note = chr3:72788104-72788134
  misc_feature 1..30: note = hyper
  source 1..30: mol_type = genomic DNA
ggccctgcgcggctccggggagagctgggt

SEQ ID NO: 28246 - DNA, 41 bp, Homo sapiens
  misc_feature 1..41: note = chr3:73674183-73674224
  misc_feature 1..41: note = hyper
  source 1..41: mol_type = genomic DNA
gccttggatgcctcccgccagccccccgaaaaagggaggag

SEQ ID NO: 28247 - DNA, 30 bp, Homo sapiens
  misc_feature 1..30: note = chr3:74664104-74664134
  misc_feature 1..30: note = hyper
  source 1..30: mol_type = genomic DNA
agggccctcggaacacggggttaaggcagg

SEQ ID NO: 28248 - DNA, 125 bp, Homo sapiens
  misc_feature 1..125: note = chr3:75955872-75955997
  misc_feature 1..125: note = hyper
  source 1..125: mol_type = genomic DNA
cgctgcgccaccacccggaggagggagcgcggtagctgcaggcaggggagggagaggaaagaaaaggaaggacggctcccagacagagagtgggagaaaccggggagcagcgggagcagcaggtc

SEQ ID NO: 28249 - DNA, 123 bp, Homo sapiens
  misc_feature 1..123: note = chr3:75956026-75956149
  misc_feature 1..123: note = hyper
  source 1..123: mol_type = genomic DNA
cgttattcacacggacgctgcggagcttcccagggctgcttccctgtccccctgggtggaggctgccgtctaaacctgactccaggtgagttcggcaaagaggtgaaccgaggggtctcgaac

SEQ ID NO: 28250 - DNA, 50 bp, Homo sapiens
  misc_feature 1..50: note = chr3:77089150-77089200
  misc_feature 1..50: note = hyper
  source 1..50: mol_type = genomic DNA
cctcagaggcggcaccgcgggggtgtctgcagcctcggcctccgcccggc

SEQ ID NO: 28251 - DNA, 60 bp, Homo sapiens
  misc_feature 1..60: note = chr3:77089428-77089488
  misc_feature 1..60: note = hyper
  source 1..60: mol_type = genomic DNA
attaaaaaataactccggacgtggagctgctacggagaaggaaaccgggggaaagaaaac

SEQ ID NO: 28252 - DNA, 38 bp, Homo sapiens
  misc_feature 1..38: note = chr3:79068137-79068175
  misc_feature 1..38: note = hyper
  source 1..38: mol_type = genomic DNA
tccggaggaagggctcggggtgccgggagtgtgactgg

SEQ ID NO: 28253 - DNA, 391 bp, Homo sapiens
  misc_feature 1..391: note = chr3:79815522-79815913
  misc_feature 1..391: note = hyper
  source 1..391: mol_type = genomic DNA
gagtagtgggagctccgactcgaggcaggagtgggatgtcttagcattccgtctcccccaccccacccatctgcgtgggacacagtgactcctagaagggtatcccaggattttagcggccaggtgtgagcgccctccacgcggtcctccgagacctcagggcgcgtggcaactgggcagaagccgtctctgcagcgccgctgccccgggtggagcggcagcccaggctgcagcagtggggttgccacgccgagttttccgcatcggccgcccgcagggctcgcctgcttctccccattgtgttctcagagctgtgggacccagccgcgcgcgcagccgcacccgcgccaacgctggaaccgaaggctcatggaagcggggctggcaagat

SEQ ID NO: 28254 - DNA, 185 bp, Homo sapiens
  misc_feature 1..185: note = chr3:79816778-79816963
  misc_feature 1..185: note = hyper
  source 1..185: mol_type = genomic DNA
actgcagagtcctctcggcaaccattctgcactccaacaaccactagtgtaaaacccagcgtgtccccttttacaaatcaaaagccagctgtcacttcccttgcaaccatttccgagacttacccttccataagactgttttcagcaatctagaggctccgtagtgcagacgcagccctgcaact

SEQ ID NO: 28255 - DNA, 41 bp, Homo sapiens
  misc_feature 1..41: note = chr3:79817317-79817358
  misc_feature 1..41: note = hyper
  source 1..41: mol_type = genomic DNA
ttgtaatgcctgctgcgatgtttaaccgaggggggaggaaa

SEQ ID NO: 28256 - DNA, 570 bp, Homo sapiens
  misc_feature 1..570: note = chr3:85007729-85008299
  misc_feature 1..570: note = hyper
  source 1..570: mol_type = genomic DNA
tgcgcagaagaacctcgcacccaggacctggcccaggcaccacgaattccagaacatgctggggacacggctaaccccgccccctcgcggtggcgattggctgaacccttcctgagtgcaaagcgctgattaatgaaggcagttgtctcgcctgcaagttcgggcgagacatctctaaagaggtaagatccgccaggggtgctgaatgggggcttcagttcttcctgcccgaagggtccttgagaagcctgtttgtttttcccggcgcttgtctccacccatccccttctctcattggccagacctggtgggcgggggagtttccattggccggggggcggtgtctgtccctggccggggtgggggcggggcctccgccgctctgagcttgcccttgtgtctggtgcttcgtagagctgccgccgtcgccgctgccgctgccgccacagccgccgctgcagccggagcatccgggagccgccactgccgccgccgctgccgctgctaccgccactagcgctgcttccactgcttctacctcccctcccaggaccccgagacaccccgggc

SEQ ID NO: 28257 - DNA, 173 bp, Homo sapiens
  misc_feature 1..173: note = chr3:85008553-85008726
  misc_feature 1..173: note = hyper
  source 1..173: mol_type = genomic DNA
cgataccccattctgcgggtgctttgccgctgccgcttctgctgccgccgatccgagtccgcgggttcgaacaccgcagcggtggggacggtgggtccggcgggcgccgggaggaggacaccagcggagccctgcactctcgtgccccgctcaccagcatctacttgccccct

SEQ ID NO: 28258 - DNA, 69 bp, Homo sapiens
  misc_feature 1..69: note = chr3:85009234-85009303
  misc_feature 1..69: note = hyper
  source 1..69: mol_type = genomic DNA
tcccccttttcaggtcgccttttcttttccccctcttcccaccatcatcatatccgtgtgtctttaaaa

SEQ ID NO: 28259 - DNA, 96 bp, Homo sapiens
  misc_feature 1..96: note = chr3:85009769-85009865
  misc_feature 1..96: note = hyper
  source 1..96: mol_type = genomic DNA
atgtaagaacctctgcgaccgcagcagtggagggaaaccgcacaaaacgctgttattatgcaaatcactgggtttggatgccggatggctaaggaa

SEQ ID NO: 28260 - DNA, 40 bp, Homo sapiens
  misc_feature 1..40: note = chr3:85010590-85010630
  misc_feature 1..40: note = hyper
  source 1..40: mol_type = genomic DNA
agcacattctccctgcgtacaccgccgagtcccatttctc

SEQ ID NO: 28261 - DNA, 56 bp, Homo sapiens
  misc_feature 1..56: note = chr3:87040188-87040244
  misc_feature 1..56: note = hyper
  source 1..56: mol_type = genomic DNA
accgcgtccggctcccgcgagggctgcggcgcccacggcagcgccagtcacagcca

SEQ ID NO: 28262 - DNA, 57 bp, Homo sapiens
  misc_feature 1..57: note = chr3:87040446-87040503
  misc_feature 1..57: note = hyper
  source 1..57: mol_type = genomic DNA
caactcgctttgcagcgggcgggtcaccctgcagggggaccccggggaaggctggct

SEQ ID NO: 28263 - DNA, 161 bp, Homo sapiens
  misc_feature 1..161: note = chr3:87841521-87841682
  misc_feature 1..161: note = hyper
  source 1..161: mol_type = genomic DNA
tattttaaaggttttcggaaaagtgattcacgtcatttttcggattccatgaacagataatctcgaaggtatcactcaagtttaagagactggacttttttctcccccgcccttctccacgcatcagtgaaagaggagggaggagacggaggagagaagag

SEQ ID NO: 28264 - DNA, 188 bp, Homo sapiens
  misc_feature 1..188: note = chr3:87842058-87842246
  misc_feature 1..188: note = hyper
  source 1..188: mol_type = genomic DNA
gaaggggtgtggggacgtggggagtgggaggctggacagcgcttgctctcggcggaaacgctgggaagccggcgccaagtcctttcccacactactttgatctaacagcgcaggaattcaagaattgccctttcccttttctgcccacaacctctgctccctgggggcgaagttctgtggtgctaggc

SEQ ID NO: 28265 - DNA, 78 bp, Homo sapiens
  misc_feature 1..78: note = chr3:87842247-87842325
  misc_feature 1..78: note = hyper
  source 1..78: mol_type = genomic DNA
gagatagtggtcaaggctgggaggaagggaggggtctgacccgggcccaagggcgaggggtggcggtccaagccggcg

SEQ ID NO: 28266 - DNA, 73 bp, Homo sapiens
  misc_feature 1..73: note = chr3:89156550-89156623
  misc_feature 1..73: note = hyper
  source 1..73: mol_type = genomic DNA
catttttctcagcaccgcggcctcatcacatcttctgtgtttcctgtcccatgggcgacgcccccactcccac

SEQ ID NO: 28267 - DNA, 186 bp, Homo sapiens
  misc_feature 1..186: note = chr3:96532078-96532264
  misc_feature 1..186: note = hyper
  source 1..186: mol_type = genomic DNA
atccctccctcctttcggttcctggcctgatgagccgcctccacctgcgagcggtgcaggcatttttgttgtcgactaaccccctctagcgccgaactggcggcatccgagccgcggctgccaggccgggagaaggctgggcttggccgggctctgcagcgctccgggctccgtccctgccctggg

SEQ ID NO: 28268 - DNA, 33 bp, Homo sapiens
  misc_feature 1..33: note = chr3:96532523-96532556
  misc_feature 1..33: note = hyper
  source 1..33: mol_type = genomic DNA
taggagagcgcggcccgacgccaccacgccgtg

SEQ ID NO: 28269 - DNA, 203 bp, Homo sapiens
  misc_feature 1..203: note = chr3:96532784-96532987
  misc_feature 1..203: note = hyper
  source 1..203: mol_type = genomic DNA
ctggtcaagtttgggcgacccgcgcggaggagggtcgggctgactgccgccgctgagctgtccccggacgggagcgcctgtccacggcactcaccccctccagcggtggaaatgtggagaagtaagtgggaggcggtgtcgggaactgactcctcttaaaacggtcggcgccgctgctctgaaatgggcggctaagtgcttgt

SEQ ID NO: 28270 - DNA, 540 bp, Homo sapiens
  misc_feature 1..540: note = chr3:96533242-96533782
  misc_feature 1..540: note = hyper
  source 1..540: mol_type = genomic DNA
ccctgcttttggctccgcaagtgcccacttgagtcgggagaggtcctcgggccgccccaactgcccgccccacctggcagtccgtccccgcccccgtcctcgcggtgaggcgctccccgccccctcgctcccctcccccaaaccacagcccgagctcgctcttgcgcgcgcgcgctctctccggcccaagtgaatagtcctcgcgcaagcgggacactgtggtggatgcaattcccctcgcctccagccgcgaggagctccccggcgccgcaggcagcgtcctcctccgaagcagctgcacctgcaactgggcagcctggaccctcgtgccctgttcccgggacctcgcgcagggggcgccccgggacaccccctgcgggccgggtggaggaggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttg

SEQ ID NO: 28271 - DNA, 61 bp, Homo sapiens
  misc_feature 1..61: note = chr3:96534035-96534096
  misc_feature 1..61: note = hyper
  source 1..61: mol_type = genomic DNA
ccacaggctaggatccgttgtgtttctaaatgtctttaaacggtagcgtgagcatcagctg

SEQ ID NO: 28272 - DNA, 56 bp, Homo sapiens
  misc_feature 1..56: note = chr3:98451370-98451426
  misc_feature 1..56: note = hyper
  source 1..56: mol_type = genomic DNA
cgaaaggtaggggttcggctgtgctcccgcctggtccccaacgcctcaccctccgg

SEQ ID NO: 28273 - DNA, 410 bp, Homo sapiens
  misc_feature 1..410: note = chr3:98451961-98452371
  misc_feature 1..410: note = hyper
  source 1..410: mol_type = genomic DNA
ttgggggtggggacacggagcgctgtttgcccctccacatatcctgccagcaccaaggaggtggcgtgcggaggcgtaaagggaccatgggcgctgggacccgcgagccagccggcgtgcgccgcagccaccgccgagagggcacccggggatcctggagccccagtgaagggcgggagggacgcgcagcctcgcgggtaagcccaggagccgtgggggccgagagaatctgctctgggaccctcttttgtcgaatcgccggcgaggttgtgcaattgggaagccaagaggagtgtccagctcctcgttcactattgttttcttgtaaaagggtctgtacgcgaggagggttgaggggtctggaaggttctggtctcttaccgtataaagtttttcgagaaacccttttt

SEQ ID NO: 28274 - DNA, 154 bp, Homo sapiens
  misc_feature 1..154: note = chr3:98452640-98452794
  misc_feature 1..154: note = hyper
  source 1..154: mol_type = genomic DNA
agtagcgagggttggcggggacagtggggaggagcaggagggggagaagaggttgctgttgaaaggtaatgtttaaaaacagtgtgtgggggtagggatgaaaataacgtggtgactgctagtgtatcagaaatcacaccgagtctaaagtcgt

SEQ ID NO: 28275 - DNA, 527 bp, Homo sapiens
  misc_feature 1..527: note = chr3:98620068-98620595
  misc_feature 1..527: note = hyper
  source 1..527: mol_type = genomic DNA
gcgggagagggggagcgcggcccaggcgggggcggcggccgcggcccggacttggggacactgcgggcagcgcctggctctcaccaccgcccggctcgccatcgcggcggccggcagtctgcctgcatagtgcgggtgcctcggcagccccgcgcgcctctggccgcggcacccgaccaggagacggcggcagcggcgggagaacaagaggcagccctcgcctcaccccgcgccgggacccttccgcccctcaccccgctttcacctactcctccttcgtcccttccctccgctccccgcgccgagaccccaggccggagcgcaggggaggggagggaaggaagcggagtcctcgagccgcggaggacggccgcggcggagctaaggaacgtgcctcccgcgccgcgctcctcaccagggtcgccgctcgccgcgctcacccgcggctccggctagctggcaggcaggcccgcagccagctccctcgcgctccctctcgcgcgcgccggccacgccccctaggcacc

SEQ ID NO: 28276 - DNA, 30 bp, Homo sapiens
  misc_feature 1..30: note = chr3:98621075-98621105
  misc_feature 1..30: note = hyper
  source 1..30: mol_type = genomic DNA
ttttgttaaaactgccgccagttgttgcaa

SEQ ID NO: 28277 - DNA, 116 bp, Homo sapiens
  misc_feature 1..116: note = chr3:99356783-99356899
  misc_feature 1..116: note = hyper
  source 1..116: mol_type = genomic DNA
gggagagggatggggcgattttcacccgcgggcggtgggacggggctgagggctgggggctgcctggctccaggccatgtcagtgcctccagctccaggtccgggtccaccctgaa

SEQ ID NO: 28278 - DNA, 402 bp, Homo sapiens
  misc_feature 1..402: note = chr3:99594912-99595314
  misc_feature 1..402: note = hyper
  source 1..402: mol_type = genomic DNA
tacctgaactgcctgcgccggggccgggcgggggccgggccggggccgctgtagtgccgcgctgcgagccgactgtgcgcgctccgagagtcgcccgaacaatgcgagcggggcgctgagcgcgcccggcctatgggcgttacgtcactgttctgccttataaggcgctccgcgtgtgcggcgctgtcggcgggggcgccggtgaccgcgggaccctcggccgcggcggcggcgcagccacacaccccagctcccgcggatgttccggccgtgtgaacggaccgtggttcccggctcccagcggagggaatgagtggtgggccggtgggccggggcgccggcgccctcctgtcgggctaacaaagtcattgggaggcagggtcgatccgcttgtaacttttt

SEQ ID NO: 28279 - DNA, 30 bp, Homo sapiens
  misc_feature 1..30: note = chr3:107149033-107149063
  misc_feature 1..30: note = hyper
  source 1..30: mol_type = genomic DNA
aagaacatgggtttccgcagtcagctccga

SEQ ID NO: 28280 - DNA, 42 bp, Homo sapiens
  misc_feature 1..42: note = chr3:107149805-107149847
  misc_feature 1..42: note = hyper
  source 1..42: mol_type = genomic DNA
gtaagaatagatagacgaacgaaggtgcgtgcaagaaaggag

SEQ ID NO: 28281 - DNA, 30 bp, Homo sapiens; identical to SEQ ID NO: 6932
  misc_feature 1..30: note = chr3:110789665-110789695
  misc_feature 1..30: note = hyper
  source 1..30: mol_type = genomic DNA

SEQ ID NO: 28282 - DNA, 49 bp, Homo sapiens
  misc_feature 1..49: note = chr3:110791365-110791414
  misc_feature 1..49: note = hyper
  source 1..49: mol_type = genomic DNA
aggtgccgggatgcacgtttgccgctttttttcccggtgaaacttgagc

SEQ ID NO: 28283 - DNA, 64 bp, Homo sapiens
  misc_feature 1..64: note = chr3:112052498-112052562
  misc_feature 1..64: note = hyper
  source 1..64: mol_type = genomic DNA
tggcaccaaaagctgcggcggagatacagatttccaggctcgctttctccgggagagctcctgc

SEQ ID NO: 28284 - DNA, 56 bp, Homo sapiens
  misc_feature 1..56: note = chr3:112930381-112930437
  misc_feature 1..56: note = hyper
  source 1..56: mol_type = genomic DNA
agaaggaattgtttgcgagttcagtcatccaaaaagcttcttccatatggagggac

SEQ ID NO: 28285 - DNA, 15 bp, Homo sapiens
  misc_feature 1..15: note = chr3:112930455-112930470
  misc_feature 1..15: note = hyper
  source 1..15: mol_type = genomic DNA
cgtcccctgcgttgt

SEQ ID NO: 28286 - DNA, 228 bp, Homo sapiens
  misc_feature 1..228: note = chr3:112931046-112931274
  misc_feature 1..228: note = hyper
  source 1..228: mol_type = genomic DNA
gcggccgaggctgggcgcgccgggcgccgggcgaagaagttggggcgaggcgggcagcgggggtcccgggggctgcagccgctacggggcccaggggcgccgcatctcgttccctgccgcagcggtctggccgggcgatggtggtttcgcctcagcggttcccagaagcttctcgggtggaagaaggatccagccagcctcccaaacttccaccgaaggttgacacca

SEQ ID NO: 28287 - DNA, 44 bp, Homo sapiens
  misc_feature 1..44: note = chr3:112931566-112931610
  misc_feature 1..44: note = hyper
  source 1..44: mol_type = genomic DNA
tcgtgtgtgcgtgtacgtgtgtgcgcgcgcgtgtgtgcgtgttc

SEQ ID NO: 28288 - DNA, 16 bp, Homo sapiens
  misc_feature 1..16: note = chr3:115231485-115231501
  misc_feature 1..16: note = hyper
  source 1..16: mol_type = genomic DNA
ggggctgcagaagccc

SEQ ID NO: 28289 - DNA, 282 bp, Homo sapiens
  misc_feature 1..282: note = chr3:115231502-115231784
  misc_feature 1..282: note = hyper
  source 1..282: mol_type = genomic DNA
ctgcgcgcctcctggtttctatggagaccctgcttgatgtcaatggcggctccggagcgcagggaaacctaagcgtttgtatttaaatgagggaaagtgggggaaggggaagtaaaagaggaagggaacagaagagaggatggtagaggtgagcgggcgggtgttgaactctggggactagaaaaatccagctgcgttactcagtcatctcatgctcgcggagaaatcagaggaagcagcagcgggcagaggggtgtttatttcttgcgtgagaaatatccg

SEQ ID NO: 28290 - DNA, 111 bp, Homo sapiens
  misc_feature 1..111: note = chr3:115377728-115377839
  misc_feature 1..111: note = hyper
  source 1..111: mol_type = genomic DNA
ccttcttggcccgctcgccttcagctcccacccgcagcagcaaccgcagcctgcttccggggactgagcagccctgggtcagccaaggttaagcagcgggtggggaagagg

SEQ ID NO: 28291 - DNA, 243 bp, Homo sapiens
  misc_feature 1..243: note = chr3:116163696-116163939
  misc_feature 1..243: note = hyper
  source 1..243: mol_type = genomic DNA
agcagaaaagttgcccgaaagccctacctgaggatggctgtgtccccctgcctcacggtgatgttgtccgtgcctcggttaaaatccacgctgcgaacaggcagtcctgtgggaagaaggcagagcaatctcagtaggaccagtggcaactgtttccgatccggctgaactctcctgaccatggtggccacgccgaggtgcgggtccgcggggtgctctggaggggtgcgcgctgctcgcgag

SEQ ID NO: 28292 - DNA, 30 bp, Homo sapiens
  misc_feature 1..30: note = chr3:116583135-116583165
  misc_feature 1..30: note = hyper
  source 1..30: mol_type = genomic DNA
tgcatggtcagcagacgcacaaacacgctg

SEQ ID NO: 28293 - DNA, 95 bp, Homo sapiens
  misc_feature 1..95: note = chr3:117715557-117715652
  misc_feature 1..95: note = hyper
  source 1..95: mol_type = genomic DNA
tcagcaccggggacacggggatagcgaacaccaccgcggctcttggagtttacagaggagcaaccccagctccgtcgccaccacctcgcgcaaaa

SEQ ID NO: 28294 - DNA, 352 bp, Homo sapiens
  misc_feature 1..352: note = chr3:117715772-117716124
  misc_feature 1..352: note = hyper
  source 1..352: mol_type = genomic DNA
acacacacacacacacacacacaagccctggcttctttccccatcaacaccgatgttgcagcaagtctgtccgcacaatcccgcacgcctcaggacccagcctgggcgcagagctggcagggcagggagcgcaccgcaggacttgtaaataaaccctgttccatccagaaccggagcgcttcttactccaccgaccaccccggagcccggcggcagggaggagggggcgcaaggggtcagggaatcctccccctaccttgcaatgagaagagggacaggaaaaagcccagcacccagacgctgtgcagccagtaggtcctcatgtctccgctgcgctcgatgctccctcgcg

SEQ ID NO: 28295 - DNA, 99 bp, Homo sapiens; identical to SEQ ID NO: 2246
  misc_feature 1..99: note = chr3:117716213-117716312
  misc_feature 1..99: note = hyper
  source 1..99: mol_type = genomic DNA

SEQ ID NO: 28296 - DNA, 394 bp, Homo sapiens
  misc_feature 1..394: note = chr3:117716313-117716707
  misc_feature 1..394: note = hyper
  source 1..394: mol_type = genomic DNA
ctcgtagcccgtgcctggtgtaaacacaccgagcccccttgtccctcgagctctcccgctttcctgcttcctatcctcctctccctcactcccctgcagcttcaactaaatgcgatgtacttaaacaagcagcgccttataggaccgcgaaccgagccgaaagggccccgctactgccatctagtgctcacagaacggcatcgccgcggctcttcttcgctgtgtgtctgtgccaagtctatccaacgccgccaaagtcccctctgctctcagcaaacacaggtgaagctcttgccttcttaaatccttgacttgaccttgctgtcccataagtcctgaatttctccttttcacgaggaagctcttggaacatgctagccgcacatcttcatca

SEQ ID NO: 28297 - DNA, 30 bp, Homo sapiens
  misc_feature 1..30: note = chr3:119298886-119298916
  misc_feature 1..30: note = hyper
  source 1..30: mol_type = genomic DNA
tacgagaatgtgacccgtgaaagttcagag

SEQ ID NO: 28298 - DNA, 59 bp, Homo sapiens
  misc_feature 1..59: note = chr3:119421863-119421922
  misc_feature 1..59: note = hyper
  source 1..59: mol_type = genomic DNA
cggccgttaccatagcgacgtgcacgcagtagccaggcctgacccgctggtcccttgct

SEQ ID NO: 28299 - DNA, 206 bp, Homo sapiens
  misc_feature 1..206: note = chr3:120003742-120003948
  misc_feature 1..206: note = hyper
  source 1..206: mol_type = genomic DNA
tgagagtttctttaccggttccaaacaaactgcccagattctggaaagggagagaaagcccctccccctttccactttcacttaataattaagtgtttgaagttttgtggatccttaaggtcgctgtgctcacctcatcagcgtcggaccgccgagaagcgccaagcccgctgctatgtgcaggacgcccacggtcccccggcgtc

SEQ ID NO: 28300 - DNA, 50 bp, Homo sapiens
  misc_feature 1..50: note = chr3:120004161-120004211
  misc_feature 1..50: note = hyper
  source 1..50: mol_type = genomic DNA
tcgaccctgctctcccgcgagggccgggagggctccgggaccttgcagac

SEQ ID NO: 28301 - DNA, 319 bp, Homo sapiens
  misc_feature 1..319: note = chr3:120169658-120169977
  misc_feature 1..319: note = hyper
  source 1..319: mol_type = genomic DNA
cgggtcccgcaggctcgctccggccgcccaagcacccccggccgcccgaagagtccggcctccgcgccgtgcgccctgcgctcaccgtggtctggtccaggtctcctgggggcgcggggcaggacggcggcagcgagctgtaagcggaggtgggagctccgccgatcgccagcctcggaggaaatgcgacctcccctcgccgccccttaagacctctccttccccgcctgcctgcccccccagctcctccccattctcctcccccttctgctgcagcggcccccgcggctcccgctccccctccttccgacccctgctc

SEQ ID NO: 28302 - DNA, 144 bp, Homo sapiens
  misc_feature 1..144: note = chr3:120170066-120170210
  misc_feature 1..144: note = hyper
  source 1..144: mol_type = genomic DNA
cggaggcagagggggtgtcccgtgggtccctgccacaaaggggtagggggaagggaaaccccaccccgggaggggctgctggctggcggcggcccgggcgggctgcggcggtggccaggtgggcggtgccgtggggggcccggg

SEQ ID NO: 28303 - DNA, 30 bp, Homo sapiens
  misc_feature 1..30: note = chr3:120627043-120627073
  misc_feature 1..30: note = hyper
  source 1..30: mol_type = genomic DNA
tggagcctgactgctcggttaggacctcgg

SEQ ID NO: 28304 - DNA, 682 bp, Homo sapiens
  misc_feature 1..682: note = chr3:120627329-120628011
  misc_feature 1..682: note = hyper
  source 1..682: mol_type = genomic DNA
gagcgagcgcaccagcgcgcgaatgcccgtgtgagggtgtttgtgtgtgttctggctgggagcgcgaatgcctcggcgtgaggtgtttgtgtgttcgcgcgcccgcgggcgggcgagagccccgcgcctcagcgctgggcctgggggagggacagcgggagcggcggctctgcgcgcccagcaggctgaggcgggactcgggccgcagccgtcgccgccaccgcttcacgtcccccgagagcggctgccgtgcagcggggagagcggacggcgggcgggcgaacaggcgggagagcgcggcggcggctgcgggcagaggtggagggaggggagcaggagatggggagaggggggaaagaggacgcggggagggagatgagggggaggtgagggggaggcggagggacaagtggaaacagacggtgtcgccgttctcctcctccccccctccccggcagctgttgctgtgggtcactcgcagatgttttggggtccgggctgctgggggatggggactagaaaaagtacccccctccccgcctttcatagtgacaaaaaaggaagcgttgaagctgatgggggaagagcccggaaggtggtggcagagtaaataccggctcccccaacgtcgtttttctgaaaataaaatactctgagccgaacgtttcgaagaaggaaagtc

SEQ ID NO: 28305 - DNA, 30 bp, Homo sapiens
  misc_feature 1..30: note = chr3:120628354-120628384
  misc_feature 1..30: note = hyper
  source 1..30: mol_type = genomic DNA
caaggtctaattgcacgtgttaagtcacct

SEQ ID NO: 28306 - DNA, 223 bp, Homo sapiens
  misc_feature 1..223: note = chr3:121902727-121902950
  misc_feature 1..223: note = hyper
  source 1..223: mol_type = genomic DNA
aaattgtgccaccctcggcacagagaacgttggtggcgtcgtaagcgccctaagcttctttccatcgccaaggagtaggggtcagggaagaggacagcgggaacaggatttgagagccgggaacccctggctcggcacgggagagggcaggagaggacctaagcgcggggctcgccgtctgctggggacccgagccggcctgtggccctcggggaaccgaaga

SEQ ID NO: 28307 - DNA, 229 bp, Homo sapiens; identical to SEQ ID NO: 309
  misc_feature 1..229: note = chr3:121902990-121903219
  misc_feature 1..229: note = hyper
  source 1..229: mol_type = genomic DNA

SEQ ID NO: 28308 - DNA, 335 bp, Homo sapiens
  misc_feature 1..335: note = chr3:121903323-121903658
  misc_feature 1..335: note = hyper
  source 1..335: mol_type = genomic DNA
cggccgaggggccggagctgcctctgtgcgagggagccctggccgcggcgcaggtaggaccggggaacccaaggagggcgggaggaaagcgcccctggtgggggaggggccgtggcggggtctgggggccaagggctccgggccgaacgaggggcacacgccggagcagctccagcctgggagcattgggcgtgaacgtgggggaaagtagggaccagattacaggatcaaggctttccccggctcagaactggattgttcagtgcccctagaaggggcagcgggtcgcccacgcgaatgaacgggagcgcgcaccaaaacgcctgctgttggta

SEQ ID NO: 28309 - DNA, 45 bp, Homo sapiens; identical to SEQ ID NO: 6949
  misc_feature 1..45: note = chr3:122296693-122296738
  misc_feature 1..45: note = hyper
  source 1..45: mol_type = genomic DNA

SEQ ID NO: 28310 - DNA, 33 bp, Homo sapiens
  misc_feature 1..33: note = chr3:122745310-122745343
  misc_feature 1..33: note = hyper
  source 1..33: mol_type = genomic DNA
aggagggggccagaacggcgctgcaggtgatcc

SEQ ID NO: 28311 - DNA, 47 bp, Homo sapiens
  misc_feature 1..47: note = chr3:122745601-122745648
  misc_feature 1..47: note = hyper
  source 1..47: mol_type = genomic DNA
atgagaaacataaatcgggaaatcgccgctcgcgtccctgcttccag

SEQ ID NO: 28312 - DNA, 224 bp, Homo sapiens
  misc_feature 1..224: note = chr3:122745957-122746181
  misc_feature 1..224: note = hyper
  source 1..224: mol_type = genomic DNA
tccctcagcctcactcgtccgtctccttctccaggcctgggtcccgggtccccatcgccgctgcagcccagatgcgccgaccacagccctggcagggcccagtgcaacccggacccaagctggctggcggcgggaacgcagcagcgatgagggctctcaagccgaggtggcagcgggaggcgcggaagccaggggaccccctgtcctcccgcccgcagcctcac

SEQ ID NO: 28313 - DNA, 32 bp, Homo sapiens
  misc_feature 1..32: note = chr3:123166974-123167006
  misc_feature 1..32: note = hyper
  source 1..32: mol_type = genomic DNA
ccgagccgccgccgccgcccgcagggggcgcc

SEQ ID NO: 28314 - DNA, 687 bp, Homo sapiens
  misc_feature 1..687: note = chr3:123167300-123167987
  misc_feature 1..687: note = hyper
  source 1..687: mol_type = genomic DNA
gcagagcggtgttcggggcctccccggggcgccggcgccgcagtcttctgcgccgcgtagcccggggggctcacgcttttggagccggacatccccccctcggcctcgtcgtctccttcctcctcccccggaagccgggccgggggtctccaaggggagggcggacggccgagcagggggaccaggctagggtcacacgtcgggggcggcccggggccctgcgctgcagcggggcatcttggcacccccgtcctgagcggaggaggagggcacagccccgaggtgagaagtagctgaggatccgcgtcagaagtcccaggtccgaaatggagttgcctccgaggtggggtcgcagggactggtctggctgctgctgcgccgcacgcggagagacgtccgggatcctggctcgcgtcgagctcgacgagggccggagttgcggacgagacgggacggagtggtgtccttgcgggcggtgcctcctcgggccggcagtgcccgggcgcggcgctcgctgattccgcctaagcggagcccagctgctctcggggctcggcggcggcgagggcggctcggcgggggtcccggcgaagagacactgcgggtgcgctttcctcgcagcggactgggagcgactgggaggtgcgggcgccagccagcattattttcttacgaggggtggggagg

SEQ ID NO: 28315 - DNA, 27 bp, Homo sapiens
  misc_feature 1..27: note = chr3:123168541-123168568
  misc_feature 1..27: note = hyper
  source 1..27: mol_type = genomic DNA
gcgccatgcacgcttcgggccctgcgc

SEQ ID NO: 28316 - DNA, 241 bp, Homo sapiens
  misc_feature 1..241: note = chr3:123168581-123168822
  misc_feature 1..241: note = hyper
  source 1..241: mol_type = genomic DNA
cgcgccgctcctcccttctcgcccgctcgccgccgccggagagccctccgcatcccctcctcccgctgcctccccgccccccgcgccgcccgggcctcggctcacagccgcgcgaggccgcctccgcccccggcctggccatggccccagcctcggcgccccgcgggcatcctcaggcctggccgcgggcaccccagttccccttcctcacctaaaattctcgctgcgcccctccctccct

SEQ ID NO: 28317 - DNA, 330 bp, Homo sapiens
  misc_feature 1..330: note = chr3:123602641-123602971
  misc_feature 1..330: note = hyper
  source 1..330: mol_type = genomic DNA
cccgccctaccttcccggaatcacatttgggctggaaggaccttcacgtggcacccccttcccagaggccgtcaccgagtcctctagcgagggtctgggagctgggagaagggtccgcttctcctccgcccctcaaatcaaaggcacccccttcggatgattcctagaaaggcaatcgcatcagtgtccccaagcacttcatctccccaaaagaaaactcgtgcagcctggcgtcactggggtcgtctccttacgcccctgactcctcgccgcaccccggggcccctctccattaggggagtcgggaggcacagacggtgggggtcccag

SEQ ID NO: 28318 - DNA, 327 bp, Homo sapiens
  misc_feature 1..327: note = chr3:123603226-123603553
  misc_feature 1..327: note = hyper
  source 1..327: mol_type = genomic DNA
cgggggtgagcgaaccggcgagagagagagcaagtgggagagcggagagcggacgcgcgctgaggagagcgagtgagagcgcggcgctacggggtcaggactcaaaccacccgctccagcccccatgcactgatttgcatgacatttgcatagcgctcggggagtggacctgctgcccttcccgccacgcccacccgccttctgcctcggagtccggagcggagaatccgcagccaaacctagcgccagacccgggcccccctcgcacttatcctgcaccgccccagttaactcctcgcaggcggcggtcagcgggctggtactgtc

SEQ ID NO: 28319 - DNA, 69 bp, Homo sapiens
  misc_feature 1..69: note = chr3:123752431-123752500
  misc_feature 1..69: note = hyper
  source 1..69: mol_type = genomic DNA
agccccgccgcccaacgcccgccctcgaagctccgcggccgccagctctgcggccgcagcagctgcgcc

SEQ ID NO: 28320 - DNA, 50 bp, Homo sapiens
  misc_feature 1..50: note = chr3:123752973-123753023
  misc_feature 1..50: note = hyper
  source 1..50: mol_type = genomic DNA
cactttgcagcgcgccgctccggctaccggcgtcccggcccctcccttgg

SEQ ID NO: 28321 - DNA, 139 bp, Homo sapiens
  misc_feature 1..139: note = chr3:124606603-124606742
  misc_feature 1..139: note = hyper
  source 1..139: mol_type = genomic DNA
gggtcgtgccggtaccgcctcatcctcccaaagcctcactgccggcggcctgagatgggacgtagacgcccgcgcgtggaaccgcaaagcgacttctggatgagcaagggagggcgtggtggggcgtggaggcacaagt

SEQ ID NO: 28322 - DNA, 51 bp, Homo sapiens
  misc_feature 1..51: note = chr3:124773881-124773932
  misc_feature 1..51: note = hyper
  source 1..51: mol_type = genomic DNA
ccatgcaaccccaaccgcgttcctttgcttttaagtcgaaccagtagagcg

SEQ ID NO: 28323 - DNA, 607 bp, Homo sapiens
  misc_feature 1..607: note = chr3:125898649-125899256
  misc_feature 1..607: note = hyper
  source 1..607: mol_type = genomic DNA
ctaggcaagtgcccgcggggcctgagctctcgatagcggggccccaggagccacgttgtggggtctgctatccggcctccctctgcacgcgcgaccgtccacttgagcgcagtggctggagctgggactccagcgcagcccctgagcgctcacgtcgacccctccaatcacaagaggccctcgtgccaggcccccagatttggccaatcagggaagacctttccctgtcacagaatggggtcgaggggcccaggaaacaggtagtccccagtcacaaatcatcgcgtcgccttcgctggtccctttctcttatcgagcctcagttttctcttccataagccgggccagcagtgcccaccccacaggttggcgccagctccgtaagggccctaccaccgcggccggccagatcctcggcgggccagtcctggcgctgcggtcatttagcctgatgacccctggccaggttcagcctcaattgctccaaagaactccggacccgtaccccgagcccggcgtcccagcggcgaagttgatgggccccgcaggagcccttgcggtgagaaccgagtcctggagcccctggagcccccggagcccccggagc

SEQ ID NO: 28324 - DNA, 68 bp, Homo sapiens
  misc_feature 1..68: note = chr3:125899498-125899566
  misc_feature 1..68: note = hyper
  source 1..68: mol_type = genomic DNA
tcagccgagtgggggcggcgctcaccggtggtgggactatggcgggagcgcagcgcaccctctccggg

SEQ ID NO: 28325 - DNA, 32 bp, Homo sapiens
  misc_feature 1..32: note = chr3:125931984-125932016
  misc_feature 1..32: note = hyper
  source 1..32: mol_type = genomic DNA
gccttctcgggcctccgcgtccgccctgcgcc

SEQ ID NO: 28326 - DNA, 296 bp, Homo sapiens
  misc_feature 1..296: note = chr3:125932252-125932548
  misc_feature 1..296: note = hyper
  source 1..296: mol_type = genomic DNA
cttttaactttttggcgtggagtgcgcgtcctgacgtgccccctgagctacagcttactgagctttactggcttcgccggacagccgtccccaggtggagagacagcgcgtcgcgcgctgcccgggccccgcagggcctggcgcctggggcccttgcgccgctttggggcgaggggatcacaccgcgggctcccggagcttagcgtcttccacgcggcgctgtgtgtcatccacgcagtgtgctctcgctgccgtgttcaggtcactgcgagggtgagccccgctttatctacccc

SEQ ID NO: 28327 - DNA, 178 bp, Homo sapiens
  misc_feature 1..178: note = chr3:125986552-125986730
  misc_feature 1..178: note = hyper
  source 1..178: mol_type = genomic DNA
gctccatttaccctccgcggagggcgctgtgcggcggcacttaagcggcagcttcctctctcccaggcggcctttgtggctgtggccgggacagggaaaagctgcccaggccaagagggcgggggcgtcaggggcagccagcgccgcctttgcgcaactgaagcggatgaagccgcct

SEQ ID NO: 28328 - DNA, 60 bp, Homo sapiens
  misc_feature 1..60: note = chr3:126075183-126075243
  misc_feature 1..60: note = hyper
  source 1..60: mol_type = genomic DNA
gtcacctccgagggccgtgggagaaaacagcccctctgtgccctccgtgagaggggggtt

SEQ ID NO: 28329 - DNA, 125 bp, Homo sapiens
  misc_feature 1..125: note = chr3:126113532-126113657
  misc_feature 1..125: note = hyper
  source 1..125: mol_type = genomic DNA
tcagaggaagaaacccgcgttcaccaggcccaggcctgggccaggcgctgtcctggcggcgtcagggaggacatcgtgcccagagctcggacccagcagcccggccccgcgccctccctgtcccg

SEQ ID NO: 28330 - DNA, 116 bp, Homo sapiens
  misc_feature 1..116: note = chr3:126113794-126113910
  misc_feature 1..116: note = hyper
  source 1..116: mol_type = genomic DNA
cggagcgagccggggcagtcggggtcggtgggtgcgctcgcggtccggggagagggggcgcgcggggtccgtgagggcgcgtgggggcggcggcaggggtgcgaaaccagggcccg

SEQ ID NO: 28331 - DNA, 66 bp, Homo sapiens
  misc_feature 1..66: note = chr3:126242937-126243003
  misc_feature 1..66: note = hyper
  source 1..66: mol_type = genomic DNA
gtgagggtgggggcacgaaaagaggagcgggcttgcggccccaccgtgtcccgcctcctcagtccc

SEQ ID NO: 28332 - DNA, 38 bp, Homo sapiens
  misc_feature 1..38: note = chr3:126243423-126243461
  misc_feature 1..38: note = hyper
  source 1..38: mol_type = genomic DNA
cagaaaggctctagacgcccccgcgagcaaaggctctt

SEQ ID NO: 28333 - DNA, 46 bp, Homo sapiens
  misc_feature 1..46: note = chr3:126373487-126373533
  misc_feature 1..46: note = hyper
  source 1..46: mol_type = genomic DNA
cccgggacccgcgggcgccccggcccggacccgccctgccccgggt

SEQ ID NO: 28334 - DNA, 72 bp, Homo sapiens
  misc_feature 1..72: note = chr3:126373752-126373824
  misc_feature 1..72: note = hyper
  source 1..72: mol_type = genomic DNA
ccctcggacatggcccgagcggcggttgggggcatcgcccgcctttcccggcccgggcgactgcggcggcga

SEQ ID NO: 28335 - DNA, 80 bp, Homo sapiens
  misc_feature 1..80: note = chr3:126854425-126854505
  misc_feature 1..80: note = hyper
  source 1..80: mol_type = genomic DNA
tatcgcgcggacggtcgctcttcttcacgtaattggagaaacttttcccattacccgctgtctctgcgaggcggctctcc

SEQ ID NO: 28336 - DNA, 291 bp, Homo sapiens
  misc_feature 1..291: note = chr3:126854536-126854827
  misc_feature 1..291: note = hyper
  source 1..291: mol_type = genomic DNA
cgtcacgcgggttcttttcctcctccttaagaggctgacctaatttccactctttgtcattttctcccgaccaaactcggagtcggctttctccaggagctgctaggagcctgggctcccactgagcaatccagagcagcgtctccatttcctgggctctccaggccatcgcagcccccggccctgccacgcaccggcgcagcccctgcactcgggcggccctgcctcggcgggatgagttcgtccgaggtgcatacaagatgagaaacagagcgccgggttgcagtgcca

SEQ ID NO: 28337 - DNA, 38 bp, Homo sapiens
  misc_feature 1..38: note = chr3:127176205-127176243
  misc_feature 1..38: note = hyper
  source 1..38: mol_type = genomic DNA
ccgggctctggaagccgagctgccgaggcgtaagctgg

SEQ ID NO: 28338 - DNA, 251 bp, Homo sapiens
  misc_feature 1..251: note = chr3:127347860-127348111
  misc_feature 1..251: note = hyper
  source 1..251: mol_type = genomic DNA
ggacgggcggagggacggccgcccgcgcgtccgcttcgtctccgcgggggcgcgcccgcggcacgcggccgggcggggccgggcgtgagtgacggccatgcggaccaatggggcgggcgcgcgccgccgccgccgcccgcgcggcccctgacgcgggcccgggcgccgcgccgctgcggctgcaggcggcgacggctacaccatgggccggctgctgcgggccgcccggctgccgccgctgctttcgccgc

SEQ ID NO: 28339 - DNA, 39 bp, Homo sapiens
  misc_feature 1..39: note = chr3:127633909-127633948
  misc_feature 1..39: note = hyper
  source 1..39: mol_type = genomic DNA
agtgtaaaagactaacgggaacaccggcatttttcaaag

SEQ ID NO: 28340 - DNA, 30 bp, Homo sapiens
  misc_feature 1..30: note = chr3:127634282-127634312
  misc_feature 1..30: note = hyper
  source 1..30: mol_type = genomic DNA
gacctctatttatatcgcccagccagcaca

SEQ ID NO: 28341 - DNA, 428 bp, Homo sapiens
  misc_feature 1..428: note = chr3:127794432-127794860
  misc_feature 1..428: note = hyper
  source 1..428: mol_type = genomic DNA
gaagtcgcgcactttcgtcgcgacttcccaagtcgtgctgggtgtgacttggaatctcggatccctgggctaggcctggccacgcccccatggggggaggggcagcgcggcgggggcggagcctgggcccgaaacgccacgggcgcgactctgtgcgcgtccgcccacacgggggcgctgtgtcctcgcaagctcccgcggggtgcctcgcggccctggaacgctgtggttttcgaggggaaaagtgagagtggctggtcctgcctccgctgccgcttggccctgagatccccactgcccacgggataggccccagtccacccagccggggccccccccttcccctcgtctcgctctccttggcagttcggacttcgggtcagtcccacactcgcgcccggctgtccctgctgcgctcctgtcactgg

SEQ ID NO: 28342 - DNA, 15 bp, Homo sapiens
  misc_feature 1..15: note = chr3:127795148-127795163
  misc_feature 1..15: note = hyper
  source 1..15: mol_type = genomic DNA
cccaacagcatgacc

SEQ ID NO: 28343 - DNA, 128 bp, Homo sapiens
  misc_feature 1..128: note = chr3:128202349-128202477
  misc_feature 1..128: note = hyper
  source 1..128: mol_type = genomic DNA
cggggagggctgagccacaaggaaaagtacttcatggccctatttttaaaaaagagctaagcagaggccagaggacaggagtccggcccgtggacactcaacttcggggatcccggagcagagtgggg

SEQ ID NO: 28344 - DNA, 283 bp, Homo sapiens
  misc_feature 1..283: note = chr3:128205402-128205685
  misc_feature 1..283: note = hyper
  source 1..283: mol_type = genomic DNA
tagaaggaaccccaccggacagaccctacagggaaccctcacaggccagctggaagtgggcagaaaccctgtgggtcccagaccctccccaatcggccgctgctcccacctctcccgccccaatttttcagcagctcgattcctgcggatcctacatccgggaagcaagcagacgggccctcctcccctccctcgcctggcgcgcggcgcctgggttctcatcaccacgggcccagtgctcaccgtgcgcggggctgtaggagacgcgcgcccgcgcgtgagc

SEQ ID NO: 28345 - DNA, 98 bp, Homo sapiens
  misc_feature 1..98: note = chr3:128206332-128206430
  misc_feature 1..98: note = hyper
  source 1..98: mol_type = genomic DNA
cacacccacacttggcgccagatacacatactgatctcaaccccgaaaacatgcacacgcagccccctgagcgcagtactaagcggcacaatcaggac

SEQ ID NO: 28346 - DNA, 200 bp, Homo sapiens
  misc_feature 1..200: note = chr3:128207015-128207215
  misc_feature 1..200: note = hyper
  source 1..200: mol_type = genomic DNA
ctcttgcgaacactccgggatccctcgatgctctgggcctccctagcagtaactaaccaccaactgccccctccccaggagcccgggccgcacaccctctggatggcctctccccgagaccctaaccccgccacgctccttcaccgctgaacgtggtcagtccgagcgcagttacctacccagaccgttccctcccctag

SEQ ID NO: 28347 - DNA, 120 bp, Homo sapiens
  misc_feature 1..120: note = chr3:128207713-128207833
  misc_feature 1..120: note = hyper
  source 1..120: mol_type = genomic DNA
ggggagacggaggctcgaagggagccccgggccgaggagggaggtccaggacaaaggcattttgggggacctagacaggtgccgagtactggggggactcaacagcgtcctccagccctc

SEQ ID NO: 28348 - DNA, 552 bp, Homo sapiens
  misc_feature 1..552: note = chr3:128208053-128208605
  misc_feature 1..552: note = hyper
  source 1..552: mol_type = genomic DNA
aactttttaataatccgaggagggaggaaagccctcggtcccctcggctccgggggcgcccggctgggcccagctccgcgggcgcgcccccgtcaccccctcccaggccagttcagggcagcgccaaggggccgcgggctcaggctgaggcctcctcctgcctaggcgtctggcgtccgtttgtctgtccgaggcctcagcgcaggtaaagcgcggggctggggggcgcagagctccattgggctgggaaccagcgcgtctcgtgcccttgggggacccgcctgcccgagccgcctgctaagcctcccgctcccctccacgctggagcgcgcggagcccggtctgctcggaactccactctgcgggagcggaggccggcgccagcccgggaagccgcgcagggggcgggaggccgagcgcgaggcccttggcgccgggcctccgcggccaggccgggcaggtgagcagtctccgtgcctcccggttggcgttcccctcaacgcgtgcggtcccgccggggcccactgtctctccgtccgtctgtctctcaac

SEQ ID NO: 28349 - DNA, 397 bp, Homo sapiens
  misc_feature 1..397: note = chr3:128208949-128209346
  misc_feature 1..397: note = hyper
  source 1..397: mol_type = genomic DNA
taccctccccctccccgttccgtgtgtattcccagtttcagcgcagcgagctcggcgtctaacccctccgcggcagggtcccggccactgcggtagtggaggtggccagcctggctgagtcccctgcccaaacgtcagccctgtgctgccgcctgcctgacgcagagcggagcgagggaggggatttaattaccccgctcggcagctcagaaaatcgccgcacagaggggcttagcaggacggttaaggagtgcttgagcaggggcctcgggagacccgaaccagcctccttgcccgcaatccggtgtagaggaaaaaaaggaaacaggagttctgccaggtcctttcaggccttggggttgccttcctcgacaacgcaggcaggagccggcttgac

SEQ ID NO: 28350 - DNA, 220 bp, Homo sapiens; identical to SEQ ID NO: 2255
  misc_feature 1..220: note = chr3:128273832-128274052
  misc_feature 1..220: note = hyper
  source 1..220: mol_type = genomic DNA

SEQ ID NO: 28351 - DNA, 347 bp, Homo sapiens; identical to SEQ ID NO: 2256
  misc_feature 1..347: note = chr3:128274308-128274655
  misc_feature 1..347: note = hyper
  source 1..347: mol_type = genomic DNA

SEQ ID NO: 28352 - DNA, 41 bp, Homo sapiens
  misc_feature 1..41: note = chr3:128326970-128327011
  misc_feature 1..41: note = hyper
  source 1..41: mol_type = genomic DNA
cgcggggtaacagcccgttccggagccggtcatcaggcgcc

SEQ ID NO: 28353 - DNA, 37 bp, Homo sapiens
  misc_feature 1..37: note = chr3:128327483-128327520
  misc_feature 1..37: note = hyper
  source 1..37: mol_type = genomic DNA
gactttgttcagggccgagaaccggaggaggaggcca

SEQ ID NO: 28354 - DNA, 466 bp, Homo sapiens
  misc_feature 1..466: note = chr3:128417155-128417621
  misc_feature 1..466: note = hyper
  source 1..466: mol_type = genomic DNA
gcactcctgcgtgagcgacttccattcgggacggctcagccgcccgctaccgcagccttcccgcctgggtctcccacaggcctcccggggcacctagaactgcgtgcctcacgcgggccccgctgggctcctcacccgctcagccactgccacctgcctgggaccctccccctgcggagcgggatgtttggcggggagaaatgcggaggggaaccctaggctggcggctttcctccttccgcagaacccacggtcctgatctccggccgcctccttctgacccggggttctggccccctcctcccccaggacctcagcgcggcaccccacccaccaccccccgcccccaacccaggccagctgtctctttttcctcaggggtcgggctcccagcctctgccctccacaaccacccgcctgcctcaccagggcccagcctggcccctgggagcggccacagcgccga

SEQ ID NO: 28355 - DNA, 82 bp, Homo sapiens
  misc_feature 1..82: note = chr3:128720061-128720143
  misc_feature 1..82: note = hyper
  source 1..82: mol_type = genomic DNA
tcggagcgaactctccgcgccaggcgggcggggcggagggaggagggagttgagagtggacggccgggagtgggaggaaaag

SEQ ID NO: 28356 - DNA, 184 bp, Homo sapiens; identical to SEQ ID NO: 2257
  misc_feature 1..184: note = chr3:128720163-128720347
  misc_feature 1..184: note = hyper
  source 1..184: mol_type = genomic DNA

SEQ ID NO: 28357 - DNA, 116 bp, Homo sapiens; identical to SEQ ID NO: 2258
  misc_feature 1..116: note = chr3:128720418-128720534
  misc_feature 1..116: note = hyper
  source 1..116: mol_type = genomic DNA

SEQ ID NO: 28358 - DNA, 318 bp, Homo sapiens
  misc_feature 1..318: note = chr3:128720566-128720884
  misc_feature 1..318: note = hyper
  source 1..318: mol_type = genomic DNA
cgccctggcgcaccactacgggctggaccgcggcgtggagaacgagatcgtggtgctggccaccggcctggaccagtacctgcaggaggtcttccaccacctggactgccgcggcgccggccgtctgccccgcgccgacttccgagcgctctgcgctgtgctggggctgcgcgcggagggggccaccacggccgggcaggcagcaggtgacgggaactccagagatgtgacccccggggatgcggccgctgagttggccacggacggggactcagataccgatgaagaggcgcgcctggcgctgcgcgccgagccgcc

SEQ ID NO: 28359 - DNA, 430 bp, Homo sapiens; identical to SEQ ID NO: 2261
  misc_feature 1..430: note = chr3:128720885-128721315
  misc_feature 1..430: note = hyper
  source 1..430: mol_type = genomic DNA

SEQ ID NO: 28360 - DNA, 118 bp, Homo sapiens
  misc_feature 1..118: note = chr3:128764489-128764607
  misc_feature 1..118: note = hyper
  source 1..118: mol_type = genomic DNA
aactacaatttgctccggcggaagtgaggagcaggcctgggccctaagggccgggcctcgaccccccgcaggtccccgcggtcccggtcccccgcccgggacatctgatggaccgagc

SEQ ID NO: 28361 - skipped

SEQ ID NO: 28362 - DNA, 92 bp, Homo sapiens
  misc_feature 1..92: note = chr3:129324567-129324659
  misc_feature 1..92: note = hyper
  source 1..92: mol_type = genomic DNA
cgcctcgctgttgagcgccaggtacgcgtaggactgtgcacccggcggcgggtcggacgggtgcaggaaggcgctcacgaagcccagcttgt

SEQ ID NO: 28363 - DNA, 30 bp, Homo sapiens
  misc_feature 1..30: note = chr3:129324893-129324923
  misc_feature 1..30: note = hyper
  source 1..30: mol_type = genomic DNA
gcagaactagccccacggtggacgcgttcg

SEQ ID NO: 28364 - DNA, 30 bp, Homo sapiens
  misc_feature 1..30: note = chr3:129346534-129346564
  misc_feature 1..30: note = hyper
  source 1..30: mol_type = genomic DNA
cagtggctggaggggcgtgagagtgggaga

SEQ ID NO: 28365 - DNA, 129 bp, Homo sapiens
  misc_feature 1..129: note = chr3:129693071-129693200
  misc_feature 1..129: note = hyper
  source 1..129: mol_type = genomic DNA
ccccattctctctctctctctctttctctctctctctctcttgctctactctcgcccgtctgcgttctacattggttctgcggccgtgtccctttcgtgtgtgtctgccctgtgtttctccgtcgtctc

SEQ ID NO: 28366 - DNA, 195 bp, Homo sapiens; identical to SEQ ID NO: 312
  misc_feature 1..195: note = chr3:129693304-129693499
  misc_feature 1..195: note = hyper
  source 1..195: mol_type = genomic DNA

SEQ ID NO: 28367 - DNA, 345 bp, Homo sapiens
  misc_feature 1..345: note = chr3:129693954-129694299
  misc_feature 1..345: note = hyper
  source 1..345: mol_type = genomic DNA
ggacagagctgggtattcagggcgtcggcctgagaacctgggagttcgaatcccaatctcaacgctagaaatagaattttagcgttgaagttaggattttagcgttagaatcagattcctggcttagtcatgaaagcttagcattagaaatagaatcttagctttgcaaatagactttgagctttagaacctgaatcttagcgatagaaatgggatcttcgcgttggaatgaggacgtcggccacggagcttggagttagaacgtggcgatggggacctttgggggagtcttggcggggacgcaaccgttagcgtcgcggctgtgcctggcgctgcaatctcaat

SEQ ID NO: 28368 - DNA, 159 bp, Homo sapiens; identical to SEQ ID NO: 6976
  misc_feature 1..159: note = chr3:130064451-130064610
  misc_feature 1..159: note = hyper
  source 1..159: mol_type = genomic DNA

SEQ ID NO: 28369 - DNA, 47 bp, Homo sapiens
  misc_feature 1..47: note = chr3:130064780-130064827
  misc_feature 1..47: note = hyper
  source 1..47: mol_type = genomic DNA
cggtttccagggtccggagtgtcccctgaccccgggaaagctgggta

SEQ ID NO: 28370 - DNA, 45 bp, Homo sapiens
  misc_feature 1..45: note = chr3:130235542-130235587
  misc_feature 1..45: note = hyper
  source 1..45: mol_type = genomic DNA
tggaccttaatctcacggtcttcgttcccacggaaaagggaggag

SEQ ID NO: 28371 - DNA, 271 bp, Homo sapiens
  misc_feature 1..271: note = chr3:130235793-130236064
  misc_feature 1..271: note = hyper
  source 1..271: mol_type = genomic DNA
ctttcttttctcccacggtcgggaccttagggtaggagtttcaagaggggagaagccggtggagcagtaacagccttcataatgtctccagtcccgcttccgtcacctccctaaggctgcgcccccctcctgggggacgtgcgctgggcccggggccgccggggcggggaagggtcgggcccggggcggggagaagcgtttatatgtcggcgaggggcgtgggagctgccacccgcttgcctgcgggacaccggagtcaagaggctgccca

SEQ ID NO: 28372 - DNA, 15 bp, Homo sapiens
  misc_feature 1..15: note = chr3:130236173-130236188
  misc_feature 1..15: note = hyper
  source 1..15: mol_type = genomic DNA
cgtccagaggaaatc

SEQ ID NO: 28373 - DNA, 180 bp, Homo sapiens
  misc_feature 1..180: note = chr3:131752606-131752786
  misc_feature 1..180: note = hyper
  source 1..180: mol_type = genomic DNA
atggtaatcagcactcgcttgacttggcgtggaccacctcctaattatctccattggattcagccctaacagttctcgtgtgtctgtgataccacgcggggtcgtgatctccttactcagctgtggcttggtttcagtggtccctccagtcccgtcccctgtccccgtccccctttcctt

SEQ ID NO: 28374 - DNA, 86 bp, Homo sapiens
  misc_feature 1..86: note = chr3:131753975-131754061
  misc_feature 1..86: note = hyper
  source 1..86: mol_type = genomic DNA
cccaggccttggcggcggcgctctccgtggtcctgccgcgcccgcagtctgggctttctgctcagctttgtcgctcaactgagctc

SEQ ID NO: 28375 - DNA, 463 bp, Homo sapiens
  misc_feature 1..463: note = chr3:132757017-132757480
  misc_feature 1..463: note = hyper
  source 1..463: mol_type = genomic DNA
aacccccagagacatcggagcgggcgctgccgagggcaatttggtgattggctggtctcaccacgtgaccggcgctgagccttccgtgcgaccggattggctgtcgcggacgctgacggacaaggccggggcgggccagagcctggtcggaggggcgcgcgcgggggcccgaggggcgaaggcgcgagtgcgcgagagcgcgtgcgcgagcggtggggctttctcctgagccgtcggagggagccggagcgcttctcccgaggtaagcggcgctccggggcgtccccccagtccttcccatgctgggtcccggcaagcgggttaggctgggctgggcggggctcggggaggtgtggggtcagcttgccccgggagcccagcttcagggaggatgcagccccggttgccttggtttcccttttcctatcctctcaggcaccttcccatcctccccactgcgtga

SEQ ID NO: 28376 - DNA, 372 bp, Homo sapiens
  misc_feature 1..372: note = chr3:132757536-132757908
  misc_feature 1..372: note = hyper
  source 1..372: mol_type = genomic DNA
cgcctggagggttgctggcatgaaccccctccccaggtggagggtgcgggtgatggggcgcgggcgtcaggagcgctggacctgggctggggccgaggaggaggtggctttaatgcagggggacctgtcacatggggaaacgaagaagaagaaatgtagtgtcactttggccagcccgagggactcgaactaatcctgcggccgcgagcggagccgaattcctagcgcagctgtgcgaagagccctcctgcctaggtgccggcggcctcgccggggacggagcctccgtgctgcccgggaggttgctctgccggctggacctggcggttttcaccccagagttgcagcgaaattgaacgctttgagcctgct

SEQ ID NO: 28377 - DNA, 51 bp, Homo sapiens
  misc_feature 1..51: note = chr3:133613719-133613770
  misc_feature 1..51: note = hyper
  source 1..51: mol_type = genomic DNA
ctggacgtgccctttcgcatggttcccagcagggtccgcagggaacacccc

SEQ ID NO: 28378 - DNA, 62 bp, Homo sapiens
  misc_feature 1..62: note = chr3:133615071-133615133
  misc_feature 1..62: note = hyper
  source 1..62: mol_type = genomic DNA
cgaggcccgtcagggcggtcagacctagggaaacctggcgtacttggcgcagatggggctcg

SEQ ID NO: 28379 - DNA, 130 bp, Homo sapiens
  misc_feature 1..130: note = chr3:133646291-133646421
  misc_feature 1..130: note = hyper
  source 1..130: mol_type = genomic DNA
gagaggaagttttctcgaggctgtgtcccgtgagcaggcgccggtgggctcagccgccgggccctccgagtaggggaaggcgtgcgtgcgtgcgtgcggtgggcgcggggagccccgcaggcccgagggc

SEQ ID NO: 28380 - DNA, 34 bp, Homo sapiens
  misc_feature 1..34: note = chr3:133748071-133748105
  misc_feature 1..34: note = hyper
  source 1..34: mol_type = genomic DNA
caggacgagggggctcggacgagacacagtctgt

SEQ ID NO: 28381 - DNA, 127 bp, Homo sapiens
  misc_feature 1..127: note = chr3:134032405-134032532
  misc_feature 1..127: note = hyper
  source 1..127: mol_type = genomic DNA
cctctccttggagaacgccggcccgctctgtgccaccctctccccaagcccccggtacgtccgtctgtccgggtggaggacagggccccgagggccgcgaccaggagggactcgcaggaggcaccgg

SEQ ID NO: 28382 - DNA, 554 bp, Homo sapiens
  misc_feature 1..554: note = chr3:134125220-134125774
  misc_feature 1..554: note = hyper
  source 1..554: mol_type = genomic DNA
catctgcatttgaaacgggctcccggggctcttcaaggaggcgagcggccgctgcagggctcctctaggccagattacatcccagaacgcccaggcaggacgctccggctcagattgtgaaccctgggactctgcgtccaggaggggcccctaaaccctgcgctaaaagccagaggtccggggagcaggcggatgccctcagacttggctattttgcttaaggtcacctccaaacgggactggaataaaccctccttgtttgcctctcgccaggcctaagccccgggtccccttgggtgtcgtccaggacgccaggcgcggctgcttacaatggctctcagacgacagatggcgggcaggaagggagggggcgccgggcaggtgcgcgggggagacgcgccgcggcagcgccggacgccaggctgcagggtgaatagatttgcagcccgccggctgcaggcggcggccgccgagccctgcaaacaataagtgaattctccgaagcgactgaaaccccccgggctgggccacgcgccagccggggagggcggacc

SEQ ID NO: 28383 - DNA, 44 bp, Homo sapiens
  misc_feature 1..44: note = chr3:134369475-134369519
  misc_feature 1..44: note = hyper
  source 1..44: mol_type = genomic DNA
gttgccacgggactgcgcgttgccacgggacgccggtgccactg

SEQ ID NO: 28384 - DNA, 59 bp, Homo sapiens
  misc_feature 1..59: note = chr3:134369552-134369611
  misc_feature 1..59: note = hyper
  source 1..59: mol_type = genomic DNA
cgggttcgctgacctcgttcgggggagcaatgggcgccccccggcgggcaggcccttgt

SEQ ID NO: 28385 - DNA, 100 bp, Homo sapiens
  misc_feature 1..100: note = chr3:134369983-134370083
  misc_feature 1..100: note = hyper
  source 1..100: mol_type = genomic DNA
gcccgcctgggagggcgctaccctaatgaagcggctctaagtcacctttgaaaggaaatccccgggcccaagccttgacctgcaccggggccatagtcag

SEQ ID NO: 28386 - DNA, 524 bp, Homo sapiens
  misc_feature 1..524: note = chr3:134514264-134514788
  misc_feature 1..524: note = hyper
  source 1..524: mol_type = genomic DNA
gcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaaggtaacgtaccctccacggagcaagttggctgctggtgccggccgccttgggactgctgtgctccgcggttcgcggggttcctctggctgctttgcggtgcaggcatcccgggacccgagggcaaggaggtttgggagcctcggccgctgccgagcgcggggcttgggcggcacccaccagagcgcccccggctggctcttagcgcccgaaactggctcgcgagtcccccggcttcctcgccccggcactccctggta

SEQ ID NO: 28387 - DNA, 1194 bp, Homo sapiens
  misc_feature 1..1194: note = chr3:134515127-134516321
  misc_feature 1..1194: note = hyper
  source 1..1194: mol_type = genomic DNA
accagtctggtggtccgggcgcctgcgggactgcaggtttccagggtcagtcggggagaggtggaaacccttttcgcctcttgagccttggaacaggagtgggctggggtgagtggtcggtcctacctaaagtctcccagcctctccaccaccccggagaggatactcggcggccgggagtcgtcgggcagcgtcactctctgccagctcagacttggcggtgcctccggcttggtggctgggaaagcgcgctccaaagacaccgtgcccggcgcagcggggagcctgggcgctcggtagcgctcgcgaatccctgtgggaaatcccggcccagctccccgcctcccgccccttcccccgcctctgttcttcgcagcctagcagcggccgcggcagcctcctgggaacacagctccgcgggagagcggagttggagttgtcgggagaaaaccaactctaggggtgatgcgctgccgcagtccggctagcagccccactttccggtgtcctgctccggatggaactcctctgggggactccaagccggggaggagcagctcttggcgaccgcgcagcgttcccatctgggagctcgctccgcttgttactcgttcctcgcgaaactgtgaccggttgcccagtggaaactcccccaaacacgatggtttggtgccccccgccattccggaaagctctgcccttctggaagtgaagctggaggggcattccgggccctgaggcgcggctaagattcccttcccttttggcgaagaccaccgcatcccacgtttgttctggtggcggcgtgggggtgcggcgattaatgcctagaaagctctcgcttgcttttccgaaggtggctttttgtctgccctcagtctcctgcttccctcagggactgctgggctttgtagggaggggagcaaggaggggtttgctttttggaacgtgcaggagaagactggagccgtgtggagtgccgtcaacaccctggcgcagggatgcctgggtttgacttattgagagacacgtgtgggagcagttgaaattggaaattcaaggggatatatacccccaaaccgggcaggaaagccagggtgagcgcatttgcaagggcaattccagactggacttgcagcattggggtggcgtcatgcaggtccgaggctcggtccggcccgcggctctttgcgc

SEQ ID NO: 28388 - DNA, 548 bp, Homo sapiens
  misc_feature 1..548: note = chr3:136537631-136538179
  misc_feature 1..548: note = hyper
  source 1..548: mol_type = genomic DNA
gaaggaatagacttgcgacttttaagcgcaaacaatgggtggaaatggacagaaactgcctccgtgcccacttgcagcggactacgtagccctggcagacaggcaattgcttcaaacaagcgccctccaagggcgtaagctagaggggcccgggcgggcgctttcccgtggaccctcccacctcgcgggtagaggaagtccttcagttcaggcacaaccctgagcgtcccccgcagtctccaactccggcgccagtcaggttgtggggtgggggcggcggagggcggagagcgcaggcgcagagtccgcgcggcggcgcccctctccctccgcagtactccgggcagcgcccgcctcgattttcccaggcgagggcacgcccgcgtcagtcgcctccggggcaccttcctcgccacgacacgcaggtaaccgggccccgggagccggtcggcggcggcggactgggaccttgatcctgcctgcccggccgcccgacaagggaatgagagcggaccccgaactccacacacccgcgtttagccgccaca

SEQ ID NO: 28389 - DNA, 103 bp, Homo sapiens
  misc_feature 1..103: note = chr3:136538621-136538724
  misc_feature 1..103: note = hyper
  source 1..103: mol_type = genomic DNA
attttcgtggtacatcgacggtttgtagacatcttttcccaagggaagacgagggcaagggttagtggaggaagggcctcgtcacggccgagagtggcggaga

SEQ ID NO: 28390 - DNA, 188 bp, Homo sapiens
  misc_feature 1..188: note = chr3:136751561-136751749
  misc_feature 1..188: note = hyper
  source 1..188: mol_type = genomic DNA
gcagggcactttcttcgggaaggactcctgggagctcaggagtttgcatacgaagccgagggagcgaggggcttctgataatgatattcagcgtcgaacagagtcgctcatatgcagagccggagtctctcccagctttgatatatgagattattatggagagtaatgcaggccgagtgatgcttgct

SEQ ID NO: 28391 - DNA, 172 bp, Homo sapiens
  misc_feature 1..172: note = chr3:137479130-137479302
  misc_feature 1..172: note = hyper
  source 1..172: mol_type = genomic DNA
cttgggggggtgggccggattaactgtcttgtctctaaacacctgggtgcgctggcgctcactctcagctgcgagctgaagcccacgctgctctcaggcttcccgcaacaggcacctgcgacttcgctcaccaaaatcttccagtggccacagtgagcgggcaggactggtg

SEQ ID NO: 28392 - DNA, 231 bp, Homo sapiens
  misc_feature 1..231: note = chr3:137479510-137479741
  misc_feature 1..231: note = hyper
  source 1..231: mol_type = genomic DNA
cagagaggagggggccggagggtggggcggagccttgtggcaaggcaggtgggtgcaggcctctggggccccagactgccgcgtctggctctaccaggctgtgtctcgggccccgtgcctgcagctgcaaggcggggaaagacctatcgggaagatccacctcggcctgggcagaaggaaactttactgagagtcttctctgagtttggaattatgcggaaattgaaccca

SEQ ID NO: 28393 - DNA, 742 bp, Homo sapiens
  misc_feature 1..742: note = chr3:137479943-137480685
  misc_feature 1..742: note = hyper
  source 1..742: mol_type = genomic DNA
tacgcgcaggagctgcgtgaaaggagaggcccagagccagaaaagaggaaggcgcatcctggacgctctgcgccctggagggagacgaaaggcccggagagaagcagattaggtcggtgcccttagaggcctcttccttcacttccgggaaacagcggcggttccctgacaaaatccctgttgctcgggggttcggacgccttgctaaggctggcacgcagcggaccttgagtagctgcgctgtgtactgaacgtgtgcacagcttctccaggcaaatgtgcaagcggaaagacctcatccaagcgttatctccagccctggaggagaatgaactggtagcctggggccaaacttcaggccgtggacaaagcaggaggagtatttaggcaacctctgtcctaatgcttgttctggttgtgaccgaagttgctgactctcctcaggggtcacgtctccaggacgtgctacccggtggtttagacccgtcagggaggcacagcgtgaagggacagcgcagcgcagtagaggcacctgctggagacagcaccaggccagaccccaggatcacgggaactcctgctcccgccacagctctaaagagtgttgaataaaccggtggtcaccggtactgcgtaaggggtgtgcgtggctttgcagttcgcctaggagacaagctgatgcacggcctggaaggtgcagccctcatccctgcgttccctccccgcgcggagttcctgtctc

SEQ ID NO: 28394 - DNA, 177 bp, Homo sapiens
  misc_feature 1..177: note = chr3:137481170-137481347
  misc_feature 1..177: note = hyper
  source 1..177: mol_type = genomic DNA
attccttcccaaagccgtcgggatcgcccagtagaattagaattgggtgattcctgaatctcctatccctggctggctctgaatatagcgcaccgctggtcagacctgagtaggggttgccagcgacgctcggaaaccctttccagactgggctgaaaagtgcgtttgcttcctgag

SEQ ID NO: 28395 - DNA, 99 bp, Homo sapiens
  misc_feature 1..99: note = chr3:137481774-137481873
  misc_feature 1..99: note = hyper
  source 1..99: mol_type = genomic DNA
gggtgagaagttccacgcgtctttctaattttaggaaggggaagcaaagtcttctcctcaaacttgatacactacatgctagagaaagatcctcccttc

SEQ ID NO: 28396 - DNA, 214 bp, Homo sapiens
  misc_feature 1..214: note = chr3:137481935-137482149
  misc_feature 1..214: note = hyper
  source 1..214: mol_type = genomic DNA
cgcgtttctggccggtcctcccaagagagaatggtgcaaaagccaataagcctggaacacacgcaggtcccgccgggcctgggacaatggtttccatttaataaatatttcccccaagggcatttcacatcgggcaggcaattattcaaaggaaacaggcgcgcaggttggctctgcgggttatttcgtcctctttacccgaagaatgctcatt

SEQ ID NO: 28397 - DNA, 30 bp, Homo sapiens
  misc_feature 1..30: note = chr3:137483214-137483244
  misc_feature 1..30: note = hyper
  source 1..30: mol_type = genomic DNA
agccacgactggaaacgcaagaggagagaa

SEQ ID NO: 28398 - DNA, 30 bp, Homo sapiens
  misc_feature 1..30: note = chr3:137483668-137483698
  misc_feature 1..30: note = hyper
  source 1..30: mol_type = genomic DNA
ttcatggtatggtcccggggccagcggcgc

SEQ ID NO: 28399 - DNA, 106 bp, Homo sapiens
  misc_feature 1..106: note = chr3:137483910-137484016
  misc_feature 1..106: note = hyper
  source 1..106: mol_type = genomic DNA
cttgccctacctgggcgacacggacccgctcaaggcggctggcctgcccgtgggggcctccgacggcctcctgagcgcgcccgagaaagcccgggccttcttgccg

SEQ ID NO: 28400 - DNA, 463 bp, Homo sapiens
  misc_feature 1..463: note = chr3:137484225-137484688
  misc_feature 1..463: note = hyper
  source 1..463: mol_type = genomic DNA
gccctgtaactgtaccgcctggtctgcctccaccctgcagccccccgtcgcctacatcctcttcccaggcatgaccaagactggcatagacccttattcgtcagcccacgctacggccatgtaacccccagcccggcccggacctgaggcgtggtctgaaagccgggtctgcaccctgtcctctgagcctagccccggcctgcagacgcctccggggtcagccctgccgctgtcccttacaccacccagacttttcctctctcttccagggggaagggtggggcgtcctcccggacccaaggcgcagacaggtaccggaaacttgcaaacgttatgtcagctacacagctgcccctatcccgactctcccaaaacaaatctccgactgtaccccctttggacaaaaaagtaggcagttttgctttatttatatccccttcactctcctcggataggctttgga

SEQ ID NO: 28401 - DNA, 548 bp, Homo sapiens
  misc_feature 1..548: note = chr3:137485061-137485609
  misc_feature 1..548: note = hyper
  source 1..548: mol_type = genomic DNA
tcataaatgttttgacgatgtcttggaaatgtacctagaaggattttacctcgttgctctgttcatttgttgaacaaagacgttttgaataaagacaatctgtcattgtaaaaaagtaacctttgatgtgcctaaaatctgaagtcaggagccaggttggagggactggaaagtcgggtgcggggaggctgaaagtgcatagagcgactttaagcagtgatggctggtggctgccccccgttggcccagcttggtggtctgcgggttgggtgtagaagggcctagagcttcggatccgtccggaatgcgccctggagattgctttttgcctttagaggctagacaaaggtatcgttccctgggacttcactctctcctcccattcttcccaaaagggtcaggccacttcaaggaatgaatgaactaagtcaaaggccgacccagaccgctgagatctgggtgagtttactttttaaaaaaccaaacgctgaaggagcagggagaagcaccgagtctcctgggaaccagttgcgcgctgaacaccccgt

SEQ ID NO: 28402 - DNA, 373 bp, Homo sapiens; identical to SEQ ID NO: 6998
  misc_feature 1..373: note = chr3:137485937-137486310
  misc_feature 1..373: note = hyper
  source 1..373: mol_type = genomic DNA

SEQ ID NO: 28403 - DNA, 304 bp, Homo sapiens
  misc_feature 1..304: note = chr3:137486516-137486820
  misc_feature 1..304: note = hyper
  source 1..304: mol_type = genomic DNA
cacaattaacatacacgggcgctgaataggagaggacgcctataaataatagatagataaataaatgagcgatcaggcgaaggtaaacaaaggcgggctgagggaggtgtagggggagtccgggctggctgcgccacgcttacttagcattacaaaacccttttacaaatcgagacaattaggaagtgacttgcctctggtggccgtccggtctgggggcctgggcgcttagggaaggcccctcctcccgccccctaggaagcccaggaggcctgggacggagacgccacggttttcctgtctg

SEQ ID NO: 28404 - DNA, 56 bp, Homo sapiens
  misc_feature 1..56: note = chr3:137487025-137487081
  misc_feature 1..56: note = hyper
  source 1..56: mol_type = genomic DNA
ggctggaaaggggcacgtggcgagtgcgagggcaaagtgcgaggggcaaaggcctc

SEQ ID NO: 28405 - DNA, 17 bp, Homo sapiens
  misc_feature 1..17: note = chr3:137487082-137487099
  misc_feature 1..17: note = hyper
  source 1..17: mol_type = genomic DNA
gacggtggctgaagctg

SEQ ID NO: 28406 - DNA, 132 bp, Homo sapiens
  misc_feature 1..132: note = chr3:137487656-137487788
  misc_feature 1..132: note = hyper
  source 1..132: mol_type = genomic DNA
ctgtagggagaggagcgccccgcccgcccggagtggagaagagccgcttctcccgagcgcgcgtcgcgcagcaaagagcagccaagagttgccctggacagactcctggcatccggagaacctgaactccgg

SEQ ID NO: 28407 - DNA, 154 bp, Homo sapiens
  misc_feature 1..154: note = chr3:137487850-137488004
  misc_feature 1..154: note = hyper
  source 1..154: mol_type = genomic DNA
cgcgtccggtagccagggagccccagacttctctcgcttagcaacctgggcctccttcgagcggggttggcagggagggcccggacctctcgcctgaggctcccattgcttccccgggacccttctccccgccaaaagtgacccaaatacatgc

SEQ ID NO: 28408 - DNA, 245 bp, Homo sapiens
  misc_feature 1..245: note = chr3:137488337-137488582
  misc_feature 1..245: note = hyper
  source 1..245: mol_type = genomic DNA
taatttccttaggcccgatgactttaaagacggaaaagaccagctactttgagtaaattacgctgaggtgtgagtgactgacatctgagaccccctgaacgtttgcattttggaactggagcgagctaacctgtaggaatctccggtgaaccaaagcgggatgatgtttccgtctgagtagggccaaggtactttcaatacagctcaccatttagggaagtgtgtcccgccggtcagcttctctt

SEQ ID NO: 28409 - DNA, 542 bp, Homo sapiens
  misc_feature 1..542: note = chr3:137488807-137489349
  misc_feature 1..542: note = hyper
  source 1..542: mol_type = genomic DNA
gggacagaaggggtccgttagatttggaggcaggagagcttcccgcctccaccgaggtgcgtgctctcctggcctctgtcctgccctgccctgccctgcctcctaggctctagtggacctagcagtgggagagctacttgggctggtttctttcctgacgctgcagggatgggcatcggcctggaaccagaagcgcaggagctgggccacggcagagtaattaagaaaataatgaaattgatggcggatgggggcgctagaaatcctggggcgtctacttaaaaccagagattcgcggtcggccccacggaatcccggctctgtgtgcgcccaggttccggggcttgggcgttgccggttctcacactaggaaggagcctgaagtcagaaaagatggggcctcgttactcactttctagcccagcccctggccctgggtcccgcagagccgtcatcgcaggctcctgcccagcctctggggtcgggtgagcaaggtgttctcttcggaagcgggaagggctgcgggtcggggacgtcccttg

SEQ ID NO: 28410 - DNA, 142 bp, Homo sapiens
  misc_feature 1..142: note = chr3:137489557-137489699
  misc_feature 1..142: note = hyper
  source 1..142: mol_type = genomic DNA
ttttccacttaggtccgtaagaaaagcaattcatacacgatcagcgctttcggtgcgaggatggaaagaaacttcagaaaaactctcgccagacaacccggcagcacttggccccggaacagagaggagagaaagacctgac

SEQ ID NO: 28411 - DNA, 1165 bp, Homo sapiens
  misc_feature 1..1165: note = chr3:137489875-137491040
  misc_feature 1..1165: note = hyper
  source 1..1165: mol_type = genomic DNA
cggctgtcgaggcaaacgcagagcacccgcccagtcctccaagggccgagagccgggagtcccgaacgccgcttaagcagctccttgcttcccgcagcccgtccacatccctgcgggatttctggacgccccgcccggggacctagggaggagggagagaggagggagggagtgggcagcctgggcgcacgccaccggtccccgtacgcccggcaccccccgtggcgcggcgagtcaatgggatttgcacactcgaggtgtaacagcattactgcattaattaccatttccatttcacgtccagattgtttacttatctgcgggaaacatatgtcgggagaagttcacattccggattctgctccgctgcccaaggtgcaattccggggaggcggcgaggggggaggggagggcttcagattttttattacaccctctagccttatctgccgctgtaaattatgaggatcctccattgagcggcatatggagattatatacttttttgaatatcgtttcccaaagcctgcagattttcactttgaaatgaaacaatcctccgctggttcccccggggacaggcgtctcctgcgttcccccgcgcggcctgggggacccttctcgcagagcaggcgcgcaccccaatgccgtggccggcgcccagtggagacttctttcacagggtctagaataatcttccgcggaacacccatccatatgcagtgtttgagaactaaggcagctcccttgctctgttttcctgcgcctagcccccggacttttgtgccgtttgcagctctttttcatttcgaatacccgcatagacgcgagcccacttctgccctcttcctacgctgggcggctccaaacccgccgcgagggctgaggtgttcacacctgcccacggcagcctgcctcgccctcaagcgcctcaaagcttcctaagcgcttacattggtcttgggacagccgactttggcttctttgtttgtttgagggaccgcggaagtggcggggaatgtgcccccgcttgagaccgcttattgtgagccctcaacggaaatcctgcacggaaggcaaccgcctccccgctcgcggtaagcaggatccacccgagtagcggggaccgaatcccatctttcttatctctcgaagactcctttca

SEQ ID NO: 28412 - DNA, 64 bp, Homo sapiens
  misc_feature 1..64: note = chr3:138066780-138066844
  misc_feature 1..64: note = hyper
  source 1..64: mol_type = genomic DNA
tctttatttttttaacggggggaaaatgacgccgctggagaggagttagcggaactgaaacaat

SEQ ID NO: 28413 - DNA, 373 bp, Homo sapiens
  misc_feature 1..373: note = chr3:138153904-138154277
  misc_feature 1..373: note = hyper
  source 1..373: mol_type = genomic DNA
ttccttgacaatgaacgcgagttcatcagccgcgagctgcggggccagcacctgccagcctgggtgagccaagccgggtgggagtgggaggtggggagatgcctttcgaggttcggaggaacttgcggtcagcggggagctggtgcgcgcaaacccgaggcagggcgggagcccggcgacctgcacaccccgttccccaccgctcccggggcgcagaccctggggacggtgaccgcccctcccgcggcgcgcagcaccctcacgtccacctctggtccgactgcggtgggagtggggaacttgggtttcatttaaggccccagagctcgagagaagagtcacgggcagaccacacccgggagaaaaacaaggg

SEQ ID NO: 28414 - DNA, 148 bp, Homo sapiens
  misc_feature 1..148: note = chr3:138655990-138656138
  misc_feature 1..148: note = hyper
  source 1..148: mol_type = genomic DNA
ccatggccttggaaccgccgggatcgcctcagcggcactccggccagctcccgacttcccgccctgggcactagggtcacccagctccagaagatagtgcttatcagcacaggaattgagaccccacacccggcgcagtgggtctccc

SEQ ID NO: 28415 - DNA, 55 bp, Homo sapiens
  misc_feature 1..55: note = chr3:138656834-138656889
  misc_feature 1..55: note = hyper
  source 1..55: mol_type = genomic DNA
cagtttcaagacccccgatcctgccggtgaggggagggagcgagaaggagtgcgc

SEQ ID NO: 28416 - DNA, 680 bp, Homo sapiens
  misc_feature 1..680: note = chr3:138657617-138658297
  misc_feature 1..680: note = hyper
  source 1..680: mol_type = genomic DNA
cgattccatttctggggatcgggtccggtggggagccactgtccctaacgcctccagagactttaagtaggacaatataatgctggtaggagcaaggtgcaaggaatttagcggcagaagcctttcgggggggtggggaaaggcagatccgtgcctcgtctgagcctgggggtggggacagcccctggccttgtagcccctgttccggggatcagctgggcccacctaacccccctacatggggttgaaaggggccaatgggacggccccgccgcccctccctcgggattccacagggccctgacccggcctttatctctgcacggtcagcagtcgcgggggcttcaggaaggaggacaaaggcccggtgtcaccgcgggcgggggctcggtttcctggctctctgctcacactcacagcctttagcggttgttgggggaagatttttaaaaatatgtgtcgaatttcctttttttctcttctagaaacaaacaaacaaaaaaggcaaaaggcgaattccccttcactcctcgtccatagagattaaagtttcctgggatcctgccctttttttttctttgactgcctagaaatacttgttctcccttgtacatagaggaaaatgcggggaaaggttttttaaaactcggtttcatactattattattactaaggacaac

SEQ ID NO: 28417 - DNA, 161 bp, Homo sapiens; identical to SEQ ID NO: 319
  misc_feature 1..161: note = chr3:138658703-138658864
  misc_feature 1..161: note = hyper
  source 1..161: mol_type = genomic DNA

SEQ ID NO: 28418 - DNA, 29 bp, Homo sapiens
  misc_feature 1..29: note = chr3:138659080-138659109
  misc_feature 1..29: note = hyper
  source 1..29: mol_type = genomic DNA
cgtgcgcctggccccggaaggtgctcgca

SEQ ID NO: 28419 - DNA, 93 bp, Homo sapiens; identical to SEQ ID NO: 2277
  misc_feature 1..93: note = chr3:138662087-138662180
  misc_feature 1..93: note = hyper
  source 1..93: mol_type = genomic DNA

SEQ ID NO: 28420 - DNA, 167 bp, Homo sapiens; identical to SEQ ID NO: 2278
  misc_feature 1..167: note = chr3:138662281-138662448
  misc_feature 1..167: note = hyper
  source 1..167: mol_type = genomic DNA

SEQ ID NO: 28421 - DNA, 41 bp, Homo sapiens
  misc_feature 1..41: note = chr3:138662801-138662842
  misc_feature 1..41: note = hyper
  source 1..41: mol_type = genomic DNA
tcctacctacagtcgcgccttgtgaacgaaccacggcagaa

SEQ ID NO: 28422 - DNA, 30 bp, Homo sapiens
  misc_feature 1..30: note = chr3:138663076-138663106
  misc_feature 1..30: note = hyper
  source 1..30: mol_type = genomic DNA
aacacaaaatttattcgggaatcgacaagg

SEQ ID NO: 28423 - DNA, 25 bp, Homo sapiens
  misc_feature 1..25: note = chr3:138663703-138663728
  misc_feature 1..25: note = hyper
  source 1..25: mol_type = genomic DNA
aaaacattagccagccgccggggcc

SEQ ID NO: 28424 - DNA, 242 bp, Homo sapiens
  misc_feature 1..242: note = chr3:138664141-138664383
  misc_feature 1..242: note = hyper
  source 1..242: mol_type = genomic DNA
ggaaagagacgagcccagtagaaagcgcgcagagaggcagcttcaggccaggggagtgcaaggtcacagaggtcagggaggtgagcacaggaggacataaactgaggggacaaagaggagcgacaggagcttaggaaagcgaaaaagcacagagggaccctgggcgctggctccagaggcgggcccagagggtgtgaggtcaggctggcggcggcgtcgtcggctgcgaccggggccggcgt

SEQ ID NO: 28425 - DNA, 68 bp, Homo sapiens
  misc_feature 1..68: note = chr3:138664701-138664769
  misc_feature 1..68: note = hyper
  source 1..68: mol_type = genomic DNA
ggcggaggcgggggtgcggccggcgggcctcccaggccattgtacgagttcactacgccggggggcag

SEQ ID NO: 28426 - DNA, 534 bp, Homo sapiens
  misc_feature 1..534: note = chr3:138664802-138665336
  misc_feature 1..534: note = hyper
  source 1..534: mol_type = genomic DNA
cgaggcggccgggcccgccagccccttgaccacagcggccgcgccagggctaccggggcccgcggctgcagccgcagctgctgcagccgctgcggctgccgccatctggcaggaggcatagggcatgggtgagggaggctgcggtagcggccacgagttgttgaggaagccagactgcaggtacttggggggcgccaggtagccgtagccgtcggccccggcgcccgccacgccgcacccgcctgcggcgcctccggccccgaagagccccttgccgggctggaagtgcgcgggcggcggccggaagggcctcttcatgcggcggcggcgccggtagttgcccttctcgaacatgtcttcgcaggccgggtccagcgtccagtagttgcccttgcgctcgccgccgccctcgcgcggcaccttgatgaagcactcgttgaggctgaggttgtggcggatgctattttgccagcccttcttattcttctcgtagaacgggaacttcgcgatgatgtactggtagatgccggacag

SEQ ID NO: 28427 - DNA, 132 bp, Homo sapiens
  misc_feature 1..132: note = chr3:138665396-138665528
  misc_feature 1..132: note = hyper
  source 1..132: mol_type = genomic DNA
cgggggcttctgcgccgggtccggcttctccggggctgtcccgccgccacccccaccgcccttgcctgggctcggcggcggcccttctggctccttgactgtgcgaccggtctctggggccagcagggcccc

SEQ ID NO: 28428 - DNA, 881 bp, Homo sapiens
  misc_feature 1..881: note = chr3:138665539-138666420
  misc_feature 1..881: note = hyper
  source 1..881: mol_type = genomic DNA
cgggctcggggtagctggccatcatgacaaagccggcgcgccgcggccgggccgcctctgctctccgctccaggcgctggcgcggcaaagagttggggcgcacgagtccgcttacggccaagtctcaaacttctggagactgcggatgccgcccgcgcttgcttgctggaggcctgtcgctgctctcccctctccttccccttcccctagggagcggccggcgggagtggagctcagcctctggccatggggagtccgcccaacagagaggggctccggcctcgccgcccctccccgctcaggccagtccccgccttggtgggttttcttttctgcgctcttcccctccccccgccccccggtttcccgaagcacgacccgcgtctctggcggagctgcctcctggagtccctagtgcgccaggagcctcgctctgttctgattcgtatgggctccaccgagttccgcttgcgtcaggcgccttcgcccctatagcggggcggccagccgcgcacgggcgagttcatctccaagtcactttttgtaaacgccccgcacagcctggaccggcctgcccccgcccagcgagcctcaggggcccagccgacagccaggctcacgcgcccttgaaatctgccggtactcgctctgcgggctgggctgggagatgacgaggaccccggtggggtctgcccgcacccggccaaagcccaggaagctcgggccccagcgaggaaaggcgctccaagcctcctcgcggctttcaggtgaaagaaaacgactcctttgctctgccgtttgctgccgtcttgaggctgaacttctagctcggggctggggaggggcgagacggcgagggggctggacggggtagggtgggg

SEQ ID NO: 28429 - DNA, 15 bp, Homo sapiens
  misc_feature 1..15: note = chr3:138668670-138668685
  misc_feature 1..15: note = hyper
  source 1..15: mol_type = genomic DNA
ttacttctcaacctt

SEQ ID NO: 28430 - DNA, 352 bp, Homo sapiens; identical to SEQ ID NO: 2282
  misc_feature 1..352: note = chr3:138668757-138669109
  misc_feature 1..352: note = hyper
  source 1..352: mol_type = genomic DNA

SEQ ID NO: 28431 - DNA, 196 bp, Homo sapiens; identical to SEQ ID NO: 2283
  misc_feature 1..196: note = chr3:138669140-138669336
  misc_feature 1..196: note = hyper
  source 1..196: mol_type = genomic DNA

SEQ ID NO: 28432 - DNA, 105 bp, Homo sapiens; identical to SEQ ID NO: 321
  misc_feature 1..105: note = chr3:138679188-138679293
  misc_feature 1..105: note = hyper
  source 1..105: mol_type = genomic DNA

SEQ ID NO: 28433 - DNA, 367 bp, Homo sapiens
  misc_feature 1..367: note = chr3:139258180-139258547
  misc_feature 1..367: note = hyper
  source 1..367: mol_type = genomic DNA
ccgggggcaccggaccgcggctcgccgggatggaggcaggcaggcagcgtctcgggagggctctagggagcggcccggagctgctcggcggggcgcccagggcgcagcgggcagcgcttaccgagggcgcgcaggtactcctcgaaattctcgttgaccaacatcttccagtacccagtgaagtcgactggcatttcggggagtgactggagccagttggccacaagcgggcgggacggctggagactgccgggacagcggctgccggtgctacgcgggtggtgggcggcccggaaatgagcgccctccggggacagggggctctgcggggcggcgacagctggattcccagcgcgcacaaagcctg

SEQ ID NO: 28434 - DNA, 350 bp, Homo sapiens
  misc_feature 1..350: note = chr3:139396463-139396813
  misc_feature 1..350: note = hyper
  source 1..350: mol_type = genomic DNA
aggggccaggagtcacgtgggcccgggcattcagccgcgatccaggtcctagtgggctgacgaggggcccacgctgcgcttacctgctatttgcagggctcagcaacggcgctcggcgagtctcgggggactgcgggggactaggggacctgctgggcctagcaggggctgtcggtcagcgcgcggcccggcgcccgaggtccgagagggaaacgacgtttggtctcgggactcaaggctgcctccggcccgggcagcctcaggtctagatcccctagtacctgagctggaggcggggccaaggcgaacttgaccttgcgctcccttagcggccccgggcagatggagtc

SEQ ID NO: 28435 - DNA, 128 bp, Homo sapiens
  misc_feature 1..128: note = chr3:139653445-139653573
  misc_feature 1..128: note = hyper
  source 1..128: mol_type = genomic DNA
ttctcggagatgacgcggagccctgccattgccatccaggtccaaggctatctactctgcccgacaacccctagcaccactaggcgctgctctagtgtgcgcctggcgccctccccagaccagtcgac

SEQ ID NO: 28436 - DNA, 298 bp, Homo sapiens; identical to SEQ ID NO: 323
  misc_feature 1..298: note = chr3:139653574-139653872
  misc_feature 1..298: note = hyper
  source 1..298: mol_type = genomic DNA

SEQ ID NO: 28437 - DNA, 1228 bp, Homo sapiens
  misc_feature 1..1228: note = chr3:139653873-139655101
  misc_feature 1..1228: note = hyper
  source 1..1228: mol_type = genomic DNA
gctgaggaaagttgggggtcggggccttggggcggggagcgcggaacccggcgccgatgcccgcgttcatgaatatgcacgagccacctccctccctccgtgacgtcacgggccgtcccggggtgagcgcctgagccgctccgggtccgcgccagtgagcgcggctgctgccggcgagctagcggcgcagcggcgggaacccgaggccgagcgccgcggcggcagcgctagaagcgcacccatcgggcacggcgaggcggcccacggtgcggcaggcaccgggaggcgagagccggcgcggacagtaggcggcggctgcagctcgttggcggctgctgcgaggatgctgcctgggcggctgtgctgggtgccgctcctgctggcgctgggcgtggggagcggcagcggcggtggcggggacagccggcagcgccgcctcctcgcggctaaaggtgggtgctggggaagtttgctcttctcccaggagggaggcagggcaggcttgagggtgaaagcggcaaggacctaggctcaagctggatttgcccaccctcccttgccgcagcttctttggcctctgtgcgccctggattcccgaagtcagttccctgcgcagcggaccagagaggtccacccgcggacgtcaactcaacccctgggcggggtccgggggctgagcagaaggcgaggtctggggagtacggacaactttgagggctgtctgtgccggggtgggagcgcagtgggtgagtttcgagctctggcccagggacggctagagcagggcgctggcgcgccgtggggacaagcaggtgtctgctcctgcctgggggaaggatcagcggcggtgctttcaaggagggagccgagctgtgacttgtctcccagctcggggatggagtggaaacttgtaggctccagggaaggccccgctgacactcctcaagctcccccagggcgtctctgactccccggggaacgtgtaccctccgggtaggcggcggggtccggaagaagcgcgggatgtgaggctccccgctgcctttcctactccgctctgactaccgaggaccgaggagcctaacctggcaccactcccctgcccaccctgttcctttgaagagcttgacctccccgcgcctcccgcccggaaggaagctagatccaagcgaacgcctggctctgtcaggcgagcctggaagccggcgaaccccggactttgacagct

SEQ ID NO: 28438 - DNA, 866 bp, Homo sapiens
  misc_feature 1..866: note = chr3:140769436-140770302
  misc_feature 1..866: note = hyper
  source 1..866: mol_type = genomic DNA
gttagcaaatgactgcgtaatggacctaaagtcaattctgggagcacagacgagggccaccaaaccaagaactttcaatttccccaaggaagcgcagataccagaagcaccctcgaggcttctgttttggccacgccctttaccccatcgctcagttcaggctcccaatgaggcggcccaccatcagcgctggtagagcaaagagaccgacttcctgcgcctcgggtgggcggggaacgctccttgagcaggtgcggtatgaaattggactttaagagatgagttggagcctgatctcaaaaataaagtgtggacgtgtgtgtctgaggaagggggataataaaccacccttttttcctcctggctgctatttcccacgtgcgttgagtaaaggcaccaaagctgcctagtgactgggtgtctcctccccgtcaggggcacccaccctggcgctccaggagcgcttgaatgaatccgggaggacccgcgcgcaggaatgaatgcgagagctagggagtgagcgggcgagtgggcgggtgagtgaatggcgaccgcgccgccgccttggcacaggggcgcgggcgcgggctccacttccctctcccgccagctggtggcctcgagaaggtggcggcgccggcagcggcccgagctgggacggccggggcgcgggatggtgggggaaggggcgttcccggcgaccgcgccttccgcggctattggattagtggccttcagggatgagctcagccagatcggctttcagctgcagcctccgggccggccgggaaggcggggagcgggcggcggcggcggaggagggggaggcggcggcggctgcagcatccagagctggccgtggcggc

SEQ ID NO: 28439 - DNA, 183 bp, Homo sapiens; identical to SEQ ID NO: 326
  misc_feature 1..183: note = chr3:140770407-140770590
  misc_feature 1..183: note = hyper
  source 1..183: mol_type = genomic DNA

SEQ ID NO: 28440 - DNA, 40 bp, Homo sapiens; identical to SEQ ID NO: 327
  misc_feature 1..40: note = chr3:140770643-140770683
  misc_feature 1..40: note = hyper
  source 1..40: mol_type = genomic DNA

SEQ ID NO: 28441 - DNA, 651 bp, Homo sapiens
  misc_feature 1..651: note = chr3:140770684-140771335
  misc_feature 1..651: note = hyper
  source 1..651: mol_type = genomic DNA
cgcccctggccgtgcggagagagccggcatttgcgggtcactcgggcgcccctgagtgggcggcggcggcagcagacccctctccagggagtccaggacctgccagcgctggggattcttcccgaacaggcgcttgccctctcttttatggtaagtactctccagctcctggtgaggggcgcgcgggggccgggagccgagatccggctgcacggactttgtgcgggccagcactcgacacagctggcgctcctgacgtcccagtccctgagaattcctctctgcaggttgtggcagttcgagatggttgatttgcgcgcagccctggggcgtttggggcccggcctttggtatcatgggttctaagccctttgcttctctgcgtagcggacaacgcacaaaaaactgccatccgattcacccgctttggtttggatccaggatccgtcactcactggctgagtgaccttggacagggcgccaaacctgtttcctcatccgtaggatgggaatgataattgtgcacattttataggggtattggaaagatctatgggatggtgttcgtaggtagacatgtgctgggcacacaggaaacactcaatcatatgttagctagtattattattagctttgcgagcccaagcttgt

SEQ ID NO: 28442 - DNA, 175 bp, Homo sapiens
  misc_feature 1..175: note = chr3:140771638-140771813
  misc_feature 1..175: note = hyper
  source 1..175: mol_type = genomic DNA
ggtcagagacttgagcgcggcaaatgtgtccgccctggtcgctctgtacgcgccaggggctccaagccagaaggggacgccgagcccccgacctctgactggcgggagaaccgggggagtggctgctcccgccggcccatggccaagcgcagacggctgccggcaggaaggagag

SEQ ID NO: 28443 - DNA, 665 bp, Homo sapiens
  misc_feature 1..665: note = chr3:141516079-141516744
  misc_feature 1..665: note = hyper
  source 1..665: mol_type = genomic DNA
ccgcccaggaagtggcggcagaaagcgagccctgagaagccaggggcaggagcggcctccgcgcgacactgcggcgctcctgattctgcggcctggggccgagcatgcggggcgggcggagcctcgagctaagtcccctggggtcccagggccgcattcctccgaggtctgcaaaggccactgcttaaaggcgcagaggagcagctgggaacgagaacaaagcggccaggcccccctcggaggaaggaaggagagagccccaggaaacagctgatagcgctaagctcagcttgtttttttcctctgctcaacagttctcctgccacggcaaacaaaacatgtacattctgattccctcttctgtttggattgtgctgtcgactggatctggtttgtgatgagctgggggaagaggcatccgcgggcgatttctggctcggcgtgccagtgtgcttttgctgggccgcgccgggatcgcggagcttcctctccggctcctttctccccgtctgcgtcgctaatccagcctggcccggccaccccaagggaagacacggccgtttcttttgatagtggaattggaggttgccaagttttcagatttaatgggaggtggagggttgctcgtgtccttgaccttgaaggacctgcgcacactcatactt

SEQ ID NO: 28444 - DNA, 264 bp, Homo sapiens
  misc_feature 1..264: note = chr3:142443587-142443851
  misc_feature 1..264: note = hyper
  source 1..264: mol_type = genomic DNA
cctttctcctctggacgcccctgtcctccagacctttagtcctctcccccgcctcaacttatatcggggcattccctctgtctcaggcgccgagtgtcttcccgcctcgcctgctgcctcaggcggtcttctcctcaccgcctctgccctgtgagtgtggagctggcgggagagtggagctggggctgcgccctcggagcgctgcaccgtcgggggtggctctggccttggggtccggggtttaggtagcgccttgggagcccc

SEQ ID NO: 28445 - DNA, 30 bp, Homo sapiens
  misc_feature 1..30: note = chr3:142607418-142607448
  misc_feature 1..30: note = hyper
  source 1..30: mol_type = genomic DNA
ggccatccggcaggccgggctggggaccca

SEQ ID NO: 28446 - DNA, 41 bp, Homo sapiens; identical to SEQ ID NO: 7032
  misc_feature 1..41: note = chr3:142607792-142607833
  misc_feature 1..41: note = hyper
  source 1..41: mol_type = genomic DNA

SEQ ID NO: 28447 - DNA, 140 bp, Homo sapiens
  misc_feature 1..140: note = chr3:142681855-142681995
  misc_feature 1..140: note = hyper
  source 1..140: mol_type = genomic DNA
ctcaggaagaacagacggcagaacttgctcaggaacagcagcagcgggatgaagtgcgtccagaagttgagcgtctcgttggtaggcttcagcaccgaggctaggcactcctgggccgtgcacggcagacgccggtagcc

SEQ ID NO: 28448 - DNA, 1188 bp, Homo sapiens
  misc_feature 1..1188: note = chr3:142682049-142683237
  misc_feature 1..1188: note = hyper
  source 1..1188: mol_type = genomic DNA
cggcttggcagacgctggggggtcccgggaggcggcagagtgggagttccgggcggcccccgaagctgccggggccggggccggagggccttttgtgcccgcgccccggggctgcaggcgccgcggcatggtgcccggggctcggctagggcgcgcgcaggcgacctctggcgccggctcccgggcgctgggcagcccccgccggccgccgtcggagcctttgtgcccacgccgggggcgtcgctgcaggtttaggagaagacccgtgcctccgagcagccgctcctaaaaattaaataaatcaataagagaatcaattaataggcagcgctgcgaccgccaggagcgcggagcgcgcgaggctcagcggcttcctcgccaagcccctgctaccggcgcgcggccgcccgcgctgcggcagcggcggcggcgcggctgactgcggcggcagcgcggcagcggtgactgggcatcgcgcggtgcgggtgcctccgccgccgccgcccccggagcgggaggtggggatgtgcgagccgaggcgcggagggagggacgggcgcaccgaggaagggcgggggcctcccaggctagggtttcgcggccgcttcgggggatagagttgtcccctgtctcgagttccgtaccatccccctcctcgggccgccgcagcccgggccgccccgttaatgattgatgcgggggccgcaggctggtcggcgacgcggcggcgcgcgcgccgagtactagagtcggccctggggttcgaaacccgacagccacgcgggcgttctggaggacactggggagccgcgttcgcggggggcggggagctgcggctgcggggggaggggagggcgccggagccgggcagggcggagagatgcgccagcggtaatctccggaggtcgccggggaggggggcactccggaagtcggggggctttaagcccgcgtccggatcggggccgtgtcattgtcagctacctggggatgcgcctctcgctccctcactgtctttgcgtgtgtgttagtgtgtgtgtgtgtgtgtgtgtgtgtgtgtcggcctgtctacgcactacacgaaggcttagttggtcttctttcgtctagtgggcgcactcaggtgcgtcaccattctgccgtttccctcgcccttgtcctgtccgaaagaaccgtccgcaagctgcc

SEQ ID NO: 28449 - DNA, 449 bp, Homo sapiens
  misc_feature 1..449: note = chr3:142837870-142838319
  misc_feature 1..449: note = hyper
  source 1..449: mol_type = genomic DNA
cccaattccagaggacgtcaatcacagtggacgcagcaccgcgagcggaaatgcggagagcatcggggctccgcatgtggggcacaatgaaacaagagcagccccggccagaggtccagtaaagcggaaagacggtcccgcccgcacacccctccggaaaactgaagcgtctcctctgacccccaaggtcagaaagatttattacttccttcgagagggcgcagccacagacccactagagagggcgggcagggtgtcggaagccagagaacggcgctccgcgtcctcccaccgctccagggcgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgca

SEQ ID NO: 28450 - DNA, 168 bp, Homo sapiens; identical to SEQ ID NO: 2294
  misc_feature 1..168: note = chr3:142838479-142838647
  misc_feature 1..168: note = hyper
  source 1..168: mol_type = genomic DNA

SEQ ID NO: 28451 - DNA, 197 bp, Homo sapiens
  misc_feature 1..197: note = chr3:142838876-142839073
  misc_feature 1..197: note = hyper
  source 1..197: mol_type = genomic DNA
cgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggctt

SEQ ID NO: 28452 - DNA, 322 bp, Homo sapiens
  misc_feature 1..322: note = chr3:142839204-142839526
  misc_feature 1..322: note = hyper
  source 1..322: mol_type = genomic DNA
cgcagggcgcccgctgcccggaaactgcccagggataagtcggccgactccccagacccctcgaaggtgcggggacccccagcggaagcgagagggagcgaaatcgaggaacgagtgacagccggacagtccgccgggcggtgatccggggccgctcccgggcgcgccctcggctccaggtgagcggaggaaccgggcagaaccgagggtgggcgttacttaggaggaggaggctgggagggagattggggcgcatccgctcactccgcttcccctcgcaggtcctacccggagccgctgccatgggagagccagccttggg

SEQ ID NO: 28453 - DNA, 16 bp, Homo sapiens
  misc_feature 1..16: note = chr3:142839562-142839578
  misc_feature 1..16: note = hyper
  source 1..16: mol_type = genomic DNA
cggcccgagtcccggc

SEQ ID NO: 28454 - DNA, 110 bp, Homo sapiens; identical to SEQ ID NO: 2298
  misc_feature 1..110: note = chr3:142839579-142839689
  misc_feature 1..110: note = hyper
  source 1..110: mol_type = genomic DNA

SEQ ID NO: 28455 - DNA, 119 bp, Homo sapiens; identical to SEQ ID NO: 2299
  misc_feature 1..119: note = chr3:142839783-142839902
  misc_feature 1..119: note = hyper
  source 1..119: mol_type = genomic DNA

SEQ ID NO: 28456 - DNA, 47 bp, Homo sapiens; identical to SEQ ID NO: 2300
  misc_feature 1..47: note = chr3:142839944-142839991
  misc_feature 1..47: note = hyper
  source 1..47: mol_type = genomic DNA

SEQ ID NO: 28457 - DNA, 136 bp, Homo sapiens; identical to SEQ ID NO: 2301
  misc_feature 1..136: note = chr3:142839992-142840128
  misc_feature 1..136: note = hyper
  source 1..136: mol_type = genomic DNA

SEQ ID NO: 28458 - DNA, 33 bp, Homo sapiens; identical to SEQ ID NO: 2302
  misc_feature 1..33: note = chr3:142840221-142840254
  misc_feature 1..33: note = hyper
  source 1..33: mol_type = genomic DNA

SEQ ID NO: 28459 - DNA, 46 bp, Homo sapiens
  misc_feature 1..46: note = chr3:143566766-143566812
  misc_feature 1..46: note = hyper
  source 1..46: mol_type = genomic DNA
cgtgtgagaacatgactgtgacatttgctctcgtgacatggcaaat

SEQ ID NO: 28460 - DNA, 33 bp, Homo sapiens; identical to SEQ ID NO: 7046
  misc_feature 1..33: note = chr3:145878520-145878553
  misc_feature 1..33: note = hyper
  source 1..33: mol_type = genomic DNA

SEQ ID NO: 28461 - DNA, 39 bp, Homo sapiens
  misc_feature 1..39: note = chr3:147072631-147072670
  misc_feature 1..39: note = hyper
  source 1..39: mol_type = genomic DNA
ggaggccgcgccgggcgggccggccgctcacaatggagc

SEQ ID NO: 28462 - DNA, 30 bp, Homo sapiens
  misc_feature 1..30: note = chr3:147073006-147073036
  misc_feature 1..30: note = hyper
  source 1..30: mol_type = genomic DNA
ccgggactgtgctcacgtgcctaacagtcc

SEQ ID NO: 28463 - DNA, 30 bp, Homo sapiens
  misc_feature 1..30: note = chr3:147073973-147074003
  misc_feature 1..30: note = hyper
  source 1..30: mol_type = genomic DNA
gacagcttaggccaccggaaaatgacccag

SEQ ID NO: 28464 - DNA, 64 bp, Homo sapiens
  misc_feature 1..64: note = chr3:147074974-147075038
  misc_feature 1..64: note = hyper
  source 1..64: mol_type = genomic DNA
gattgggctgtctggcgcggcttccaattccagtcttttccgccaggcgcggctccagtttaga

SEQ ID NO: 28465 - DNA, 368 bp, Homo sapiens
  misc_feature 1..368: note = chr3:147076998-147077366
  misc_feature 1..368: note = hyper
  source 1..368: mol_type = genomic DNA
cctttctcctcctcccgccaggtgctggagtttttacaccggtgctttgttacttaaggagaaaaactgcctgcatggtgcaggatgctgaaggggagacagaaagagaaggtctggcggcctgggggcggccatgcgtgtagccctccccggtatgtttttgtgcacagagttggcgccagggcagcgccccagaccccagtcctggctggacaataaatgaccggacagctgcggccgctacaaaggagcccctcgaccgcgtcgctgtttacttagtgtcgggtctgaccccagggctgcttgcggccagtacagatgctgattccaccctgggaacaggctttctgtcctccgttcgccgcgct

SEQ ID NO: 28466 - DNA, 287 bp, Homo sapiens
  misc_feature 1..287: note = chr3:147078959-147079246
  misc_feature 1..287: note = hyper
  source 1..287: mol_type = genomic DNA
gcctcattttctctccgttgttctcgggggaaccaaaataggggttgagattctggtctctacaagcctttcaagcgccttcaactttggcggcggcagcagcaggttgcgttgccatggatactgtactgtatggctgtggcggcggccacggcggccgcagctcgaatcccctaaacaatgccgagccaagtgcaggtttctcgcccttttccgtgcacttttctcttctaatggggctagtggcctcaaatgggagatgcatcttgacacgaaaacaatcccta

SEQ ID NO: 28467 - DNA, 339 bp, Homo sapiens
  misc_feature 1..339: note = chr3:147087253-147087592
  misc_feature 1..339: note = hyper
  source 1..339: mol_type = genomic DNA
cttccctacgttcagcgaatacagggcatcactttccagtgaaatatgcctcccccaccaatatatctacaccgtctcccacagataatgccagttatttttccagcccctaaaaaaaaatacaaatgatttcaagtggatgtcaacttgagcaactcggaagtggaatatttttagggttaaacaaacgtgcgcacgcaccaaccggtagggtttactctgcatcaatagtcatttggcaagaaccaatggctgagtttttgcaaatcgtccatttaaaggaatagtttttttcccttgataaaccccagagtcgcagctgtgcgcatccacaggcaa

SEQ ID NO: 28468 - DNA, 30 bp, Homo sapiens
  misc_feature 1..30: note = chr3:147087807-147087837
  misc_feature 1..30: note = hyper
  source 1..30: mol_type = genomic DNA
aaaacagagcaaagtcgcaggaggaagtca

SEQ ID NO: 28469 - DNA, 92 bp, Homo sapiens
  misc_feature 1..92: note = chr3:147088421-147088513
  misc_feature 1..92: note = hyper
  source 1..92: mol_type = genomic DNA
tcgggagactttgctcgttattcatctgtttagtcgcctcagaggcacaaaagcggatctgcggcgttatgaaaaatggcctgggcgcggag

SEQ ID NO: 28470 - DNA, 94 bp, Homo sapiens
  misc_feature 1..94: note = chr3:147088939-147089033
  misc_feature 1..94: note = hyper
  source 1..94: mol_type = genomic DNA
agttaaactttccagcgccagcagcctggagtgaagcgaacgcctgaggcggtaggcgggttcattgcaggccaccattcggttccaggttcaa

SEQ ID NO: 28471 - DNA, 256 bp, Homo sapiens
  misc_feature 1..256: note = chr3:147090427-147090683
  misc_feature 1..256: note = hyper
  source 1..256: mol_type = genomic DNA
gagacgcgacccagtcgggtctgggcaactccctccttcccttgcgctgggctgcagagccccctggaatacctgaggatatccccaacctggtctctcaaagatgccccgacactggaagaaacctttaaagatggactggagaagctcttttggaagacaaggcgctcacttttccacttttgggaagtaaaataagagaaccagaggaagacgtcgcggcgactgaggatcccgccagcgcacccagcctact

SEQ ID NO: 28472 - DNA, 98 bp, Homo sapiens
  misc_feature 1..98: note = chr3:147096028-147096126
  misc_feature 1..98: note = hyper
  source 1..98: mol_type = genomic DNA
aggagtccctgaccccgtgccttggctggagcgccgtttccctggacgactgtggctgggatggcctcccggcagtaatcttgcgcaaacaccctgcc

SEQ ID NO: 28473 - DNA, 308 bp, Homo sapiens
  misc_feature 1..308: note = chr3:147098379-147098687
  misc_feature 1..308: note = hyper
  source 1..308: mol_type = genomic DNA
agccagggcaacaagcgtgtcccccattgacaaggagccctattcagactgcaggtgcgaagtgggccggcgcgcccgaccacattatgtcaaggttgttggagattagtgttcagccctaataactaaagcgcttgatttacattggaaaaaagccccctcagccgtgaaaacaaaatctttgaacgcgtgatcattgcgagggcggctgatatcctaatacgtgcattgttctcggcctggcccaggcgcgccccggcctccttaggaagggcaaggcctgggctgctggccgtggaccaggtccc

SEQ ID NO: 28474 - DNA, 35 bp, Homo sapiens
  misc_feature 1..35: note = chr3:147102662-147102697
  misc_feature 1..35: note = hyper
  source 1..35: mol_type = genomic DNA
gtttctcaaagaggccgggtcgaggagaggcccct

SEQ ID NO: 28475 - DNA, 30 bp, Homo sapiens
  misc_feature 1..30: note = chr3:147103192-147103222
  misc_feature 1..30: note = hyper
  source 1..30: mol_type = genomic DNA
ccagataagagtgtgcgtgcatcggatgct

SEQ ID NO: 28476 - DNA, 62 bp, Homo sapiens
  misc_feature 1..62: note = chr3:147105883-147105945
  misc_feature 1..62: note = hyper
  source 1..62: mol_type = genomic DNA
taaacgtgggcaagtcgggttctagaaaggaagtatatactggagagcgcagtgacagtatt

SEQ ID NO: 28477 - DNA, 979 bp, Homo sapiens
  misc_feature 1..979: note = chr3:147108787-147109766
  misc_feature 1..979: note = hyper
  source 1..979: mol_type = genomic DNA
ccgacgagggcgacacgagggcagacggtgtagccgaatcgtagccagagctgggcggcggcgagcgcccgtgcaccttcatgtgcttacgcagcgagctggggtgcgtgtagcacttgtcgcagccccgcaccttgcacgtgtatggcttgtcgctagtgtgcacgtgcgaatgcttcttacggtcgctgctgttggcgaagcgccgctcgcagccctcgaactcgcatctgaagggcttctcgcctggcggaggcaacgcagagacattagtgcttgtgggtcgtgttcccgtcaggtgcttgccaccctcccccattcgtctctcattttctggaaaagaactacaaaatattttcagaaatccctttccacggcgcctcaggtcgagcacccctttccctcgtgcagagagcgcccccggtgccctctcttgaacgcctccatccctcccgccttcctcctctgggctcatggggagggtatggaggaggagcgacagtgactccatcttagtcgagtttccatcctcgaaaatcctgatccactcgggttgtttcctccaaattttctccacttggaaccagaagcacctctgctcggaaatacattaacggaggagctcacaatatagttaacggggaagctcacatctgctcgatttaaagttgctgtttcagactaacttctctgccgctaccccgcccagccgttcatcccccccacccacccccatcctggcccaaattgtttcctaaagtaggttttgcgcaaacgccaaagcgatgaaataatttaaggatgcgcagccgatgcacattgtgtgtgcataaagtggattcgtgctgcagggagaggtattctgagcaatgattcacttcagaagagatttttacaggaatggagccccctccctctttccttctaccccctgagggcaaacatttagcagcattcttcaaatcttgcctaaaccttc

SEQ ID NO: 28478 - DNA, 105 bp, Homo sapiens
  misc_feature 1..105: note = chr3:147110010-147110115
  misc_feature 1..105: note = hyper
  source 1..105: mol_type = genomic DNA
cgctgcggcttcgggaagaaaacagctgctgctgtcaggccaggcctggctccgcagcccggagggccaccaggcggctggcataggccggggaggggctgggat

SEQ ID NO: 28479 - DNA, 497 bp, Homo sapiens; identical to SEQ ID NO: 331
  misc_feature 1..497: note = chr3:147110228-147110725
  misc_feature 1..497: note = hyper
  source 1..497: mol_type = genomic DNA

SEQ ID NO: 28480 - DNA, 215 bp, Homo sapiens
  misc_feature 1..215: note = chr3:147110934-147111149
  misc_feature 1..215: note = hyper
  source 1..215: mol_type = genomic DNA
aaaaatcccgccaaacgcttatccgatctcgtgagcgcctcactggacattcacgtaaaacaaaaacaattatttcgctccagacgaggagcagaggagaaaacagcagtgcactgagtgataccggcagccgggaagttcgcaggcccctaggaggccaggtgaggccgcgccccagcttgctccggagctgcaggaggcgccctggtctctgc

SEQ ID NO: 28481 - DNA, 365 bp, Homo sapiens
  misc_feature 1..365: note = chr3:147111965-147112330
  misc_feature 1..365: note = hyper
  source 1..365: mol_type = genomic DNA
tttgagggaaatgcccgagcaggccagactctgtagttcgttgttggtcgtgtttgtttgtttgtttgtttttgtttgttgtttcccccaccccccaccgctaatgaatcaggaccgcgaaccgaaagaacgcacaaaattctgtcctgaaaacacgaaaacctgagccagccgtggcgcactgaacttgcttctctgctgtaggtcgactgtgctaagaatttaaccattttctgcttcacagaattcaaacagtgggccggcaaagagctgtaaaagtttgtttgtttaaaaaaaaaaaaaaaaaaaccctgtcattaaagatgagttccttctccagctcaggactgcgagtctaccttccg

SEQ ID NO: 28482 - DNA, 39 bp, Homo sapiens; identical to SEQ ID NO: 7062
  misc_feature 1..39: note = chr3:147114179-147114218
  misc_feature 1..39: note = hyper
  source 1..39: mol_type = genomic DNA

SEQ ID NO: 28483 - DNA, 213 bp, Homo sapiens
  misc_feature 1..213: note = chr3:147126992-147127205
  misc_feature 1..213: note = hyper
  source 1..213: mol_type = genomic DNA
cgggccaatgagctgcgcgcggcgcctcggcgcgccctccgttggcgcggcggctgagggcggggggaatgcgggcgcaccaatgggcgccagcgtcggcagcacgtgacacctcccccctgctcccattcatcaagggggggacggtgtcgtcctttcaattcatttatctgcaggaatgattgctgctatcagtctcgcgctcaccgcccg

SEQ ID NO: 28484 - DNA, 237 bp, Homo sapiens
  misc_feature 1..237: note = chr3:147127676-147127913
  misc_feature 1..237: note = hyper
  source 1..237: mol_type = genomic DNA
gcagccgtccggctactttgcgtttggcccggccagcgcccgggcgcgccgcgccattgcctgcaggctaggacttcgcgaggtgggtcgactccccctccctcctcctcttcttcctcctcttcctcctcctcttgttcctcctcctcctcccgattttccctcctcggctggcgagggtggggggggcgggggaggccggggctcgccccgagcagccacgatgctcctggacgc

SEQ ID NO: 28485 - DNA, 138 bp, Homo sapiens
  misc_feature 1..138: note = chr3:147136863-147137001
  misc_feature 1..138: note = hyper
  source 1..138: mol_type = genomic DNA
tagggggtgcaacagcgagacttccccacaacacctccaccgaaggctgggtcgtcagcgtttgagggaccctcccgccaccccgcagcctggcggggcgctttccaaatcgtcgcggcaggctctggccgggcaggg

SEQ ID NO: 28486 - DNA, 296 bp, Homo sapiens
  misc_feature 1..296: note = chr3:147137075-147137371
  misc_feature 1..296: note = hyper
  source 1..296: mol_type = genomic DNA
cgcgggctagagagagaaccaagcagaggctccggcctgtgaaagtcgctggctaggctcccaaaatagtgcggcggggtagctgcacgtgtttgttttcaaaccgcgctggtttaagtgagttcacactgcggagccgacagcagagggtagagcaacctggggctgctgccattggaacggcgagttgagcgggcctgtcagggcctctccgccgagggccgggggctgcatggtgctcgagccccagccggccacaccccagtgcatcgggtggctgggcttccagtttacac

SEQ ID NO: 28487 - DNA, 89 bp, Homo sapiens
  misc_feature 1..89: note = chr3:147137428-147137517
  misc_feature 1..89: note = hyper
  source 1..89: mol_type = genomic DNA
cggctgttctcatatccctagcccctcggagaagacttagcctacccctagtcagagctcaggccccaggtgaccgggcagcggcttgg

SEQ ID NO: 28488 - DNA, 231 bp, Homo sapiens; identical to SEQ ID NO: 2307
  misc_feature 1..231: note = chr3:147138768-147138999
  misc_feature 1..231: note = hyper
  source 1..231: mol_type = genomic DNA

SEQ ID NO: 28489 - DNA, 321 bp, Homo sapiens
  misc_feature 1..321: note = chr3:147139250-147139571
  misc_feature 1..321: note = hyper
  source 1..321: mol_type = genomic DNA
cgtagacctccccaaattgcccgtctccggtatgactgaatctgtctgctggcctctcagctaccaactctgcccgaaatctagatcccagacctggtaagtcgcgttcctcccctaccccgccccgccaccttactagcggactctgcccgcgacagcgtgcgcgcgcgtggcctgaggcgcgcgctgagaagttgggctgatttggaactgctgcgctagttcggcctctgccgctggggtgtatacgtttatacgccgtacgctccagggtagtcaggaatgtcgcggggctccccagtgaggcgggagcgaaaagag

SEQ ID NO: 28490 - DNA, 127 bp, Homo sapiens
  misc_feature 1..127: note = chr3:147141097-147141224
  misc_feature 1..127: note = hyper
  source 1..127: mol_type = genomic DNA
agttcccagctactctctggtgaaagcgggagggcgaagcgaaattgtgttctagctctgagctccgcagccctccaatggctgacttccttcagctgctgtcctggggtgccgatcgctgcggcag

SEQ ID NO: 28491 - DNA, 500 bp, Homo sapiens
  misc_feature 1..500: note = chr3:148415340-148415840
  misc_feature 1..500: note = hyper
  source 1..500: mol_type = genomic DNA
agaagttctctaattcgtccttaaaagttttccaagttcagaaaaaaaaaatgttgaagaacacgaatctccgcaggaaatgatactcctgtacccccagctcgctctccctcacgacccctcgctaggcggggttcgggaccaggtgaacgctgatctgatagttgacacgggacgactgtggcatcatccttgctgccgtcaatatcccgagagggaggaggttgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgc

SEQ ID NO: 28492 - DNA, 194 bp, Homo sapiens
  misc_feature 1..194: note = chr3:148415861-148416055
  misc_feature 1..194: note = hyper
  source 1..194: mol_type = genomic DNA
cgcaccagcgcagccggccctcggcgggacgtgacgcagcgcccggggcgcgggtgagtccgcgcggaccgccaggcatgcttgggggacttcaagggcggggtgctaagtttcatgtcacggtgtcctaactgctggctctatactgggaagctctcggggaccaaggaaagagcgaccgtagttctggtcag

SEQ ID NO: 28493 - DNA, 30 bp, Homo sapiens
  misc_feature 1..30: note = chr3:148943086-148943116
  misc_feature 1..30: note = hyper
  source 1..30: mol_type = genomic DNA
ctgactatgaccaatcggacagataaccac

SEQ ID NO: 28494 - DNA, 442 bp, Homo sapiens
  misc_feature 1..442: note = chr3:149374964-149375406
  misc_feature 1..442: note = hyper
  source 1..442: mol_type = genomic DNA
ccacgagctaggcttcggattcatgacagagttgaagagggcttcgaggtctgtgtctaggtcctgcgtgacgtggatcacttgctgcccaggcggcgggagcggagggggcgccgaggccggattcatcttctgcaaaaagaaggtcagatcagccttttatttaaagtcggaggaagtgggtaagagggttacagggtgagagggcgagatggtgggagaaagaatagagggaaaaggaaacgaggagacagataattgcccgcctggagatcccagacactcagcggtaagaccagcaggatgggggaggggtccctcctggcctcgagaattatgcaactttcttgaagcaaagaagttgcctggaggaggagaagatagggcgaggggtggagggaataactgcactcggggcttgctgaaccgcaggatggcaaag

SEQ ID NO: 28495 - DNA, 113 bp, Homo sapiens
  misc_feature 1..113: note = chr3:150802887-150803000
  misc_feature 1..113: note = hyper
  source 1..113: mol_type = genomic DNA
agggtacagtaagaccgtggaaggttgtaaggaccagagattctgactatcaagatcctggcacgtagcgaaggctccataaatggcagccatcattcttggccaagtgcggg

SEQ ID NO: 28496 - DNA, 639 bp, Homo sapiens
  misc_feature 1..639: note = chr3:150803025-150803664
  misc_feature 1..639: note = hyper
  source 1..639: mol_type = genomic DNA
cggggtccctcaggacaggccgagcccgcctccgcggctccggtctcgcagagctcgcgccaggtggcccagcatcttggtgcccgcgccccgaagcgaggagcgagggcgggttggatgaccaaggtctgccctggaggatcaccccccccgccccttccacgctcccggcgcaggtgaggttttcggcccaggccacggggaccgcgacctctggggaggtcgaggcggagggtgcagcggggggcttggagcagggctccagagggcgctccctccctcgcccaggttcaccccagggccagcctcggcgccggggcccgcgggctgcgcgctctgcggctgcgaaaacccggagaggcggattggagcgcgctcaccgcgctctcagccaactcctccgcggtccggccgccgagctgggcatgctcagtgcggacgccgcgccgccgtccgccaactcggaagctcgcgctcccgggccgtgggggcgagaacgccggcggcgagccggcgtcgctcgccgcccccagacagtggcaaacttcgcggcgttcccggagctcgtccgggcgaggcagataccgcacaaataaaatcaaatccaagtcccccatcccaacccgaatgatggaggct

SEQ ID NO: 28497 - DNA, 189 bp, Homo sapiens
  misc_feature 1..189: note = chr3:150803890-150804079
  misc_feature 1..189: note = hyper
  source 1..189: mol_type = genomic DNA
tcggccccacgccaccgtgagcacggccccctccagccgccgcgaccgccagcagcgcgcctcggcgcctgcccggagccgccgaggggaccgtagctgcggatgcgccactggaacctggcgggcgtctaggaggcaccggccgcttcccaccggccgcatccctgcgtctcgcgccccctccagacc

SEQ ID NO: 28498 - DNA, 433 bp, Homo sapiens
  misc_feature 1..433: note = chr3:150804463-150804896
  misc_feature 1..433: note = hyper
  source 1..433: mol_type = genomic DNA
cggagcggtgcgtcccggggctcgagcgcagccgagtacccgccgaaggctgtccccatcagtgcgtgtctgctgccgggcagcggcagcatccaacctgctttattcctcctgcctgcagcgccacagcgagcgagcgagcgaggagggggagagagggagtctgtctgcaaagtgctgctccctggtgctcagaggcggctgctccagctccaactctcattcatttcgccggttaacatgagagatcatggccgccttcgggcttctcagctatgagcagagaccgctgaagcgcccccggctcgggccgcccgacgtctacccacaggaccccaagcagaaggaggtaagggcgccggcggcctccccggcaaccggggccgcgctctgcagcactgacccggggccaagttggcccagcgggcatcgc

SEQ ID NO: 28499 - DNA, 116 bp, Homo sapiens
  misc_feature 1..116: note = chr3:150804936-150805052
  misc_feature 1..116: note = hyper
  source 1..116: mol_type = genomic DNA
cgggggccaggctgggggtgctgggcgaccccccggcggcggagaccgagcggctgtcagtccccgcgctccactggggcgctcgctttccatgtgccggtcgctttcccgttgcc

SEQ ID NO: 28500 - DNA, 489 bp, Homo sapiens
  misc_feature 1..489: note = chr3:152552388-152552877
  misc_feature 1..489: note = hyper
  source 1..489: mol_type = genomic DNA
catgtgccagaaatccggtcccggcaaagctagacgctctgcaatgacaggcgttcccagctagggactcctggctgcttggagcttgaaaacacctggcgtggttctcgagggccctagaggctcctgctacggactggtcggctctggggttgtaggcagaaggctctaagcggtcggaagggtttcctgtgtgtcagcaacttcactttgccgagatagctggcggaagagggaaggagcgctcgcgggccaatcgcctgccagcagccaccttggagcgcacccctctccctcgccgccgactccggtagcagcgtgccggcagaggctgaacacactcggcctcggcggagacctgctccccagaagacgcctcctgcttcccactgcgccctggaggacgcgggctggctgctgggcgagctcggcggaggcacgcccctcgcctccccgcggagtgcggactcgccccggtgcccaaactcc

SEQ ID NO: 28501 - DNA, 450 bp, Homo sapiens
  misc_feature 1..450: note = chr3:152553275-152553725
  misc_feature 1..450: note = hyper
  source 1..450: mol_type = genomic DNA
cggcggttccctgcgcgccctgttgtgtaagctcggcgttgccagcggacggagaagttgctggcttgcccgatagcccagttcggtggcggcccggggcggatttcatggcccgcggcgaacgcggggccagagctggcgtgggcgagcccctgcgcgccccctcccgcggggatccagttcgcctgctcccttccgctcgctggcttttccgatgcttgctgcgcccctggccgccgctgccctctcgccgcctcctacccctcggagccgccgcctaagtcgaggaggagagaatgaccgaggtgctgtggccggctgtccccaacgggacggacgctgccttcctggccggtccgggttcgtcctgggggaacagcacggtcgcctccactgccgccgtctcctcgtcgttcaaatgcgccttgaccaagacgggcttccagtttt

SEQ ID NO: 28502 - DNA, 176 bp, Homo sapiens
  misc_feature 1..176: note = chr3:153838818-153838994
  misc_feature 1..176: note = hyper
  source 1..176: mol_type = genomic DNA
tcacaaagtctactacgccgcgcgttctcggtttcaacgcacctccaggattcagggcttcctaagctgcaattcagcagggctcccttgcttgttctcactctgtgcccccggcaacgaccccgcgcgcctacactcccgtgccgcctcagctactagtccgcaacttctagccc

SEQ ID NO: 28503 - DNA, 226 bp, Homo sapiens; identical to SEQ ID NO: 2308
  misc_feature 1..226: note = chr3:153839727-153839953
  misc_feature 1..226: note = hyper
  source 1..226: mol_type = genomic DNA

SEQ ID NO: 28504 - DNA, 225 bp, Homo sapiens
  misc_feature 1..225: note = chr3:154145627-154145852
  misc_feature 1..225: note = hyper
  source 1..225: mol_type = genomic DNA
cggagctggctccctgtccttggtgatgggctcctgggaacggcggggcacacccccagggttgggaggggtttcagcttttgagtgccggatctgcgcccgctgcctattcaagactccaccagaaaggcacagtctacaacgtgggggacgctagctaggaaacaggcgtccgtgaaacccgcatctgattctccgaatggcctttgtcgcctccctggaccc

SEQ ID NO: 28505 - DNA, 64 bp, Homo sapiens
  misc_feature 1..64: note = chr3:154146133-154146197
  misc_feature 1..64: note = hyper
  source 1..64: mol_type = genomic DNA
atccttggccaccaccgatatggaaaactaagtcgctcgcgacggaaagcgatccccatgcccc

SEQ ID NO: 28506 - DNA, 436 bp, Homo sapiens
  misc_feature 1..436: note = chr3:154146542-154146978
  misc_feature 1..436: note = hyper
  source 1..436: mol_type = genomic DNA
aggcttcagccccagcggcagcgggcgcacccggtccgaacacggtgtcggagctcggagagcatcccccagagcgccgcagactcgggcctggagcatcctctggggacagggaaaccactctccccgcagtaggaggggtcccaggaattgaagctccacgggaaatttcctggtagttggagtggagtctcggcggctcctccgaacacagcaatcggtgagtgagtgggactgagaggcccacgaggagtccgaaggccaaagcgtacacgatagagaggaatagtacgtaggagctggagcagtccaccaggcagccccagggcgtgcgcacgaaggcgccccagccgcacagcgggagcgccgagagcagcagactggctgcccacacggtcagcaccacgccgagcacctggcccgatcttctggaggc

SEQ ID NO: 28507 - DNA, 306 bp, Homo sapiens; identical to SEQ ID NO: 7081
  misc_feature 1..306: note = chr3:154797472-154797778
  misc_feature 1..306: note = hyper
  source 1..306: mol_type = genomic DNA

SEQ ID NO: 28508 - DNA, 184 bp, Homo sapiens; identical to SEQ ID NO: 7082
  misc_feature 1..184: note = chr3:154797835-154798019
  misc_feature 1..184: note = hyper
  source 1..184: mol_type = genomic DNA

SEQ ID NO: 28509 - DNA, 272 bp, Homo sapiens
  misc_feature 1..272: note = chr3:156009028-156009300
  misc_feature 1..272: note = hyper
  source 1..272: mol_type = genomic DNA
acccaggctttcgctcgagaatgagtggggaggggtcttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggac

SEQ ID NO: 28510 - DNA, 265 bp, Homo sapiens; identical to SEQ ID NO: 333
  misc_feature 1..265: note = chr3:156009318-156009583
  misc_feature 1..265: note = hyper
  source 1..265: mol_type = genomic DNA

SEQ ID NO: 28511 - DNA, 30 bp, Homo sapiens; identical to SEQ ID NO: 7085
  misc_feature 1..30: note = chr3:156009875-156009905
  misc_feature 1..30: note = hyper
  source 1..30: mol_type = genomic DNA

SEQ ID NO: 28512 - DNA, 182 bp, Homo sapiens
  misc_feature 1..182: note = chr3:157155252-157155434
  misc_feature 1..182: note = hyper
  source 1..182: mol_type = genomic DNA
caaggcaggcctgggcgggctgctaacgtgtgtgtatcccgtactctagccacgccgtgcgcctgcggtcaggagcactcggaatgggacaagctcttcatcatgctggagaactcgcagatgagagagcgcatgctgctgcaagccacggacgacgtcctgcggggcgagctgcagaggct

SEQ ID NO: 28513 - DNA, 30 bp, Homo sapiens
  misc_feature 1..30: note = chr3:157155701-157155731
  misc_feature 1..30: note = hyper
  source 1..30: mol_type = genomic DNA
aggtaaggaggcaagcggggccgggacctc

SEQ ID NO: 28514 - DNA, 105 bp, Homo sapiens
  misc_feature 1..105: note = chr3:157156015-157156120
  misc_feature 1..105: note = hyper
  source 1..105: mol_type = genomic DNA
cccgatccgactaagcgctgcaggagtccactggcccgttataaccgtgatccctcttgccgcccagcttccctccgttagggatttccacgtcttctaatttta

SEQ ID NO: 28515 - DNA, 83 bp, Homo sapiens
  misc_feature 1..83: note = chr3:157261119-157261202
  misc_feature 1..83: note = hyper
  source 1..83: mol_type = genomic DNA
gagggacccggtccccgccccgcgtgctcaggctgaacagcttttcttccctgatctctcggaggcgccggctgctggccaac

SEQ ID NO: 28516 - DNA, 104 bp, Homo sapiens
  misc_feature 1..104: note = chr3:157812154-157812258
  misc_feature 1..104: note = hyper
  source 1..104: mol_type = genomic DNA
aagaggaggcaagggcgccgcgagctccccggatgcactggtcccacaggccgtgcccgagtggagcactgcgaatggggccaagaaattttggcctttctcgc

SEQ ID NO: 28517 - DNA, 209 bp, Homo sapiens; identical to SEQ ID NO: 2312
  misc_feature 1..209: note = chr3:157812436-157812645
  misc_feature 1..209: note = hyper
  source 1..209: mol_type = genomic DNA

SEQ ID NO: 28518 - DNA, 97 bp, Homo sapiens
  misc_feature 1..97: note = chr3:157812973-157813070
  misc_feature 1..97: note = hyper
  source 1..97: mol_type = genomic DNA
ctctttcagtctttgcggaaggtcccgtcatcacaagagcccgcgcgggaaggaaagttcctgccttggacatggtcagggccgagtcttcaaagtc

SEQ ID NO: 28519 - DNA, 140 bp, Homo sapiens
  misc_feature 1..140: note = chr3:157813465-157813605
  misc_feature 1..140: note = hyper
  source 1..140: mol_type = genomic DNA
ggaattatagcaaaacgaataacgagagtccatcttggggaaggaagttactctatcctatgttattttacttcttatctgttctttcattaatttggtataaccctgtttctatgctgggtggataaaatggagggggc

SEQ ID NO: 28520 - DNA, 38 bp, Homo sapiens
  misc_feature 1..38: note = chr3:157813669-157813707
  misc_feature 1..38: note = hyper
  source 1..38: mol_type = genomic DNA
cggcacgtaagagcagaggcaagcgcttttccaagttg

SEQ ID NO: 28521 - DNA, 372 bp, Homo sapiens
  misc_feature 1..372: note = chr3:157820497-157820869
  misc_feature 1..372: note = hyper
  source 1..372: mol_type = genomic DNA
tggctcagttcctctcgcatgaaggcgtcgggatagtgggtctcgtcaaaaagcctctccagctcattgagttgttccagggtgaaattggtccgacttcgcctctgcttgattttggtctggccttcgtcctccatccctttcgcatcctctttgcgatctttcagctccggggacactggagggggcaccccagcggggccacacgtgcatccacacgaacacacacacacacgcacacacacacggacgaaaacagcacagcaaatcctgttaccagatttgtcgcaaaaaagaatagagaatccttccccctcgtggaatcctggtccggcttctcaacccacccggaggaagaatatcccggagaag

SEQ ID NO: 28522 - DNA, 126 bp, Homo sapiens; identical to SEQ ID NO: 2315
  misc_feature 1..126: note = chr3:157821536-157821662
  misc_feature 1..126: note = hyper
  source 1..126: mol_type = genomic DNA

SEQ ID NO: 28523 - DNA, 30 bp, Homo sapiens
  misc_feature 1..30: note = chr3:157822056-157822086
  misc_feature 1..30: note = hyper
  source 1..30: mol_type = genomic DNA
ttgtggactcatggccgggaggctgcactg

SEQ ID NO: 28524 - DNA, 15 bp, Homo sapiens
  misc_feature 1..15: note = chr3:157822865-157822880
  misc_feature 1..15: note = hyper
  source 1..15: mol_type = genomic DNA
gcccgggagaagcag

SEQ ID NO: 28525 - DNA, 109 bp, Homo sapiens
  misc_feature 1..109: note = chr3:157823011-157823120
  misc_feature 1..109: note = hyper
  source 1..109: mol_type = genomic DNA
cgaccggagggttaagctttccacctctgccccttctccctcccggcaaactctgcgctagaggctagctttagtcccgccgtctggttcagcaccccctcctgcagcc

SEQ ID NO: 28526 - DNA, 736 bp, Homo sapiens
  misc_feature 1..736: note = chr3:157823138-157823874
  misc_feature 1..736: note = hyper
  source 1..736: mol_type = genomic DNA
cgtccgcctgcgggccatccgggctgcgggcccatcctcccgctggtgaaaaatgcatttcggtggaatgggaacatctgggaagggcgcgcacaaaccccacacgcttccccccacgccacccccacaacacactaggaccccacccatgaccgagcataccaccggacccccacccttccactatcactctagctgacaaagctggggtccagggccctctccgtgtccctctcccctccccgctgggcctcggagtcctctcccgcccgagaggagtccggaaggcgggaaggggaaccgctgccgggggtcagtcaggtcgttaccctccgtcagtcgcgggctgcccggctccctgcttctctcggcggcgcccatgtccagctcccggacgggagagcgccctcctccagctcctccgcctgctcctcctcctcctacacctcctccgcctcctccgccgccgcctccgcctcctccgccgccgcctccgccggccgcccggactgccgggctgctgcggtcgtcgcggcccgcctcggtgcagccggtcggctccttggccccgcgcagcggcccgctctccagcacctcccggtacgtgatcgcctccttcttctccttcactttctggtcaaaagacttggagacgaacgccgtaagttcttccatcgccgccgcacgtcagcccggcgctcaacctctgccagcagagccccgctctttttttcct

SEQ ID NO: 28527 - DNA, 30 bp, Homo sapiens
  misc_feature 1..30: note = chr3:157824303-157824333
  misc_feature 1..30: note = hyper
  source 1..30: mol_type = genomic DNA
ttcccgggtagcagtcgcgcctctaccggg

SEQ ID NO: 28528 - DNA, 211 bp, Homo sapiens; identical to SEQ ID NO: 7097
  misc_feature 1..211: note = chr3:157824698-157824909
  misc_feature 1..211: note = hyper
  source 1..211: mol_type = genomic DNA

SEQ ID NO: 28529 - DNA, 230 bp, Homo sapiens
  misc_feature 1..230: note = chr3:157825059-157825289
  misc_feature 1..230: note = hyper
  source 1..230: mol_type = genomic DNA
cgctctattattcgtgtcctggagcccagctgactcctctatggacagaccccgctaaaagggaccagtcgatttaacaagtttccccagcagctgttagctgacagatctcattttaaagtgtttccttagcgcccggtcaaggacagctcgacttcgttcgtttcctctctgaggtctcagaactcccacccttctcccttactctctgcactcggacccctctatgg

SEQ ID NO: 28530 - DNA, 92 bp, Homo sapiens; identical to SEQ ID NO: 7099
  misc_feature 1..92: note = chr3:158288920-158289012
  misc_feature 1..92: note = hyper
  source 1..92: mol_type = genomic DNA

SEQ ID NO: 28531 - DNA, 230 bp, Homo sapiens
  misc_feature 1..230: note = chr3:158449969-158450199
  misc_feature 1..230: note = hyper
  source 1..230: mol_type = genomic DNA
cgctgggcgagccggaccggaagttgaagaagtgaagcgccgcgcgcgccgcctgctgcaggagcctgcgcgggaccccagcatcctgaggctgcccagggtcgtcggggtccccggaccccgcgggcgccgccaccggggcgagcaacagcagcagcgcgagcagcggggcggtggggcgcgggcccctgggcccggaccagggagcaggcagccgttgccggcggggc

SEQ ID NO: 28532 - DNA, 247 bp, Homo sapiens
  misc_feature 1..247: note = chr3:159756650-159756897
  misc_feature 1..247: note = hyper
  source 1..247: mol_type = genomic DNA
ccgccctttctcctccgtggctccccagccaggaggctgcgcttacctgctccgcacgacctctgcggcttgggggctctcagctctgtcgctgcggggctccaggctggtgcttgtgctgagaatgactgcgggaggggctcgcgtgcccagcactgcaccgcgaggcgaccaaccgctgacatgtggggcgattgggtggacaggaagactcggcgagcttttgtagccgcgggtagggacagcc

SEQ ID NO: 28533 - DNA, 300 bp, Homo sapiens
  misc_feature 1..300: note = chr3:159943920-159944220
  misc_feature 1..300: note = hyper
  source 1..300: mol_type = genomic DNA
cggggaggcggcgggcgctcggacccctcctgcgcctcagagcacgagatgcgtgtagtgtcgccggtcttcctgcagctgcccagctacgaggaggtcaagtatctgcccacctacgaggagtccatgcggctgcagcagctcagccccggggaggtcgtgctgccagtgtcggtgcttggccgccctcgaggcggggtcgccgcggagcccgacggcggcgagggccgctaccctcttatctgagcgctcggggatcggcggctggtgcagggctgggggctgcgggtggcaagcaac

SEQ ID NO: 28534 - DNA, 166 bp, Homo sapiens
  misc_feature 1..166: note = chr3:159944437-159944603
  misc_feature 1..166: note = hyper
  source 1..166: mol_type = genomic DNA
ccctctgccttgcctcgtattgtggttcactagtaagtgcctgcttccctagtcaaagagaacacgtgagccctttggtgcgtcgagagaagggcggtcttctttagggctgaggagaaaggaccgcagttccactcctttccctacctgccgcctggacaggtct

SEQ ID NO: 28535 - DNA, 185 bp, Homo sapiens
  misc_feature 1..185: note = chr3:160167683-160167868
  misc_feature 1..185: note = hyper
  source 1..185: mol_type = genomic DNA
tcaactgcaaggcatcggccaatgggaactattgctgggctcgttcgaaagtaaacggtggacggcgcggcccgaggcaggtggcgggagtcagtttaaggctggcgcccagctttccgcgcctgcgtgctaggcgcaggccgcctctcggaagcttggcctcgcaggagcggctctctatcctg

SEQ ID NO: 28536 - DNA, 109 bp, Homo sapiens
  misc_feature 1..109: note = chr3:160822766-160822875
  misc_feature 1..109: note = hyper
  source 1..109: mol_type = genomic DNA
ctgggccccttctcccgcgctcaccggaggcgggcagctgctcgtcaccgagacccgagacccacggtgcggcggctcaacctgggccacgctccgctctagaggagtg

SEQ ID NO: 28537 - DNA, 217 bp, Homo sapiens
  misc_feature 1..217: note = chr3:161090326-161090543
  misc_feature 1..217: note = hyper
  source 1..217: mol_type = genomic DNA
tctcggcccggactgcggcaggagggcaaactggggaaagaaggctgggaggcggcccggtggtgcagagacgcgcggcgcctgctcccgcggctcccggggctggcgtgccctgcgcttacgctccgcgctcgaatatcttccccggagggctcgggaccagcgcgagcaccttccctggaagcccacatccatcacccagcgatctcctctccat

SEQ ID NO: 28538 - DNA, 137 bp, Homo sapiens
  misc_feature 1..137: note = chr3:164911621-164911758
  misc_feature 1..137: note = hyper
  source 1..137: mol_type = genomic DNA
actcaaatatttctccgtgaaattttcggggagtgaatcctagggagtagtgggagtgggggtggaggtgattgaaggaagatattgtattgtagagggactaccagatgacagttcaggaacgctttcagaggaat

SEQ ID NO: 28539 - DNA, 63 bp, Homo sapiens
  misc_feature 1..63: note = chr3:164912404-164912467
  misc_feature 1..63: note = hyper
  source 1..63: mol_type = genomic DNA
ctcccccccatcccccgcccagcactttgggtacccaatgtgcagaggcggtgactatttatc

SEQ ID NO: 28540 - DNA, 35 bp, Homo sapiens
  misc_feature 1..35: note = chr3:164912977-164913012
  misc_feature 1..35: note = hyper
  source 1..35: mol_type = genomic DNA
tctgctgtcgtcaggcgaaacgcacaatggtctgt

SEQ ID NO: 28541 - DNA, 1140 bp, Homo sapiens
  misc_feature 1..1140: note = chr3:164913244-164914384
  misc_feature 1..1140: note = hyper
  source 1..1140: mol_type = genomic DNA
cctagcacctgtgagcgtacagaatacaccgcggccaaactcgatgtgctctacaatgcacatcctacatacgagaaatactggtttcaattaggcgaagtaggaaaggatggcggcgagtacctatggtgcagagcgctcaggatctccgaggtttgctgcgaggggctacccagcaggaggggcaaactctctgcgaagctgaattgtatccatcatactgtagccttgtagcttctcctcttctggccaccaactttccgaaaggctaccgaatcacgcttgtaatccgtttaaatgtttccacctttgagacttgcagggaaatggtcgctgcataccaatgggagagcggggcgcgcacctagcgcggcgatgccagcgacagggagctcacgaccacagctccctatgccctcgatggttggtaggcaggcaggcagagtgagtgtcccaggactaggttcctttgatttaaaatctcggtgctctggatcagtggagagcttcgttgttcccgagagcctgagctcagtctctggatttctctctttctctcttcctcaaaggttgtcactcacagcgcaatccctgcccgaggcctccttccatccgagaagatggaattagcccttgcttttccagggtgtctttgctctttgccctttaggtgggtgggagtgggggttggtggcgtgtagatgagagaagaaaagggtggggagaggcggaaaggaggcaggaagggggcgactagatctcagatcccagcattggtcagacggcgaaggtggggggaaagaaggagagggggagagaagatacaaatacacagtatggctgtgcacaccaaattccacttggatttgggagatctcaggcaaagcacgaaggtgaagcgataccgttggcagagagtgagtcctctgaccgctcaccattcaagcaccctcacttctcgagcgggagaaggtgcgggggaggggggtgggagggggaggggactgctgaacgtttcaggccaaggagacgctcgcggcggcggcggcggcggcatcttttaagactgacctgctttaaaagtgccactttaatggcctaggaaataactaaaatcggattacacgttacttaccaacg

SEQ ID NO: 28542 - DNA, 449 bp, Homo sapiens
  misc_feature 1..449: note = chr3:164914796-164915245
  misc_feature 1..449: note = hyper
  source 1..449: mol_type = genomic DNA
cctctcccccattatcggtcacaacctggcagctcttcaagagacaccctgtgaaattgagtgtcgggaagtcagcattctgtacccgtggattgatttgtaacttttatttgcaaatgagagagatgcctgtttggaaaattacagcccaaaaggtggagggtgatcaaattaagaacatctgagctgtattggtgggcggtatcgctaaacgcctccggggagcggtttccaagtgatttgcagtaatcccccaccttcatgatacatgggtgacgatttgaaagtacacatatttcctcatctgtttacatttgccgggggcggggggcataaaactgtagggcacagggagttgggaggggggcatttgcctgagagatgctggataccatttcgcgataaattagatacggacactggaacaattaatacgtgtaataacacgt

SEQ ID NO: 28543 - DNA, 30 bp, Homo sapiens; identical to SEQ ID NO: 7107
  misc_feature 1..30: note = chr3:167097947-167097977
  misc_feature 1..30: note = hyper
  source 1..30: mol_type = genomic DNA

SEQ ID NO: 28544 - DNA, 66 bp, Homo sapiens
  misc_feature 1..66: note = chr3:167967494-167967560
  misc_feature 1..66: note = hyper
  source 1..66: mol_type = genomic DNA
cgagcctctggggctcgcccggccgctcctcgcgctcccagacgcctgtgacgcctgttggggcca

SEQ ID NO: 28545 - DNA, 384 bp, Homo sapiens
  misc_feature 1..384: note = chr3:167967946-167968330
  misc_feature 1..384: note = hyper
  source 1..384: mol_type = genomic DNA
cacctgcgggggctgcgggctgtcccgggcggagcgcggcggaacgcagtccccagctagtccttggggagcgccagcccgggagcggagaccgcgaccggggcgggtgtgctctccacccggtacttcctcagcgcctgacagatttttgtcccccgcccccaggtttgggtgtgtgcgcgcgtggtatgtgtgtgttttcgttatttttctgttttaagagtaattggctaatgactaccactttgtgacagggttgtgaatgaaatcctgtcgaacaccgagtttgacatttttttctttgtagagaccaatgagttcgtgcacatgtattctttctttttttgggggaagtatcgccgagtcggacggagtggtttattc

SEQ ID NO: 28546 - DNA, 47 bp, Homo sapiens
  misc_feature 1..47: note = chr3:168864015-168864062
  misc_feature 1..47: note = hyper
  source 1..47: mol_type = genomic DNA
tctagccaaagggtccgaatgtgactttctcgcgaagcagcacacga

SEQ ID NO: 28547 - DNA, 30 bp, Homo sapiens
  misc_feature 1..30: note = chr3:168960419-168960449
  misc_feature 1..30: note = hyper
  source 1..30: mol_type = genomic DNA
tatcatactgattgacgaaaccaagagtga

SEQ ID NO: 28548 - DNA, 149 bp, Homo sapiens
  misc_feature 1..149: note = chr3:169375895-169376044
  misc_feature 1..149: note = hyper
  source 1..149: mol_type = genomic DNA
ttttagaaagaagaccgtggctagtggagtggggaagtcgggagggaactaatgatttatcctgcgccgtccaggagaaaagaaaagcagaccccacagaccgttttagaaaatgcctagacagcggcttccagcggaagaagggttaa

SEQ ID NO: 28549 - DNA, 30 bp, Homo sapiens
  misc_feature 1..30: note = chr3:169376305-169376335
  misc_feature 1..30: note = hyper
  source 1..30: mol_type = genomic DNA
gcagcgcgccaggcacgcagcccctctgag

SEQ ID NO: 28550 - DNA, 141 bp, Homo sapiens
  misc_feature 1..141: note = chr3:169376602-169376743
  misc_feature 1..141: note = hyper
  source 1..141: mol_type = genomic DNA
ggttctccatctcaccgcccgcttccagcggaggcaacgcgcaggggggtgccgggagagagggggccgagccgggcgtgccgggggcaactccgctctcttgtccttctagcccggggaggagggcgtccccccttcctg

SEQ ID NO: 28551 - DNA, 210 bp, Homo sapiens
  misc_feature 1..210: note = chr3:169379435-169379645
  misc_feature 1..210: note = hyper
  source 1..210: mol_type = genomic DNA
ctcgcggggctacaccgccgactccaatgcccgcgaagccgagcctgctgaggtgccgccgacttcccgggctgctgcagggacgcagtgagcaaggaggcgtggatacgatacctaccgtatttggttctaatgtgcgagggtcgcgcggggggagactgggatttcactggggagaagcatcccacccatctccgatctctcatttct

SEQ ID NO: 28552 - DNA, 42 bp, Homo sapiens
  misc_feature 1..42: note = chr3:169386544-169386586
  misc_feature 1..42: note = hyper
  source 1..42: mol_type = genomic DNA
ttaccttctctacctcgtaaaacttgccgttttgtaaattgc

SEQ ID NO: 28553 - DNA, 64 bp, Homo sapiens
  misc_feature 1..64: note = chr3:169483001-169483065
  misc_feature 1..64: note = hyper
  source 1..64: mol_type = genomic DNA
aggacgttgcccttccgcacgtccgggaaaggctttgcgtctttacttccgaccttctttaaag

SEQ ID NO: 28554 - DNA, 428 bp, Homo sapiens
  misc_feature 1..428: note = chr3:169529973-169530401
  misc_feature 1..428: note = hyper
  source 1..428: mol_type = genomic DNA
ctcctctcctgcccccggtcgcaaagggcgaccggggactcttctcctgccctcgtttctgggcgccccaaacctctggccacagctggggttcccaggggcccccctcccgcctcgacgccttgggctggcgggctgctgggaggactcctgccgtgcgaccccggcgcccctcgcgcgttttgtctgggccaggccgcgcagacgtgctccctacttcttaccgcgctggaccgccagggccgcgcccggagtactggcctgagtggaggcccaagccggggacctggccggcgcacgggcggcctcccgggagctccccatgctcctctcacccactggccgcggcggctgcgctgccatggcgaccgcgcgcgcacttacagtccgcctgcagctgtgaggcggctacacgagcctcggcgcca

SEQ ID NO: 28555 - DNA, 107 bp, Homo sapiens; identical to SEQ ID NO: 7111
  misc_feature 1..107: note = chr3:170136940-170137047
  misc_feature 1..107: note = hyper
  source 1..107: mol_type = genomic DNA

SEQ ID NO: 28556 - DNA, 133 bp, Homo sapiens
  misc_feature 1..133: note = chr3:170302544-170302677
  misc_feature 1..133: note = hyper
  source 1..133: mol_type = genomic DNA
ctaccttgcccccagcgctctcctagaccctatacctagggggaggcagggtgacatcctgcggcccttgggcaattcgggccagtgacgttcaccgacactcaggcggggatcccttcgccagagccagttc

SEQ ID NO: 28557 - DNA, 114 bp, Homo sapiens
  misc_feature 1..114: note = chr3:170303029-170303143
  misc_feature 1..114: note = hyper
  source 1..114: mol_type = genomic DNA
agcttccctggacaccgctcccgtcacgtcctcttcgccgctcccgggagagtcaccactctccggggacagacgcccctcggggcgccaccatcctggtcggggtgctgggct

SEQ ID NO: 28558 - DNA, 116 bp, Homo sapiens
  misc_feature 1..116: note = chr3:170303379-170303495
  misc_feature 1..116: note = hyper
  source 1..116: mol_type = genomic DNA
cggcgccggagccgcgctggcccccgccccgcccggcagctcccgcgagtcagagcccggtgcccccagaccgcgggcagtcggggcctcattccgggccagagcaggaaagagcc

SEQ ID NO: 28559 - DNA, 177 bp, Homo sapiens
  misc_feature 1..177: note = chr3:170303738-170303915
  misc_feature 1..177: note = hyper
  source 1..177: mol_type = genomic DNA
tggtggctggcagtccgcacttactgcgcggagctgtctctctagctgggatgggaagtggtggtggcggcaaaggaaggcaggaggcagccgctgctgctgaacagctcctcaattattcagattgggcccccaccccccgaacccctccccgtgcctgctcgtcctccctccagc

SEQ ID NO: 28560 - DNA, 346 bp, Homo sapiens
  misc_feature 1..346: note = chr3:170625828-170626174
  misc_feature 1..346: note = hyper
  source 1..346: mol_type = genomic DNA
agtcgcagaggagctcgctgagggtggggacacccgccctgggcgctcctccgtgctggaaacagcaggttgcggcccccatcgccccaccgcagaagccggcgaccttcccccgccgcccagccctcggccgccgccccgaaccctactgcgggggacccagcccaggccgcaggtccccgcgaaggatgcggggtaacagaacctggccagcagcacccggccctctgctagctggcgcgcaccccgccctccacccttcaacgtcgccgccgcggccgcacaggcgccccctgttctgccggcatccagggctcagctcggcccggcccggccccactagggc

SEQ ID NO: 28561 - DNA, 63 bp, Homo sapiens
  misc_feature 1..63: note = chr3:170626617-170626680
  misc_feature 1..63: note = hyper
  source 1..63: mol_type = genomic DNA
ggattagtgcacttccggcgtggagcgcactttcagcagtctggttgccgagggtgagctcgc

SEQ ID NO: 28562 - DNA, 353 bp, Homo sapiens
  misc_feature 1..353: note = chr3:172165432-172165785
  misc_feature 1..353: note = hyper
  source 1..353: mol_type = genomic DNA
gttctggtccctgagcgaggcacccacgacagcatcgccgcgcctcctccgccacagcttcctgccgatgagactgtagaggaccgtgagacagaagacaggaaggaagaagaagatgctggacacccacaccatgaccgtgagcagtccagagcgcaccgcaaactcggtggggcggcactcgttggtgtcccaagggtcggtgccgttctcgtgctccaccccgactagcacgaagatgggcccggcgctgcagaaggccacggcccagatgacgaagatgaccagcttcacccgccccttggtgaccaccaccttggcccggagtgggaagcagatggcgaagtagcgct

SEQ ID NO: 28563 - DNA, 368 bp, Homo sapiens; identical to SEQ ID NO: 2318
  misc_feature 1..368: note = chr3:172165866-172166234
  misc_feature 1..368: note = hyper
  source 1..368: mol_type = genomic DNA

SEQ ID NO: 28564 - DNA, 278 bp, Homo sapiens
  misc_feature 1..278: note = chr3:172166235-172166513
  misc_feature 1..278: note = hyper
  source 1..278: mol_type = genomic DNA
tgactgcgctgggaggctggaccgagctggctcccgaggaggtccgcttaggcgcgggagggtgcgagggaggagcgggtgcagacgcgtagggaggatgcttggagaagaaagagagggaggtgagaggcagaagccgaggaagaaggtgagatggggacaaggaagagggagagagactggtggtcagtgggtgagagagtgacccactgctttctctgacacctcccctttcccccaccaactcccccaaagtttctcccaacacatcctccggc

SEQ ID NO: 28565 - DNA, 33 bp, Homo sapiens
  misc_feature 1..33: note = chr3:172166672-172166705
  misc_feature 1..33: note = hyper
  source 1..33: mol_type = genomic DNA
cgctggactagtgtgccccggaaggacaggtca

SEQ ID NO: 28566 - DNA, 45 bp, Homo sapiens
  misc_feature 1..45: note = chr3:172166999-172167044
  misc_feature 1..45: note = hyper
  source 1..45: mol_type = genomic DNA
cggatctcccacccggttgggacttctgagcgcacaggggcaaga

SEQ ID NO: 28567 - DNA, 43 bp, Homo sapiens
  misc_feature 1..43: note = chr3:172167431-172167474
  misc_feature 1..43: note = hyper
  source 1..43: mol_type = genomic DNA
aataaatagaagacgcgttgctgttgagaagtagaagctgtgc

SEQ ID NO: 28568 - DNA, 322 bp, Homo sapiens
  misc_feature 1..322: note = chr3:172167595-172167917
  misc_feature 1..322: note = hyper
  source 1..322: mol_type = genomic DNA
cgaattcacaaatccgaccggcccctcccggcccaccgacctcgggaccgccccaggaacatattcagcactgtggccagcgccacatccatcctaccgcaaagcgccgctggaggaatggcttccctgtcactcccaccgtttttaacttgcgcttctaacgcctcagtcctaccccacggaggagcagggcagactcccacgaagcacaggccggcgttagtcactgccttgaccatacacatcggcgctcacccgatgagataccacgtactgtgtatgagagagtatccccctcagttgaatgcgtttgtacttgcct

SEQ ID NO: 28569 - DNA, 32 bp, Homo sapiens
  misc_feature 1..32: note = chr3:173113479-173113511
  misc_feature 1..32: note = hyper
  source 1..32: mol_type = genomic DNA
aggacgctcggctgccgcgggaggagtaaggg

SEQ ID NO: 28570 - DNA, 386 bp, Homo sapiens
  misc_feature 1..386: note = chr3:173114201-173114587
  misc_feature 1..386: note = hyper
  source 1..386: mol_type = genomic DNA
tttacatgcaggaaacgtatatatgtttatataccgaccgcataatatataaatacatatacgcgtgcccaagggcctggttttcgtctctcctccccacgaaacggaatgttttggagccgatggataacaagaacactattaacattcttttgagcctgttttttaaaagggggagggagcgtgaagaattgtttaacatttggccatcgtttggctgcacactaagcaccacgaagtatttatggttgcagatcaggtgcaaacggggcttagagagaaaggtaagggagcttcctgcgtccgccgagctccggcgtttaccttaatcccggggattgccgagaacttcctattccctgcctctccttcgccttccccacctt

SEQ ID NO: 28571 - DNA, 709 bp, Homo sapiens
  misc_feature 1..709: note = chr3:173114985-173115694
  misc_feature 1..709: note = hyper
  source 1..709: mol_type = genomic DNA
acagtggaggagattcgccttccgtttctgcataaaaccaatacattttacttggagggtaatttgccagagttgagcgagacgaagccgtgtctaaataagtacatgacactaaatttccttttaaatccaccttttacaccatggccagtcgcttgtttaactcccgttcaagggacacggttttcaaacgtgaccttttggggagatgtgggaacttcccctcatttcttcttctgtgccgctaacctctttcctcctccgcgcggcatctccagccccggcagtttgtaaattgcccgttttgcccaccctcctggtgggcgttctctcccccactccactcctgccccctctgtcctttcttcattggcgtcttcggagcagatgcatcttctttcttcttggcctcactctcccgttcccccgtcagtccccccacccgcggctccccacttgccccagctctcctcgccgctcctccccgcctccccgcggagggttgacccttcaattcggagtcccggcctgtgggcgggcgggggagcgccgcggctgtaagccgaggatcaggcggcggcgcggagagcgcgcccgggcggccagcgccgagcgcgcggagctggcgtggggagacacggcaggaaaggcgagtcggagtgggtgatgagaggccgggagagcccgtccgagccggagagaccggaga

SEQ ID NO: 28572 - DNA, 210 bp, Homo sapiens; identical to SEQ ID NO: 7127
  misc_feature 1..210: note = chr3:173115965-173116175
  misc_feature 1..210: note = hyper
  source 1..210: mol_type = genomic DNA

SEQ ID NO: 28573 - DNA, 23 bp, Homo sapiens
  misc_feature 1..23: note = chr3:173302646-173302669
  misc_feature 1..23: note = hyper
  source 1..23: mol_type = genomic DNA
tggaacaagaattaccgggtgct

SEQ ID NO: 28574 - DNA, 291 bp, Homo sapiens
  misc_feature 1..291: note = chr3:173302927-173303218
  misc_feature 1..291: note = hyper
  source 1..291: mol_type = genomic DNA
aatataaaaccacctcgcgcatccccggggggatcgctagggagctacctagatcgagctaaaaaaccttgtttttgtggcgtcggtgggggagccaagcagctctccaagctctcaactttgcattgaaaatctctcagttgggagacgcttcccagatccagtgctttctcctagcaatactttaaggagaggaggcagcggtgccttggaaaacctgcatgtagagcggaaaagcccaagtagaaatcgctggtgcttcggccgccgtttctgcggctgtcgtggctt

SEQ ID NO: 28575 - DNA, 896 bp, Homo sapiens
  misc_feature 1..896: note = chr3:179168744-179169640
  misc_feature 1..896: note = hyper
  source 1..896: mol_type = genomic DNA
gttattttgggggcacgcacgggctcgtgctctgagttcctggaaggaggcctcggggagtgacgagaaaccaggggggtctgcaggacttggaccgccgaccgttcctcgctccccggggcgagcggtctggaccgcccgggaagtgcctgcgccggcggtcgtggggccagttcccgcgtggcagctgggcgcgacacaggcgcgccctcctcgtccctcccgggcagcgtcggccgcccgagcccggggagacccgccccgccccgcgccgtcacccgggccccgttccgcaggggtggctcgcggcgccccacgtccctgcgagaagcccgggatcgcttcgcggggcgcaccgacgagccgccgctcgcgagctcgccgcctacctggagggagctcaggcccgcgtcgaccgcgcgctgccggtgtccgctgggcgctcagcagcccctggagcgcggagccggcgtggagagcgcagctcacagccgagaccagagccgccggccacacccagtcccgcacctcccagcagccaactccgcggcgcgccggagccggggcggggacgtggctggaggcgcgaggcgcgaggcacgaggcgcgcgggcccggcggggacgtgccggggacgcgcagaccctcggagcgcgcgcagcccgggcggggggcgaagggagcgggcgccgcgcgcagcttctgcttcctattttctctctcgtttcctgccagaaggagaagaaaaacattcattcccgggcagtttcgttttcttgttggtgtggcgccggggcacgctgctaagtagcgcccgtctaagtggcgtggccagtttcctttccggcgctgacaggcgccagtttgcttgttagcaggatcgaagggcagagcta

SEQ ID NO: 28576 - DNA, 15 bp, Homo sapiens
  misc_feature 1..15: note = chr3:179754178-179754193
  misc_feature 1..15: note = hyper
  source 1..15: mol_type = genomic DNA
cccttctcccacctt

SEQ ID NO: 28577 - DNA, 245 bp, Homo sapiens
  misc_feature 1..245: note = chr3:179754238-179754483
  misc_feature 1..245: note = hyper
  source 1..245: mol_type = genomic DNA
cggtcatgttgcatcacttcacttgttgagctgtgcgaaggcagcacttgaccacagaaacttggtgaaccgccttgctcttaaattagcccccaagaattctctccagccctatagaaatgtcttacctgcatgtgtccctggtacattctgcttcggtttcttcagggctccctgaggccaccggatgcttttcccccgtgcttacttgcccaccaaaagaggggaaaaggtgggtgcacagc

SEQ ID NO: 28578 - DNA, 276 bp, Homo sapiens
  misc_feature 1..276: note = chr3:179754484-179754760
  misc_feature 1..276: note = hyper
  source 1..276: mol_type = genomic DNA
ggttctcagagggtgctcctgagccccctggagctccgggtactcggccggccggcggccactcggcagcgctgcgggctgccgggaactgttctccgctcggggtgctgaaagcggacgcgggagagcgcgcagagaaggcgaggagccgggtcggccaggctctcctgcaggcgcgggtcctgctcgcggggcgtctctagaactcactccttcttcgccgaactctttctcgcttcctgccaggttgcctcatgtctctctctctctgagctg

SEQ ID NO: 28579 - DNA, 70 bp, Homo sapiens; identical to SEQ ID NO: 336
  misc_feature 1..70: note = chr3:179754803-179754873
  misc_feature 1..70: note = hyper
  source 1..70: mol_type = genomic DNA

SEQ ID NO: 28580 - DNA, 286 bp, Homo sapiens; identical to SEQ ID NO: 337
  misc_feature 1..286: note = chr3:179755086-179755372
  misc_feature 1..286: note = hyper
  source 1..286: mol_type = genomic DNA

SEQ ID NO: 28581 - DNA, 732 bp, Homo sapiens
  misc_feature 1..732: note = chr3:180397310-180398042
  misc_feature 1..732: note = hyper
  source 1..732: mol_type = genomic DNA
ttaccaaacaggaaacgctccagcccgaaggcgaaacttccggttgagaactccctgcctgcaggccgaagaatctttttcttaccttgagcactgagggatgagcagcaacttgcccctcccgacgttcccgggggttgccaggcggcagcgtaactttccacgaaaaggcggctctcggatcgctcccggagcgtgtgaaaactgtggcccccggagctggctggaggaccacggggcagctggctggaagtaaaccacacgatcctccgattgcctgggggaagacgggagccaacagggattataaactaagtttcttttcaaggtgtgtttgctgtgttgtgtagatttcagctactacagtaggtgaaagtagaccgaagtgaactggtgtttggaaacaactctctctctggcatcactgggatgttctgatcgtcgcctgtttcagtcggccagccttcctcaccgcactcaccggccccatcgcggatgtcccagtcgatcacagacgcggaccgcgcggaggccgcacacttgtggcgcggtgtggtggtccctccggcaccactcccatacttgcatttttctttgcatttttgtttgctaacatttaaagtgtggaatttcgcataaacgtctgtatttcctctgcttgaaaaagggtaggtgacacaatccccattatcaaaaggcaatgttccgctggagaggcgccccctttagacc

SEQ ID NO: 28582 - DNA, 982 bp, Homo sapiens
  misc_feature 1..982: note = chr3:181413421-181414403
  misc_feature 1..982: note = hyper
  source 1..982: mol_type = genomic DNA
gacccacccagccgggcccgatccctcaagacactttcagcctcagcccccgtttctcctcgggtttccacagacccaggaaaggacagaggcggcgagcaggctgacaagtttattctagaggctttgaaaaatgaggtttccaggtctcttcgcacgcgcgcgcgcgcgttctcgggctaaaggttcgaagctagagtttgaatttaagccacgtcctgggacaggtcgcgttcagcgtgggcgtcggccccgccgcggccccaggcctcttcgaagtgcgcgtcaagtggggtgtcgggtcgttttgttttttctctaagtgaataattcaatcgtgttaggccagattacatgctcataatacccaggtgtatttaaaagcacccgcgtttctaaacctcccgcagaaagtgggaagcaatcgccccctcggacctggcgccgctgcgcctgctggagcctcgcttccccacagtcgggcggccagtggagggcgaggagcgcgcgcgtcacgagaggcggccccggcctcccagagcccgcaccgggaggccgagggctcgggactcgagccttctgagtccgatttctttccacgtgcagagggtagaaagtggccagtcagggcgtgattgattgcttaaggaaagagaagctacagctttcacggtagttgataactaaagcatgacatgatgccatctgtgtgaaactcgtgatgtgtgtggtcattggctccctggaacatccagaccctgatcgtgcgtatcgtgtttccttataagcagcactcgcgatttaaaaacaggtcccggtgcccctcttgctgatcctctctgccattagcccgcttaattccctttttgtaaattcccctctttacctttctttcgtccctccctccctctctttcttctttcctcctctccttttcccctttctctttttcttcctcaatctaggtcgtttctgctgaatg

SEQ ID NO: 28583 - DNA, 95 bp, Homo sapiens
  misc_feature 1..95: note = chr3:181419696-181419791
  misc_feature 1..95: note = hyper
  source 1..95: mol_type = genomic DNA
tgttggctcagaaaccgtgtaatttctcatccgataggagtttctttatgagaacatcaaaggataaaaagctctgcattttcgtagttggttaa

SEQ ID NO: 28584 - DNA, 575 bp, Homo sapiens
  misc_feature 1..575: note = chr3:181419911-181420486
  misc_feature 1..575: note = hyper
  source 1..575: mol_type = genomic DNA
aaagaatttagcctttaatctctttttatccacgaagactaaagctctgtactcgaccccgcgagcggctctcgccttccggggctggaacccgactcagatgtgaagcggcactgagccgctgcgcaggttcgtgcccagcgccccctgttggacacagtaggagctgcgcagcgccagtcccagaaatcgctggaatcctgctctggggttagagaaaactcttttattgccctccaaaaaagaaacgggatgcgaaaacaaatttttatatccttgaaaaataatataatattaactcaataaaaaactaaagaggcgatactacaattttaattcaataaaaaataaagactgtcctcctcacatcccagccatcccccacccggtttggttttgtaactcttttgaaaggttctgcgatggtaaaacaggtaaagaaaagtgacgaaaaacaaagcatttttctgtagccgtggagaatcaagcaaagtatacttcctccgttttgtccacatttcaaaaaattaaacggaagatgctgctgcttgctgttttgacgttgtcagcagcgt

SEQ ID NO: 28585 - DNA, 1136 bp, Homo sapiens
  misc_feature 1..1136: note = chr3:181421249-181422385
  misc_feature 1..1136: note = hyper
  source 1..1136: mol_type = genomic DNA
acctcccaaaattagcgaattcgagataacatttcaaggggaattgctatttagtgcgatgagagatgacttctccatctggttccagaattagatctcggcttaggttttttagtaagtaggttcagatgcaatggaaggagagaagaatcaagccttttgataaaatctctaccccgaattctatggaaaagacaggcaagcgggattccagccacagcacccccaccttttgctctaccaaaaggcttgtccccattacagaaataatatagtcggtgctagttttgtgaacccgcgccaaccgataaggtaagaaacggtgcgctgacagccgaggtccgaaggctgctcagtggttcccgcagcccgtggggtagggaggccaaagccagcaaaatgttggaggcgacgccagaaagagagtatatgcctgctattcggaagtgatgtcgaacgtgcaatagcagagtcctggagatttccaccccgttccgcacccagggatcccagcctgtggggtagcaggttgttgggtgaaggcaggagggagaagccgcacctggctgagggcgggtgggcgtgccgggagcgagtgcccaactttctagggcccatggagaaagcataacccctagttgaggaaagagagctaaacaagtgggtggcccaggcctgggaatgccacccagctctcccgacgcagtgttatttctgtggtcccagggggccccagcacctgcccgaatcccactccccaaggccgccagcaggaaggcagcccctccatctttgagggctgaggagggggcagcgagtgacttgattccttagtagcagggaaaaccgcagcggctggcaacgggccgcgtttctccgcggcggcaaagcgccctttaggggcggggcgggcatttttggtctcctgtcccagcgtccaggcctgagcccgcgcgggttggctgggcgccctgctttgtaagtaaccaatcttgctggattctgaggactatccaggcggatgggcccacttagcttaggcccactgagaccctgccaactcctcagacccttttccccttcatccctcacacctttcatgatgaacccaggaaagaacccgaactctgaaaaac

SEQ ID NO: 28586 - DNA, 250 bp, Homo sapiens; identical to SEQ ID NO: 7141
  misc_feature 1..250: note = chr3:181422925-181423175
  misc_feature 1..250: note = hyper
  source 1..250: mol_type = genomic DNA

SEQ ID NO: 28587 - DNA, 515 bp, Homo sapiens
  misc_feature 1..515: note = chr3:181428313-181428828
  misc_feature 1..515: note = hyper
  source 1..515: mol_type = genomic DNA
ctattgaaatctttacgtcgggacaatgggagagcggctaaaattaccctcttgggtcctgggcgggcaagattcctgagcccctacccccgcccccatctcatcctcctctaacccgggccttgctgggctcccccttccccagtcccggccgccttctcccagtgtgcgctgcctgcacctgtgcctggagagcatcgaccccgcctcccaggccttgagcccctttgcggcgcagccccagccttgcgcggcctgggctttgcggccaccacaatggaaatctacggggaaaatgccagggctggttctgctggagtcctgggaactctgcgtgggagggagtttgtgactgcggcccaaaagccacctccatacagtgccgtgggatgccaggaagttgaaatcaccctcccccatcgcctgcacttttgagcgcccttccgtctgtgtctttccccagcccccatttgaaagccgcacgaccgaaacccttcttacggggaggcatggga

SEQ ID NO: 28588 - DNA, 32 bp, Homo sapiens
  misc_feature 1..32: note = chr3:181430289-181430321
  misc_feature 1..32: note = hyper
  source 1..32: mol_type = genomic DNA
ttcatggtgtggtcccgcgggcagcggcgcaa

SEQ ID NO: 28589 - DNA, 627 bp, Homo sapiens
  misc_feature 1..627: note = chr3:181430695-181431322
  misc_feature 1..627: note = hyper
  source 1..627: mol_type = genomic DNA
acccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaa

SEQ ID NO: 28590 - DNA, 170 bp, Homo sapiens
  misc_feature 1..170: note = chr3:181437129-181437299
  misc_feature 1..170: note = hyper
  source 1..170: mol_type = genomic DNA
gttttatatagagttcggcgctttgaactatcatttgcctagctctcccagcttccgcgcgggccacggctccgggctgtgagcgcgccggcctcccgccggctgccctggggagcgcgcagtgcccagtgctgagagccgacgcgcgggcaaattgaggccgagctgac

SEQ ID NO: 28591 - DNA, 230 bp, Homo sapiens
  misc_feature 1..230: note = chr3:181437300-181437530
  misc_feature 1..230: note = hyper
  source 1..230: mol_type = genomic DNA
agctccggcgggtggacctgacgtcaccgcggcccgggtcacctcacccatggggctccccaagaaggtgctgtgtggggctcgagttctctctgcccgggctctgctcaaacggtcgcattccctctccctcaggcaccgacccgcgtcagacaagtctagaaagtctcccgaggcgttggggccctcaccactccagagtcctctgcctcctgcgccccagcccaagc

SEQ ID NO: 28592 - DNA, 256 bp, Homo sapiens
  misc_feature 1..256: note = chr3:181438167-181438423
  misc_feature 1..256: note = hyper
  source 1..256: mol_type = genomic DNA
gtattaaataaggagcggtgaattcttcccaagggttcttatcgctggcggccaggccagaagcgggactgcgcccccacccccacctcgtgacgtcagggcctgcagggctccggggatgaaatgattcgtttgagtgttccagaaagggcaatccgaacgcttacagggcgaggccagtgcagcccagctccatcaccactaccaagccccagtttgggaggctcccgaggcccctggccgccccccagacccc

SEQ ID NO: 28593 - DNA, 30 bp, Homo sapiens; identical to SEQ ID NO: 7147
  misc_feature 1..30: note = chr3:181440785-181440815
  misc_feature 1..30: note = hyper
  source 1..30: mol_type = genomic DNA

SEQ ID NO: 28594 - DNA, 1407 bp, Homo sapiens
  misc_feature 1..1407: note = chr3:181441019-181442426
  misc_feature 1..1407: note = hyper
  source 1..1407: mol_type = genomic DNA
tcagtgccaccactgcgggcaaggacagttccctcagtgccaccactgcgcctggagagatccccgcggccctgccgctggctgattctcccctgtgccttgacttgctgaaacatctctctggggaaaattactccctacttgcttacatgtgtgtattaaaaaacacatgtagccatacacatgtttcatcacggcaacaaaaaatatcaacattctagccccaggagcaaaacgtatcaatcattcgcctaaatattgttcagtagatgggggcgggaataggtagacctcctaggagagcggtcacaagtcccctctcctccgcatggacaccaggaatgcggggtctggcggtgctgggcgcagggcgagaagatttgatgtgcagggtaagtaaaggacaagttatttaaaacctcaacacaggaaaagatggtaagagtgctgtgtagccctttgcttgcttgtgactacgagtcgctaggtggcccgcgtttagagtatgcctacggcgcctactaacgtctagacctaggagaggcgtctcccgcccctcgacccacagccagccgccacttgatagctaacgcgtcttccggccggtacacacccacaattaatctttcttattaaagcctccattctgtacccatggggcgactcaaacctatttagatttccgtggttggctgcacaaatttaagtgggcaacgagttataaacctaataacagaggacgagagagggtgatttgagtagagaagacgcaagattcactagggtcgtgaagatgctgcgggccttgcccaccacggcatctacctcggggtgcacgccaggctctgagaaaggtagtgaacctcacaatcacactcaccacacacaacatgcgtacacacacttgcactcctaccccctttgctcacaggtacacttgtgtggaaattgcctcttccgtagttcttataaactcctcccagacaggcagaattctcagagcatcggaaccagggaacttgcagggaaccagggaaggtttgcactgtttgggattaattgagaataattaacactggagccgttaatcaccactttgctgctctctccctcctttcgggtctgcggcgtctgcctttttcgctcccgctgccggcgcgggtgtactggtgaaagtgaagacgtcgcggtagctgtcacccagttcggctgtacttttttaaacgctcgcatattgtttgattactaattcgagttaatatgatctttatggcaacataacagtggataattggcctttttttctgaacaacaatgtaaatcacaatcgctttattatttaataacgtcaaacgcttcgttggattggccccgaccgagaagaccttttctttctagacagtgttg

SEQ ID NO: 28595 - DNA, 587 bp, Homo sapiens
  misc_feature 1..587: note = chr3:181442963-181443550
  misc_feature 1..587: note = hyper
  source 1..587: mol_type = genomic DNA
ctggaagagcacatgaaactcagagaactacaatgcagacgacaacgcctagaaggaatgggtccccgctgctcgaatgaaagattaattacatttgccccaaaagccccaattctaacggtctctatcgcggcttttgccgtcactgaaggaccgctgtctctggggtcttcagacatcggagtcctttgcaaatgaagagcccccaccatttggaattcgggtcaaggagaaagactctgagcctgcagcagtttttgtttttgcgtgtgcccgcctctccattttattcaacttcttctgcctgtcgggaagcagaacaatcgctccccacccacccccctccgccccgtttctaagataaacaggaggtgcaaaatgctttgcctgcacacgcgccctcgtggcccagtcttcctgcaacccccagcgcaccggccatgcatctgtctcccaaccagacgtgggagaagacatccccccttcactcttcccacctgcatttaaaaaccatcacattgactgctctagagtcaggttcacatttttggccctccatgccaccttccagtttcttcccggtccac

SEQ ID NO: 28596 - DNA, 143 bp, Homo sapiens
  misc_feature 1..143: note = chr3:181444050-181444193
  misc_feature 1..143: note = hyper
  source 1..143: mol_type = genomic DNA
cataattatgcactgcagattctccagcctcctcgccctcaatcttggtaacctggtctttggttaataatatcgcaactcgggacttcaacgctcagaccccctccaggccccagcctccgtattctcggagccctccacta

SEQ ID NO: 28597 - DNA, 91 bp, Homo sapiens; identical to SEQ ID NO: 2335
  misc_feature 1..91: note = chr3:181444434-181444525
  misc_feature 1..91: note = hyper
  source 1..91: mol_type = genomic DNA

SEQ ID NO: 28598 - DNA, 146 bp, Homo sapiens
  misc_feature 1..146: note = chr3:181444612-181444758
  misc_feature 1..146: note = hyper
  source 1..146: mol_type = genomic DNA
cgtagtcagcttctgctttatttgtttgtttgtaatctcatatttagcaagccgggacggtggcagcaagggagaaaggacgggatggaggagggggcttcgcggtaaccacaccccttcctaatgagttaatttccatatttgcg

SEQ ID NO: 28599 - DNA, 131 bp, Homo sapiens
  misc_feature 1..131: note = chr3:181444818-181444949
  misc_feature 1..131: note = hyper
  source 1..131: mol_type = genomic DNA
actgtgctgttgcgtcttgcgcagcgcagacacctccactctggattgaaacgaaaaagctcgcggtaagagcagaaaattggtctattgatacattcgctccgagtgttgatcttggcatcaccgatagc

SEQ ID NO: 28600 - skipped

SEQ ID NO: 28601 - DNA, 735 bp, Homo sapiens
  misc_feature 1..735: note = chr3:181444990-181445725
  misc_feature 1..735: note = hyper
  source 1..735: mol_type = genomic DNA
cggattgccgagggcttgcaggcactcaggcagacgcagacagaaacccacatcgaccccccccctttccccgcctccagctgtccgaccctcaagtctctttctttttcttttttacccaactccggattattttccccctcaaggtgagggcagtgagagcagcgagggcacagtccgcacaaaaagggggaaaataatcgcaaaccaaggaaccaaaagtgaaagtttcaaactagataccaaccctgatggaggttgggtgctgacccgactgtgggtacttaagagaaggaaggagggaaactgaggtggtgagattatgtccacagtatgggtcggttaaaagttgtagtaaagaagttttgggagggccctcactagaaactcaaggcgggtttcagctgatttaacctggtttcctacacatttttgcggtgattctgctctggaaattggcgaaagagacagacctttgcaattgctcacccctccctgcccccaaccaccctgcttactttcgcgaagcgcattaggatgtgggctctggcttgagctccaaaatagcttgcttgtcaattgcgagctgcagcaatatcaaagtgaactgtcccaagtaactcttgtctagaagctgggaagaagcttaagcagctcgctttaatgatgatttgtagctcggcgaggggcacggacagcaaacaccccgcaggtgtgtgccgtaacaccatcatc

SEQ ID NO: 28602 - DNA, 62 bp, Homo sapiens; identical to SEQ ID NO: 2341
  misc_feature 1..62: note = chr3:181445799-181445861
  misc_feature 1..62: note = hyper
  source 1..62: mol_type = genomic DNA

SEQ ID NO: 28603 - DNA, 30 bp, Homo sapiens
  misc_feature 1..30: note = chr3:182896611-182896641
  misc_feature 1..30: note = hyper
  source 1..30: mol_type = genomic DNA
tgctgggaggcggaccgggagctcccagtc

SEQ ID NO: 28604 - DNA, 224 bp, Homo sapiens
  misc_feature 1..224: note = chr3:182896884-182897108
  misc_feature 1..224: note = hyper
  source 1..224: mol_type = genomic DNA
cccggctccgaatatcgaagtgcgcggtcgagaaggcgtgggctgcgggctctgctcgcctctgcaggcgccttagagcagctccgaggtcccccgtgcggagctaggcgcgcacccaggacacccctcgggctcctcggaggaggccctggttgtcccctttctgccgccgccgaggctccggctgctttctgcgtagctgggcagggcccgggcccccacac

SEQ ID NO: 28605 - DNA, 313 bp, Homo sapiens
  misc_feature 1..313: note = chr3:182897157-182897470
  misc_feature 1..313: note = hyper
  source 1..313: mol_type = genomic DNA
cgcagggaggtcagctctcctgggcggaggtcctcgggcgcagcgccctcgcctggaaaccagccgtcgcccccgcaggagccagccggcccgtggacgccccagcgcgctcctcctcggtgctgcgggtcgccctgcaattccgagaagaaagtcagagacgccgtggcccaaagaggcgcttagtctttcctcgctcacactcacgtttcctcctcatcgcgttcttctttttctccctggctgctttctcccctctccaggaaagcagatttggaggaacaggtttcgtgactgtcgtccgactggaaaa

SEQ ID NO: 28606 - DNA, 110 bp, Homo sapiens
  misc_feature 1..110: note = chr3:182971127-182971237
  misc_feature 1..110: note = hyper
  source 1..110: mol_type = genomic DNA
tgttcttgagaccagcgactttagctccgatgcgggaaggaaagccgacctccgatttggacatttaaagagctgggcttgaacttcgtgagtttcgctctaaactgccc

SEQ ID NO: 28607 - DNA, 196 bp, Homo sapiens
  misc_feature 1..196: note = chr3:183145371-183145567
  misc_feature 1..196: note = hyper
  source 1..196: mol_type = genomic DNA
cacccaccctactcccgtcagaagcagctaacggatggtaacagcccagcagccctcggtttggagctcaacggactcggcaaccacctggtgaaggcaccagcctcggccccccgacccccaccagcggcgcgccccagggatgccccccgctgggcaccgcaggcaggacccagagcagcgaggcccagatgcc

SEQ ID NO: 28608 - DNA, 55 bp, Homo sapiens
  misc_feature 1..55: note = chr3:183948534-183948589
  misc_feature 1..55: note = hyper
  source 1..55: mol_type = genomic DNA
gcgtgttcgtgtacccgctggccgaggccgaggtggtgtccggcttcgaggccga

SEQ ID NO: 28609 - DNA, 78 bp, Homo sapiens
  misc_feature 1..78: note = chr3:183978018-183978096
  misc_feature 1..78: note = hyper
  source 1..78: mol_type = genomic DNA
cgcagggagaaagcgcgtcagccgcgcggcctcggggggcggcggcgatgagaatgagccccgcgtcctagcttcccg

SEQ ID NO: 28610 - DNA, 522 bp, Homo sapiens
  misc_feature 1..522: note = chr3:183980079-183980601
  misc_feature 1..522: note = hyper
  source 1..522: mol_type = genomic DNA
ctgtgccagtgtctccgtctcctgaatctgggtatttcagtctctcctaggaggggtctatagaaactgggccgacgcgcgcgcaccagggcagacacccccagccctagtccggtggctgtagccccccgcggctctggagtggtgcgctcgcagtgtaggaggaatgaatggcggcgtcgcggggggcgccctgggctgcgggtgacgcggggaagctcggagcacctgaggacgcggagcgcgccagtgtgtgccccgagggagtgcggtagagatggagggtgccccccgccctcgttgctttggaccacgggtgagttctcgcctcaccgatgggaacatgccctcttctccccttgcctcccgcccccacaacccccgccctggctggccgtcacccgcggcgtcacctgcttgccagcgcgcaggagctctggcgcaatcactggccttggggaggagggggtgtctcacatgcggcgacagtgacggcagcgctgaaaacggtaatgatcaccc

SEQ ID NO: 28611 - DNA, 37 bp, Homo sapiens
  misc_feature 1..37: note = chr3:183993816-183993853
  misc_feature 1..37: note = hyper
  source 1..37: mol_type = genomic DNA
agcgggggtgctgcgcggcggccgtgatggctggtga

SEQ ID NO: 28612 - DNA, 374 bp, Homo sapiens
  misc_feature 1..374: note = chr3:184243074-184243448
  misc_feature 1..374: note = hyper
  source 1..374: mol_type = genomic DNA
ccccccacaaacgcacgtaaaacctctataaagggagaaccgccttgctgctgagggcgcggtgggacccgtcgcagggccagctgctccggcaggtgcccccaaagggtcccgcaggtgatcctcggggactgagcgcccatcgcccttcctacgcactcagatccgccgagcccagcgcccgccagagcccagagagtcctcggggtcagagtggtcacgtcaccgtcattcttttcctgcccgactagtcgctctgggctccccggggccgggggccgggggccgagccgccgccccgattccggcttcacccgcccgcagcgcgcggcgccccgcgctccattcgcgctacctggcggctggcaggctgc

SEQ ID NO: 28613 - DNA, 169 bp, Homo sapiens
  misc_feature 1..169: note = chr3:184301502-184301671
  misc_feature 1..169: note = hyper
  source 1..169: mol_type = genomic DNA
ccgcgccgccgcagccggcccgggggaggggcgccccgcacggctaagctctctgcgtccccggggcggacgcggggaggggaggggaagggacgcagcctctccgccgaggcctccttcctcccctagtgggggggaggggctgtgcgggggcaggggcgggcgatgc

SEQ ID NO: 28614 - DNA, 15 bp, Homo sapiens
  misc_feature 1..15: note = chr3:184319828-184319843
  misc_feature 1..15: note = hyper
  source 1..15: mol_type = genomic DNA
cccggggctggggcc

SEQ ID NO: 28615 - DNA, 223 bp, Homo sapiens
  misc_feature 1..223: note = chr3:184319873-184320096
  misc_feature 1..223: note = hyper
  source 1..223: mol_type = genomic DNA
cggcgggcccctcctggccattttggccggggaatctgtgtaaagtgtttaaaaagaaaaactctccggaggaggacgtaaccttttcttaacatctggggctcaattagctaatgacagcaaagccttctccggtgtcgctgacccctgggcggcagcccagctcccccacccccggtatttatacagctgcggcccctcgctgggacggggggcagggggc

SEQ ID NO: 28616 - DNA, 95 bp, Homo sapiens
  misc_feature 1..95: note = chr3:184321779-184321874
  misc_feature 1..95: note = hyper
  source 1..95: mol_type = genomic DNA
gaaacgttcagtagtcggacctgggccacggagggcacagcggccactctttctgagaggcagaggtcggtgggctccaccctcccactccgagc

SEQ ID NO: 28617 - DNA, 47 bp, Homo sapiens
  misc_feature 1..47: note = chr3:184322209-184322256
  misc_feature 1..47: note = hyper
  source 1..47: mol_type = genomic DNA
cgccccttgccaaggtcaatcaaaccctcccacgctccggaggcgcg

SEQ ID NO: 28618 - DNA, 46 bp, Homo sapiens
  misc_feature 1..46: note = chr3:184870261-184870307
  misc_feature 1..46: note = hyper
  source 1..46: mol_type = genomic DNA
cgggcccggagcccacggcggccccagcctccggcagagcagcccc

SEQ ID NO: 28619 - DNA, 262 bp, Homo sapiens
  misc_feature 1..262: note = chr3:184871031-184871293
  misc_feature 1..262: note = hyper
  source 1..262: mol_type = genomic DNA
tgaacacacactcctcggccgctttgtactcacatgcacgccagcctacatatgcacttccccccgagtgacactggccaccgagaactgacacacgcgtccacacgctccacggagggctgcgcacacctggcccacgcccacccgaacctcctagtggcccgggccgggtgcatcgcgtagcgaggatctcacacacacagcctgtccccacaggcgtctcacatctccctcgtacacacctccccgtgtctgggcatgg

SEQ ID NO: 28620 - DNA, 43 bp, Homo sapiens
  misc_feature 1..43: note = chr3:185543626-185543669
  misc_feature 1..43: note = hyper
  source 1..43: mol_type = genomic DNA
gtgtggtcgaaggatcgcgcgcgggagtcgggacgcctaggac

SEQ ID NO: 28621 - DNA, 60 bp, Homo sapiens
  misc_feature 1..60: note = chr3:185544035-185544095
  misc_feature 1..60: note = hyper
  source 1..60: mol_type = genomic DNA
gagggtggctggaagcggaggagcgcaggctgtgtaggagttccccgagcactgggaagg

SEQ ID NO: 28622 - DNA, 608 bp, Homo sapiens
  misc_feature 1..608: note = chr3:186078723-186079331
  misc_feature 1..608: note = hyper
  source 1..608: mol_type = genomic DNA
agtccgaggaggcagcggcgcagcgcgggagagcgcgcccacgggttcacagcgctcccgggcaccactgcggcgcagccacagatcgcttcgcgctgcagcagacgctcccgccgcggggggcgactgggggaggggtctcgaccgccaccctgagttccgcagctcatccctcccatctgggaggtggttctagctctagtcccaagctttccactgcagtgatggtggggatgggggcagcacgtcaaatcacctgtagggctttttagaactccacagccccctcccctaattctattccactagttcaaacgaagaaaatctcagactaggcaaggggaggtggaccggtggagtctgcgaaagcaccacaggtgactccgggtacgcactcctcaggacacaagcacacacacggacacatcttgtgactctgagactacacagatcaacctcagattcgacccttccctcctttattctctgaggtgtccgtgttcgcttcagcttccctttaagtcgccctgcgcaggggctttgtggagtgcccccaaagtcctagaaccccgcgggacggtcggaggctttggcggccagacattagg

SEQ ID NO: 28623 - DNA, 104 bp, Homo sapiens; identical to SEQ ID NO: 7167
  misc_feature 1..104: note = chr3:186079667-186079771
  misc_feature 1..104: note = hyper
  source 1..104: mol_type = genomic DNA

SEQ ID NO: 28624 - DNA, 427 bp, Homo sapiens
  misc_feature 1..427: note = chr3:186079818-186080245
  misc_feature 1..427: note = hyper
  source 1..427: mol_type = genomic DNA
cgagagacagaagggggaccgaagctggcctctgggcgtcttcccgcctgcgcagccctctcgggggagggggatgcagccccagtgggtgccgcggagaccaggctgccaggctgtggttggtagcgccggggtcttcaccctgtgctcggagttcagcagctccaaagctgtctatctccgtggcccgctactacggcactgcggctctgtgccctgcccctcgcagcctggcaagtccagctgccactctcactgcggagccctgcccccgggcgcagagcccgcccccgccacacacaccggcgcgcgcgcgtacacacacggcacacacagacacgcgcttccacacatgcacacgcgtgcgcacacacgaatgtggatccgctcgatgggaacctgaccccctttggtgcaactagggcgc

SEQ ID NO: 28625 - DNA, 49 bp, Homo sapiens; identical to SEQ ID NO: 7169
  misc_feature 1..49: note = chr3:186080246-186080295
  misc_feature 1..49: note = hyper
  source 1..49: mol_type = genomic DNA

SEQ ID NO: 28626 - DNA, 664 bp, Homo sapiens
  misc_feature 1..664: note = chr3:186857050-186857714
  misc_feature 1..664: note = hyper
  source 1..664: mol_type = genomic DNA
tgcaagggcctggggcgcgggcggaaaaggcgggcccagctccctcaggtctgcgtgtcaccgacccgaacccgctccgtcgtcctgacgcccccggcctagctgcagccaccttgtcgcaggggccttggtgtctctgagactccgagacgcctcgcccccacctggcgttcggaggcggttgcctcgctgggcgcagcaattcaaccgccgcgcgccggatgctaagaccgcgatttccccggatgctagggcggtgatttcccccgtgacaggccccgccccggccccgcccaggcccgggcggtcccgccccactgagctgtggctcggggagccgtgggtccgactcctgcgtgtgatgtgtcaccaagttgactttggggtcccccattcttccttagttctctattttacctcagcgcgttgtctagctgctgcctggccacggtacttagcacacagcgtgacttaatactggataaacgaggaaaggattcgtacgccctggcggggccagaggctcacagcttgggttcccgcgagcacacgagccaggaaccgccaatgcctccagggggcgctctccctcccatcgagccaccgccgggccattggagaccaggaggacctctcagctccatccctgcgtctctaacaattg

SEQ ID NO: 28627 - DNA, 130 bp, Homo sapiens; identical to SEQ ID NO: 341
  misc_feature 1..130: note = chr3:187387791-187387921
  misc_feature 1..130: note = hyper
  source 1..130: mol_type = genomic DNA

SEQ ID NO: 28628 - DNA, 202 bp, Homo sapiens
  misc_feature 1..202: note = chr3:187388006-187388208
  misc_feature 1..202: note = hyper
  source 1..202: mol_type = genomic DNA
cgccggtgacacagcccagggccaggacgatggacagcgcagccagcgcgcactggaggcggcaggacagcatctcggcgccgcgaaagccgagctggagagtggctggtcaaactctaggcgcggatcagcaggcagcagcgatggctccgaacctcgctcctaaagcggcttgtgtgctctcaaccgtctccctctgttt

SEQ ID NO: 28629 - DNA, 1255 bp, Homo sapiens
  misc_feature 1..1255: note = chr3:187455388-187456643
  misc_feature 1..1255: note = hyper
  source 1..1255: mol_type = genomic DNA
cttccagggactgcccgcccctgggcgatccacctcgaagccccccgcaaggcgcgacggaggctttgtggtatgaccgtggcggcccttaatttagttacattcaaataaaacttttggtgcacctcggtagctaacattgtgtgtatgcctttttttttttttttttttttttcctgttacgccgtcaatgcagcaggcaatgaggggaatgacacagccctctcattcccggaacgtagtcaatctcggctctgcggatttcacagaacacactttgcctattgccggctccaacaagaagtaactttccaggaagctgccggccccggcagccgccaggatcgctgcctgcgctgcgctggccgccggggattcacccagggaggcggggccgctggggaaggctcgcggggaatacagcacactttcccctaaatccctcgtccgcgccgagtgcagggctctcagagttcacctagtcccacctctcacccacaacagtttataaatggggaaggtcagacaagttagtagcagagctgggtctagaacccaggagttcgaatacaatccgaggctcatatcgagactttaagttgtccgattccgaagtttatttgcttttttccctctttttgccttccattctccctcacccccgttcttttaggggaatgtttgagcgagacttcaaggtcaaaagatggagtccctaggggctgagggtctccatcataggcgccccaggcaaggttggagaaaaactaaacagaaagccccttccgcctacgttggcaagaacgggaacccagctccacttggtttccgcccaaagtctttagaacaggagctgccaagccgtaaggatttccgaatccgatttccccgaaaccgtagagacacagcttggactcggcaaaggccggggccccgacccctgcgcgcgcactggcactctccaaagttgcctcgccttcctgtggccctcccgggaattataacccccgggtgccatgtcctaattggtctcggtagcaggctccggggtgcgctttcgggggctaggggacagcgaaagactcagccacaaaggccgcagtctggtcctaaaactagccagtggcgtcacactgcgccgctcatcccttctgcggcaagcggaagggtcagagtcggtctgcaaagaacgagcctttggcctcaaaatcctacattgaggctttctcaccccttcgcccggtgggataaaggt

SEQ ID NO: 28630 - DNA, 542 bp, Homo sapiens
  misc_feature 1..542: note = chr3:187457112-187457654
  misc_feature 1..542: note = hyper
  source 1..542: mol_type = genomic DNA
agccaactagctgcacggctgcagacaccaccgtggtccggcggcagggggtgaggtcaaatcgcggagctgtttttattcttgggggaaaacactcttcgccctcttggctggggaacgggagggtgcaggagacgacagtaaataaaagcgaatttgataacgcgatggcctcgacagccgctttggataaccgaggtgttcggggacattgtgtcctgactttcatttctatcacgtttcctgccaacagtgctcttgcaagcctgcaagcttctaggaaatgcaataaaacagagggatgtgttttatcatcaagatctgaagaggagttgcagaagggacgttccccatacgctcagcgcgagacagccttccagaagggcccgaagacaatgccagcaaatcgcgtcccggagcagagatccctcggccgtcctggctggactgggctcagcctttgcaaaaaggctggcgggggaggggagaagcatgatctcctcaagcaaacaatgcctttaaaaatccgatctggaaagaag

SEQ ID NO: 28631 - DNA, 329 bp, Homo sapiens
  misc_feature 1..329: note = chr3:189838508-189838837
  misc_feature 1..329: note = hyper
  source 1..329: mol_type = genomic DNA
gcgctcccgcatcctccgcctcagagaggcgcgggacggttacgctcgagagggcttcggggcacctcgcgtccgggtcccctctcccaccttccctcggggaagcgcgccgactccgccgcgatctggccgctccgcgagccccaggtgaccgccggcgctccgcgtactgagaggcggaggccgtgcctggccagccgctcttaaagggacgcccacagctcacacgctcctcctgctgcctgagactccgagagccgctctcccaggctccccgctgcagcggcggggctgccaggggcggcacactccagcgccagccagagagc

SEQ ID NO: 28632 - DNA, 39 bp, Homo sapiens
  misc_feature 1..39: note = chr3:190039913-190039952
  misc_feature 1..39: note = hyper
  source 1..39: mol_type = genomic DNA
gcagggcagtgctgacgatggcgccgatccatcccagga

SEQ ID NO: 28633 - DNA, 48 bp, Homo sapiens
  misc_feature 1..48: note = chr3:190529604-190529652
  misc_feature 1..48: note = hyper
  source 1..48: mol_type = genomic DNA
tgcatctctaataaacgggatggtttcttgcggcggcttttgctagag

SEQ ID NO: 28634 - DNA, 107 bp, Homo sapiens
  misc_feature 1..107: note = chr3:190580805-190580912
  misc_feature 1..107: note = hyper
  source 1..107: mol_type = genomic DNA
gacgggcggcgaccccgcagccgggaccgaggcgagggccgggctccctcccgctccacgcgcagcgcggggcagggccgagccgggccgggcgagaagatggtcca

SEQ ID NO: 28635 - skipped

SEQ ID NO: 28636 - DNA, 483 bp, Homo sapiens
  misc_feature 1..483: note = chr3:192126228-192126711
  misc_feature 1..483: note = hyper
  source 1..483: mol_type = genomic DNA
ttccccaacctctggcggccggggggcggggcggggcggtcccaggccctcttgcgaagtagacgtttgcaccccaaacttgcaccccaaggcgatcggcgtccaaggggcagtggggagtttagtcacactgcgttcggggtaccaagtggaaggggaagaacgatgcccaaaataacaagacgtgcctctgttggagaggcgcaagcgttgtaaggtgtccaaagtatacctacacatacatacatagaaaacccgtttacaaagcagagtctggacccaggcgggtagcgcgcccccggtagaaaatactaaaaagtgaataaaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggc

SEQ ID NO: 28637 - DNA, 63 bp, Homo sapiens; identical to SEQ ID NO: 344
  misc_feature 1..63: note = chr3:192126786-192126849
  misc_feature 1..63: note = hyper
  source 1..63: mol_type = genomic DNA

SEQ ID NO: 28638 - DNA, 110 bp, Homo sapiens; identical to SEQ ID NO: 345
  misc_feature 1..110: note = chr3:192126850-192126960
  misc_feature 1..110: note = hyper
  source 1..110: mol_type = genomic DNA

SEQ ID NO: 28639 - DNA, 412 bp, Homo sapiens
  misc_feature 1..412: note = chr3:192126961-192127373
  misc_feature 1..412: note = hyper
  source 1..412: mol_type = genomic DNA
ctctttctctttccgcttgctttccggcacgagacgggcacagttggtgattatttagggaatcctaaatctggaatgactcagtagtttaaataagccccctcaaaaggcagcgatgccgaaggtgtcctctccagctcggcgcccacacgcctttaactggagctccccgccatggtccacccggggccgccgcaccgagctggtctccgcacaggctcagagggagcgagggaagggagggaaggaaggggcgccctggcgggctcgggatcaggtcatcgccgcgctgctgcccgtgccccctaggctcgcgcgccccggcagtcagcagctcacaggcagcagatcagatggggattacccgccggacgcaaggccgatcactcagtcccgcgccgcccatcccggc

SEQ ID NO: 28640 - DNA, 175 bp, Homo sapiens; identical to SEQ ID NO: 348
  misc_feature 1..175: note = chr3:192127556-192127731
  misc_feature 1..175: note = hyper
  source 1..175: mol_type = genomic DNA

SEQ ID NO: 28641 - DNA, 204 bp, Homo sapiens
  misc_feature 1..204: note = chr3:192127936-192128140
  misc_feature 1..204: note = hyper
  source 1..204: mol_type = genomic DNA
cgcccaggtggggccgagctgggggccgggcccctggagcgctgggaagcacagcgcgctctagtcaggttccctttcctggagccctccgcttccagactcccttctttcctccctccctcccgccacccctctccctcctctctgtgtcttctgtctctccccttttctcctctctacgcaatcctacgtgattgaggtttg

SEQ ID NO: 28642 - DNA, 201 bp, Homo sapiens
  misc_feature 1..201: note = chr3:192231876-192232077
  misc_feature 1..201: note = hyper
  source 1..201: mol_type = genomic DNA
ctttcccagggcacccggttgaagcccaaggctaactgggaccctcctacttcagcaccaaggacagaaatcgctaaatctccaggggaaacgtacccctaaccaccgccagatgtctacttttcagacaaagcaagaaaaagaaaatatacctgccttgccagccatctgtttaaaagtcccctctcctgtggaacgcac

SEQ ID NO: 28643 - DNA, 97 bp, Homo sapiens
  misc_feature 1..97: note = chr3:192232078-192232175
  misc_feature 1..97: note = hyper
  source 1..97: mol_type = genomic DNA
agcaacttttcggagacactgaacaactccaagtcgcgcgccgccctcgcaaatcgcagagagggccgcgagaaggtgcgaacgcaggtcacggcca

SEQ ID NO: 28644 - DNA, 245 bp, Homo sapiens
  misc_feature 1..245: note = chr3:192232574-192232819
  misc_feature 1..245: note = hyper
  source 1..245: mol_type = genomic DNA
ctccccgcccacctgcgctagtagtccaaccaacaggcggcctgtcttcggaagccgggtcccgagtccatcgcgcgcgcccaggtggaggggagtttgcacatggagccggagggagcccgggcgccggcagggggcgggccgggacgcggaagtgccggtccgccgggggcagccctccgagagcccgaggcgctgccacccctcggtgggctcgagcacggccccttgagaccttccggagg

SEQ ID NO: 28645 - DNA, 103 bp, Homo sapiens; identical to SEQ ID NO: 7188
  misc_feature 1..103: note = chr3:192232849-192232952
  misc_feature 1..103: note = hyper
  source 1..103: mol_type = genomic DNA

SEQ ID NO: 28646 - DNA, 435 bp, Homo sapiens
  misc_feature 1..435: note = chr3:192233094-192233529
  misc_feature 1..435: note = hyper
  source 1..435: mol_type = genomic DNA
gcagggagggctggaccccggaggctgcagagcgtcagaagcgactctagggaactagggggtggggtagggaggcggggacgtggaataaagaaagctcctgggtgccggctatgagaagtcaggtgtgcgtaggcgtggacagagtgccgatgtgggagtctggacacctggattttctggtcggggctctgtgtccttgggtaagtcacttaccaccctgggcgtctccccgtcaatctgggtggggaagagggtgtgagatagaggattggcagcggcgtgcttgtttgtccccgtgcctttcaggctcctagaaaagcttagcataggtgcagtgggaagtggagctagaagggacagagggagaggaggcaggtgaggcgagaaatctgaagacaaaagagcgcttcgctttggcgccagtattctggc

SEQ ID NO: 28647 - DNA, 30 bp, Homo sapiens
  misc_feature 1..30: note = chr3:192445447-192445477
  misc_feature 1..30: note = hyper
  source 1..30: mol_type = genomic DNA
cctccctccccaatacggtcctcagttatc

SEQ ID NO: 28648 - DNA, 136 bp, Homo sapiens
  misc_feature 1..136: note = chr3:192634345-192634481
  misc_feature 1..136: note = hyper
  source 1..136: mol_type = genomic DNA
cttcggaatgttgaccgccggccacgcaccgcttgacagccacggatccgctggcggagccgcaagttacaacccaggcgcctggcaaactcacactacacctcagtagcaataatcccaacggcaggacacctgg

SEQ ID NO: 28649 - DNA, 32 bp, Homo sapiens
  misc_feature 1..32: note = chr3:192959076-192959108
  misc_feature 1..32: note = hyper
  source 1..32: mol_type = genomic DNA
cgggcgtctcagagccgcggaggggccgccgg

SEQ ID NO: 28650 - DNA, 103 bp, Homo sapiens; identical to SEQ ID NO: 7190
  misc_feature 1..103: note = chr3:193776076-193776179
  misc_feature 1..103: note = hyper
  source 1..103: mol_type = genomic DNA

SEQ ID NO: 28651 - DNA, 69 bp, Homo sapiens
  misc_feature 1..69: note = chr3:193776392-193776461
  misc_feature 1..69: note = hyper
  source 1..69: mol_type = genomic DNA
ttctccagggccctgcggggtgggctcccatcttcatctcgcaagcatccaacccggggaggtggcttt

SEQ ID NO: 28652 - DNA, 33 bp, Homo sapiens
  misc_feature 1..33: note = chr3:194208225-194208258
  misc_feature 1..33: note = hyper
  source 1..33: mol_type = genomic DNA
attctcatatgaccacggactctgcgccccggc

SEQ ID NO: 28653 - DNA, 118 bp, Homo sapiens
  misc_feature 1..118: note = chr3:194208467-194208585
  misc_feature 1..118: note = hyper
  source 1..118: mol_type = genomic DNA
cgcgcccggccacctgcagcctctggctgcggccatctttccgcctggggccacctggcctgcgccctttgtgcccggcccgctccgtgactgttcttcttgccgctacttacagaac

SEQ ID NO: 28654 - DNA, 216 bp, Homo sapiens
  misc_feature 1..216: note = chr3:194407566-194407782
  misc_feature 1..216: note = hyper
  source 1..216: mol_type = genomic DNA
gaagaagcacaagttcgagctgctggccgaggcgccgccgcggcaggcgtccaagcccaagggctacgctgtgagcctgcactactcggcgctcagctcgctggcgcgggcgtgccccgaaggcgcgcttagccgggtgggcagcatgttccgctccaagcgcaagaagctgcacatcactagcgaggacccaacttacaccgtgctctacctggg

SEQ ID NO: 28655 - DNA, 394 bp, Homo sapiens
  misc_feature 1..394: note = chr3:194408375-194408769
  misc_feature 1..394: note = hyper
  source 1..394: mol_type = genomic DNA
aacccgagggctgcccggaggaggaggagaaccgtgcggcagagggagatccagcagaggaggaggccgaggcgcagcgtgcgctagtggtcgccatgcactttgagtgcggggacttgttggatactctggagaatggccgtggggaggcgctaggaggcggcgggggctccctgggcccgggggccgggccgccgcctctgctgctgggcagcgcctccgacatgaaggctgagctgtcgcaacttattagcgacctgggcgagctcagcttcggcaacgacgtgcgcaccctgcaggccgacttgcgggtgacgcgcctgctgtcaggcgacagcacgggcagcgagagctccatcgagggcgggggccctgacgccacctccgccaccgc

SEQ ID NO: 28656 - DNA, 281 bp, Homo sapiens
  misc_feature 1..281: note = chr3:194408838-194409119
  misc_feature 1..281: note = hyper
  source 1..281: mol_type = genomic DNA
cgtcgccggcgctccaccgtggctacccatccgtggtcccgacaacctccctgtcccttgcccgcccccaggaagggggaaatggggcatttggggcccagacctacacttggagcccaggtccagcgttcccccgaccgctttcccctacctcccggcccccgctcccgccccagcacttttggctctgttgcgcgtggggatgcggggagatttgagaggggaaaaccccgccaggagggagagagaggcacccctctgggatgcgggtgagggaaggt

SEQ ID NO: 28657 - DNA, 95 bp, Homo sapiens
  misc_feature 1..95: note = chr3:195474927-195475022
  misc_feature 1..95: note = hyper
  source 1..95: mol_type = genomic DNA
tggaactgcagctggcggagggcccggagcccaggtctgcgtggggccgcggcttcctgcgctgttaaccagcggagccccggggactgctgatg

SEQ ID NO: 28658 - DNA, 10 bp, Homo sapiens
  misc_feature 1..10: note = chr3:196255622-196255632
  misc_feature 1..10: note = hyper
  source 1..10: mol_type = genomic DNA
gcggtgtcgc

SEQ ID NO: 28659 - DNA, 174 bp, Homo sapiens
  misc_feature 1..174: note = chr3:196366687-196366861
  misc_feature 1..174: note = hyper
  source 1..174: mol_type = genomic DNA
ggaggccggagcccccggagacgatgcgccccgcgcagccgcctgcgcctgcgggagccgtgagtatttcccgcgtgggggcgtccccggggcacagccggggcccttctccaggtgggcgagctcgagcgaggttgggtggtaggaggtcagcgtccgcggcccgcagctcag

SEQ ID NO: 28660 - DNA, 30 bp, Homo sapiens
  misc_feature 1..30: note = chr3:196755999-196756029
  misc_feature 1..30: note = hyper
  source 1..30: mol_type = genomic DNA
cccgtcccaccatcccgggccctgactccc

SEQ ID NO: 28661 - DNA, 145 bp, Homo sapiens
  misc_feature 1..145: note = chr3:197183201-197183346
  misc_feature 1..145: note = hyper
  source 1..145: mol_type = genomic DNA
cagagaatgtagcatcgtggcagagaggaaaaggaactaagggaagcggaagtatcagtaaggagcctccgacagaaatggtaggctggcaacatcctgatcagcagcagaagtgattttcccgtgtccccgtgtccctgctcac

SEQ ID NO: 28662 - DNA, 131 bp, Homo sapiens
  misc_feature 1..131: note = chr3:197840417-197840548
  misc_feature 1..131: note = hyper
  source 1..131: mol_type = genomic DNA
agggaggaagagaggcgggaaagacagaagaaaggcaggggaggcgcgacggggcgagggacggggaggaaagcggtctcccgcctccagggcgggccgagggctgggcccgcggggcgctcacgtccctc

SEQ ID NO: 28663 - DNA, 616 bp, Homo sapiens
  misc_feature 1..616: note = chr4:330715-331331
  misc_feature 1..616: note = hyper
  source 1..616: mol_type = genomic DNA
gggtgagcttggggagggagacacactctcagcccacctcgccccgcccgacagcgctccgagtcctgagtcccctcacccccattctacagacacgaaggtgaagccaaagacgggacgctcacttcctgagaatttgctgcctgctgcgtggacaccaccgacctattgtttacagcggtcagggacccgccccccagacccccaggaccgcgcttccgggggaggagggtgtcctcagcaacggtgacccgcaccaaagccctcctcaccggggtcaccgccacagccggtgcgaggcccgcagggcgctggggatgcgcgaccgactcccgtgaacctgctcctcgcgcgtcagggagagctgtgcacccaactaggctctgtgaggacggactgaggtcggcctgcaggctgcggccccgaaggcaggatttgtggagagatgattcgcgagccttggaggaaggatgggctgtgcgtgcgtgggtgcgtgcgtgtgtgtgtgtgtgtgtctgtgacttttgtatgtttatgtgagactgcgtacgtgcgcgcgtctgtgtgtgcgcgcgcgcgtatatgtctgtgtgtgtgcgtgcgtgtataatttcta

SEQ ID NO: 28664 - DNA, 172 bp, Homo sapiens
  misc_feature 1..172: note = chr4:331562-331734
  misc_feature 1..172: note = hyper
  source 1..172: mol_type = genomic DNA
cagccagagaggaggcggtggcttccgggatgtggcgcgggtctttgcgtctggctactaccagaccgcgggttaggggcttcatctctctgcgttctcagttgtgggaggccttggtgattcggccacagctcagcctccgtcgctctgtgacctgcgggtattggatgat

SEQ ID NO: 28665 - DNA, 121 bp, Homo sapiens
  misc_feature 1..121: note = chr4:332122-332243
  misc_feature 1..121: note = hyper
  source 1..121: mol_type = genomic DNA
tgttcggaatgagatcgaggccccatcaaaacagagttcatgtgagcaaatggggactcattaatgggacagcgccggccgtggctcgtggtttgggggctgccagcgggtcttgaaggaa

SEQ ID NO: 28666 - DNA, 30 bp, Homo sapiens
  misc_feature 1..30: note = chr4:380533-380563
  misc_feature 1..30: note = hyper
  source 1..30: mol_type = genomic DNA
tttgggggctgctggcgggtcttaaaggaa

SEQ ID NO: 28667 - DNA, 340 bp, Homo sapiens
  misc_feature 1..340: note = chr4:568313-568653
  misc_feature 1..340: note = hyper
  source 1..340: mol_type = genomic DNA
tcgctctgtccccctcgcctcggaccaccaggcagagcagccccagggtttggacttgccaagaaaagtgcagtcgggctagccaagcccaaacatttattgtaaacttgaaaatggaatccagatatgaacgacacaaataagaagagaaacctcccagatacagaaatggtcacatcaggggccccctcctgtggtcacggagcccgcagagggggccaggccggaggctgcaaagccacgtggaagaggcggcgcccctgaggcctggccctggaccccgccccgctgcccgtcctcccttgccgcgggggtcctgagcggggcggggtgggtggaa

SEQ ID NO: 28668 - DNA, 69 bp, Homo sapiens; identical to SEQ ID NO: 2356
  misc_feature 1..69: note = chr4:569047-569116
  misc_feature 1..69: note = hyper
  source 1..69: mol_type = genomic DNA

SEQ ID NO: 28669 - DNA, 162 bp, Homo sapiens; identical to SEQ ID NO: 2357
  misc_feature 1..162: note = chr4:569274-569436
  misc_feature 1..162: note = hyper
  source 1..162: mol_type = genomic DNA

SEQ ID NO: 28670 - DNA, 273 bp, Homo sapiens
  misc_feature 1..273: note = chr4:569460-569733
  misc_feature 1..273: note = hyper
  source 1..273: mol_type = genomic DNA
cgagcatgaagaccaggacgccgagcagaagcaggttctggctgctcaccggccccggggccccggccgcggcccccgactcgcccggcgtggcctcgggagcgcctgccggcgccgcggggacccccaaacccgggcccggttccgaccccgcgaggggcgcgtcccggggtccgcagcagagcagggcggcgccgagcagtgagaggccggcggccagcagcagcccggagtagaaggcgccggcggcggcccccaggcggaacggctccc

SEQ ID NO: 28671 - DNA, 33 bp, Homo sapiens
  misc_feature 1..33: note = chr4:570224-570257
  misc_feature 1..33: note = hyper
  source 1..33: mol_type = genomic DNA
cccgggacgcccctccgcttcctcctcccggag

SEQ ID NO: 28672 - DNA, 203 bp, Homo sapiens; identical to SEQ ID NO: 7201
  misc_feature 1..203: note = chr4:570298-570501
  misc_feature 1..203: note = hyper
  source 1..203: mol_type = genomic DNA

SEQ ID NO: 28673 - DNA, 1117 bp, Homo sapiens
  misc_feature 1..1117: note = chr4:570836-571953
  misc_feature 1..1117: note = hyper
  source 1..1117: mol_type = genomic DNA
ttcaagggatggggacgatcagggtctctgggaagtgctgacgtgtgcgcgtgtgcggtgtgttgcttgtgggtgcgtgtgtggtgtgtgcatgtgtgtgcgcgcgcgtgtgtgcggggtgtgccgtgagcgtgtgcccgcggttcgggggatgagtaggggcgctgacttttaggaccagccatttgagtcaagctggagacgacgtcttagaacctaggatgagtctcgtttggttttagtctgcaaagctcgtctgcatcagacaggaattttccccagacgcgggtgcacgtgaattaattcatcagaaggcggttcacggcctgagtgagggggacgagggcggcgaattcctccgcctcattcctaccctgacgattcgaggtgggtgagaggaaggcgtggggcggctgggtgcgtggggtgggggaaggtcacctcttcggcctctctgggccctccagcctcttcctgagaggagctcgcctcggccccttggttggggggatgggagcgtctccggaaggccctcggccgagcagctgggcctgcacccctggtcccttccagttcgtttctgctgcggcggcaagaggctggggagccgatgactcaccctgccggctaattgcagcgttaaataactttgcgccggattcggtggctgcagcagggaacgcgctccgggcgccgggggaggtggagggacgccctgagaacgcacctccgtccctgtcaccagccttagcaagttctggcctgtggagccgtcatccagagcgcacagcttcatgcccttgaagggcgcagtgtgtcccgtggtgcccggtgggcccggacagagaccccagaggctctgtctgaaggaagctgcacccacagactccatccaggcagcgcgggcgcggtcctgtcgcctacctttctcggaagccatctgcccatgtgaatctatgtgaaggcccttcatgcgctcctggacatctgcgtgggatttacttcaactgctatcgctgcgaggaggacgagcatgtttcactgtatttttagcagagagtgcagattttagaacctcgcgaacggtcctgtatctcctgcacgatgactctccaga

SEQ ID NO: 28674 - DNA, 108 bp, Homo sapiens
  misc_feature 1..108: note = chr4:779786-779894
  misc_feature 1..108: note = hyper
  source 1..108: mol_type = genomic DNA
ggggcggagagcggccgcgtgcggacgcaaatactcacggcggagcgatccgaaccccggagtccgcgtgcaggagggggacccaggccccgccgccctcgccccgcc

SEQ ID NO: 28675 - DNA, 154 bp, Homo sapiens
  misc_feature 1..154: note = chr4:788810-788964
  misc_feature 1..154: note = hyper
  source 1..154: mol_type = genomic DNA
ccacctctaaggagccgaggattcgtgctccccgcaggctgcaaagccactaggctcagagggacccgccgcgaacctggggagcgtcacagatgccgcccacgcccccccgcttttcggcccgggtactgcagggaggcgcctccagaaccac

SEQ ID NO: 28676 - DNA, 341 bp, Homo sapiens
  misc_feature 1..341: note = chr4:789169-789510
  misc_feature 1..341: note = hyper
  source 1..341: mol_type = genomic DNA
gcatgagctgcatcccgcatccgcaggagggcggcgctgcgacccacccccgcccccgtttccagaggaggccgctgcggcgcggggcggtcccacgtggtgcctgaggctgggacaccccgactctgattgcaggggggtcggatccgaggctgggggtcccgcagtctggctggggtccgctactggcctcgacgtacaggggccgaccccacccctacctcgttctctgagcctcagcttccccccgtgagaggtggaggcggtgggggggcgcaccgggcacgaccccgcggcaatgacggggctggcaacgccccccacagcggcacaggcggata

SEQ ID NO: 28677 - DNA, 15 bp, Homo sapiens
  misc_feature 1..15: note = chr4:967602-967617
  misc_feature 1..15: note = hyper
  source 1..15: mol_type = genomic DNA
cgggccagacttctc

SEQ ID NO: 28678 - DNA, 36 bp, Homo sapiens
  misc_feature 1..36: note = chr4:967716-967752
  misc_feature 1..36: note = hyper
  source 1..36: mol_type = genomic DNA
ggccgcgcaggacgcccccggcgaggggcagcgctg

SEQ ID NO: 28679 - DNA, 119 bp, Homo sapiens
  misc_feature 1..119: note = chr4:995875-995994
  misc_feature 1..119: note = hyper
  source 1..119: mol_type = genomic DNA
cggacccgctggtgggctggtccctgccacagccgtggagggcggacgtgacctacgcggccatggtggtgaaggtgggccggcccaacgccctgcgcgccccccggccaccttcctcc

SEQ ID NO: 28680 - DNA, 75 bp, Homo sapiens; identical to SEQ ID NO: 7206
  misc_feature 1..75: note = chr4:996100-996175
  misc_feature 1..75: note = hyper
  source 1..75: mol_type = genomic DNA

SEQ ID NO: 28681 - DNA, 44 bp, Homo sapiens; identical to SEQ ID NO: 7207
  misc_feature 1..44: note = chr4:996495-996539
  misc_feature 1..44: note = hyper
  source 1..44: mol_type = genomic DNA

SEQ ID NO: 28682 - DNA, 124 bp, Homo sapiens
  misc_feature 1..124: note = chr4:1165449-1165573
  misc_feature 1..124: note = hyper
  source 1..124: mol_type = genomic DNA
cgtgagcgccccctgcccccaccgcatccccggaaccgcacaccgcaggcgctcggcaaacattctggtgttagagtctcccgacgtcagcacgccccagactgggaagcgccgccgtgcagct

SEQ ID NO: 28683 - DNA, 307 bp, Homo sapiens
  misc_feature 1..307: note = chr4:1165999-1166306
  misc_feature 1..307: note = hyper
  source 1..307: mol_type = genomic DNA
ctcctgcggtgcttccgagacccccatcagcggaatggacggcgcggggttagatcgcccgtgcgcctgcgagcgaccaggggtaacgggcaggttttcagtccgagtccctgcagcttgccgggccggtctgggtgcggcctccgggatgccttcgccgtcgcagggacccggggccttggccgactggctgcccccgggactagacccttaaagctcggtcgcagccagtcctgggggtccctctggaggtgccacaaggttctgggccgcggggaaagtgcaggaggcccgggccctctctggg

SEQ ID NO: 28684 - DNA, 187 bp, Homo sapiens
  misc_feature 1..187: note = chr4:1396406-1396593
  misc_feature 1..187: note = hyper
  source 1..187: mol_type = genomic DNA
ctcaaggccaacacccgaggagccttggtccccaccggagaggattcacgggtgggcccggccgggcggagggcggcgcgggagcctgggagaagggggcgcggccgcctgcggtttattgattgagtgaagttccgcaaagtgcttcgcagcgggccgagcccgcgggagccacctgcccggcccc

SEQ ID NO: 28685 - DNA, 103 bp, Homo sapiens
  misc_feature 1..103: note = chr4:1396594-1396697
  misc_feature 1..103: note = hyper
  source 1..103: mol_type = genomic DNA
acgcgcatggtcatttataaatttaaaactcttccgtagcaaccggttatgtacagagtcaacgactggaatcgtagaaaacagccgggcccggcagcggcct

SEQ ID NO: 28686 - DNA, 119 bp, Homo sapiens
  misc_feature 1..119: note = chr4:1397376-1397495
  misc_feature 1..119: note = hyper
  source 1..119: mol_type = genomic DNA
cgcgccctggcaacccgacccgcgggccccgaggccgccgccgcctccccgcgcctcctccgcgcctcgcgccgcctccgtctcgggcgcttcgtcctcgtcgtcgtcctcgtcgtcgg

SEQ ID NO: 28687 - DNA, 97 bp, Homo sapiens
  misc_feature 1..97: note = chr4:1398277-1398374
  misc_feature 1..97: note = hyper
  source 1..97: mol_type = genomic DNA
gggtagggccctgctcggcctcaccaggagggctgggcgggcgtgcaggtcggagtggctccccgcggcctaaaggcccggtcggccgagtctgaac

SEQ ID NO: 28688 - DNA, 72 bp, Homo sapiens; identical to SEQ ID NO: 7212
  misc_feature 1..72: note = chr4:1399065-1399137
  misc_feature 1..72: note = hyper
  source 1..72: mol_type = genomic DNA

SEQ ID NO: 28689 - DNA, 30 bp, Homo sapiens
  misc_feature 1..30: note = chr4:1399500-1399530
  misc_feature 1..30: note = hyper
  source 1..30: mol_type = genomic DNA
aggcgaaccctggaccggcctcacagccct

SEQ ID NO: 28690 - DNA, 92 bp, Homo sapiens; identical to SEQ ID NO: 7213
  misc_feature 1..92: note = chr4:1400248-1400340
  misc_feature 1..92: note = hyper
  source 1..92: mol_type = genomic DNA

SEQ ID NO: 28691 - DNA, 525 bp, Homo sapiens
  misc_feature 1..525: note = chr4:1400997-1401522
  misc_feature 1..525: note = hyper
  source 1..525: mol_type = genomic DNA
cgttccgtgggtctcggtcccgcctctctcacttgctcccgcttggggtctccttttgcgtctccagggtctctcttgctcagggtctgtgcccctccatcccttcccacgcccgcccctttcacgtcgtcaaattagggcccgacctggagtgccagcagaggggcggagccggcggtccccgggccgctcattagaagtggaatcgaaaatgagagactgcttgtccctcttaacccgcccccaaaagggggaccgacaaattgcacacacagcaggcggcctacataaaatcgatcctcttcaagtaaggagaaaatgtgtgtttcttccaaaaagaatacgacaaatgcccccttctccacatctggataaataggaagccccgcggcctgagtctttatttgggtacgttttatctacagcggcggtgtttgcaggacagggccctgcggcccgcggccctcggccctcgaggattgggcctggcgtccggagtcccagtgcgggatcgtggtagctccc

SEQ ID NO: 28692 - DNA, 188 bp, Homo sapiens
  misc_feature 1..188: note = chr4:1401642-1401830
  misc_feature 1..188: note = hyper
  source 1..188: mol_type = genomic DNA
cgcgtgcaccggcgggtgtgcgcgccgccttacactgcggtccccggagcctgttccgcgcgcagggcggtcctttgcaattaccgcgggcaatgatcctttggaagcagaaattaaaagttgggagaaataatggtggaccgatcggctgtaatttgggccaagctcggacacgctgagccccaggg

SEQ ID NO: 28693 - DNA, 99 bp, Homo sapiens
  misc_feature 1..99: note = chr4:1402294-1402393
  misc_feature 1..99: note = hyper
  source 1..99: mol_type = genomic DNA
cgccagcgccagctccgcgctggtgttggttcctctttcactgtttcccgaggaggggcacaccagacactttccagattgctgcgccccctccccagg

SEQ ID NO: 28694 - DNA, 99 bp, Homo sapiens
  misc_feature 1..99: note = chr4:1403967-1404066
  misc_feature 1..99: note = hyper
  source 1..99: mol_type = genomic DNA
agtgtttgcctcgtgcgaagtgcactccaccccacacttggccccacagcctcgctgtgcacctccttgcatcggccggacgggggcggggggtgcggg

SEQ ID NO: 28695 - DNA, 411 bp, Homo sapiens
  misc_feature 1..411: note = chr4:1404120-1404531
  misc_feature 1..411: note = hyper
  source 1..411: mol_type = genomic DNA
cgcgccacggcgacccatgttgatcaccggagtttgggaagtcagaggggagccctctgctttcaggcctgggttccttctctaagatatgcccacttaggggcctgtgactcctccagaatgagtgtaccacactcgggacaccagaagcgagaggggacacaggctctgacctcgagagcacgtcagctctggagacccgcggccccagcctcgtgtgcctccgcacagggcagcttcagcactgcgaacagcgccagcaccgcggacagcgcgctcccacctcgcccccggaggccacgggctcgggccgtgttcagcaccgcggacagcgccagcaactccgagggtctcctggcctccagcccgccgtctctgacctccctgccccgccctcgactccttctcaaa

SEQ ID NO: 28696 - DNA, 172 bp, Homo sapiens
  misc_feature 1..172: note = chr4:1407948-1408120
  misc_feature 1..172: note = hyper
  source 1..172: mol_type = genomic DNA
tgaggaacgctcctgcggaagccttggagagtgattctggcgccaccgcctgcttggggccgcccgcagggagggagtcggggtgggcgcgtgtccgcgggagggagtcggggtgggcgcgtgtccgcgggagggagtcggggtgggcacgtgtccgcgggagggagtcggg

SEQ ID NO: 28697 - DNA, 41 bp, Homo sapiens
  misc_feature 1..41: note = chr4:1515026-1515067
  misc_feature 1..41: note = hyper
  source 1..41: mol_type = genomic DNA
ccgggagctgggagccgcggccacatcggtggagcagggcg

SEQ ID NO: 28698 - DNA, 42 bp, Homo sapiens; identical to SEQ ID NO: 7219
  misc_feature 1..42: note = chr4:1811789-1811831
  misc_feature 1..42: note = hyper
  source 1..42: mol_type = genomic DNA

SEQ ID NO: 28699 - DNA, 66 bp, Homo sapiens
  misc_feature 1..66: note = chr4:1864167-1864233
  misc_feature 1..66: note = hyper
  source 1..66: mol_type = genomic DNA
gtgggcagcaatggccgcgcgccctgctctgggtggtcccgaccccggggaagtccctgtgcagaa

SEQ ID NO: 28700 - DNA, 75 bp, Homo sapiens
  misc_feature 1..75: note = chr4:1864268-1864343
  misc_feature 1..75: note = hyper
  source 1..75: mol_type = genomic DNA
cgcggcacccaggcctcgctgtcttccctttcccttcgagggacctcgcgctgcaaaatccgaagagcccggctg

SEQ ID NO: 28701 - DNA, 17 bp, Homo sapiens
  misc_feature 1..17: note = chr4:2042106-2042123
  misc_feature 1..17: note = hyper
  source 1..17: mol_type = genomic DNA
tagattgtccgtgggcg

SEQ ID NO: 28702 - DNA, 91 bp, Homo sapiens
  misc_feature 1..91: note = chr4:2042168-2042259
  misc_feature 1..91: note = hyper
  source 1..91: mol_type = genomic DNA
cgagcgggcgcagcgtgggaccgaaggggagaaggacgcctgcggcccggcgcgtccccggaggcacgtcccccccagggctccgcggccc

SEQ ID NO: 28703 - DNA, 56 bp, Homo sapiens
  misc_feature 1..56: note = chr4:2042655-2042711
  misc_feature 1..56: note = hyper
  source 1..56: mol_type = genomic DNA
gcagtcccagcttgtgccgggaagaccaccggccagaaccccgggggttgggggta

SEQ ID NO: 28704 - DNA, 82 bp, Homo sapiens
  misc_feature 1..82: note = chr4:2043082-2043164
  misc_feature 1..82: note = hyper
  source 1..82: mol_type = genomic DNA
tcacgggactgaaatcggcacagagaggccgaggacctgtggtcggggctccgcgcaagcggttctccggtctccgaggaca

SEQ ID NO: 28705 - DNA, 90 bp, Homo sapiens
  misc_feature 1..90: note = chr4:2048818-2048908
  misc_feature 1..90: note = hyper
  source 1..90: mol_type = genomic DNA
ttcccctgggctgctcggcggctccccgcgcccctgttcttcctccccacggactcgggctcggggcgttcgcggcgggataggagcgcc

SEQ ID NO: 28706 - DNA, 148 bp, Homo sapiens
  misc_feature 1..148: note = chr4:2060007-2060155
  misc_feature 1..148: note = hyper
  source 1..148: mol_type = genomic DNA
cccaccccaccagggcgctgcggcctcactcccacgtccacgggcaggcccagcccctcctggccttcaggtgacctcagctgcccggctggccccaactccaccgcacaacgcagactgcgggtccccaggcctggacccctggccc

SEQ ID NO: 28707 - DNA, 115 bp, Homo sapiens
  misc_feature 1..115: note = chr4:2060173-2060288
  misc_feature 1..115: note = hyper
  source 1..115: mol_type = genomic DNA
cggggaagctctgctccggcagccctcggggtggtgctgggaggtcgcgcagaactgaagggggctaggttcgagaagcgccgaggatggggtctgcgaccgcctccccgcacct

SEQ ID NO: 28708 - DNA, 44 bp, Homo sapiens
  misc_feature 1..44: note = chr4:2061725-2061769
  misc_feature 1..44: note = hyper
  source 1..44: mol_type = genomic DNA
ccccccgctttctgccgcgccgggccccgcgcagggctggctat

SEQ ID NO: 28709 - DNA, 114 bp, Homo sapiens
  misc_feature 1..114: note = chr4:2061972-2062086
  misc_feature 1..114: note = hyper
  source 1..114: mol_type = genomic DNA
ggggaggccgcctcccgctcggtgctaatttatgaggggaagacagccggcgccgcggggggtgcgcgcgcctggcacagccggggcggtcgcagagggcggccccttcagcgt

SEQ ID NO: 28710 - DNA, 107 bp, Homo sapiens
  misc_feature 1..107: note = chr4:2418673-2418780
  misc_feature 1..107: note = hyper
  source 1..107: mol_type = genomic DNA
gagccctcaaacctccgtgccgatcttccaaacccacctcccgccttcctggaatgggcgcacgcgaggcacggatttcaggaaacctctgccgtgacagctcaccc

SEQ ID NO: 28711 - DNA, 449 bp, Homo sapiens
  misc_feature 1..449: note = chr4:2765778-2766227
  misc_feature 1..449: note = hyper
  source 1..449: mol_type = genomic DNA
tggtatgggaccctccgggtgggcgcggccccgcggggccttgcggccacaccgccaccgtgcccagcggccccatcagcgcatattcaggatgaaccccggacacgcgcccagaaccgtctggtgacccagtgatgaaagctcgaatcttataggatccgtattcatttcccgtgggctcaagcccagcctccgcgggcggcgcgggccctcgcggcgagtgtccacgaggaggcggtgtggacccgcggccccagaccaggcctcaggcagaaggcgagcgcgagcgccccgcccagcccctccccgtcccgcaacccgcgccccgaccagcgcccccagcacctctccaccctcgctctcgagcagtctccacgtttgtctcagaggagacccactttgctccccagcgtgggcccctgagcgctgggggaagttggttggtttgt

SEQ ID NO: 28712 - DNA, 584 bp, Homo sapiens
  misc_feature 1..584: note = chr4:3767309-3767893
  misc_feature 1..584: note = hyper
  source 1..584: mol_type = genomic DNA
gcgcgcccccgcctgcgcccatgcctgcgccgggggaggcgaaggaggctccagtcttagaaagagcagcttctggaactcaccacccaggccggccgccgctcggccccgtcccgcaggctgcaggcggccctggagggggcgccctcgccgagcgcgcgccccgcgccgccgccccggactcctccccggcgccgcgcgggcaggttcgaccaggcggccgcgggctccggttcccggccagctccccagggcccgcggcccgccccgccccgcgcgcccgccccgctgcgcaactcgacccaagttggaagccgatcgcaggcggccgcactcgcgcccagcgcagggcggcggcggcggcggcggcgcagctccggcgagcgaggcggcggccgcacggccaagcgtggaccgcggggggcgcccgcgcccgggagcagccggaggactcgcggcggcgccggcgccccgcccgggaaagtaaagttggagacggagggagcgcgcgggcgcgggggcccggaggagcggcggccggcgccccggcgcgccgagccctagccggccggatgggaggcgga

SEQ ID NO: 28713 - DNA, 91 bp, Homo sapiens
  misc_feature 1..91: note = chr4:3768116-3768207
  misc_feature 1..91: note = hyper
  source 1..91: mol_type = genomic DNA
cacgctcggcagctgcggggagcccggcagccacgctctccggcgcgccgcccgcggagccaccacggccgagggccggctgctgggcgcc

SEQ ID NO: 28714 - DNA, 111 bp, Homo sapiens
  misc_feature 1..111: note = chr4:3768839-3768950
  misc_feature 1..111: note = hyper
  source 1..111: mol_type = genomic DNA
ggccaccatcgtggccgtgtggctcatctcggccgtcatctccttcccgccgctggtctcgctctaccgccagcccgacggcgccgcctacccgcagtgcggcctcaacga

SEQ ID NO: 28715 - DNA, 196 bp, Homo sapiens
  misc_feature 1..196: note = chr4:3768994-3769190
  misc_feature 1..196: note = hyper
  source 1..196: mol_type = genomic DNA
cgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccgga

SEQ ID NO: 28716 - DNA, 63 bp, Homo sapiens
  misc_feature 1..63: note = chr4:3769559-3769622
  misc_feature 1..63: note = hyper
  source 1..63: mol_type = genomic DNA
cgaggcctgccaggtgcccggcccgctcttcaagttcttcttctggatcggctactgcaacag

SEQ ID NO: 28717 - DNA, 686 bp, Homo sapiens
  misc_feature 1..686: note = chr4:3873083-3873769
  misc_feature 1..686: note = hyper
  source 1..686: mol_type = genomic DNA
actggagggcgatcgcgggctccaccgggagggagcagctgtgcgccttgacgtaaaatccccaccctggctccaatggcccgcacctgccctggggtgcgccggggtgggctccgcggggacatcacgagggtgagcaacggggaggagcctcgaggagcccatcccttcggcaggtggtgggggcccggatctgggtctacgccgccccacctccctcctggccacaccgctgcggagaaggtgccgcacctgcgcgaccgctgcctggccggtctagagcccaccgcggtggagcgtcagccctcctgagtggcggttcctgtgggcgggacgcctgggttgccatggagaccgagagcccagccccgcggagccccgggtgtgcaccgggacaggaagccgaaagcagagcgggagactcgacttgcactttaataggctctcccaggagccgttgtccagagggagcggggttcgcggggctggcggggacgtggcggggcggtggaggggtgagggggaggggaaggacggcggcgggggcgggggaggtgcacggtggggccgcggggacggggcgggggcgtcgcagggcgagtgcgcgcccccactgccatccaggccgtcgcggcgcggctcgaacactcacagaggaagcacctactgtgcgccaaccctgcgcc

SEQ ID NO: 28718 - DNA, 154 bp, Homo sapiens
  misc_feature 1..154: note = chr4:3882096-3882250
  misc_feature 1..154: note = hyper
  source 1..154: mol_type = genomic DNA
gctgcgctgccagggcgctgtcaggatggcgcccagaggacgggctgctgccctggggctgcctgaggagggtccgcagaagttccctctcgagcgggaggaggggatttgcatattcacttagaaggatgaagcgctgcggggaaccttccca

SEQ ID NO: 28719 - DNA, 96 bp, Homo sapiens
  misc_feature 1..96: note = chr4:4145235-4145331
  misc_feature 1..96: note = hyper
  source 1..96: mol_type = genomic DNA
ggcggccgagtccagcgggctcggggccaggccggggtcccgcgggcggcgcctcctcctccgcggcgtccccatactcgccctccgcgtcgctct

SEQ ID NO: 28720 - DNA, 46 bp, Homo sapiens
  misc_feature 1..46: note = chr4:4145386-4145432
  misc_feature 1..46: note = hyper
  source 1..46: mol_type = genomic DNA
cgggatgtggggctagcgcggggccatgccccgccgcagcttctgc

SEQ ID NO: 28721 - DNA, 84 bp, Homo sapiens; identical to SEQ ID NO: 7234
  misc_feature 1..84: note = chr4:4228084-4228168
  misc_feature 1..84: note = hyper
  source 1..84: mol_type = genomic DNA

SEQ ID NO: 28722 - DNA, 87 bp, Homo sapiens; identical to SEQ ID NO: 7235
  misc_feature 1..87: note = chr4:4228188-4228275
  misc_feature 1..87: note = hyper
  source 1..87: mol_type = genomic DNA

SEQ ID NO: 28723 - DNA, 253 bp, Homo sapiens
  misc_feature 1..253: note = chr4:4229644-4229897
  misc_feature 1..253: note = hyper
  source 1..253: mol_type = genomic DNA
ctgccctgttgctaccggcgcccaagcgtcttcactagccccttccaaagccccggtgcccgcctggcacccgcctgctcccggaaggggactgagtctgccagggagccccgctcgggtgccgctaagtggaggtctgggaagtttcagctgaagagcgttctacgggtctggcgtggctgacaggaggcgccggaccccagccccccagccgcaggttggagaggggagttgggagcgagcctggggcaag

SEQ ID NO: 28724 - DNA, 1045 bp, Homo sapiens
  misc_feature 1..1045: note = chr4:4387460-4388505
  misc_feature 1..1045: note = hyper
  source 1..1045: mol_type = genomic DNA
gtcacctgtcaaagacggctagccctcctggggattttgaaatcagggcacccgcggcaagttcccaggctgtgcctggggctcaaggcggtggctgctcctgtgctctgggcttattcccaggattctcagacggctgatggaaaacgccccggaccctccgtagtgccgcggggaagtccccggaaagggtgtgaaaaagtatcgaatttgggtgatgcctcctcctcgtccagcgcctgacagggcccagctcctggcccaggtgcccaggaggcaccgatccccgcagccggcctcctcccgcgcgggctccactcccatttcggcctcgcccccacaccccatagtctttcatccgtgagtcctgcaggcaggacgggttggaggtctgcaaacaggaccctctctgggaagccgcgacagcggctgagctcggggtttgggggcgcaggtcgggctagaaccaccccccttctctccgcgtccgggcatcgtcccagcggcccctcctctgtgcccaggatgctcgggcggcggctgcagtgggacctccaccttctctgccaaccagagcggaggaacctttccgcctccctccaagcggcgcactgagcgctctttgcctagaacgacttccctcccgctgcctggggcagcctcaccctgggcgcccacaccccagccctgggagagcgctactccgcctcccgcaccaccgaaaacctcctcctcctttacgggccgcgcctcctttacgggccgcgccccctttatacgcggacgcgccctcttttggtcgccccctccccaacccagcactaaggagcaccctgctctggtctccgccaccacccagcgcctcctggacccatccccccaaacccttgaacgtcctcaggacccccaggtgagcgcggcgcgctgcgggcggggaccctctctgcacctccccgcacccctgggggtcgctctgtccctacggtccccgcctcccctttctcctttctaagcgcctcgcgcccaggccgccgcccggggtggc

SEQ ID NO: 28725 - DNA, 505 bp, Homo sapiens
  misc_feature 1..505: note = chr4:4388506-4389011
  misc_feature 1..505: note = hyper
  source 1..505: mol_type = genomic DNA
cagcccgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctcagctgacctgccggagccgggcgtgggtgagtgcggccggccgcgcctgggcttgccgaggccagaccttgcccgcccaggagcagtgcccgggggatgcccatctcccggagtacgcgggacggggctgtgaacag

SEQ ID NO: 28726 - DNA, 35 bp, Homo sapiens
  misc_feature 1..35: note = chr4:4389262-4389297
  misc_feature 1..35: note = hyper
  source 1..35: mol_type = genomic DNA
tgcccacttcccccccgccccgccccgggtcttgc

SEQ ID NO: 28727 - DNA, 30 bp, Homo sapiens
  misc_feature 1..30: note = chr4:4854402-4854432
  misc_feature 1..30: note = hyper
  source 1..30: mol_type = genomic DNA
ctgcctgcgggttcccggtgaccctttccc

SEQ ID NO: 28728 - DNA, 523 bp, Homo sapiens
  misc_feature 1..523: note = chr4:4854669-4855192
  misc_feature 1..523: note = hyper
  source 1..523: mol_type = genomic DNA
ctctcctgcctgggccgacccggcgctttactgcttctcacgaaggtgcgccggctgctccagaaatcgcagactgcctccaggaagaacttgctggagtcacagcagcttctcagcgacttgacagcagtgattcagacttcaacttgggcggaggggcgggggaggagaaagagatttccagagaaaacgactgagcggtagggaggggaagagagaccgagccacgcgcctcgagaagcagtgcagagagcggaagagacagaggctgcgagacctacccacagagaccaagagagacgctcggaggggagaccgccttaggcgcagagattcagaggcagacagacaggcagacagaaggatacaggaaaggaatgtcgccgaaaggcagggacaaacctgagtcccagaaaaataagagacaactcccacacaccaggctgtccgcgggccgccttgtcacagaaaggcagctccccagccccgcagagtcccgacagctgcccccgcgaaggtgggg

SEQ ID NO: 28729 - DNA, 413 bp, Homo sapiens
  misc_feature 1..413: note = chr4:4855230-4855643
  misc_feature 1..413: note = hyper
  source 1..413: mol_type = genomic DNA
cgcccctcctttccagcctcagctctggcctttctcggcatccccagcttgccttcagtttcactccatatctgggtctctcagaggcctcgggaggtcttccgttctctctgtcgccgtgtccacggaaggagcctccccaaccctctgtggctccgcgcctcttgggccggagcatctctgtcttccggagtctcttgatcattgctcctgcccgtcctcgcccatttcaaagacgaccaacagaggcttagaaaaattggccctccaccctcggctggttacctggctcgtagccctgggtctgttttcttctcagagagacctgagatcctcgacatttcctaaattcatggaaaacctcgacagtgttcaggactcccaaagaaggtggtgggcgggagggggaggag

SEQ ID NO: 28730 - DNA, 171 bp, Homo sapiens
  misc_feature 1..171: note = chr4:4858696-4858867
  misc_feature 1..171: note = hyper
  source 1..171: mol_type = genomic DNA
tctgcctattaggcgcgctgaggaatcgtgacacattgtttatccccgcaattagcgatgcggcccttttcaggccgcccgcccccgggccccccgcccccccccccccccccgcggcggagtccaggccttgctgcgctcctcaactgcgaccgccgcaagttccacact

SEQ ID NO: 28731 - DNA, 226 bp, Homo sapiens
  misc_feature 1..226: note = chr4:4861342-4861568
  misc_feature 1..226: note = hyper
  source 1..226: mol_type = genomic DNA
ccgccccgctggcctcgccttattagcaagttctctggggagccgcggtagggcccggagccggcgagtgctcccgggaactctgcctgcgcggcggcagcgaccggaggccaggcccagcacgccggagctggcctgctggggaggggcgggaggcgcgcgcgggagggtccgcccggccagggccccgggcgctcgcagaggccggccgcgctcccagcccgcc

SEQ ID NO: 28732 - DNA, 183 bp, Homo sapiens
  misc_feature 1..183: note = chr4:4861780-4861963
  misc_feature 1..183: note = hyper
  source 1..183: mol_type = genomic DNA
ccaaagtgtccccttcgctcctgcccttcagcgtggaggcgctcatggccgaccacaggaagccgggggccaaggagagcgccctggcgccctccgagggcgtgcaggcggcgggtggctcggcgcagccactgggcgtcccgccggggtcgctgggagccccggacgcgccctcttcgccgc

SEQ ID NO: 28733 - DNA, 280 bp, Homo sapiens
  misc_feature 1..280: note = chr4:4862165-4862445
  misc_feature 1..280: note = hyper
  source 1..280: mol_type = genomic DNA
gctcctggtggcctccggcgcctgcgtacctgcagccggtgctagggagccgtgggctgcaaggccgggtcttgcgcctccctccactcccacccaggaagaaggttccagacctcctcgccttggcccagagacgctgcgggtgggagttaacggataggacaccgatgtctgggcaccctgtcctcctgcccccaccaaacgacctcaggggtccatgatccctcatctgatcccaaactctgtttcatcggcttcaccccagcggatgaatgtgtgt

SEQ ID NO: 28734 - DNA, 311 bp, Homo sapiens
  misc_feature 1..311: note = chr4:4862799-4863110
  misc_feature 1..311: note = hyper
  source 1..311: mol_type = genomic DNA
tctactcagagaacacgctcggagatatttcaggagcacgggaaattcccaagttttcctcgtttcctccgattattttgctcggcataatagcagccagatttcaatggcgtgatgctgaggaatgatttttatctggggattaaacgtctttgaaaggccagtccctccctaagcctaatggccggagaaggtggccccgctctgggttgtcgccgctgaagggagtgacgtttctctcggcgcccgcccctcgggcggcccggcggaaagctagttgggggccaagcgcttcccggactcccggtggc

SEQ ID NO: 28735 - DNA, 185 bp, Homo sapiens
  misc_feature 1..185: note = chr4:4867591-4867776
  misc_feature 1..185: note = hyper
  source 1..185: mol_type = genomic DNA
agagcaacataattgcggtaatgagcaacggctcaccctctgcagacgcgtcgcggctccagcgaggcggtagctgcaggcgaggcgggcgcgcctccccgccccctccctgcgccgcagcccgggtgcgagggcccggcctccctgggaccccggcccgcgcgcgcctccgcctctggctgctg

SEQ ID NO: 28736 - DNA, 30 bp, Homo sapiens; identical to SEQ ID NO: 7247
  misc_feature 1..30: note = chr4:4868050-4868080
  misc_feature 1..30: note = hyper
  source 1..30: mol_type = genomic DNA

SEQ ID NO: 28737 - DNA, 248 bp, Homo sapiens
  misc_feature 1..248: note = chr4:4868545-4868793
  misc_feature 1..248: note = hyper
  source 1..248: mol_type = genomic DNA
ataggggcgtctcaccggccctgcacgctgtgaaagcgttttcgttttgttggggaggagacggaagcctcattttgcaaattcagcttctgaccacgcagtcaagaccaaagcagtccgtggcgtggaagcggggcagaaatgaggttacctggcggcaagggacctggggcgcctcgagctttgagcataggtccgcagggccggggcggttggggaccgggaggctggggtggggctgaagacct

SEQ ID NO: 28738 - DNA, 172 bp, Homo sapiens; identical to SEQ ID NO: 2363
  misc_feature 1..172: note = chr4:4868828-4869000
  misc_feature 1..172: note = hyper
  source 1..172: mol_type = genomic DNA

SEQ ID NO: 28739 - DNA, 127 bp, Homo sapiens; identical to SEQ ID NO: 2364
  misc_feature 1..127: note = chr4:4869131-4869258
  misc_feature 1..127: note = hyper
  source 1..127: mol_type = genomic DNA

SEQ ID NO: 28740 - DNA, 61 bp, Homo sapiens
  misc_feature 1..61: note = chr4:4870173-4870234
  misc_feature 1..61: note = hyper
  source 1..61: mol_type = genomic DNA
aatcgcctgagggaacgctgggagttcccccccccacccgcccccgcgcaagaacagccag

SEQ ID NO: 28741 - DNA, 44 bp, Homo sapiens
  misc_feature 1..44: note = chr4:4871340-4871384
  misc_feature 1..44: note = hyper
  source 1..44: mol_type = genomic DNA
tctagtgctttgagtcgctgtttctctgacgatgctgcttttaa

SEQ ID NO: 28742 - DNA, 149 bp, Homo sapiens
  misc_feature 1..149: note = chr4:4871883-4872032
  misc_feature 1..149: note = hyper
  source 1..149: mol_type = genomic DNA
tccaactcagacagccggtgccaccatctggcgcccctaaatctcagttccctggtccgcggaatgggaacactttcgggctggtgcagaggaaactatgggtgactccaaaggcagcgcgcggtaagaactccgggtgagaaggggag

SEQ ID NO: 28743 - DNA, 108 bp, Homo sapiens
  misc_feature 1..108: note = chr4:4872059-4872167
  misc_feature 1..108: note = hyper
  source 1..108: mol_type = genomic DNA
cggagcatagaggcaggatggtgacctgagcgctctttgctggccggctctgctctccgcagcgccattggaattccttactctccagtcccccgagggtgtgtgtgg

SEQ ID NO: 28744 - DNA, 97 bp, Homo sapiens
  misc_feature 1..97: note = chr4:4873139-4873236
  misc_feature 1..97: note = hyper
  source 1..97: mol_type = genomic DNA
cgaggtagaaggggccgcgtgcccttgtaggagagggaagtgtcaatggccgggaccaggggtggctgcctgagacgtgcctcgtctttggtgattc

SEQ ID NO: 28745 - DNA, 1184 bp, Homo sapiens
  misc_feature 1..1184: note = chr4:5052921-5054105
  misc_feature 1..1184: note = hyper
  source 1..1184: mol_type = genomic DNA
ctacctctagacctccgtctactgcgctctaaaatatgaacgatgctttcttactgctgggttgtcggaggcggatgtgggatggtgctaacaaagcgcgtagccgaggcctggccatagtgggtgctgacaaaccgcttactgcctgcagggaccgagctcccggccgagggaggagggccgagcagggattcagattcttccgggccgatccctttctcagctccttccgccctgccgccgcccactgcgtgctgccttcgtccgtcccctcctcccccgctccttcccctccttcccctgctcccgcgccgcctcgcgtctcccgcccgctgtagccggcgaggagcgccgcacgttggccccggcgcgaggagctcccgggttcccgggcgggcactggagtaaggagctgcgagcgcagcccgaggcggggcacggcggaaggcgcggcgagagcggggtccctgcgagcgcagtcggaagggcgtccaggagaagggggacgccgtccccgcccctgcacggtgctcggccccctcgggctccgcgcgcggctacaacccggactgggcgcgcccccggcatcccgcatctctgcgcgcgtcccacatcccgcatccggcatcccagcggccgggcatgtagcagcggcagcaacggcggaatatgggcgggaaccactcccacaagccccccgtgtttgacgagaatgaggaaggtaagagagcgagaggtgcgaattcccgcttcgcggggcatccccttcctccaccaccctcggccgagccctgcggggcaccgcatgctgcccggcgcggggacccaggcatggccacttcgcccagcgaatgcagtgtgtgcccgacccgtgccaggcgcggcgcttctgctgaggcaactcctaggtacccagtgccgtttagtagtcgggacggtgcctagcgcgggactggggaggcggcttcagagagttgaacccgaaacctgcacttgggggtgtggaagggaggagttgacttcggaggccagtcgggatggttctaggctcgggctccccaggaaaccgaggtttccttgagagcctgaggctgacggaggtggcctggaagggcgggttgcaccgtgtgtctgtgtgtgtgtgcgcgtgcccacgacgcatttggtctcgtgcaagggcctgt

SEQ ID NO: 28746 - DNA, 79 bp, Homo sapiens; identical to SEQ ID NO: 7255
  misc_feature 1..79: note = chr4:5709906-5709985
  misc_feature 1..79: note = hyper
  source 1..79: mol_type = genomic DNA

SEQ ID NO: 28747 - DNA, 341 bp, Homo sapiens
  misc_feature 1..341: note = chr4:5712891-5713232
  misc_feature 1..341: note = hyper
  source 1..341: mol_type = genomic DNA
gctgaaagttttgagcggtgatccaggctcctccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcct

SEQ ID NO: 28748 - DNA, 1490 bp, Homo sapiens
  misc_feature 1..1490: note = chr4:5889116-5890606
  misc_feature 1..1490: note = hyper
  source 1..1490: mol_type = genomic DNA
tgggctccagtggtccgcatccctcaggaacagtcaggctccacgctgatgccaggcaggaactggggcggagggccagctcctgaccgctgcgccctcagctccccaccccgagacaaagcgtaaagacggggattcctttgtttccggccacacccagggacgcagcccggctgttctgcctccaccaccgtccccaccctctcgcggcccagcgtcgggaacattaacccttcccgggccgcagccgccagcgtcgccccattaggttatttttagctgcggggaggggtggaccgagcttccatcatggcgctgtccctaggtccggacttccactccatcagtaaaggcggggagtggggagcgctggatgatctttttccctcctccagcgggggaggtaccgggctgtggggtgcatgggccggacggtgcgggggccgagccaaggaggctcagctcaccctcccacccccgcgcgaggcctgcggggagggggttcggacccctgcccctccctcttttgttcggctccgcatcctccctgtccacgccatcctctggcacatcccgtggggggagggggcggcaagcccgcggggagagggactcccggctccagccccgccccgccatgcggggctcccccacccccattgtccccagaggctgggggagggggctgaaatcccgagaccggccccgccccacccgcggcgacgcaggaggcctcggggggcgcccctgccggcgccccgtggatctggaccctgccgggcgcccactcccagcccacaaaggccagcgcggggcggcgggggcgggggccgcttaccgtgatgtgcgggatgctcttcttgccctggtacgacatggccccctctggcgccctcggcccggccgctgacctgcggggctgtctgactggaaccggcgctctcggccccgctcccagcgggcgcgctgacaaaggcccgggagggatagagacacggacggaggctcggcgcccgtggatgcccacgcgcggctgccccggctgctcggcccgcccgccgccgctccggctgccagcaccgcccggatcggcgaggagggcgggagaaggaggagggagaggcgagggcgggaggagggggctgcagacagctcctcccggcggcgcggagcgaagccggattcgcccctctcggctcgaaccaggaagcgcttcccttccgatctcccaccccgccccccgccccccacccgcccagccccgccgacccccgccctgcgcacacgcccttggcgggccctggcctcgctctcgcgatccagagagtatggttttcagggctcctttaaaagaaaaagacggcgcggtcagggcccgcgggcggcgccacaggtgtgtggccgcgcgtctggaggcctccccggaacatctgcgggggtgtggggggagggagtgtgggacgggggccaaggatcggcccaagctgctg

SEQ ID NO: 28749 - DNA, 116 bp, Homo sapiens; identical to SEQ ID NO: 2367
  misc_feature 1..116: note = chr4:5891966-5892082
  misc_feature 1..116: note = hyper
  source 1..116: mol_type = genomic DNA

SEQ ID NO: 28750 - DNA, 120 bp, Homo sapiens
  misc_feature 1..120: note = chr4:5892109-5892229
  misc_feature 1..120: note = hyper
  source 1..120: mol_type = genomic DNA
cgcagaaacccctcctgcagcccagggagaagcctggtgggcggggggggaagggccggggcacccgttgcgaagccctggagcggtgaggcccgccccggaacccgagcccactgtaac

SEQ ID NO: 28751 - DNA, 30 bp, Homo sapiens
  misc_feature 1..30: note = chr4:5892597-5892627
  misc_feature 1..30: note = hyper
  source 1..30: mol_type = genomic DNA
cctagtactccaccacgctttgaggaaggc

SEQ ID NO: 28752 - DNA, 237 bp, Homo sapiens
  misc_feature 1..237: note = chr4:5893517-5893754
  misc_feature 1..237: note = hyper
  source 1..237: mol_type = genomic DNA
tcaagagagaatacccgcagggcccaagccctagcgttccctctccctgatcctcccggccccatgctcaggtccgggaggccagagaccccagttcaaatcccagctctacctccaccttgctctgtgaagcaggcacatcggtgtgtgctgtggagctcaggagtgccccttgaatctactggcgcttgagggtaggggtttacggctccaactgcccgacgaactaaatcctta

SEQ ID NO: 28753 - DNA, 102 bp, Homo sapiens
  misc_feature 1..102: note = chr4:5893981-5894083
  misc_feature 1..102: note = hyper
  source 1..102: mol_type = genomic DNA
ccagaggttccttcgcgtttaagcgtccatgcggtagctttagccaacttcccctctcagaacctctctccctttctgtagaagaggagccgggactggacc

SEQ ID NO: 28754 - DNA, 300 bp, Homo sapiens
  misc_feature 1..300: note = chr4:5894812-5895112
  misc_feature 1..300: note = hyper
  source 1..300: mol_type = genomic DNA
cggcccagggaggggaggggcggggcgtggcgcgcgccggggcggggccggggcggggcctctgggcggctgcgggctagcggcgcggccagctacaaaggaccaggaggcggggatcgcggctggggcggggagggacggtgacgctcccgagccgcagcgcggagggcgggccgcggcaccgcagtgccctcgccgcaccccccactctccgcccccaggcggagcgcagggcgcgaggagagcgcggggcaggagccgtgtgcgtacactcgcgcgcccacacgctctggaggcaca

SEQ ID NO: 28755 - DNA, 465 bp, Homo sapiens
  misc_feature 1..465: note = chr4:6200828-6201293
  misc_feature 1..465: note = hyper
  source 1..465: mol_type = genomic DNA
cagctgaagttagggcgttcgcggagagagcacagcactggcaaaggccaaggacagtgtgcctgcgagtgtgcgcagatggggcgggcggcggaggagggctggcggttagatacagtatcgctggagctcagagagccgggcagaggctggcggagagccgaggctggcccagccttcaggagaccggcgagctggggtgtgtgggagcgggatgcttctaaggcgaaaagaagcgccagcctcgtaagcggcctctatctgggctgcccaggccggatgctcaggagcccacagcaggggggatggagcgaaggaccgaggggctgggaggcgaggccgcagcgcactgacgcaggccagcgaggccgctggccccgacgcagggcgcccggcaaggtgtctggcaccacgagagtcaatccttgcgcgccatctccggaggccagtgcgcccagggcgcgc

SEQ ID NO: 28756 - DNA, 299 bp, Homo sapiens
  misc_feature 1..299: note = chr4:6201349-6201648
  misc_feature 1..299: note = hyper
  source 1..299: mol_type = genomic DNA
cggcgcccacgtgggcggagcagcgcgagggtgtgcgtggcaggggccgcggcggcgtgtgccgtgcgtggggtggggtgcgggctgggcggcctcgccttcgggccccgcgccgccggggcgcggcccccagctccatcttctttgccacctgggcggagatctgggggactgtgacctaccctgcggaagacacggaggggacgggccggccacaccccccgcgccactccggcaggcaccgggtgggtccccctcccgctccttggcttgagggcggaatccggagaagagtggaa

SEQ ID NO: 28757 - DNA, 763 bp, Homo sapiens
  misc_feature 1..763: note = chr4:6201895-6202658
  misc_feature 1..763: note = hyper
  source 1..763: mol_type = genomic DNA
gccaggtccgcccctcggtcgccgggtccacgggttccctctggccagcgctcgcctcccgccccccggcgcacctgtacccacctgctcggcgctcaggcccgagccgggcagcagcagcggacgtagcgagcgcagccccgcgccgcatcctccggccgccccctccccgctgcgagcttacgccgctgtcgccgccgccaccgccttaaaaaggacaaaacggaacagaaaatgaatgcatgcacaaaaaaaatcgtaaaaagcaattgaggaggatggcagtcgcgcgcgcggctcggcggggcgggagtcgagaggccgcggcactggtggccgcgatccgggcaggcggccggcgcgtgccgcacgcgggtggctgcagctccctcggtcgcccgcgcccggctcaggcacggcaccgcccctccccccggggagcccctccgattggtctgtcttcctgccagtcaggcaggagggcgcggcgcccgccccgccccgcccccgcccccgccccgggcagatgccgggagctctcctgccgccgtgggagggggagctgagctgccggagcgtgcgcactgggccagcgggcggccggggcagggctggggtcccggcgctgagcgcccccagccgcgccgggcagcctggcgcctcgctgagtcggagcaacccccggcaggagctttcaggctctggtcaagcctcgggacccgggaagctatccctgccctcgggggctcgagcctggagtggg

SEQ ID NO: 28758 - DNA, 73 bp, Homo sapiens
  misc_feature 1..73: note = chr4:6223724-6223797
  misc_feature 1..73: note = hyper
  source 1..73: mol_type = genomic DNA
cagccccgggctgctcggaaaggccggagtccggagcacagcaacgcgcggagcggcccggcccctctggtgg

SEQ ID NO: 28759 - DNA, 35 bp, Homo sapiens
  misc_feature 1..35: note = chr4:6224121-6224156
  misc_feature 1..35: note = hyper
  source 1..35: mol_type = genomic DNA
gtgctgaaggagccacgccccgggctccggagcct

SEQ ID NO: 28760 - DNA, 518 bp, Homo sapiens
  misc_feature 1..518: note = chr4:6247199-6247717
  misc_feature 1..518: note = hyper
  source 1..518: mol_type = genomic DNA
ctcgggtgtgggggtcgcccgcgctcctgggagccgagcaagggcgcgcaccccgcagtgggagaggggcttcctgcgcagcgcgggaggagcttccaggacgggagctgtctggggcagagccctggctacggtggcctcgcagcacagcgaaagcacagggactgcgcagtcgggaggcgcttgctctccgtgcagacccccgggtgcgcggccgcagtgcctgcagccatcgccctacggggcctcgcgactcgggcatcgcccctgctctccaggcaggactagagcttccagaaagtcccagggcacccctcgcgcatcccaggggccaggcgggcgctgcaaagcctgctgggaggtgtagttttcgctgaagacggggctgcccagagccaaagcagggtgggctccagagcaagaagccatcgtggacgcggcgtctgcgggaggaaagcagctccttctggcttcgcgaaggccgcctagtccaggagccccagcgcccttctcccagc

SEQ ID NO: 28761 - DNA, 30 bp, Homo sapiens
  misc_feature 1..30: note = chr4:6472398-6472428
  misc_feature 1..30: note = hyper
  source 1..30: mol_type = genomic DNA
gcagaaaccacatcccggacccacgctgat

SEQ ID NO: 28762 - DNA, 100 bp, Homo sapiens
  misc_feature 1..100: note = chr4:6472882-6472982
  misc_feature 1..100: note = hyper
  source 1..100: mol_type = genomic DNA
actggggcacccacccggggaatccgcgcacacttctgcggccgggccgccagcccgtgggttagcggctgacagtccccgcactcgggcagggctccag

SEQ ID NO: 28763 - DNA, 172 bp, Homo sapiens
  misc_feature 1..172: note = chr4:6473792-6473964
  misc_feature 1..172: note = hyper
  source 1..172: mol_type = genomic DNA
acatcgcgcggtccaaaccttcggagggcattcggtgcgacggcatccccacgccgcggccggccggaggggtctcagacaacacgtacgttaccttcagtcacatagctgtggtcccgcaggaagctgtggttaattttccgcgtgtccgtgtcctcgcccattgaaggcc

SEQ ID NO: 28764 - DNA, 277 bp, Homo sapiens; identical to SEQ ID NO: 7269
  misc_feature 1..277: note = chr4:6473965-6474242
  misc_feature 1..277: note = hyper
  source 1..277: mol_type = genomic DNA

SEQ ID NO: 28765 - DNA, 40 bp, Homo sapiens
  misc_feature 1..40: note = chr4:6474447-6474487
  misc_feature 1..40: note = hyper
  source 1..40: mol_type = genomic DNA
ctgcaccgccgtgctcgggccctcgcggtgggcaccttgg

SEQ ID NO: 28766 - DNA, 136 bp, Homo sapiens
  misc_feature 1..136: note = chr4:6564642-6564778
  misc_feature 1..136: note = hyper
  source 1..136: mol_type = genomic DNA
tcttcgggctctgggcgcgccactgtcatggactgtccctgccagccaaaaaaaaaaaaaaaaggcttctccaaaccagagcagcagccgggcctgactcagcacccaccggcgcgggcagcgggaggagcgcgta

SEQ ID NO: 28767 - DNA, 97 bp, Homo sapiens
  misc_feature 1..97: note = chr4:6565004-6565101
  misc_feature 1..97: note = hyper
  source 1..97: mol_type = genomic DNA
gttccctcaagaccccgagagcacgcgctccggagggaccccggcacttcggaccctagcagagccagccctgccccaggaccgccccggggtcggt

SEQ ID NO: 28768 - DNA, 161 bp, Homo sapiens
  misc_feature 1..161: note = chr4:7194377-7194538
  misc_feature 1..161: note = hyper
  source 1..161: mol_type = genomic DNA
cgcaccgggggccctcgcgcgcctcgaagggccccggccccaccgcccgagccccgagccccggggctccgccgccgccgcgctcgccgcgctcgcggccgctcctgctgctgctgctgctgctgggcgcctgcggggcggcggggcgctcccctgagccc

SEQ ID NO: 28769 - DNA, 93 bp, Homo sapiens
  misc_feature 1..93: note = chr4:7194789-7194882
  misc_feature 1..93: note = hyper
  source 1..93: mol_type = genomic DNA
cgtgctcaagggggacgcgacgcacaaccaggcgatggtgcactggacgggcgagaacagcagcgtaagtgacctccacgcgctcgccgcggc

SEQ ID NO: 28770 - DNA, 30 bp, Homo sapiens; identical to SEQ ID NO: 7272
  misc_feature 1..30: note = chr4:7195153-7195183
  misc_feature 1..30: note = hyper
  source 1..30: mol_type = genomic DNA

SEQ ID NO: 28771 - DNA, 30 bp, Homo sapiens
  misc_feature 1..30: note = chr4:7195419-7195449
  misc_feature 1..30: note = hyper
  source 1..30: mol_type = genomic DNA
ttgagctcttgctgccggtcgccccgcctg

SEQ ID NO: 28772 - DNA, 290 bp, Homo sapiens
  misc_feature 1..290: note = chr4:8201139-8201429
  misc_feature 1..290: note = hyper
  source 1..290: mol_type = genomic DNA
gggctccggggcaggcggggcgtggactggccgagcaggctgctgtctgccagtcttgccatggttggatctttacactttcttgaggacttttctgacctgtttgggatgggggtggagcgaaactgcgagctgggggcctcggggaggtcgtcggcaccctcagcagaccccactcagagctcacaggtgctggcagtgccaatccgcagtgattgagggcaatgatttcagctttgaccaagcacccttgcttctgggacctggcctgaccccgtgctggcccttgg

SEQ ID NO: 28773 - DNA, 289 bp, Homo sapiens
  misc_feature 1..289: note = chr4:8271325-8271614
  misc_feature 1..289: note = hyper
  source 1..289: mol_type = genomic DNA
agtcccaaggcctgccgggtgggtccaggcccggaaggccaggcggggccctgtcggggcctgggcggggctggcggaggggccgggccgccccttccagcgagggcgggctgggcggtcgcctttaaaggcgcgggacccgccgcccgcggaccgtcaggctggagggagctggtccctgcgctccctgcgccctggggatgcccctgccgccctgacgcccgccagcctgagccaccggcgcatgtgaccgcgcgtccgccccagtcccatccgtaggcgcccggcg

SEQ ID NO: 28774 - DNA, 70 bp, Homo sapiens
  misc_feature 1..70: note = chr4:8582115-8582185
  misc_feature 1..70: note = hyper
  source 1..70: mol_type = genomic DNA
tataagccaccaggtcgctccagtttggtgccagcgcctggagggagaggcgtggcgagggctgtgctgc

SEQ ID NO: 28775 - DNA, 39 bp, Homo sapiens
  misc_feature 1..39: note = chr4:8594420-8594459
  misc_feature 1..39: note = hyper
  source 1..39: mol_type = genomic DNA
actgtaacccgactccggcatttgcgtttggggcgccct

SEQ ID NO: 28776 - DNA, 137 bp, Homo sapiens
  misc_feature 1..137: note = chr4:8690019-8690156
  misc_feature 1..137: note = hyper
  source 1..137: mol_type = genomic DNA
tatttggttctttcccgtcccttccccggaggcctggcctgcagctccccgcaaggccactgcgtggcgccctgtaccccaggcgggacggccggcgccgagcccaggattcgtccacgcctcgcgcagtggagctt

SEQ ID NO: 28777 - DNA, 254 bp, Homo sapiens
  misc_feature 1..254: note = chr4:8858794-8859048
  misc_feature 1..254: note = hyper
  source 1..254: mol_type = genomic DNA
gcggaccatctcaataacaaaccgaaactctggctatctccaggtagtcgaacttgggatgccttttgttttcagtgcttgtaattttctgaatttttaaaataacgaacagagtctccttgcgacattaaatgcaatgcagccgccgaggaagcgtcggggacagatggggttggacgccgtccccacttcctcccctgcagccgcctccaggccgccaacctcgcccagccggagcctcagtcctggagggt

SEQ ID NO: 28778 - DNA, 557 bp, Homo sapiens; identical to SEQ ID NO: 351
  misc_feature 1..557: note = chr4:8859381-8859938
  misc_feature 1..557: note = hyper
  source 1..557: mol_type = genomic DNA

SEQ ID NO: 28779 - DNA, 108 bp, Homo sapiens
  misc_feature 1..108: note = chr4:8860445-8860553
  misc_feature 1..108: note = hyper
  source 1..108: mol_type = genomic DNA
ctgagctccaggcaacgaaaaacgaaggtcctggagtcggtcctgagtgcattcctccactgggccccgtcgagaatgaaactctcggagcatcgtcactgggaggtc

SEQ ID NO: 28780 - DNA, 98 bp, Homo sapiens
  misc_feature 1..98: note = chr4:8861448-8861546
  misc_feature 1..98: note = hyper
  source 1..98: mol_type = genomic DNA
agtcgcactgggacccgaatgaggacatccccccgccccttcgtcatcgtgggaataccgtggaacaaggcgggcaaagggctgatcagctcccgtcc

SEQ ID NO: 28781 - DNA, 148 bp, Homo sapiens
  misc_feature 1..148: note = chr4:8861605-8861753
  misc_feature 1..148: note = hyper
  source 1..148: mol_type = genomic DNA
cgggcagtggcccacggctctgggcccggatctgtgtccacctctggatacccaattcccgccaccatgttgttgggagcaaggaggcacaactgcccgtggtgggagtggagggcttaggtccccattagaaccggcagagccccga

SEQ ID NO: 28782 - DNA, 265 bp, Homo sapiens
  misc_feature 1..265: note = chr4:8861918-8862183
  misc_feature 1..265: note = hyper
  source 1..265: mol_type = genomic DNA
cgccaaatggaagtgggggcgccccctggcctttcctatacccggggccaaaaccgctgggaccgatatactgcaggagtccgggcacaggctgaggggaccggcccgtgcgttgagcgcctcggaggtgctccgggtcatggtgggtgctgagcgggaacacggaaggctgtgtacacagcagcaagcaatgcacccgcgctcccgtcattacatcgcgccgccttcacccccgctacgatgaccactccgcagatgggcaaga

SEQ ID NO: 28783 - DNA, 419 bp, Homo sapiens
  misc_feature 1..419: note = chr4:8862393-8862812
  misc_feature 1..419: note = hyper
  source 1..419: mol_type = genomic DNA
ctccgctctagccttcgggttaacaccgcttccttccagaagcctaaggaggcccgggcggatcagacgcctcccttctccgcagccccatgccctgcccgcagcttgagctcaccgcccttctcggggtggcggtgcggagaccggacggctccactgtgcagaccccgaggggtaaggggccgggtaggggaggggagcgagaagtggcgaggtgagaactgaggggcgaggctgaaggctgagccagacttccagacgccagagagacgccaggtgagccgggcgggggcgggggcgagggcgggggagggggcggggccggaaccgcggggagggggcggggcgcccgggagggccgcgagctgggaaggtcccgggcggccggagacggtgaagaggcggggccgagtcgcgtc

SEQ ID NO: 28784 - DNA, 197 bp, Homo sapiens
  misc_feature 1..197: note = chr4:8863330-8863527
  misc_feature 1..197: note = hyper
  source 1..197: mol_type = genomic DNA
ggagccccgggggcacggccgaggctgcgcttcaggagtgtccgccaggcgccttcccgggcggttggcgaaacccgaggaggcccacagctctggcctggggcgccgtcgttccaggggcctctgcgcctctctctggcgtctgtctggaccctcagagccccgggatcaaggcgcccatcctcttgatggcgggg

SEQ ID NO: 28785 - DNA, 79 bp, Homo sapiens
  misc_feature 1..79: note = chr4:8863856-8863935
  misc_feature 1..79: note = hyper
  source 1..79: mol_type = genomic DNA
ggaggccgggaaagctgcgtggaaaagaggaagggttaagactgaaatcattctacagagaccacgttaatgggtttaa

SEQ ID NO: 28786 - DNA, 90 bp, Homo sapiens
  misc_feature 1..90: note = chr4:8864526-8864616
  misc_feature 1..90: note = hyper
  source 1..90: mol_type = genomic DNA
cgtttgctccccaggcggtgaggctggctcttcgaccacttagctgttctcggcgcccgatcctgtgtgtccttccgtgcatgacacgca

SEQ ID NO: 28787 - DNA, 190 bp, Homo sapiens
  misc_feature 1..190: note = chr4:8864930-8865120
  misc_feature 1..190: note = hyper
  source 1..190: mol_type = genomic DNA
gcgggtggaggagggcgccggggagcctcagtgccaccgtgctccagaattcctgcccctctcagaaccccggtttccctttccaacaagttgcaaggtggggcggaaggccacgaaagactcttgggggagaggcactgacagaaagggaaagagaagcccacccggcctctcccgcctccctggtgct

SEQ ID NO: 28788 - DNA, 136 bp, Homo sapiens
  misc_feature 1..136: note = chr4:8868710-8868846
  misc_feature 1..136: note = hyper
  source 1..136: mol_type = genomic DNA
agggacggcacccagcgcagcttgagctgtctctgccctcgtgatcacaaagcagtgaaactgtccagaaaatgtccctttttattccatacgcaaataagtagattcatttaaaaaaacaacaacccggaggctg

SEQ ID NO: 28789 - DNA, 340 bp, Homo sapiens
  misc_feature 1..340: note = chr4:8868931-8869271
  misc_feature 1..340: note = hyper
  source 1..340: mol_type = genomic DNA
cgcgagaggggtagcacagccctccgggccggcctgctgtctgggtcccaggaaagggacgtttagtgttgggggcagtctgtggggacagtcaccgctcagccttggacagccggttcgtagttttcctttgttgcgctgggcttggcctgagggcagctgccccgggtggccatggccgaccgctcctcgctgaggccggggggtggccgtggcgccgggggctgcgcagcccagagtctctgcatggccccctgttcgagtggggatccagcctggcaaatgggtggggcgtcccattacattctagaggcgctccccacagaagctgaggcccgcc

SEQ ID NO: 28790 - DNA, 477 bp, Homo sapiens
  misc_feature 1..477: note = chr4:8869368-8869845
  misc_feature 1..477: note = hyper
  source 1..477: mol_type = genomic DNA
cgtccacacaggtccacagggtcgtggggagagggcccggcaggcggggctcacaccaggccaggcatctgcgcccgcagaaagggcacggaggcggcggccgggaaggcggccagcgggtaggcgagggccccggagaagccgagcagcggtgggggcggcgcgggcgcggcgggcgccagcgggaagggcagggtggccgggggcccagcggcggctgcggccggggggctttcgtggtagagcaccggcacgcggaccaggcgctgcgctcccggcggggacaggctggccgcctccagctcggctgccagctgccgcttccacttgttgcggcggttctggaaccagatcttaacctgcgtctcggtgagctgcagggaggcggccaggccggcgcgctcggcgctgctcaggtagcgcttcaggtcgaaggtggattccagctggaagacctggctgcgggagaagactgtg

SEQ ID NO: 28791 - DNA, 30 bp, Homo sapiens
  misc_feature 1..30: note = chr4:8870046-8870076
  misc_feature 1..30: note = hyper
  source 1..30: mol_type = genomic DNA
gtctccggtgagtcccggtcgctggctgca

SEQ ID NO: 28792 - DNA, 349 bp, Homo sapiens
  misc_feature 1..349: note = chr4:8872724-8873073
  misc_feature 1..349: note = hyper
  source 1..349: mol_type = genomic DNA
cctgcaaaacctcctcgttagcggagctcctgccccagagggtgggcctccaaaccagcccaaccaggggctcctgggggccccacaaggcccagacgccgttccacagaagggagaggatggcccagaacgggcggcgacgagcccgaagtcccccagcaaatgcgcagggaggaagtcgggccccaccgcctgacccaccctccccgcgccctcactcactgtcaggactgaggccgcctccatagccaccgtgcgcccgtgggtaccagcgcgctgcgcctccgcagcccagagcgaagggcggcccgggaccggggggcggccgaggaccgaggcccagcgcgcc

SEQ ID NO: 28793 - DNA, 211 bp, Homo sapiens; identical to SEQ ID NO: 7286
  misc_feature 1..211: note = chr4:8873773-8873984
  misc_feature 1..211: note = hyper
  source 1..211: mol_type = genomic DNA

SEQ ID NO: 28794 - DNA, 59 bp, Homo sapiens; identical to SEQ ID NO: 7287
  misc_feature 1..59: note = chr4:8874476-8874535
  misc_feature 1..59: note = hyper
  source 1..59: mol_type = genomic DNA

SEQ ID NO: 28795 - DNA, 172 bp, Homo sapiens
  misc_feature 1..172: note = chr4:8875756-8875928
  misc_feature 1..172: note = hyper
  source 1..172: mol_type = genomic DNA
ctggccaccaccaggcgggtggtggccctgagcgcataacgctcgcgggtgtcttcccactgcctctggggggcgcgcatgagaggggcgcttccacacactgccgcgtggggcctgggatgggagcgaagaggggcggtggatccgaagcgaggaccgtgcacccttttcc

SEQ ID NO: 28796 - DNA, 128 bp, Homo sapiens
  misc_feature 1..128: note = chr4:8878547-8878675
  misc_feature 1..128: note = hyper
  source 1..128: mol_type = genomic DNA
gtctcgagacattctcgttgtcttagtctgatccccacgtcgcagccagcaggaaatgtccttgcagctgtggagatgtggatcggaactagggcacctcactccagctcagccgctggcccactaag

SEQ ID NO: 28797 - DNA, 103 bp, Homo sapiens
  misc_feature 1..103: note = chr4:8879491-8879594
  misc_feature 1..103: note = hyper
  source 1..103: mol_type = genomic DNA
cctggagcctggaaccgccggggccagctgagaagccgcctccgccgctggagtccctgggaagggtcccctccacctgcccacagccagcctgggaggcaga

SEQ ID NO: 28798 - DNA, 61 bp, Homo sapiens
  misc_feature 1..61: note = chr4:8893403-8893464
  misc_feature 1..61: note = hyper
  source 1..61: mol_type = genomic DNA
gctccatcctatccgcggacagaaacgaatccgagccgcagctgcacgtttgaaccccgca

SEQ ID NO: 28799 - DNA, 216 bp, Homo sapiens
  misc_feature 1..216: note = chr4:8893815-8894031
  misc_feature 1..216: note = hyper
  source 1..216: mol_type = genomic DNA
cgaagctgcgagttgtctcgggccctcccggagctgcgggcggctcctcgagaaactcagagagcccaggcgcaccacgggccagccaggacatccccaggcggccctgttagccccattttatggaggaagactgaggctttgggttgcatgggacccgcggttaccccgcaaacacagacgcttacgaagacgctatcgcgagccgaacagtct

SEQ ID NO: 28800 - DNA, 317 bp, Homo sapiens
  misc_feature 1..317: note = chr4:8894641-8894958
  misc_feature 1..317: note = hyper
  source 1..317: mol_type = genomic DNA
ggaaacgcctgcctccggtcggtctagcgcggcgtgtgcgagtgcagcccccgcggggacgtgggcaccaacagcaggcgagtgactaccgcggcgcagttcccgaggacccagcgcctctcccgaggccaccctcccgggcaggaattactgtctgccggcccgaagccgccaccccacccgccgccctgtttcaaagttggggagagtccatgccgcgacggagcgagcagacttggacatggtcgagtgcctggtgcgcacgattggtcttaagagtttagggaaaaaagcacgcggggaaaccacgcggggcc

SEQ ID NO: 28801 - DNA, 353 bp, Homo sapiens
  misc_feature 1..353: note = chr4:8895231-8895584
  misc_feature 1..353: note = hyper
  source 1..353: mol_type = genomic DNA
cgcccgcgctaccttcctgccctgtggcctacctgggtcccccttacacctctgctcggtgcagccctgagcctcggtttcccagacggcgcagctgaggctctcgaggtgacgagaggctgtgggggtgaggtcgcagccctgctccctcctcagttccgccacccaccccttcggtagtaacgccgttctcaaaatgggcccagggccccttccggccaaacacagcctggactcctgggcagagaccgagcgcggcagaggtggcccgaaggccgggttgcgggggatcccggcctctgcccaactgccccggaatctggcaggcagacacgctgcgccactggggacaa

SEQ ID NO: 28802 - DNA, 134 bp, Homo sapiens; identical to SEQ ID NO: 2375
  misc_feature 1..134: note = chr4:8895964-8896098
  misc_feature 1..134: note = hyper
  source 1..134: mol_type = genomic DNA

SEQ ID NO: 28803 - DNA, 205 bp, Homo sapiens; identical to SEQ ID NO: 2376
  misc_feature 1..205: note = chr4:8896117-8896322
  misc_feature 1..205: note = hyper
  source 1..205: mol_type = genomic DNA

SEQ ID NO: 28804 - DNA, 40 bp, Homo sapiens
  misc_feature 1..40: note = chr4:9499335-9499375
  misc_feature 1..40: note = hyper
  source 1..40: mol_type = genomic DNA
taggcggggaaggtgcggggcgaggcggccgcgggtccct

SEQ ID NO: 28805 - DNA, 113 bp, Homo sapiens
  misc_feature 1..113: note = chr4:9499921-9500034
  misc_feature 1..113: note = hyper
  source 1..113: mol_type = genomic DNA
ccaagcacagtggttcgaaaatacagctgaaaccctgcgggcccttagcaggcgccccagcgccggagcagggtcagggtcttcttgcgacccggccccgctccagatccccc

SEQ ID NO: 28806 - DNA, 15 bp, Homo sapiens
  misc_feature 1..15: note = chr4:9783081-9783096
  misc_feature 1..15: note = hyper
  source 1..15: mol_type = genomic DNA
gggactagggtctgg

SEQ ID NO: 28807 - DNA, 265 bp, Homo sapiens
  misc_feature 1..265: note = chr4:9783125-9783390
  misc_feature 1..265: note = hyper
  source 1..265: mol_type = genomic DNA
cgcccctacactctggcgcgctgagggcggtgagcgagggcgccaaggcacaggtggggcgggagtcgagcgcggaggctcggggggcgggacgcggggcctgggagcggccagggaccgcggcagcgcctcagtgccagcctggcgcccgcgactgcctgccccagcccctcagtggcggcttgctctcttctctcgctccgaaccagacacagccgctgccgctgccgtccggcgcgctacagactcccgagaacagccctgg

SEQ ID NO: 28808 - DNA, 873 bp, Homo sapiens
  misc_feature 1..873: note = chr4:10458378-10459251
  misc_feature 1..873: note = hyper
  source 1..873: mol_type = genomic DNA
aaccaaaaccgtcaacgctcagctccgaggcccgcaggaggctttaaaaatggcctcctgacgacacttcctgctcggcgcggacggtaggagccctcggaggaggcatccttcataacgctgggggcggggagcgcaggccgggccagcggcgccacacgaacggccccgcgggacgctgccacccccgcctcggtcgccccggcgcgtcggccgagtccgcggggtcgcggcgcacaaaggcgagctgggggcgccgggccggaccccgaccctaggccaggcccgcgtacctgctcaacgcgcgccaagccgcggcccgggcccccaccccagccggtgccccacgcccaccagccggagcccgcgttcggcctacccggtgccacttgccacgacgccagccctcagcgcgggcacgcggggccgcggccgctcgacccgccccggcctggccccgtcaggcccccgccccgcgcgcccccacgacccggccgcagctggcgcttcggtcacgtacacgcggatccgggggccctcgccctcccgctcagctacttacccggcaggccggattcgggtgccaggtcccggcgaaggggcgtctacaccgccggccgcagaccgccggcgccgcgcccgctgtaggtccctacccggggggcggagcccgcgccagccccgcgcgtgcgcaatgtgaagcggcggcgcggctccagcgaggccggcgcctgaggtctctaaggctgcgcccgcccccgccgggcttctaagctgtccagagcggggagcctcagacccagccgagccccacttctgggcttagagcttgacccaacacgttcgcaccgtagcgagcgaggtccacattta

SEQ ID NO: 28809 - DNA, 273 bp, Homo sapiens; identical to SEQ ID NO: 354
  misc_feature 1..273: note = chr4:10462775-10463048
  misc_feature 1..273: note = hyper
  source 1..273: mol_type = genomic DNA

SEQ ID NO: 28810 - DNA, 184 bp, Homo sapiens; identical to SEQ ID NO: 355
  misc_feature 1..184: note = chr4:10463072-10463256
  misc_feature 1..184: note = hyper
  source 1..184: mol_type = genomic DNA

SEQ ID NO: 28811 - DNA, 280 bp, Homo sapiens; identical to SEQ ID NO: 356
  misc_feature 1..280: note = chr4:10463257-10463537
  misc_feature 1..280: note = hyper
  source 1..280: mol_type = genomic DNA

SEQ ID NO: 28812 - DNA, 111 bp, Homo sapiens
  misc_feature 1..111: note = chr4:11429592-11429703
  misc_feature 1..111: note = hyper
  source 1..111: mol_type = genomic DNA
gagctggggtctaggcgttccaaccgcgggttcgcaccccgccatccctcacctccatccgctgccactacccaagggcccggaaatagaaaaccacgaagggggaaaaaa

SEQ ID NO: 28813 - DNA, 304 bp, Homo sapiens
  misc_feature 1..304: note = chr4:13523948-13524252
  misc_feature 1..304: note = hyper
  source 1..304: mol_type = genomic DNA
tccctaccttcctcccgagggagaggcagagcctctagctccatttcagacctgcaaggaaagggctttgagaagggaactggggagaagcacgttccaggtgtgggttcagctcggcactcgccacaggcctccgcaggtggctctccttggcagcgaggcaaggcgcaaacccgctggcttgggaagcctgacgtgacccccgcccgccaagcctggcaggaagcgacgccggggttctccgcaagaagaaggcggcctccgggtgtcggccgcagccaggctactgtgctccggggcaaac

SEQ ID NO: 28814 - DNA, 37 bp, Homo sapiens
  misc_feature 1..37: note = chr4:13529606-13529643
  misc_feature 1..37: note = hyper
  source 1..37: mol_type = genomic DNA
acaacatcctctcagcgctcaacgccccccatcactc

SEQ ID NO: 28815 - DNA, 68 bp, Homo sapiens
  misc_feature 1..68: note = chr4:13530912-13530980
  misc_feature 1..68: note = hyper
  source 1..68: mol_type = genomic DNA
agcacagcttcgctgcggcggggaaggaggaccgtcgggcccagagttcccgccgccacatatggtct

SEQ ID NO: 28816 - DNA, 84 bp, Homo sapiens
  misc_feature 1..84: note = chr4:13537658-13537742
  misc_feature 1..84: note = hyper
  source 1..84: mol_type = genomic DNA
aaccgcaactgctggcggcaccagggactgcgagcaggggcatggagtgggagggaaagctgaggagagcgggctttgagcctg

SEQ ID NO: 28817 - DNA, 30 bp, Homo sapiens
  misc_feature 1..30: note = chr4:13539344-13539374
  misc_feature 1..30: note = hyper
  source 1..30: mol_type = genomic DNA
agcctttctgtaaagcgagttaaacttcgt

SEQ ID NO: 28818 - DNA, 43 bp, Homo sapiens
  misc_feature 1..43: note = chr4:13541880-13541923
  misc_feature 1..43: note = hyper
  source 1..43: mol_type = genomic DNA
agccccaattgcacccgtccgaggaaaacgctcgggtgaccct

SEQ ID NO: 28819 - DNA, 121 bp, Homo sapiens
  misc_feature 1..121: note = chr4:13545940-13546061
  misc_feature 1..121: note = hyper
  source 1..121: mol_type = genomic DNA
cgcccctctggcgcggccagcccgccgcgctcctctttcttgttgaggatcgcctggatggagaaggacgtcaaggtgttggcgccgcgcacagccatctgcgccgcgggcaggagcggcc

SEQ ID NO: 28820 - DNA, 240 bp, Homo sapiens
  misc_feature 1..240: note = chr4:13546362-13546602
  misc_feature 1..240: note = hyper
  source 1..240: mol_type = genomic DNA
gtgaaggaggattggcgggggcccctccgtggcagcagtcccctcccgagcgccgccggggcgcacagcccgagtcactttttctttgcgcgtctgtcccttcctcgcctgcaggatttcgctcctggcccgtcctccccttccctgctgggcaggctcttccggagcccacccccggcggcggcggcggtagccgcggccgcggccgctggattccgagaggcgcggggaactttttta

SEQ ID NO: 28821 - DNA, 88 bp, Homo sapiens
  misc_feature 1..88: note = chr4:13548502-13548590
  misc_feature 1..88: note = hyper
  source 1..88: mol_type = genomic DNA
aaagatgtggtttggcgactttgagttgtcgggtatttttgtgtcccaggagtgtgagaaaggggctacgttccgcgtcttccggagg

SEQ ID NO: 28822 - DNA, 1001 bp, Homo sapiens
  misc_feature 1..1001: note = chr4:13548634-13549635
  misc_feature 1..1001: note = hyper
  source 1..1001: mol_type = genomic DNA
cgcttagtcgatcattaggtctgtgggtgactgtaggcagagccgggagttgggtgcttggcgcggagggtgaactcgcgggtcttgagctgcaactagaagctgctcctagcaaggggtcgggtggagatgaaaagactgtggggaaggggaggtggttgtatgcccagagatatcccggcgtaactacggagtccaggcccagagtggcggtgtgtggcgaaggcgcagcaggcctgcgcctgtcggaggacggcagatctggacgcgaccgcgcgggcgtgcctgggtcccgcttcctgcccatcgagggcgacttccttcgggctcagctgtgagctccaggaactctgcaacctcccgacgggcgccacgctccggcttgggccggcccgggagttggcggagctgcgcggcccggccgggcggccggtgaggctttcgagaggcaccgggctcgctcagcgtccgcgcctctctaccccgccgcgccccctccgcgcccacgggcccattttttcctagtcttctgcctctcttccttcttcctccctcccctcctcctccacacctttgtcttcttcctcctccctcctcctgcttctcctccgcagtttggatcctacgggccccctacgtgccgcgcccttcggtccccggaaccgcccgggctgggggtgctgctgcgcggtgagacttccgcgggcggcgggcggagagcgggatttgactgcgaaagccaagggggcggggaaggggaagccccggccctcgggggcgcgcagtaaactgctgcacacgtgcccgcgctcccgaggggggcgcccagtgggctcgggatttcctggctgcgccaccgcgcgcctcgcccccgacgcccgccacctgtgccctgggccgccttccctgacgccagcggccggaggtcgcgcgcgccgggtgctgcccagcaacgaaaggccatgcggggttcgtccctcagatgccggtgaccttgattg

SEQ ID NO: 28823 - DNA, 516 bp, Homo sapiens
  misc_feature 1..516: note = chr4:15780044-15780560
  misc_feature 1..516: note = hyper
  source 1..516: mol_type = genomic DNA
actgcgagttcagcccggtgtccggggacaaaccctgctgccggctctctaggagagcccaactctgtcttggcgtcagtatcctggtcctgatcctcgtcgtggtgctcgcggtggtcgtcccgaggtggcgccagcagtggagcggtccgggcaccaccaagcgctttcccgagaccgtcctggcgcgatgcgtcaagtacactgaaattcatcctgagatgaggtgggttggcgactaaggcgcaccggtgggcactgcggggacagcagggccccgcgcgcagggaagccgcccggatcgcccggaaccgggcatcttccgtggcgggtcagccgagagcccgccgggtggtgctgagtagggagtcccgggctcggggctccgcgggccgctttcaggagcagctggccttggcaccgagcgtgcccgcgggaggcgggggggggcgctgctcggtggctctgctgcgtagccggtgaacacttggcaccgatgcccgccttctgggcaag

SEQ ID NO: 28824 - DNA, 48 bp, Homo sapiens
  misc_feature 1..48: note = chr4:16083930-16083978
  misc_feature 1..48: note = hyper
  source 1..48: mol_type = genomic DNA
ttcaacccaacatatcgcagcggttgttcgtgtcgcatgagtctcggg

SEQ ID NO: 28825 - DNA, 60 bp, Homo sapiens; identical to SEQ ID NO: 7312
  misc_feature 1..60: note = chr4:16084408-16084468
  misc_feature 1..60: note = hyper
  source 1..60: mol_type = genomic DNA

SEQ ID NO: 28826 - DNA, 78 bp, Homo sapiens; identical to SEQ ID NO: 2384
  misc_feature 1..78: note = chr4:16084741-16084819
  misc_feature 1..78: note = hyper
  source 1..78: mol_type = genomic DNA

SEQ ID NO: 28827 - DNA, 14 bp, Homo sapiens
  misc_feature 1..14: note = chr4:16085166-16085180
  misc_feature 1..14: note = hyper
  source 1..14: mol_type = genomic DNA
cgcagagcgaaccc

SEQ ID NO: 28828 - DNA, 121 bp, Homo sapiens; identical to SEQ ID NO: 2386
  misc_feature 1..121: note = chr4:16085181-16085302
  misc_feature 1..121: note = hyper
  source 1..121: mol_type = genomic DNA

SEQ ID NO: 28829 - DNA, 251 bp, Homo sapiens
  misc_feature 1..251: note = chr4:16085351-16085602
  misc_feature 1..251: note = hyper
  source 1..251: mol_type = genomic DNA
cgccagaccctggctcgtgaattatttatgacccggcttctgggaccaccgcgacggctttcggagagcccgcctcccactgccggccgcggaggggctcaggcggcgctgcggccggaccctcggacgtggcgggaggcaggagaaaggcccgggtgcccggggggacccgttgcggcttcctctgtcccggacggggacctaggtatggggccgccgtaatggaaaggattccttaaacatactcaccg

SEQ ID NO: 28830 - DNA, 26 bp, Homo sapiens
  misc_feature 1..26: note = chr4:16085674-16085700
  misc_feature 1..26: note = hyper
  source 1..26: mol_type = genomic DNA
cgagccctggacgcactctgattgga

SEQ ID NO: 28831 - DNA, 30 bp, Homo sapiens
  misc_feature 1..30: note = chr4:17326218-17326248
  misc_feature 1..30: note = hyper
  source 1..30: mol_type = genomic DNA
atttttctccccccccgcagaaaagaaact

SEQ ID NO: 28832 - DNA, 356 bp, Homo sapiens
  misc_feature 1..356: note = chr4:17782938-17783294
  misc_feature 1..356: note = hyper
  source 1..356: mol_type = genomic DNA
gcactcagactctctcgttttctccctgcccaccgtgtgcacgtgcgtgcgcgcgcgggcgtgcgagcgtgtgggtttctcgggagaggtggcactgcagtcccgtcgcctgcaccgccgcgtggccccagcttcccgaaggtctccgcctcccgggcccacccgcgcgcccaccctttttcctctcctgctggttctctggctggctggctccgcgggcacccgcaccctgcggcgaggcgtcggcgccccgcacgtgccgctggcgatcagtctgcagttccccagccagtgcaggtttcgtgtgcaaggggagagcttccgcggctaggagctgccggccttggggggtttgc

SEQ ID NO: 28833 - DNA, 27 bp, Homo sapiens
  misc_feature 1..27: note = chr4:17783295-17783322
  misc_feature 1..27: note = hyper
  source 1..27: mol_type = genomic DNA
gtgggcgggcactgcgctcttggacac

SEQ ID NO: 28834 - DNA, 158 bp, Homo sapiens; identical to SEQ ID NO: 2390
  misc_feature 1..158: note = chr4:17783323-17783481
  misc_feature 1..158: note = hyper
  source 1..158: mol_type = genomic DNA

SEQ ID NO: 28835 - DNA, 275 bp, Homo sapiens
  misc_feature 1..275: note = chr4:20253687-20253962
  misc_feature 1..275: note = hyper
  source 1..275: mol_type = genomic DNA
gcaggccgaagctgccgcgctttctgggcacggcgggagtgctgagcagaaaggggagcgccgggggcccgcagccggctccggaggcgcgggccgggtttttgtttggctacgctgagcgccagtcagccccagcgaacaactccagttacgacaacaacccaccttccttccagacaagcgagacttgggctgctgcgtccgtcctattgtttagacacttgccaggggctccggagtcggcagagccaccgagtccccgctctgagtcgtcg

SEQ ID NO: 28836 - DNA, 84 bp, Homo sapiens
  misc_feature 1..84: note = chr4:20254239-20254323
  misc_feature 1..84: note = hyper
  source 1..84: mol_type = genomic DNA
cggctcttgtttcttctacctttgccatcaggtgtctgccgcggagctgcggcttatctgggagacgagcggggttgacacgcg

SEQ ID NO: 28837 - DNA, 30 bp, Homo sapiens
  misc_feature 1..30: note = chr4:20254720-20254750
  misc_feature 1..30: note = hyper
  source 1..30: mol_type = genomic DNA
gtgtttgtaaaccatcgttggctgtcggga

SEQ ID NO: 28838 - DNA, 51 bp, Homo sapiens; identical to SEQ ID NO: 7323
  misc_feature 1..51: note = chr4:20255045-20255096
  misc_feature 1..51: note = hyper
  source 1..51: mol_type = genomic DNA

SEQ ID NO: 28839 - DNA, 38 bp, Homo sapiens
  misc_feature 1..38: note = chr4:20255330-20255368
  misc_feature 1..38: note = hyper
  source 1..38: mol_type = genomic DNA
ggttgctagccccgccgggcactgggcctcagacactg

SEQ ID NO: 28840 - DNA, 762 bp, Homo sapiens
  misc_feature 1..762: note = chr4:20255524-20256286
  misc_feature 1..762: note = hyper
  source 1..762: mol_type = genomic DNA
ggcgcagtgctcttgctcgggcagcacagtggactgtcacgggctggcgctgcgcagcgtgcccaggaatatcccccgcaacaccgagagactgtgagtatgcgctcttcgtcttcccctctccccatccgggccgcgcacccctgcctccactggaggaacctgtcagctcagggtcctgtgcctggggcagccctcgctagctctcccccatgcacatcctggggttgagctctccgggagggcactggccagggaagggcctctgtccaaggaggggcgggtccgctggcagctgcgctagttctccctcccctgctctcgtcccgccactcgcagctccttgctggctagttctctggggctggggagcgggtagataggggacaagtactggaggatgcccggggcaagtgagacgccactttgttctccagagtccataaacggagtcaccttgcgattgccagcatccaggtcggtttcagagcccagtcctcgctcttgtcgcaggctggcgcggaggggatagcagggagactcaaaagagagaaacttgccttccccgattttttgtcaccctcctgggggcgaaggttaggaagaaggggtcatggagtgcctgggggtgcttctcacaggtcgcggggagaagggtgccccaggacggcgacacctcgcatagtagcctcgcgcagccccccgccccccacttctccggggaggggaagacggcgtcaggcccctagggacttgtctcag

SEQ ID NO: 28841 - DNA, 15 bp, Homo sapiens
  misc_feature 1..15: note = chr4:20256562-20256577
  misc_feature 1..15: note = hyper
  source 1..15: mol_type = genomic DNA
aagtaaatgcagacc

SEQ ID NO: 28842 - DNA, 62 bp, Homo sapiens
  misc_feature 1..62: note = chr4:20256841-20256903
  misc_feature 1..62: note = hyper
  source 1..62: mol_type = genomic DNA
gctctgacccgcacgtctccacccgcgcagcccattgcacttcaagtcgcccttcttatcca

SEQ ID NO: 28843 - DNA, 32 bp, Homo sapiens
  misc_feature 1..32: note = chr4:21950123-21950155
  misc_feature 1..32: note = hyper
  source 1..32: mol_type = genomic DNA
gcagccgtcttggctcgcgagggaaggagggc

SEQ ID NO: 28844 - DNA, 140 bp, Homo sapiens
  misc_feature 1..140: note = chr4:21950156-21950296
  misc_feature 1..140: note = hyper
  source 1..140: mol_type = genomic DNA
gaagcgggcgcccgctcgcaagcttattgcatcctaccgcctgtagagctggcctcctccagctgagccgaaatgctttccaccctcctcacattcatgtctagggacgcagggtgcagaagcgagactcgagagtccac

SEQ ID NO: 28845 - DNA, 40 bp, Homo sapiens
  misc_feature 1..40: note = chr4:21950838-21950878
  misc_feature 1..40: note = hyper
  source 1..40: mol_type = genomic DNA
gccgcgccttctcaacgcgccgctgcgtcccccaggggct

SEQ ID NO: 28846 - DNA, 90 bp, Homo sapiens
  misc_feature 1..90: note = chr4:24473588-24473678
  misc_feature 1..90: note = hyper
  source 1..90: mol_type = genomic DNA
ggcgcaactggaaggcgggtaggcgccgggcgcacaggggcgcggcgcccgcggcgacttggggaaggttgcgctcgagttccctggttc

SEQ ID NO: 28847 - DNA, 48 bp, Homo sapiens
  misc_feature 1..48: note = chr4:24801867-24801915
  misc_feature 1..48: note = hyper
  source 1..48: mol_type = genomic DNA
cgcggcccccacccggcggcggccagggacccccgaggcccccctctg

SEQ ID NO: 28848 - DNA, 242 bp, Homo sapiens
  misc_feature 1..242: note = chr4:24914406-24914648
  misc_feature 1..242: note = hyper
  source 1..242: mol_type = genomic DNA
cccatcccgcctggccggcgccgcggcctcacctcgctcaccagcccctgccagtcgctctcagtccggtcgccgttcatggcctcctcctccatgcgctggccggcctcctggacccccgccgcctcctcctcctcgcgacgtcgcgtcgccgccgccgcccgggccccgcgcggccccgagagggcccggcgcctccgagccgctgcgccgccgcctctcgcggccgccagcgctgttga

SEQ ID NO: 28849 - DNA, 235 bp, Homo sapiens
  misc_feature 1..235: note = chr4:25657130-25657365
  misc_feature 1..235: note = hyper
  source 1..235: mol_type = genomic DNA
cacttgcgggaatctcgtgcggaccgagtcggggcgggagagggcgcgcaccagccaggctagggcgcgcggggcgccgaggggcgcggggccgtttggggccgttcgggccagttcgcgcggcggggcccgtcggagcttttctctcggcagcctggctggccgcgcgtcttctccgcgcagcgggcgaagtcgcgatgggttcattaaggcggcaggtaggcagtgccccggc

SEQ ID NO: 28850 - DNA, 48 bp, Homo sapiens
  misc_feature 1..48: note = chr4:25657366-25657414
  misc_feature 1..48: note = hyper
  source 1..48: mol_type = genomic DNA
gcggctgcggcaggcggtcctggaatgtgcgaggggcgtgatgacagc

SEQ ID NO: 28851 - DNA, 62 bp, Homo sapiens
  misc_feature 1..62: note = chr4:25657415-25657477
  misc_feature 1..62: note = hyper
  source 1..62: mol_type = genomic DNA
gccagcctctttgcgcaacaccttcgccatatatacccggggcgctgcgctccacctggccg

SEQ ID NO: 28852 - DNA, 137 bp, Homo sapiens
  misc_feature 1..137: note = chr4:26030429-26030566
  misc_feature 1..137: note = hyper
  source 1..137: mol_type = genomic DNA
gcagaggaggggcagcgtcggggcggcggagtccgacctcgggggattcaccctgagggttacaggcaaggccgctccaggcacgcagcacctgccgggcgccacccaggagggggcagcagcgccattcgcaaagc

SEQ ID NO: 28853 - DNA, 15 bp, Homo sapiens
  misc_feature 1..15: note = chr4:26030635-26030650
  misc_feature 1..15: note = hyper
  source 1..15: mol_type = genomic DNA
cgtcccaggggacct

SEQ ID NO: 28854 - DNA, 30 bp, Homo sapiens
  misc_feature 1..30: note = chr4:27086432-27086462
  misc_feature 1..30: note = hyper
  source 1..30: mol_type = genomic DNA
aaattgcaaagtaaacggcaagatgttgcc

SEQ ID NO: 28855 - DNA, 250 bp, Homo sapiens
  misc_feature 1..250: note = chr4:30719374-30719624
  misc_feature 1..250: note = hyper
  source 1..250: mol_type = genomic DNA
aatgctttgaagatgcggagaggcttattcaagtttatggtctggagagggaagagggagtgcacaacgtttctgcccaagcggctgcctgaagtttgcaaaatcttagtaaggcgatgaggggagtgagtgcactgcaccatattgccgcgcatcggaatgcacggcgcaaggccgcggagtggagacggcttctcccatttgcctccaacctgggaaaaaggggaaccagggtcggaggtttggagag

SEQ ID NO: 28856 - DNA, 43 bp, Homo sapiens
  misc_feature 1..43: note = chr4:30719991-30720034
  misc_feature 1..43: note = hyper
  source 1..43: mol_type = genomic DNA
cttggaaatctctgccgcctctccctcctcattcctgttcctg

SEQ ID NO: 28857 - DNA, 367 bp, Homo sapiens
  misc_feature 1..367: note = chr4:30720054-30720421
  misc_feature 1..367: note = hyper
  source 1..367: mol_type = genomic DNA
cgctacatctgctcgttgactttattggtgtttgtcttgtttaaatcattctgcctcgtcacccaggtctcgtaaagaatacccacactggacagattttattttttcggctttaaatttttctttgaggggaggcccttaaatgtgtatggatacgtcaggcgagctgaagactaagcaaatcccagcagcggccctttctctctttcgagatggtaaaaattctccccaaatacctacagtccgtctcagtcgtcttaatcctagccgggcctcttcgtttacagccactgaaataaatgagtaaatggctcagttcaaaaacacaaccagacctgagatctgatgaggccggctgcggtggtcg

SEQ ID NO: 28858 - DNA, 34 bp, Homo sapiens
  misc_feature 1..34: note = chr4:30720861-30720895
  misc_feature 1..34: note = hyper
  source 1..34: mol_type = genomic DNA
gagtggctttctgggcgctcgtaggttccccagg

SEQ ID NO: 28859 - DNA, 30 bp, Homo sapiens
  misc_feature 1..30: note = chr4:30721247-30721277
  misc_feature 1..30: note = hyper
  source 1..30: mol_type = genomic DNA
cgggccctcctccctcgctctctcctagtg

SEQ ID NO: 28860 - DNA, 30 bp, Homo sapiens
  misc_feature 1..30: note = chr4:30722839-30722869
  misc_feature 1..30: note = hyper
  source 1..30: mol_type = genomic DNA
aaaagaagcatctatcgctgccctcccacc

SEQ ID NO: 28861 - DNA, 225 bp, Homo sapiens
  misc_feature 1..225: note = chr4:30724228-30724453
  misc_feature 1..225: note = hyper
  source 1..225: mol_type = genomic DNA
gaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagct

SEQ ID NO: 28862 - DNA, 45 bp, Homo sapiens; identical to SEQ ID NO: 2391
  misc_feature 1..45: note = chr4:37245537-37245582
  misc_feature 1..45: note = hyper
  source 1..45: mol_type = genomic DNA

SEQ ID NO: 28863 - DNA, 525 bp, Homo sapiens; identical to SEQ ID NO: 2392
  misc_feature 1..525: note = chr4:37245836-37246361
  misc_feature 1..525: note = hyper
  source 1..525: mol_type = genomic DNA

SEQ ID NO: 28864 - DNA, 211 bp, Homo sapiens; identical to SEQ ID NO: 2393
  misc_feature 1..211: note = chr4:37246489-37246700
  misc_feature 1..211: note = hyper
  source 1..211: mol_type = genomic DNA

SEQ ID NO: 28865 - DNA, 223 bp, Homo sapiens
  misc_feature 1..223: note = chr4:37247015-37247238
  misc_feature 1..223: note = hyper
  source 1..223: mol_type = genomic DNA
gctggccggttttgcctgcacacttctattaggacacccattctccaccccgggttattcccctgggtcaatccaagaaacatccaaggcattagccggcccttctggaagctccattctgccgccgccgccaccaccacctcctgtcccccgcccttttttttttttttaaagcggtttcttctccgagatgaccgcaaacacaaacagtagctctcctccc

SEQ ID NO: 28866 - DNA, 138 bp, Homo sapiens
  misc_feature 1..138: note = chr4:37247293-37247431
  misc_feature 1..138: note = hyper
  source 1..138: mol_type = genomic DNA
cgaggtgagttccttgagactctcctcctgcaggtgcgatggtgccctttgcagaggccaagcagacttttgtgaaccggaggtcgagggggacaccctctgtgggtcccggaacaggcttcgcggtggggcgcgcag

SEQ ID NO: 28867 - DNA, 116 bp, Homo sapiens
  misc_feature 1..116: note = chr4:39047287-39047403
  misc_feature 1..116: note = hyper
  source 1..116: mol_type = genomic DNA
gggatcagaagctggcggtaaaagtttgctatgtcagagagtaaagcgttactgtcgttttttatcgcttcatttcattttcaaaaatattcttcagtagtcgacaagttcacaga

SEQ ID NO: 28868 - DNA, 73 bp, Homo sapiens; identical to SEQ ID NO: 360
  misc_feature 1..73: note = chr4:41258716-41258789
  misc_feature 1..73: note = hyper
  source 1..73: mol_type = genomic DNA

SEQ ID NO: 28869 - DNA, 765 bp, Homo sapiens
  misc_feature 1..765: note = chr4:41259085-41259850
  misc_feature 1..765: note = hyper
  source 1..765: mol_type = genomic DNA
cgctgatcggttcggttttgcctttttctttgcatttgcctttcagatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccaggtagggcgtggggcccaggatgcgccggccgccggcagtgcacgccgctccccagcttgagtcctcgggggctccccgccccgccccctcccctgt

SEQ ID NO: 28870 - DNA, 208 bp, Homo sapiens
  misc_feature 1..208: note = chr4:41362555-41362763
  misc_feature 1..208: note = hyper
  source 1..208: mol_type = genomic DNA
tgtgctccccctccccgggggcggagcggccctcgaaggtggggaggagaagaagctcccggcgcctccgcgctcgctcccgcgggtcactcacggcgcgttggagcccgggcggcgccgggaacagctgccgcggcgtcctctagcagcgcgcggctctcccgggacctgcgccggccgggggcggggagaggcggggaggggaggc

SEQ ID NO: 28871 - DNA, 157 bp, Homo sapiens
  misc_feature 1..157: note = chr4:41362780-41362937
  misc_feature 1..157: note = hyper
  source 1..157: mol_type = genomic DNA
cggggagcgcgctcctgcggcggcgacggcggcggccgtcctcatcccggcgcttgagaggacgcggggctgcgcaaatggcttgtcccgctctcggtctggaagctcttcagcccctgcagcccgagccgccccccgagcccgccttctccgaggc

SEQ ID NO: 28872 - DNA, 412 bp, Homo sapiens
  misc_feature 1..412: note = chr4:41746824-41747236
  misc_feature 1..412: note = hyper
  source 1..412: mol_type = genomic DNA
agaagaaaatgccgacggggtaggcgggagcgagggggaaaaaaagagttgcgaaacatgagacacattttgcagagtttgcagatgaaaaggcatctcatggatagggcatctttcagggccgaacggctgcaaagattcggggttgggagttgcaactgtgtggggttccgatgcgctaatggcgggatggtgttcagcgaggtgggacaggcaagggggtgcgagaaagtcactccggccgccgggacagtctgagcaagtcgtcgccgcagtgacccgaacccaaggacacgataggaaggggggctggaacggcgtccctactcttccctgaagaagagccccaagagaatccgtgctgttaggagggagcggatttaggggttcacaagatcgagccttcagctcc

SEQ ID NO: 28873 - DNA, 324 bp, Homo sapiens
  misc_feature 1..324: note = chr4:41747445-41747769
  misc_feature 1..324: note = hyper
  source 1..324: mol_type = genomic DNA
cagacacacattccccgagacagacacaaactgacacgcagacacagccccctgagagtgccccgcgtccaggccgcgctgctcacaacccccgatcagcaggcggagccctggccccgctgcgaggccccaggcaggtgcgaagccagggaagtttgtttgttttgtttgggggttgaggaagggggtaggagtggggttgaaatgagggcgacgccgttttccctttattcttagcgcgattactttaggccctcaatgaaaaagccatggcagcagcgacgacaatagccttgggcctacccgctcgcccactcgcccgcc

SEQ ID NO: 28874 - DNA, 124 bp, Homo sapiens; identical to SEQ ID NO: 7338
  misc_feature 1..124: note = chr4:41747888-41748012
  misc_feature 1..124: note = hyper
  source 1..124: mol_type = genomic DNA

SEQ ID NO: 28875 - DNA, 624 bp, Homo sapiens
  misc_feature 1..624: note = chr4:41748143-41748767
  misc_feature 1..624: note = hyper
  source 1..624: mol_type = genomic DNA
cgcagctgggggtggggttgggattgggacctgggcccccagtgctgtccgggtcagtgctcttggcctctttgctctcgtcgtccctggaagagtcagactttttgcccgaggagccgttcttggccgcggccgctgcggctgccgctgcgcgctcctgcttgcgaaacttggcgcggcggttctggaaccacacctggcccaagacggaaggagagacggtgaagcagggggagaaagaagaaaatgggaaagaaaagcaccggttagggtggcccaagttctacttcggcttgttttaacaccctcctccccatgcgctgtgatcacccccgcgcgcacatccaccaagtctaccgcttcttattgctgtgcattttcggagaaactttcttagggggagtgagcacgccagggacatgaaggcttgcggcagagtttaaaaagccgcaggtcccagaaagacccgaaaagggaaggccttattttggtgggcctctgttcagtcggcttcttgagcaagccccgagctcgccattcacccctaagcctaagttctaaagttaaactctaattggtagaaggaaaagggatcctctctgggtttgctccgctgcccatccc

SEQ ID NO: 28876 - DNA, 336 bp, Homo sapiens
  misc_feature 1..336: note = chr4:41749425-41749761
  misc_feature 1..336: note = hyper
  source 1..336: mol_type = genomic DNA
ggggtagtgagtctccgcgaagaccctttccagctctttgagctgggcactggtgaaagtggtgcggatgcgccgctgcttgcgcttctcgttgaggccgccgtggtccgtgaagagtttgtaaggaactagagtatgacagaggagacagaaagtgagcaaatcagccggcagctcgccggccgtggagctagaatgtgaggactccaaggtcaggtcatacggcagccgctacctacacccgcgcgagagagttgccgagagaagctgcgggaagaaaccgaggaaatttgttatctgcggaaacctgggctcaaacttcgggcttggcggagt

SEQ ID NO: 28877 - DNA, 497 bp, Homo sapiens
  misc_feature 1..497: note = chr4:41750102-41750599
  misc_feature 1..497: note = hyper
  source 1..497: mol_type = genomic DNA
attttctaagctttacgtctcatcgcaaagtaaataaattatgcctatcattttggcagcttaagataattttgttggcggttcgggtgtgactaggatagtgtaaccctgtaagtgaattacccctccctgcaatcgcttctaacgtgataaattctttcatttgtgtaagcaaatttcgtttggtaaatactaaacacatttccattttcaaatgcaatcaaggcttcctatatacgggcggaaaggcggcttcctccgctgagaaagctgaaggtccttacctgcggcgtacggactgctctggtggtccctgagggtgcccaggctgcaggatcccggcgtgagggaagggcagccggacgtggccccaaaagtggtccttatcgggttatactggaagccactggcctggctgcaggaactgaagtcagcataggctgaagccaggctcgaggtgtccatcccagccatacaggactcgtaggcagaggaat

SEQ ID NO: 28878 - DNA, 30 bp, Homo sapiens
  misc_feature 1..30: note = chr4:41751372-41751402
  misc_feature 1..30: note = hyper
  source 1..30: mol_type = genomic DNA
gggggtttatgtgaacgataagcggatttc

SEQ ID NO: 28879 - DNA, 181 bp, Homo sapiens
  misc_feature 1..181: note = chr4:41751719-41751900
  misc_feature 1..181: note = hyper
  source 1..181: mol_type = genomic DNA
ctctttcatctctttcgggcgctctccctctttctcgcctctttttttttttcaggtgcccacaatcctccacagacccggggattgtgtctgtttgccttttaggtttgcggactgtagtgagggaaattcttgccatgtaaatgcccaggcaagggctccaggtcgggcacctttcttg

SEQ ID NO: 28880 - DNA, 49 bp, Homo sapiens
  misc_feature 1..49: note = chr4:41752441-41752490
  misc_feature 1..49: note = hyper
  source 1..49: mol_type = genomic DNA
tgcaaatcctcggggcgtgaggaagcgctaaagtcgggagtgcagggag

SEQ ID NO: 28881 - DNA, 758 bp, Homo sapiens; identical to SEQ ID NO: 2398
  misc_feature 1..758: note = chr4:41752954-41753712
  misc_feature 1..758: note = hyper
  source 1..758: mol_type = genomic DNA

SEQ ID NO: 28882 - DNA, 90 bp, Homo sapiens; identical to SEQ ID NO: 2399
  misc_feature 1..90: note = chr4:41753713-41753803
  misc_feature 1..90: note = hyper
  source 1..90: mol_type = genomic DNA

SEQ ID NO: 28883 - DNA, 113 bp, Homo sapiens; identical to SEQ ID NO: 2400
  misc_feature 1..113: note = chr4:41753804-41753917
  misc_feature 1..113: note = hyper
  source 1..113: mol_type = genomic DNA

SEQ ID NO: 28884 - DNA, 41 bp, Homo sapiens; identical to SEQ ID NO: 2401
  misc_feature 1..41: note = chr4:41754030-41754071
  misc_feature 1..41: note = hyper
  source 1..41: mol_type = genomic DNA

SEQ ID NO: 28885 - DNA, 224 bp, Homo sapiens
  misc_feature 1..224: note = chr4:41867612-41867836
  misc_feature 1..224: note = hyper
  source 1..224: mol_type = genomic DNA
cgattacaaaaagagaaagtgctaaatcccgggagctggggcaagatttcaaaaggcaacacaccgaatccaagtctgtactttaacttttttaataacgatttttttttttctgggctggaagctcgcactgaatcctggaggaattgctaaatcggattaaggttatattttgcaacagactggatggagcaataaaggagagcgcgcggaaatgggacttc

SEQ ID NO: 28886 - DNA, 341 bp, Homo sapiens; identical to SEQ ID NO: 363
  misc_feature 1..341: note = chr4:41875410-41875751
  misc_feature 1..341: note = hyper
  source 1..341: mol_type = genomic DNA

SEQ ID NO: 28887 - DNA, 88 bp, Homo sapiens
  misc_feature 1..88: note = chr4:41881343-41881431
  misc_feature 1..88: note = hyper
  source 1..88: mol_type = genomic DNA
ccacgcgcccccatccgaggggacctcacccctgggaagactccaataaatgcaacccggcgccactcgattccgggataatttttaa

SEQ ID NO: 28888 - DNA, 30 bp, Homo sapiens
  misc_feature 1..30: note = chr4:41881717-41881747
  misc_feature 1..30: note = hyper
  source 1..30: mol_type = genomic DNA
gctgctgccacaattcgcatccctcaccca

SEQ ID NO: 28889 - skipped

SEQ ID NO: 28890 - DNA, 1538 bp, Homo sapiens
  misc_feature 1..1538: note = chr4:41882894-41884432
  misc_feature 1..1538: note = hyper
  source 1..1538: mol_type = genomic DNA
tcgggtgttagtgagcgtaatctgaccgcagaaaagctgatgggaaacctgggcttcgcgccgcgtcccgcttttcctactttcccattccattcccatctcccttccctttccttcccttctctaccttatcctccattcccttcccttcccttcctaggcatttaaataagaacaaagattacacccacaaaaagaaccttgcctaggagcgcgtggaaacagcaagggcgcccgagcgggagaggttccctcggtgagggggtccgcgcagcggcggaccccgcaccccggcccccaacggcgcctaggaagttgtcactcctctcatttaaagcctcagaaaaatgcattcatgagattgtttctttatttttcctttctgcccctctccgcattctttgcctatttgctttacggcttttcagccttgttgaggccaagaaaagaaaccaggttcttttctcttgcgattggatccgtattcccagttagggcgccttttgatgtccccatttagcgcctttgactggtcagctgaatggggccgcctgcttttgtcctttcccacaagtcccttcagaaagatccctttaaacgcccggtacccgctgatggatccgttttcaaacggcgcggggacggcagtgccggaggccgcgtctccttagtaatcgcgcgggcagggctcggcaaggggtcgctgcaagggtcgcgctcacccgccccgggtttgggcgctgggggtggggaagggagagaaggttcgaacagttttgtctctcccgcgccccggctcccccagggtgctgcgcctccagccgccccgaggcgcttcccccggcgtccgcgcgctcctctccgcaggggtctcgcgcccacggtgccgcagccgcgcggctcagccgccctccgcacccgcgcctttccagcgcccgggttcccaaaccatcgctaaaggcggacggggggcgccaggagtaacggctgctccccggagaccccaccgagcccagcgcccgcccccgccccctgggcgccctgccccattttctccctttcccaactatcccagacccccagaagggccagaattttccagaactgtcccactccacccgcgcccagggcttctgcacattgcccttggcaggacgcgagccggtcgaggggcatttaggggtggccctgcacggccctcactgctgtcccttcttctccctccgttctccgggccagggtcctcggagaccccgttccgcggcaagtacccctcccccacccccggaggcgggtgcagtgcagggcgggggcggcggtcgcagcggctcagaagccgaccctccttgaacccgaagctgccctggcccgagtatccgcactggcctgggcccgagcgaggctgcaaccctgtgaaaccccctgcaaggcggaagcctccaaacccaaacgaccccgagggcgattccgccagaaatccaacgcgggcccaaataaagtccgaggcctttttgtcggaagcccgggaggtgcccggc

SEQ ID NO: 28891 - DNA, 48 bp, Homo sapiens
  misc_feature 1..48: note = chr4:42152718-42152766
  misc_feature 1..48: note = hyper
  source 1..48: mol_type = genomic DNA
gcaaccagcccatctcgctccctgcaggcaggcagtgggctgctttgc

SEQ ID NO: 28892 - DNA, 451 bp, Homo sapiens; identical to SEQ ID NO: 365
  misc_feature 1..451: note = chr4:42152961-42153412
  misc_feature 1..451: note = hyper
  source 1..451: mol_type = genomic DNA

SEQ ID NO: 28893 - DNA, 101 bp, Homo sapiens; identical to SEQ ID NO: 366
  misc_feature 1..101: note = chr4:42153532-42153633
  misc_feature 1..101: note = hyper
  source 1..101: mol_type = genomic DNA

SEQ ID NO: 28894 - DNA, 504 bp, Homo sapiens; identical to SEQ ID NO: 367
  misc_feature 1..504: note = chr4:42153881-42154385
  misc_feature 1..504: note = hyper
  source 1..504: mol_type = genomic DNA

SEQ ID NO: 28895 - DNA, 711 bp, Homo sapiens
  misc_feature 1..711: note = chr4:42154386-42155097
  misc_feature 1..711: note = hyper
  source 1..711: mol_type = genomic DNA
ccaatgcctggagggagaaaggaggtaaagagcaagtgtttagggtaatatctgctaatgataatgggggcggggcggggcctggcgccgcagccgcccgcggggtctgcctggcggctccgcgcctccgacggggagcgggggaagggggaaagcgaggacctggaggacgcccgggaactggtgaagaaggtggggatccgggatctggctacggcgagactttagagacccagatgtggactcgaggcttctgcggctgcgggcggggtccggcttccgaaacgagctcgtggcgccccctgcatgaccccaaactctcggggttgcacagaggaggggctagtcgttggggcggggtcgtcagagtacgtgtgtattacagcaagttcttctaccaatcgggaattgctctccgatccttctgaaaagaacctcttgaagatcttggcccgggtggtcgcgcggtgtttacggggctttggggtcctgctttccccgagcatcgcggcctctgagctcatgcggaacataaaagctcgcaaggcgtagaactttttcacgttttcatttgtttcccgtaggggccccgagaacgtgcatgacaccatgatttcccccccattataaagatgagaaaaccgaggctctgagaggttgaagggaattgcccaaagtcagacactcgggagtgtgcggctgtgttgcact

SEQ ID NO: 28896 - DNA, 30 bp, Homo sapiens
  misc_feature 1..30: note = chr4:42398814-42398844
  misc_feature 1..30: note = hyper
  source 1..30: mol_type = genomic DNA
ctttgcgggcgtgaacggagaagtcgtgct

SEQ ID NO: 28897 - DNA, 1396 bp, Homo sapiens
  misc_feature 1..1396: note = chr4:42399099-42400495
  misc_feature 1..1396: note = hyper
  source 1..1396: mol_type = genomic DNA
cttcaatgactgcaccgcattcatgcattatatccattgaaaagtaaatccagcgtctccactcgcgcgcccacgtgcgtggataaacgcgggaattcggcagccctcaacgtcactctgcagagatttccgggctgtgagagagttggggtgtgcggcgggggaggggagggtctgatatcttcaggttgagagtcaagtcctgggggagcggcatgggcgggggtggccggggggaggcggaggatggagcgcgaaccagaaagcgcagaggaccctcggcccgcgccgcacccgctgtgattagctccagaggcgcgatccgggagggcggactctttcttaaccctcattgtctcctcctccctcttcctttttaaaagacgccttgcgggcagagctgtcagcaaccccgcggccgtttgtacttggccgcggcggagctgactcctgctcctgtgacagataggggctggggctgagcggccgcctgtctggggtactcgcacgtggggaacaaattcttttcctccggctcctctcgggacccggcgatcgccacaggttgggactctgtgcggcgctggagttggcagccccgggcgctatggctcccttgaggagtggggagggaggtggccggggggttggcgcgcccctcgcgcggggagcgctatgagccgggcgaagggcggcagcgacagccccagcaactgcctctgccggcgcctcccgcaggccctcgccaactcgccccgcgcaccatgctgactcccggcctgcggaactcgtagtgcagcccctgtcgcctccccggcccctgctatcccacgcaggactggcttcggccgccggggccagcagcttgcgacgtgtccctggggaggcggaatcgctgtgcgccctgagcccgggctcagcccttcgctttccagctgcgtcctgctcccggccgcccagggagcccagtggcgatgagggcactgctggcgctttgccttctccttggctggctgcgctggggcccggcgggcgcccagcagtccggagagtactgccacggctgggtggacgtgcagggcaactaccacgagggcttccagtgcccagaggacttcgacacgctggacgctaccatctgctgcggctcctgcgcgctccgctactgttgcgccgcggccgacgccaggctggagcagggcggctgcaccaacgaccgccgcgaactggagcacccaggcatcactgcgcgtaagtgcggggccctcggggacatatccccgcccgcctaacggcggcggctgcatgtgtgcgcgggaggatgcacagacccaggcaggtctatgcgccttcctgggtctgtgcgccagggggacgcggccgggtgggggaatca

SEQ ID NO: 28898 - DNA, 207 bp, Homo sapiens
  misc_feature 1..207: note = chr4:42400850-42401057
  misc_feature 1..207: note = hyper
  source 1..207: mol_type = genomic DNA
ctgtcttaatgatagcgtttctaagccacggccccgttctgcagacttcctttcaattctctgcatcgaattaccctctccggcccaccccctattgtcacgcctttcagaaatgcccaggtcttcgaggtggagatttagaaacaagggtcgaaggggcttccccgccccctattctcacttcggaaaacacgggtcaaatttccg

SEQ ID NO: 28899 - DNA, 77 bp, Homo sapiens
  misc_feature 1..77: note = chr4:44448966-44449043
  misc_feature 1..77: note = hyper
  source 1..77: mol_type = genomic DNA
ccctttccccacacccgctctcatgcccccgccccctcgaggggctctgggggcacctttatcgcttctcccctgcc

SEQ ID NO: 28900 - DNA, 90 bp, Homo sapiens
  misc_feature 1..90: note = chr4:44449480-44449570
  misc_feature 1..90: note = hyper
  source 1..90: mol_type = genomic DNA
tgccccggacacccccgcggggcctccagcggggctcaaactggcggcggctcagcagggggcgaggggtgctgggaaacgccggggctg

SEQ ID NO: 28901 - DNA, 91 bp, Homo sapiens
  misc_feature 1..91: note = chr4:44449652-44449743
  misc_feature 1..91: note = hyper
  source 1..91: mol_type = genomic DNA
cgaggagttacacgccaccatgtggaagccggcctcggacaggcgatcaaaggcctgctccaagtaggtgaacttgaggtagaagcgggac

SEQ ID NO: 28902 - DNA, 206 bp, Homo sapiens
  misc_feature 1..206: note = chr4:44449971-44450177
  misc_feature 1..206: note = hyper
  source 1..206: mol_type = genomic DNA
gggcccgagggcacggcggccgccgccccgcgcagcagcagcgcgtcgctgctaccctgcgagacgttgtcctccaggtcgctctggcagccctcgtcgttgagagagttctgcttggtgaccttgggcgacagcagcttgaccaagtcggtgagctggaaatactcggcctcgcgcagcagccgctccttctcggggaagtgctc

SEQ ID NO: 28903 - DNA, 294 bp, Homo sapiens
  misc_feature 1..294: note = chr4:44450741-44451035
  misc_feature 1..294: note = hyper
  source 1..294: mol_type = genomic DNA
gagagaggagctccgccggtgcggcggcggcaatggagaggcaagaaggagctgctgctcctttggggcgagggcggggaagtgtgagagagacttgcgagaggctctagggctgctgctcggctctccgtggggagggcgggaggaggggccgaagcaaagaaaactcgccgccccggcagcttgcaagcgtgccgcgaggccggagcgccgacggtggcgctaactactcctggcagcacgggaggaggcactgacgtcaagccccggactgggacccgagcctcagctgtc

SEQ ID NO: 28904 - DNA, 32 bp, Homo sapiens
  misc_feature 1..32: note = chr4:46391678-46391710
  misc_feature 1..32: note = hyper
  source 1..32: mol_type = genomic DNA
gagatgaggcatgcacgcgaggcaaagacaaa

SEQ ID NO: 28905 - DNA, 30 bp, Homo sapiens
  misc_feature 1..30: note = chr4:46392469-46392499
  misc_feature 1..30: note = hyper
  source 1..30: mol_type = genomic DNA
gtgttggtgtaaagccgggaatgtagtgtg

SEQ ID NO: 28906 - DNA, 851 bp, Homo sapiens
  misc_feature 1..851: note = chr4:46994970-46995821
  misc_feature 1..851: note = hyper
  source 1..851: mol_type = genomic DNA
cgaaaaaaaaaaaaccgggggcggaggagattattttaagaatccatcagagaacaggtgcaaacaggtttgttttctagggaaagagtcgcttgccccaagctaaaggagaggaggttgggggttgggatgcagaagacagaaatggtcaggaaaagcgcgccccgccgcaagacccccagtgcccacacgcctcttggatcctgcgcccttggtgctctccgcatctatgcggtcacagaaaagcctggcttcggcccctgctcttacagctgagataagaagacctagtccacccagggaggagcgagtggccaaaggggtcccggagctagccatttctccactttccgttgcccacctcctcgcaccccagagaactcaccaaaccgccaggcacaggaagcgcaggagggcgaaactgaccccggcggacagagcgatcgcgggtaccttcttggcagaaaccatctttgcaacatgccatacttcaagcctgttcacgtttccaggctcttcagatgccctgagcagggtgcgaggagagggcagagaggctcccgcggcgtgcgcacactcgcgctcacactcgcccgcgctcagccagcccgagccgcggtgggcgtgtgtgtgcacggggccaggggaggcggaacctgccttcctcgccccctcctttctcgctcagcgctcaatgtgtatgtagagctatgtataccgctccacaccctttcgtgcccgcgcgctgaaggttctggggttcgtatccgcgcgcttgcgctgcaagactcggcaagtttgttccgactgtaactccggggatgaggaacggggtctctcgcccctcctcc

SEQ ID NO: 28907 - DNA, 567 bp, Homo sapiens; identical to SEQ ID NO: 2412
  misc_feature 1..567: note = chr4:46995822-46996389
  misc_feature 1..567: note = hyper
  source 1..567: mol_type = genomic DNA

SEQ ID NO: 28908 - DNA, 30 bp, Homo sapiens
  misc_feature 1..30: note = chr4:47034011-47034041
  misc_feature 1..30: note = hyper
  source 1..30: mol_type = genomic DNA
ggacttcggaggtaacgcttcatctttttt

SEQ ID NO: 28909 - DNA, 432 bp, Homo sapiens
  misc_feature 1..432: note = chr4:47034321-47034753
  misc_feature 1..432: note = hyper
  source 1..432: mol_type = genomic DNA
agcagggagggagcccgttaagaatggagtaagggctgggaagcccccagaccctccccagcctgctgtcactgagagaatctgttcctaatgtggcccacctccccggcagggccccccgtcgacgttgggatgcggatcgatgtcgccagcatagacatggtctccgaagtgaatatggtgagtggcctcccgaggggcccggcggttcggcttacgcagatgggaaatggacaggtccctttgccctctgcgtttcattggcggtcacctcgcccctggcccctgaggtcccactccgcacccgctccccgctccggcacacacacccggtcgcccctggtttgtaatttcgacacacacgggctactgcggtgttccaggggaaacgtgctcggcactattttgggaaggacgagtgactgttgcgcc

SEQ ID NO: 28910 - DNA, 222 bp, Homo sapiens
  misc_feature 1..222: note = chr4:47034754-47034976
  misc_feature 1..222: note = hyper
  source 1..222: mol_type = genomic DNA
tggatctgctggggcggagtctgagcgttactttagctgggtttccctgcgtgtttggatgaggagggcaccatctgctggcagccgggcggcctgcactagggtccccggaccggtggtcggcagccatcacctccccaggcgcggtgctggcaatccccatggccctcgcagtccgcgagcccggatgcaccaaggccctgccaccgagagcacagtctg

SEQ ID NO: 28911 - DNA, 30 bp, Homo sapiens
  misc_feature 1..30: note = chr4:47839373-47839403
  misc_feature 1..30: note = hyper
  source 1..30: mol_type = genomic DNA
ggggaagggggcttacgtctggggcaggca

SEQ ID NO: 28912 - DNA, 34 bp, Homo sapiens
  misc_feature 1..34: note = chr4:48485255-48485289
  misc_feature 1..34: note = hyper
  source 1..34: mol_type = genomic DNA
agaaccacttactggcgattcacaggaggggacc

SEQ ID NO: 28913 - DNA, 287 bp, Homo sapiens
  misc_feature 1..287: note = chr4:48485589-48485876
  misc_feature 1..287: note = hyper
  source 1..287: mol_type = genomic DNA
cgacaacgtgaccctgctcttcgcccctctgctgcgggacaactacaccctggcgcccaatgccagcagcctgggccccggcacggacctcgccctcgcccctgcctccagcgccggccccggccctgggctcagcctcgggccgggtccgagcttcggcttcagccccggccccactccgaccccggagcccacgaccagcggcctcgcgggcggcgcggcgagccacggcccttccccgttccctcggccctgggcgccccacgcgctcccgttctgggacacgc

SEQ ID NO: 28914 - DNA, 130 bp, Homo sapiens
  misc_feature 1..130: note = chr4:48486356-48486486
  misc_feature 1..130: note = hyper
  source 1..130: mol_type = genomic DNA
ggggagcaagctagacggcgagggagctgctccaaggctgggattccatgcgcagcgcggcccttcagcagggtccctcgccgtcctccccgagcgtcggggtggcagcgcaggtcgttgtccagtggaa

SEQ ID NO: 28915 - DNA, 352 bp, Homo sapiens
  misc_feature 1..352: note = chr4:48492267-48492619
  misc_feature 1..352: note = hyper
  source 1..352: mol_type = genomic DNA
cgcctatttagggtgcggcggcgggcgggagcagtgcgcccatggcggccctgggggacgaggtgctggacggttacgtgttcccggcgtgccccccctgctcgtaccggtacccataccccgcggccaccaagggcaagggcgcggcgggcggcagctggcagcagcgcggcaggggctgccttcccgcctcctccccctgctcggcgggcgcggcctcgttgtccttcccgggctgcgggcggctgacggccgccgagtacttcgacagctaccagcgggagcggctcatggctctcctggcgcaggtggggccgggtctcgggccgcgcgcccgcagggccggcagctg

SEQ ID NO: 28916 - DNA, 213 bp, Homo sapiens
  misc_feature 1..213: note = chr4:48987912-48988125
  misc_feature 1..213: note = hyper
  source 1..213: mol_type = genomic DNA
catctgggtctccagcggtccttcctctctgccttctcctcgcagagcaccccgtgggcctagtctaaacgagggcaccactggtccggagttgcacttgttcgctccctcctgggctctggcagcgctgcatccccggggttgcttcgggttcgggcccaatagcagagtcagagccgagacgcatgtcccctgcaccggccaagggtgccg

SEQ ID NO: 28917 - DNA, 68 bp, Homo sapiens
  misc_feature 1..68: note = chr4:48988465-48988533
  misc_feature 1..68: note = hyper
  source 1..68: mol_type = genomic DNA
aaatcctcttggagtcgctgctgggtaagccgaagcccctcgccgcgagttcgcgggtgccagctccc

SEQ ID NO: 28918 - DNA, 75 bp, Homo sapiens
  misc_feature 1..75: note = chr4:52917590-52917665
  misc_feature 1..75: note = hyper
  source 1..75: mol_type = genomic DNA
cagggtatctatggccgggctcaggcggctgctggggagccaggagaccgcgcgggacggcggatgaggcgcggc

SEQ ID NO: 28919 - DNA, 117 bp, Homo sapiens
  misc_feature 1..117: note = chr4:52917964-52918081
  misc_feature 1..117: note = hyper
  source 1..117: mol_type = genomic DNA
tgggtgaaaaacccccggggttcgccctcccataggttccagcacagcccttgtcggggatttcttagggctggagttggtggccactttgcaaagcctccgcggttgcgattccta

SEQ ID NO: 28920 - DNA, 114 bp, Homo sapiens
  misc_feature 1..114: note = chr4:53617401-53617515
  misc_feature 1..114: note = hyper
  source 1..114: mol_type = genomic DNA
ggcagcagaggagctcggggcgggcaaagctcgaggggacacggggcgagcccagaccctgcctgggagccctccccgccggagaccaaagggcagaaacgcactcacagtgca

SEQ ID NO: 28921 - DNA, 52 bp, Homo sapiens
  misc_feature 1..52: note = chr4:53617855-53617907
  misc_feature 1..52: note = hyper
  source 1..52: mol_type = genomic DNA
caggaaacttcgggacgagggcaggacgggggctggacgggcccagccattg

SEQ ID NO: 28922 - DNA, 181 bp, Homo sapiens
  misc_feature 1..181: note = chr4:53728041-53728222
  misc_feature 1..181: note = hyper
  source 1..181: mol_type = genomic DNA
ccaaatcagggcgggcggcactaagccggggagcaaacaccgctcccggcccgcccagagcagacgccctaggttggggctgcagcgagtgcgcgcgtgggctgtggagccggcggaggcagcggtccggaatggctctgtggaggctgcgctctcttcctggccccgcagccacagcagc

SEQ ID NO: 28923 - DNA, 309 bp, Homo sapiens
  misc_feature 1..309: note = chr4:53728688-53728997
  misc_feature 1..309: note = hyper
  source 1..309: mol_type = genomic DNA
gaacatgtgcaccatcgccgagtaccccgcgccgggcaacgccgcggcctccgactgctgtgtgggcgccgccggccgccgcctggtcaagatcgccgtggtgggcgccagcggcgtgggcaagaccggtgagtcgtcgcgcttagccctgggtctggtcttggacgacccctgacgggagttgaggctgaacaaggcgtggggagcggtgggagctgcagcccgaccgctctccgtccccgcgcagggagccgctgccccttgggagtgggcttagccgttgtctacgccacccgcctgcttccacag

SEQ ID NO: 28924 - DNA, 1693 bp, Homo sapiens
  misc_feature 1..1693: note = chr4:54965799-54967492
  misc_feature 1..1693: note = hyper
  source 1..1693: mol_type = genomic DNA
aggggtaggtgtaaccgtggccagagctgcgctcagggactggacgactgccagtccgtcgcccgcacaatcctgctccaaaccgcaggcctcacacttcaccgcgccgcagccacccctaccacagaggagctggaaacactgagcattcctattaaataagcctccaagtccccacctggtacgctttgcggtggggcgtggggaagagttgggctgcggccagggtagcgagagggggtgggatggaggatgcagcgctgtgatttctcagtaaagcgtggagaaagagggggaggaggccggcctccccgggaaattaacaaaacctacactttgcaaagtctcccccatccccctcccccgagttcttccccgccgcgcgcccgcccctcctcgcggcttctgttgtgactcgggcagcctatcccgagggtgcggagctgccgaggagcctgagccgagcggtactccgcagcatcacgtgccagggtggggggctataaaatacccgagccggggcgccgggcgggggacgtgaggaccagccctctccggggacccctttgttcccagcccagacgccaacacctctgcgtccccaagggcttgactgcccgtgtctgcgcggctcccagggcagagcttagaacactagaggagaggggtcgccgcgaactgccggggcttccagccacccacccctctcgacatgtcgcgctccttctatgtcgactcgctcatcatcaaggacacctcacggcctgcgccctcgctgcctgaaccgcaccccgggccggatttcttcatcccgcttggcatgccgcccccattggtgatgtccgtgtccggccccggctgcccgtcccgcaagagcggcgcgttctgcgtgtgccctctctgcgtcacttcgcacctgcactcctctcgggggtctgtgggcgccggcagcgggggcgcaggggccggggttaccggggccggaggcagtggggtggcaggggccgcaggggcactgcctctgcttaagggccagttctcttcggctcctggggacgcgcagttttgcccgcgggtgaaccatgcgcatcatcaccaccacccgccgcagcaccaccatcaccatcatcagccccagcagcctggctcggccgcggcggcggcagcagcagcagcggcggcggcggccgcggcggccttggggcacccgcagcaccacgcacctgtctgcaccgccaccacctacaacgtggcggacccgcggagattccactgcctcaccatgggtagggcggggtcttggggcacctgcgctccgcgcctttcgcgctcctggagcaaactttccacctccagtggaggaagtgggagcccggggacagggtgaagagagaggacgggcttttagtgtaaccgtagagtcagccacagaagttccacgaaagtggaagttagtttgccagcttctccactcagcctggtgcgttttactcctagtagtaggtgctcgagtattgccttattaatactggggccttagggacctcgaacgtcacggcggataaaccagaggttaactgcttgggatttggggtgggtgtgtttgaacctgtgtggcatccccgcgtcggggcggctaaagcgtcttgacgtttttggctaagcctgcgcgcttctccgcttggctcaaagg

SEQ ID NO: 28925 - DNA, 24 bp, Homo sapiens
  misc_feature 1..24: note = chr4:54969747-54969771
  misc_feature 1..24: note = hyper
  source 1..24: mol_type = genomic DNA
gagtgttgtctttagcgcgcgcgc

SEQ ID NO: 28926 - DNA, 684 bp, Homo sapiens
  misc_feature 1..684: note = chr4:54969831-54970515
  misc_feature 1..684: note = hyper
  source 1..684: mol_type = genomic DNA
gaaggaaaatccctcttcgttccgtcaagggacatagggaggagggcccgcactgtgtgaggctgaaaagggagctgccggcgctttgtgcaatgtgctgagctctgtcctgcgcagaggtcccagacagccggctcactactgcctggcctgggaagctcaggcctctggatctctttcctcctgtctctcacgcgcagagctccgggctcttcgccctgcccgccacgaaagggaggaggcgcaggccggctgcctttccaaaagattctgtctcccttcttcccaagaagcaggcctctccgcgcgcgagaacagaggtgggaggacgggagtttgcaggcgcaaagaacaggagtttaagcagactatttccaccaggggaaataagaagcacaaagagcgcctgctgcagctctttgcgctcttgcccaaagctaagcttcctctgggctgtggggagactcctctggtccccgttccatctacccagcccggcccctctggggctcagcgcttgggtttagccctcccctatgtccatgactagccccgatcacagtctcttaagcctctcccggcccccggctcccaggccctgcggagccaagcacttggaacaccaggtaccgcgcgcggtggacccagctctgccatgccgcagatagccgcagtgccaaccct

SEQ ID NO: 28927 - DNA, 164 bp, Homo sapiens
  misc_feature 1..164: note = chr4:54975768-54975932
  misc_feature 1..164: note = hyper
  source 1..164: mol_type = genomic DNA
atattaatagtgtggcgaaagttttttgtgtgcgtgtccttttctaggtcgggggtggggaggggcggtgggtggacgcagagggaggaaggctcagccttggatccttgccacctgaacaacgtcgcctctgcccacgtggaaagcctcgcttgtctggcagc

SEQ ID NO: 28928 - DNA, 126 bp, Homo sapiens; identical to SEQ ID NO: 370
  misc_feature 1..126: note = chr4:54975990-54976116
  misc_feature 1..126: note = hyper
  source 1..126: mol_type = genomic DNA

SEQ ID NO: 28929 - DNA, 15 bp, Homo sapiens
  misc_feature 1..15: note = chr4:54976170-54976185
  misc_feature 1..15: note = hyper
  source 1..15: mol_type = genomic DNA
cgtgggaaagagacg

SEQ ID NO: 28930 - DNA, 919 bp, Homo sapiens
  misc_feature 1..919: note = chr4:55092914-55093833
  misc_feature 1..919: note = hyper
  source 1..919: mol_type = genomic DNA
aaaagacccgcagcccgcctcaggagggcaaggtttctagccccctgcggctccgggaccacccaggacccggggcgtcgtgggaccgatctcgaaggatcttagaacgacactgggagagcgcggcaagaactagccccaccttcccccgacgccccggactgactgccgggcgcagacccgacttctcccgaaccagcctcggaccagccttagaaggcggaaaacaggattcaaacccgcctatgagcagtggtaggggcgggggctgtgggggcaggactcggtttaaggaaccaaccgcctcggttcgagggcctcctgtccggaggttgctcctgaccactgggtttattttgcttttgcagaggaggcagatgttgacctctcttctttgcacagtctctccgcaaaattttcccccaaccatttgctttcttgcgccaccccccaccggggcactatccctggagtcagctcctcaggcctttaaaccttccagaatgtcacacatggaaacctttagcaaatgtttgttaatgatcataacaaaggcatcattcaaattaggcaggtaattactaccagaaggacaactgggtgctcgcttgctcatccattgctttctgctttaaactcccgaggagtcgctgcctggagacactcccgcccggactgcttctcgggccccattaaacggctctgaaatgaactgtgaagttaccatttgtgggcggagagcgctggggccctgcggacggaagaccctggcttgaccggactaacagtgtcgccgaagcaaagcagcccctctgggtaggctgtctgtctcgcctcctaccctctggggcaactagcctaaaaacccggttctcaacttaacagcatgtggcccagcacccgcttttgccttttattc

SEQ ID NO: 28931 - DNA, 123 bp, Homo sapiens; identical to SEQ ID NO: 7383
  misc_feature 1..123: note = chr4:55093888-55094011
  misc_feature 1..123: note = hyper
  source 1..123: mol_type = genomic DNA

SEQ ID NO: 28932 - DNA, 74 bp, Homo sapiens
  misc_feature 1..74: note = chr4:55094012-55094086
  misc_feature 1..74: note = hyper
  source 1..74: mol_type = genomic DNA
ggtcgcgtagaagaactgcggcaatgggacccccagcgcagccccaggcgccctgttttcgaggctgacatccc

SEQ ID NO: 28933 - DNA, 92 bp, Homo sapiens
  misc_feature 1..92: note = chr4:55094514-55094606
  misc_feature 1..92: note = hyper
  source 1..92: mol_type = genomic DNA
cgcggcgggagggaacggagggagaatcaaaaggcatcctcccccacgacgcggaggcggtggtacgattcctcaaacgcccaagcttgagc

SEQ ID NO: 28934 - DNA, 58 bp, Homo sapiens
  misc_feature 1..58: note = chr4:55096214-55096272
  misc_feature 1..58: note = hyper
  source 1..58: mol_type = genomic DNA
tacagcacagggagccggccgaatgcgcgtgattactggacggcgctgctctgggaga

SEQ ID NO: 28935 - DNA, 103 bp, Homo sapiens
  misc_feature 1..103: note = chr4:55096538-55096641
  misc_feature 1..103: note = hyper
  source 1..103: mol_type = genomic DNA
ggatttgaggaatttcgaaccgcacaccaaggggccctcattgtgctccgtggcccccgcccccgcctgtcttcccgcgccccctcctcggtggaatcatttc

SEQ ID NO: 28936 - DNA, 60 bp, Homo sapiens
  misc_feature 1..60: note = chr4:55097404-55097464
  misc_feature 1..60: note = hyper
  source 1..60: mol_type = genomic DNA
atatcaggtccctaccgccccgcgtccgaaaagccgcgggctgggcggtgtgggaaatgg

SEQ ID NO: 28937 - DNA, 93 bp, Homo sapiens
  misc_feature 1..93: note = chr4:55098197-55098290
  misc_feature 1..93: note = hyper
  source 1..93: mol_type = genomic DNA
cgtggtggccagcgccttcctgcagaccccacagggaagtactccctttgacctccggggagctgcgaccaggttatacgttgctggtggaaa

SEQ ID NO: 28938 - DNA, 164 bp, Homo sapiens
  misc_feature 1..164: note = chr4:55098605-55098769
  misc_feature 1..164: note = hyper
  source 1..164: mol_type = genomic DNA
aaacccgacttggggcgcctccttccctgcctcctactgcagtttctcggcccccgcgaaaggggagcgacaagcgcgggtgggcgcggactcttgagggggcagaggcggctatggcgcgtgtcgggcaaggtggcaccagaaggcacttttgtgtgtgtgtg

SEQ ID NO: 28939 - DNA, 104 bp, Homo sapiens
  misc_feature 1..104: note = chr4:55099069-55099173
  misc_feature 1..104: note = hyper
  source 1..104: mol_type = genomic DNA
gccgagagggcgcatgctagctctcctcagcattcccggtgagccgctacccacggccgtgcggctctcgtgcccataggaggcgctggcgagctcctgtaacc

SEQ ID NO: 28940 - DNA, 30 bp, Homo sapiens
  misc_feature 1..30: note = chr4:55099383-55099413
  misc_feature 1..30: note = hyper
  source 1..30: mol_type = genomic DNA
catcgccgccaaccccgggacaaccaagcc

SEQ ID NO: 28941 - DNA, 208 bp, Homo sapiens
  misc_feature 1..208: note = chr4:55523645-55523853
  misc_feature 1..208: note = hyper
  source 1..208: mol_type = genomic DNA
cccatgccacctccacgagcagcggcgtccagcctcctcccgcccgaacgtgctcgaggggcgggcagtcgacctttattgtctggggagcacctggcaggtggcgggcccgtgccctaacgtgtgcgtggtgcccagcttcacaaagcgagcgggcagcacctccttggtccgggaacggcctcagcctggccgtccacatcccagg

SEQ ID NO: 28942 - DNA, 32 bp, Homo sapiens
  misc_feature 1..32: note = chr4:55524220-55524252
  misc_feature 1..32: note = hyper
  source 1..32: mol_type = genomic DNA
ctgctcctactgcttcgcgtccagacaggtgg

SEQ ID NO: 28943 - DNA, 689 bp, Homo sapiens
  misc_feature 1..689: note = chr4:55524562-55525251
  misc_feature 1..689: note = hyper
  source 1..689: mol_type = genomic DNA
acgttgcgcggggggcggaggcggggggctcaggggtttgcaccgagcgccttctcttgccgtgcgaggcgcggccgcagcttccttttgttaaaagttgcgtgtgtgtgaccggcgcccgggaggacctgcctgcaggttctccgccgcgctgagggcaaagttagagagccctttctctgctctgcggctactgccttccaaccgcaggcgctctttgtgcccagagctggggaccgacccgctgccgcctctgctcgcggcgccacccgtggagaccaatcgaaggctgcggcgtttccccgcctccgggttaggcttttgcgctgggagtgcgcggcgtggggctgttgtggggccggactcccgcgagcctggaggtggtggcgacagggacaacttgggcagggcgtgtggaaagcagccgctaggttgcagactttttgctttcgtacatcccgtgctcgcccctttctgccgcggcgccgtttcattcctgccgcgcgccccggggcggctggaggctgtgtttgccgcctgctccgggaaggcaagggacagcgtgctgggactctgcgttccctgactccaaccgcctagcacgccggccagagtgcccggcctgcctggcgggttctgaaagcccctagttcccggtgtctgcgacctgtattcgcaggtcctgtttt

SEQ ID NO: 28944 - DNA, 191 bp, Homo sapiens
  misc_feature 1..191: note = chr4:55990946-55991137
  misc_feature 1..191: note = hyper
  source 1..191: mol_type = genomic DNA
ccgatccgggagacccggcctgagattccggcaaggttttcttccccgggcccggactaggatgttgcgcgcagccagacaacttttcaccgcctgttctcgcctgcggaggcacctcctgcctgccaaccccaggcgccttcccaccccagcctcccaagagcctgagggtgtgtcggcatctcaggaca

SEQ ID NO: 28945 - DNA, 30 bp, Homo sapiens
  misc_feature 1..30: note = chr4:55992154-55992184
  misc_feature 1..30: note = hyper
  source 1..30: mol_type = genomic DNA
cgcgtctgaagtggccgagaatctgcagca

SEQ ID NO: 28946 - DNA, 86 bp, Homo sapiens
  misc_feature 1..86: note = chr4:56501604-56501690
  misc_feature 1..86: note = hyper
  source 1..86: mol_type = genomic DNA
gcacacttgcctctccgactttatgtgatgagaagttctctattccttttcctgatctagtgcctgaaaaccgataaggcacaaag

SEQ ID NO: 28947 - DNA, 30 bp, Homo sapiens
  misc_feature 1..30: note = chr4:56503489-56503519
  misc_feature 1..30: note = hyper
  source 1..30: mol_type = genomic DNA
cgcaccgcccctccccgccccctctccccc

SEQ ID NO: 28948 - DNA, 128 bp, Homo sapiens
  misc_feature 1..128: note = chr4:56659934-56660062
  misc_feature 1..128: note = hyper
  source 1..128: mol_type = genomic DNA
cgcactccccgggtatgctgcgggccctctccatccggggaggcggggtccggggaggacacatccccggcccggcctctccgagagaccctttggatttttctcttccacaccgcctcatccgaggg

SEQ ID NO: 28949 - DNA, 30 bp, Homo sapiens
  misc_feature 1..30: note = chr4:57371838-57371868
  misc_feature 1..30: note = hyper
  source 1..30: mol_type = genomic DNA
aagaagccctgcatccgcgaggtaagcggc

SEQ ID NO: 28950 - DNA, 166 bp, Homo sapiens
  misc_feature 1..166: note = chr4:57371869-57372035
  misc_feature 1..166: note = hyper
  source 1..166: mol_type = genomic DNA
gttggcggcggtgccggggttggcagcgcccgcgggttgtctacgccgcggggcctacgtctctgtcgggcgtgcacctcgggagccacacctggggcccagagccaccgctcagcacgcgggcacgcggcgggagggaaggaaaccgcggcgctggggatggaga

SEQ ID NO: 28951 - DNA, 117 bp, Homo sapiens
  misc_feature 1..117: note = chr4:57372387-57372504
  misc_feature 1..117: note = hyper
  source 1..117: mol_type = genomic DNA
ggaggcccccgaccgcgtgggagcgaatggatctcaactgagggctatttacctatggatgaaagagatgcgccaaactttgaacgacccatccccttttcccgggccccctgccca

SEQ ID NO: 28952 - DNA, 192 bp, Homo sapiens
  misc_feature 1..192: note = chr4:57396459-57396651
  misc_feature 1..192: note = hyper
  source 1..192: mol_type = genomic DNA
tccttgctctggacacggggaacagggtcagcatctcgtctcctatctccaccgacctgtctctggcttttcttagtccccagatgcgcccagaaggtcctggagagtggtgcgtccccttggcaaccgtacaacgcgcaggaaggcggagtgagatgaggctgagtccggccggggcggggctgtgtggga

SEQ ID NO: 28953 - DNA, 379 bp, Homo sapiens
  misc_feature 1..379: note = chr4:57396946-57397325
  misc_feature 1..379: note = hyper
  source 1..379: mol_type = genomic DNA
tgtgctcaggattctcgacactcacagagagcttgaggagtccgaggatcccgagaaacacgagaatcccgaggaacccgaggaggtcagggagcaagaccagagagacgagtccgaggaatgtgatgagcctcatgagtcctatgagccccacgctccctatgcgccccacaagccccgggactcctatgcaccttacgaactccatgggccccatgcagcccccaaactcctcaaggcccgtgaaccccgccagctccgccacacccgtgagccccgcaagtcccgcgaggccaaggaaaccgagttgcttcccagcgccgcagtaatgatctccccctctctgatcaccagagccccgccacggcctcagctgtct

SEQ ID NO: 28954 - DNA, 15 bp, Homo sapiens
  misc_feature 1..15: note = chr4:57521381-57521396
  misc_feature 1..15: note = hyper
  source 1..15: mol_type = genomic DNA
aattttttaaaaaat

SEQ ID NO: 28955 - DNA, 159 bp, Homo sapiens; identical to SEQ ID NO: 372
  misc_feature 1..159: note = chr4:57521505-57521664
  misc_feature 1..159: note = hyper
  source 1..159: mol_type = genomic DNA

SEQ ID NO: 28956 - DNA, 683 bp, Homo sapiens; identical to SEQ ID NO: 373
  misc_feature 1..683: note = chr4:57521700-57522383
  misc_feature 1..683: note = hyper
  source 1..683: mol_type = genomic DNA

SEQ ID NO: 28957 - DNA, 396 bp, Homo sapiens; identical to SEQ ID NO: 374
  misc_feature 1..396: note = chr4:57522419-57522815
  misc_feature 1..396: note = hyper
  source 1..396: mol_type = genomic DNA

SEQ ID NO: 28958 - DNA, 187 bp, Homo sapiens
  misc_feature 1..187: note = chr4:57687669-57687856
  misc_feature 1..187: note = hyper
  source 1..187: mol_type = genomic DNA
gtcgccgaggccgcccggagcagggcagggtccgccgccggtctgactcccaaacccgcttttctccggaggtccccgctcgccaggaccgctccgagcgctacctgcgaaggtaactgccaggagcagcagcgccaagcgcagcaccgacagcgccatcctcctcccgcgccggctgtcttgcccc

SEQ ID NO: 28959 - DNA, 923 bp, Homo sapiens
  misc_feature 1..923: note = chr4:57975777-57976700
  misc_feature 1..923: note = hyper
  source 1..923: mol_type = genomic DNA
ttctacatatacacccggccctcactttctggacgcacgcagcaaactctcaaaataaaaccaccaaaaaggagaagggggggcgtcgcccaccgctcctggcattccgcggctgccaactctttccctcccatctggctcctgggatgcccgcgggggaatcgcagtgagcagcgcggggcgaggccgccgcggacgccccgtcggatgtgcccttcgctgggccgagcggcgcagggttggagagggaagcgctcgtgcccaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccttccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcgggaaccacaccccggggcggtgagagcacgggggccccgcccgtgccgccctcccggccccgcggggcctgcgcgcgcgctcctgctggcgt

SEQ ID NO: 28960 - DNA, 30 bp, Homo sapiens; identical to SEQ ID NO: 7405
  misc_feature 1..30: note = chr4:57977077-57977107
  misc_feature 1..30: note = hyper
  source 1..30: mol_type = genomic DNA

SEQ ID NO: 28961 - DNA, 290 bp, Homo sapiens
  misc_feature 1..290: note = chr4:62065781-62066071
  misc_feature 1..290: note = hyper
  source 1..290: mol_type = genomic DNA
gagagagagggagagcgagcgccgaggcgggcctcgaagccactggagaggtaccctttgtctgacaaaccctgaaagggaagcctctagtagcagccctcccgttcccacctccaagcgtttgccgaactgctaggtggagcccgcgccgcggagcccacgagcactccatatccgggttttgccggccacccctttccctggcgcgagccccctccccggctctcggagctcttgccgctggcccgcccgaccgctgctcattctggcctccgctccggccccggctg

SEQ ID NO: 28962 - DNA, 335 bp, Homo sapiens
  misc_feature 1..335: note = chr4:62066133-62066468
  misc_feature 1..335: note = hyper
  source 1..335: mol_type = genomic DNA
cgtcgcccccctcgcctgctggcccggcaccgctcgctccagttcccaggagcggggatgcagatgctgcagctggtcggggtgggcgccgccgccgccgccgccgccgctgctgctggtttttctcggactgctcgttgcctccgctccggcagctgctgccgccgccaccgccgcctgtgactcgccccctcccctttctttcttctctttttgccttggtcctcttcctacgggtgtgcgcgcgcgcgggttgcacggtttgctttggcaggagctcgctcgtgtgtgcgcgtgtgtgagtgtgcgtgtctggagagcgccagtgcctcgct

SEQ ID NO: 28963 - DNA, 360 bp, Homo sapiens
  misc_feature 1..360: note = chr4:62066855-62067215
  misc_feature 1..360: note = hyper
  source 1..360: mol_type = genomic DNA
gcggaaaggggaggacgtggaagaagaaaaagaaagagaaggggggtggggtgggagaactggatataaagatcggctggggggatggtggaagatttttggtctcttcggcagcgtcttttcttaagcggcggcggcagcagcagcagcaagagaaggagaagcagccccagctatgactgccgcatgttaatagctgccgctgggtccctcggctgctgctggagacagagcctgactccgaagttgtgcaactgtggactgggagagacatttgaaccctcttttcttttcgctccccttttgcccccttggggtgtgtgaagcgaggaacgtaaaggaaggcgaacatttggctct

SEQ ID NO: 28964 - DNA, 184 bp, Homo sapiens; identical to SEQ ID NO: 2422
  misc_feature 1..184: note = chr4:62067440-62067624
  misc_feature 1..184: note = hyper
  source 1..184: mol_type = genomic DNA

SEQ ID NO: 28965 - DNA, 103 bp, Homo sapiens
  misc_feature 1..103: note = chr4:62068099-62068202
  misc_feature 1..103: note = hyper
  source 1..103: mol_type = genomic DNA
gttgtgtctccttcacggcagtttggtttagacctgcgtgcccaggctttgttaggcggttttggctggagaaagctgccactttcgtgggtggcccgggctg

SEQ ID NO: 28966 - DNA, 116 bp, Homo sapiens
  misc_feature 1..116: note = chr4:62068237-62068353
  misc_feature 1..116: note = hyper
  source 1..116: mol_type = genomic DNA
cggtgttgcacgaatccgggcggccgcggcgccggggcggggtgggcagagcattggtggtcgcggttggcgggttacaggtaggagagaaggcacctcggcgcttctctgaggag

SEQ ID NO: 28967 - DNA, 30 bp, Homo sapiens
  misc_feature 1..30: note = chr4:62068633-62068663
  misc_feature 1..30: note = hyper
  source 1..30: mol_type = genomic DNA
cttgcttattgaaatcgcctgggatcctct

SEQ ID NO: 28968 - DNA, 30 bp, Homo sapiens
  misc_feature 1..30: note = chr4:66534335-66534365
  misc_feature 1..30: note = hyper
  source 1..30: mol_type = genomic DNA
ggctgagcactgttccgggagcacgaagag

SEQ ID NO: 28969 - DNA, 265 bp, Homo sapiens
  misc_feature 1..265: note = chr4:66534894-66535159
  misc_feature 1..265: note = hyper
  source 1..265: mol_type = genomic DNA
ccactccttcaagcccgaaatgtcacttccccacgcgccttaagtgaggcccagccgcacccatccccctggaacgggcctccattccccaaaggaggcctcgacctcctttcccccaaggttttccaccttcccagccccccaaccagcctctgtccacacgcatgttccttgcccagcactccgcagctaacgtcaaacaatgcaaccaaaaaccgcagaggggagcgaaaaggccagtggaaggggacgacaaataccaatt

SEQ ID NO: 28970 - DNA, 475 bp, Homo sapiens
  misc_feature 1..475: note = chr4:66535574-66536049
  misc_feature 1..475: note = hyper
  source 1..475: mol_type = genomic DNA
cgccttctggcacgcggctcctccaaatgtaggaaccacggatccggctgagacagctgaagtttgcttctggctcctctcgcctccccctttggtggggttaaatgaaatattagttctggttgctagtgcagatctggactcggatcaagggtgtcgagagggtcctgggtcctgttcctttgcctttcaaaaagactttttacggattgagaatttttaaataccactaggggaaaggtgaaggttctttgcagccttcagtgttgaaatggacgaaggtaaggaaggcaaatcattttaagacgaaatctccgattttttaaaaaaggaggaaaaaagcagggtggctaaggataaagaaagaggacttgagaaaatgtggagaatgaaaaacaggagagcagcgagcaaaagcaaagatccagagttcaaagagactggcagaaggaaatagctgcgggctgagtgctga

SEQ ID NO: 28971 - DNA, 48 bp, Homo sapiens
  misc_feature 1..48: note = chr4:66536391-66536439
  misc_feature 1..48: note = hyper
  source 1..48: mol_type = genomic DNA
gtgagtgttgcctagcggtctccgggaaaggcgcgtcttcctcccggg

SEQ ID NO: 28972 - DNA, 228 bp, Homo sapiens
  misc_feature 1..228: note = chr4:71600396-71600624
  misc_feature 1..228: note = hyper
  source 1..228: mol_type = genomic DNA
ttcctatctaaaccacgaaagaggtgcatgctgcctctgatctgaccgtaacatactctgcataaaatcagcttttccttcctgtttcaggactactttcagtttcttcctgtctctttgatactcttgcactagcgttggcttcagtgcactgtcattaaccacagtgccttacagtattttcttctattggtgagccttttctggacctttcgtgaaacagagctt

SEQ ID NO: 28973 - DNA, 241 bp, Homo sapiens
  misc_feature 1..241: note = chr4:73433899-73434140
  misc_feature 1..241: note = hyper
  source 1..241: mol_type = genomic DNA
ggatctctccctgtccggcccaaggacttcctgaaacccccgcctccggctgcccgaaaaaaccgtgagtcagttcggaggagagaaagctccaggaacccgactctggcggcagcagccagagcgctgggatcccggacccagcgtccagaacttcattcaagcgcccagaccgccctccagaaaggggaagcccagatggcccggcgaggatgggaactggctgcggtttgtcactagg

SEQ ID NO: 28974 - DNA, 279 bp, Homo sapiens
  misc_feature 1..279: note = chr4:73434964-73435243
  misc_feature 1..279: note = hyper
  source 1..279: mol_type = genomic DNA
acgcagaggtgggggcgggaggagcgaaggggaggaggagaaggcaggcggaggaggtgggaggagtgggccgctcgccggctcctgttgctcgcagcgcggcagtctgctggctgctggcgacccgcggggcgctaataaggcgtccggagctccccggactgcccctcccgccgtggcgcccacgtcatgcggggcccgaacccgcgccccccgcaccgtgtcaggattggagaccgctcgggggctggtgtggcccgggctcgacctcccaccctg

SEQ ID NO: 28975 - DNA, 69 bp, Homo sapiens
  misc_feature 1..69: note = chr4:74702331-74702400
  misc_feature 1..69: note = hyper
  source 1..69: mol_type = genomic DNA
gagtttcctgccagtcgggagggatgaatgcagataaagggagtgcagaaggcacgaggaaaccaaagt

SEQ ID NO: 28976 - DNA, 168 bp, Homo sapiens
  misc_feature 1..168: note = chr4:74809865-74810033
  misc_feature 1..168: note = hyper
  source 1..168: mol_type = genomic DNA
gactcgctgggtgagcgggactgttggcgcggggtgctaccccagccgtgtcccgctccggagaccccagggcgccgggacccatctgccgctcgccggccggaggctaccaggagcaggagcagcagcgccgcccgcagtagccggggagcgcgggggacagcgggg

SEQ ID NO: 28977 - DNA, 62 bp, Homo sapiens
  misc_feature 1..62: note = chr4:74810262-74810324
  misc_feature 1..62: note = hyper
  source 1..62: mol_type = genomic DNA
tgggtgggtggtgggcggtggctggttacccactggtgcagcctccccggctcgccttccag

SEQ ID NO: 28978 - DNA, 234 bp, Homo sapiens
  misc_feature 1..234: note = chr4:74904177-74904411
  misc_feature 1..234: note = hyper
  source 1..234: mol_type = genomic DNA
cgcccaccccagccgcgtccggcccggggaccccagggcgccgggacccacctgctgcgcgccggctggcggccaccaggagcaggagcagcagcgccacccgcaggagccggggattgctgggggcggcggagagcgtggcgtgggccatggggctcagcagacgcgtcgggaagctgtgcgagaagcgggagagctggcggggaggtgcctgcgacccgggctgtgtggctc

SEQ ID NO: 28979 - DNA, 92 bp, Homo sapiens
  misc_feature 1..92: note = chr4:75230955-75231047
  misc_feature 1..92: note = hyper
  source 1..92: mol_type = genomic DNA
tgctcccgccctgcccgtgcactctccgcagccgccctccgccaagccccagcgcccgctcccatcgccgatgaccgcggggaggaggatgg

SEQ ID NO: 28980 - DNA, 81 bp, Homo sapiens
  misc_feature 1..81: note = chr4:76555351-76555432
  misc_feature 1..81: note = hyper
  source 1..81: mol_type = genomic DNA
ttgtgatttcttctgcggacgcagtcacgagtccagggcgaagcaggcagggaggcaggtgggcctcggtccgccgcaagc

SEQ ID NO: 28981 - DNA, 82 bp, Homo sapiens
  misc_feature 1..82: note = chr4:76555649-76555731
  misc_feature 1..82: note = hyper
  source 1..82: mol_type = genomic DNA
cctgggaacctgcaccgctccaactacccctgggcgaaggcgttggccgcggagctgcaagggggggcggtttctcacccgc

SEQ ID NO: 28982 - DNA, 32 bp, Homo sapiens
  misc_feature 1..32: note = chr4:77228302-77228334
  misc_feature 1..32: note = hyper
  source 1..32: mol_type = genomic DNA
ccaggctggttggtacgcgcaggcaggtttct

SEQ ID NO: 28983 - DNA, 30 bp, Homo sapiens
  misc_feature 1..30: note = chr4:77819543-77819573
  misc_feature 1..30: note = hyper
  source 1..30: mol_type = genomic DNA
tctaagtctccgccacgcaggaaacaaaag

SEQ ID NO: 28984 - DNA, 15 bp, Homo sapiens
  misc_feature 1..15: note = chr4:79472968-79472983
  misc_feature 1..15: note = hyper
  source 1..15: mol_type = genomic DNA
tgttcgcagtttact

SEQ ID NO: 28985 - DNA, 259 bp, Homo sapiens
  misc_feature 1..259: note = chr4:81106122-81106381
  misc_feature 1..259: note = hyper
  source 1..259: mol_type = genomic DNA
tttcagaagcagttgcgctgggggtggggaaagggagggaagggacattgaaaggccgcagtggctggcaactccgcgcccgtccgatgtcctctctaatcccccagtgttctggcgcgtacccacagtgcccccagaccctccgctcgcccgtgcgccgaggtcgttgggttttagacccagagagcacgttccgtaagctcccggcccaaatcccctcggaaaaattaatcacaaccaccagcggatgcaaaatgtg

SEQ ID NO: 28986 - DNA, 325 bp, Homo sapiens
  misc_feature 1..325: note = chr4:81123055-81123380
  misc_feature 1..325: note = hyper
  source 1..325: mol_type = genomic DNA
ctcactaagcagggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgc

SEQ ID NO: 28987 - DNA, 232 bp, Homo sapiens
  misc_feature 1..232: note = chr4:81123381-81123613
  misc_feature 1..232: note = hyper
  source 1..232: mol_type = genomic DNA
aagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggcc

SEQ ID NO: 28988 - DNA, 290 bp, Homo sapiens
  misc_feature 1..290: note = chr4:81123614-81123904
  misc_feature 1..290: note = hyper
  source 1..290: mol_type = genomic DNA
gggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcac

SEQ ID NO: 28989 - DNA, 610 bp, Homo sapiens
  misc_feature 1..610: note = chr4:81124121-81124731
  misc_feature 1..610: note = hyper
  source 1..610: mol_type = genomic DNA
gcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaa

SEQ ID NO: 28990 - DNA, 37 bp, Homo sapiens
  misc_feature 1..37: note = chr4:81186703-81186740
  misc_feature 1..37: note = hyper
  source 1..37: mol_type = genomic DNA
ataacagtctggggacgttgcccgtacagggaaattc

SEQ ID NO: 28991 - DNA, 758 bp, Homo sapiens
  misc_feature 1..758: note = chr4:81187040-81187798
  misc_feature 1..758: note = hyper
  source 1..758: mol_type = genomic DNA
cgtcataatgttcagcgcagccgagagtttccaacaagaaagcagctccagtcgtggcatgatgactcagggtggcgttttaaacgctgaataaacccattccttagctctttaataaatcgctaataacagcaaaaacagccttctccccgaaccgcgccacaccaaaggcttcccaagttgggctgcgaatccctgtttggttttccaacgccgaaagacgtagaagcagtgggatctcctggtgggacgcatttctccaagggctcccagagagaggacgagatagcagggtttacagggcaaagagaggagaacctggaaatcgtgtcctggggggcaagagtgcgttgcccagtcacaagtgtgctgtagaggtgggagaggacaaggacccatttccacatttcaaccctccgtttctatcgctgcccctggaggactcagctgctaacgccgagctcgtttccacgcggctctggtcctagtcggggaatccgggtggccgcgcgacgcgagagaactgctgggatgcgtggccctggtatgggcgcacccagcgtccggggcgcaggttctctcagcccagcttctcctcccactcactcgctcggatctcctccctccttcacatcccccgcccccgggaccgcgaggctccctccccgcaccggccagtgagtacacaaagccgcgggtgaggggaagcttcgcaggcgtgcacggagcagtgagatcactggcgttataaatatccc

SEQ ID NO: 28992 - DNA, 517 bp, Homo sapiens
  misc_feature 1..517: note = chr4:81187799-81188316
  misc_feature 1..517: note = hyper
  source 1..517: mol_type = genomic DNA
gtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatccca

SEQ ID NO: 28993 - DNA, 143 bp, Homo sapiens; identical to SEQ ID NO: 7425
  misc_feature 1..143: note = chr4:81188384-81188527
  misc_feature 1..143: note = hyper
  source 1..143: mol_type = genomic DNA

SEQ ID NO: 28994 - DNA, 222 bp, Homo sapiens
  misc_feature 1..222: note = chr4:81189713-81189935
  misc_feature 1..222: note = hyper
  source 1..222: mol_type = genomic DNA
cgcaagtgggtaaggcggtaggctggctagcctcctccggtgggttaagggggcctaatgcggaagacctgatggttcatgctgagagaaaagcaggtctatgcccgcccctctgcgcctgtctagtctatctgatcgcgctgattcagcagcctgcggcgcacgtggtgagggcgcctggagcgcccagctggagagagggccctccgcacacgcaccagc

SEQ ID NO: 28995 - DNA, 405 bp, Homo sapiens
  misc_feature 1..405: note = chr4:81256834-81257239
  misc_feature 1..405: note = hyper
  source 1..405: mol_type = genomic DNA
actgattggcaggaacgaagtgggtggagcctcctgaccctgccctcctgcttccgttgctagggacgcttcggccgaggataccgcaatggatcaggaagaggggctgaaggccttggacaatattgtcactcaattcaacgcctatgaagatttcctggactcgcagatcactactgtggacttgtactacctggaggtaagggcggagcgcggcagagtagccgccgccgcgcgtccctcggtccctcctcgagttcccgcttcgtgggctggtcgccccctggcgctggacagctcagctgtcaggcgccgcggtttcgggaccgcgacactaaagccgctggcgaggtgaattgccgcgtccttaccgccccgcgctccccggtccggacagaacttggg

SEQ ID NO: 28996 - DNA, 101 bp, Homo sapiens
  misc_feature 1..101: note = chr4:81951400-81951501
  misc_feature 1..101: note = hyper
  source 1..101: mol_type = genomic DNA
aggaagctatgatgacgggctgcaggtgcaggggcccgcagtgtccgtcagaagaggctcgggaaagtaagcgagaatggtgttcacgttgtgactttgtt

SEQ ID NO: 28997 - DNA, 100 bp, Homo sapiens
  misc_feature 1..100: note = chr4:81951777-81951877
  misc_feature 1..100: note = hyper
  source 1..100: mol_type = genomic DNA
tgcaagctaagagggcgaggacgagggagtgggagagattggctgaggactctacagatcagctagagagcgaaagaactaagtctctctctctcataca

SEQ ID NO: 28998 - DNA, 375 bp, Homo sapiens
  misc_feature 1..375: note = chr4:81951937-81952312
  misc_feature 1..375: note = hyper
  source 1..375: mol_type = genomic DNA
aactcggaccagccgcgccgcagctgctccaatccctggaaaaggcaatcgagcgccctccggaccgctgcgcacagccccggctccgacctggcgcccaaaacagagctagtcctagtccctcgcgcggccagtttggccgggtgttcccaaaaataaagcgaggagggaaggtacagacagatcttgaaaacacccgggccacacacgccgcgacctacagctctttctcagcgttggagtggagacggcgcccgcagcgccctgcgcgggtgaggtccgcgcagctgctggggaagagcccacctgtcaggctgcgctgggtcagcgcagcaagtggggctggccgctatctcgctgcacccggccgcgtcc

SEQ ID NO: 28999 - DNA, 573 bp, Homo sapiens
  misc_feature 1..573: note = chr4:81952363-81952936
  misc_feature 1..573: note = hyper
  source 1..573: mol_type = genomic DNA
cgccgccggctccttgcgccttcggagtgtcccgcagcgacgccgggagccgacgcgccgcgcgggtacctagccatggctggggcgagcaggctgctctttctgtggctgggctgcttctgcgtgagcctggcgcagggagagagaccgaagccacctttcccggagctccgcaaagctgtgccaggtgaccgcacggcaggtggtggcccggactccgagctgcagccgcaagacaaggtctctgaacacatgctgcggctctatgacaggtacagcacggtccaggcggcccggacaccgggctccctggagggaggctcgcagccctggcgccctcggctcctgcgcgaaggcaacacggttcgcagctttcgggcggcagcagcaggtgagtgcgcgaggtgagactcccttcccgcggtcccgccccagctttctcccgggaccccccacagcttccttgtctgccccttgcttggtggcgctgcctagggacctttctccgccctcctcagctgccctctggattcctccgtccagtcacaccccgcgtgtcgccagctgcatctc

SEQ ID NO: 29000 - DNA, 15 bp, Homo sapiens
  misc_feature 1..15: note = chr4:82135873-82135888
  misc_feature 1..15: note = hyper
  source 1..15: mol_type = genomic DNA
gcctccaggagctca

SEQ ID NO: 29001 - DNA, 286 bp, Homo sapiens
  misc_feature 1..286: note = chr4:82135919-82136205
  misc_feature 1..286: note = hyper
  source 1..286: mol_type = genomic DNA
cgtacacacgtccacactcgaacagcacaagcaagagaccggctgggtgtggaatagaggcgcacatcgcgcaacgcattcacagcatgcacacgcgcgcaccccgaccccgtccctccccgcgcgccctcacaccccggcgcccaagacccccggcccacgaacctcaccagacagccgggtaactttccaggtgcgcagcttgtcacctcggcgcggccgcccctgcgtctcagcgtcctctcccacgccgccctccccagccgcctgcggcgccggagcccag

SEQ ID NO: 29002 - DNA, 142 bp, Homo sapiens
  misc_feature 1..142: note = chr4:82136243-82136385
  misc_feature 1..142: note = hyper
  source 1..142: mol_type = genomic DNA
cgcagcgtgggcccggggctgccggctcagtcgctccggctacgtgtgagccgggggcgcgggttagcgcgatgcgggcaggagctgcggcggcgtcggtgctgccgcctggctccgcggcgggggccggtgcagaggagac

SEQ ID NO: 29003 - DNA, 312 bp, Homo sapiens
  misc_feature 1..312: note = chr4:82136635-82136947
  misc_feature 1..312: note = hyper
  source 1..312: mol_type = genomic DNA
ttcaagtgtgtgggacgaggggagaggaaagttcagggaggtgttcattttttccttcccctccctttcctccatccttccagtctgttttcactgcaggctctctccacttcgccttccctcccagagctcaaacaggcgcacgtaccctggacatgccctcctctgtcacaccaatgcctttctacgaagacatgtgaccccgaagcagctcgtcgacgcgcccctcccggactctggggccataacttacatctagtttgccagttcacgtgatgctgggggcaggggttgaatcgagtttcgagggac

SEQ ID NO: 29004 - DNA, 316 bp, Homo sapiens
  misc_feature 1..316: note = chr4:82965388-82965704
  misc_feature 1..316: note = hyper
  source 1..316: mol_type = genomic DNA
ggcggccgcccgccccgcggcgtccagcggtgcgagtgcgcgcagccccgtccgcagcccgagcctccgctctgcgggagccggggcgccgtcgccgcgctagccttttcctctgaatgtcactattaccatagtaaagggaagggccccgccgagggggtggcgggagggccaacggcgcctcaggatgggcgccaagcgtgagcaagggcagccggcgggcgcagcgccttggcgcagacaccggcccgacccacgcctgggcagggccactcttgcaacactgccgggcgggagcagacgccttaagctccga

SEQ ID NO: 29005 - DNA, 36 bp, Homo sapiens
  misc_feature 1..36: note = chr4:83482690-83482726
  misc_feature 1..36: note = hyper
  source 1..36: mol_type = genomic DNA
gtcaaaggacggggccggggccggggccggggccgc

SEQ ID NO: 29006 - DNA, 278 bp, Homo sapiens
  misc_feature 1..278: note = chr4:83483094-83483372
  misc_feature 1..278: note = hyper
  source 1..278: mol_type = genomic DNA
ggctgtgacctgctgcggtggcggcggcggcagcagtagcggcgggtagggcgcttccttcaggaaggggtgggatctgctcacccgcccgcccggccccctcctgccgcgccggggcccgcccccgacttattctggggtccccgctgctaggccttcggggagagttgatcccctgggtctcgggcttctgccacccccccggggcccctaatagtcacccggggcaggagccgggtgtgggcgggcgagccgcttccttccgaagcctttgtgga

SEQ ID NO: 29007 - DNA, 44 bp, Homo sapiens
  misc_feature 1..44: note = chr4:83719361-83719405
  misc_feature 1..44: note = hyper
  source 1..44: mol_type = genomic DNA
cgcaccgcccgcagccgaggggcgagcggcgacctcgcgcgccc

SEQ ID NO: 29008 - DNA, 676 bp, Homo sapiens
  misc_feature 1..676: note = chr4:85402747-85403423
  misc_feature 1..676: note = hyper
  source 1..676: mol_type = genomic DNA
cccctctgtctaccttgcggagactattcaaacgccctcgcttgcggggtttcggagccagaagtctcgagctccgcgcctccgcgcccccgcgccgcgcccttccacctgcacccgttaggcgcgctgcgggacaacagcgcagatgcaaacagctttctcgcaaggaaaaagggaattgaggagaaagtttcctctctgagccgagggaagcggaaaaagatcaaaggtcgggggcgggtagagtgggggtggggggaaccgcgggacgccctagctgtgtgcgtttcgggaggcctcgcagtgccattctgcaagagtacctgctatctcgaaaatcttttgccaccgccgaccgcagcgggagggggcaaggggctctctctgactcagctccggatttgtgcatccccgcagtgcggcacccgcagtcttgacttccccagtctctgactgaacagatgtttttgtccctcgcggagatttgtaaccgatgttgggaacagctagtggacggtgctagcaacctgtatctgttctagaacacacctagtgggagctgcggggtagagtggagaggtaggaatgcagcgggactggggcaggggacaaatcaaggtgtgtgggtaaatgtgaacatatgaacacacgtgtgtacgcacgtctctaaatgtgt

SEQ ID NO: 29009 - DNA, 152 bp, Homo sapiens
  misc_feature 1..152: note = chr4:85403776-85403928
  misc_feature 1..152: note = hyper
  source 1..152: mol_type = genomic DNA
ctgtggttgccttttcggtttcaaagtaataaccaagcaaggaagagagaagaccgaaaactaccccgcggaaactagcacagtgtgcctggatgtctgtgtcccgggacctcggggaagagggcccgcaccggtctgcgaattgcaaggcc

SEQ ID NO: 29010 - DNA, 30 bp, Homo sapiens; identical to SEQ ID NO: 375
  misc_feature 1..30: note = chr4:85404111-85404141
  misc_feature 1..30: note = hyper
  source 1..30: mol_type = genomic DNA

SEQ ID NO: 29011 - DNA, 252 bp, Homo sapiens; identical to SEQ ID NO: 376
  misc_feature 1..252: note = chr4:85404224-85404476
  misc_feature 1..252: note = hyper
  source 1..252: mol_type = genomic DNA

SEQ ID NO: 29012 - DNA, 44 bp, Homo sapiens; identical to SEQ ID NO: 377
  misc_feature 1..44: note = chr4:85404649-85404693
  misc_feature 1..44: note = hyper
  source 1..44: mol_type = genomic DNA

SEQ ID NO: 29013 - DNA, 26 bp, Homo sapiens
  misc_feature 1..26: note = chr4:85414088-85414114
  misc_feature 1..26: note = hyper
  source 1..26: mol_type = genomic DNA
ggcaaaatctgggggcgagggggacc

SEQ ID NO: 29014 - DNA, 189 bp, Homo sapiens; identical to SEQ ID NO: 7440
  misc_feature 1..189: note = chr4:85414148-85414337
  misc_feature 1..189: note = hyper
  source 1..189: mol_type = genomic DNA

SEQ ID NO: 29015 - DNA, 567 bp, Homo sapiens
  misc_feature 1..567: note = chr4:85414457-85415024
  misc_feature 1..567: note = hyper
  source 1..567: mol_type = genomic DNA
ggctcggacgcgtgcagtaggaggccgccgccgccgccgctgctggacttgtgcttcttcaacagctgcgtgattttctcgtcgtccgagttgggatccagaggcttattgtagtcgtcgtcctcttcctcgttctccgaggcccccttgaggcgctctgtctccgagtcctgcttcttcttggccgtggccatctcggcagcgtgcttcttcctccacttggtccggcggttctggaaccagacctgagggcggagaaaagggaggagaggggaggcaagggcgaggaattaaacgagcagatccaggccatgctaccactcccgcatctcgatggccctcccgcggccccccgaaggcctgctgccctccctcgcagccctcccttttctcggccgtcaaagtcagtctccgtcgccccaagttccccctgagtaactggcaccaacaaactgactgccgttgccatagcgatggtaacacaagagtattgaggttgtcagtgagcgagttctcaaaagtaaaaacaaaactcggaaacttaaaaatgagcgtccctaaaagtga

SEQ ID NO: 29016 - DNA, 479 bp, Homo sapiens
  misc_feature 1..479: note = chr4:85416904-85417383
  misc_feature 1..479: note = hyper
  source 1..479: mol_type = genomic DNA
aagtcttctccagggcgaagatctgctgtccggaaaaagtgggtctcgtgtgttttctcttcccgtctttgtccaacaaaatggatccttgatctgtgagaaccaataaacaacgagagagggggaaaaacaatcggttacaagcggctgcactagggggaaaaaacgaactcgaaaaacaatgttttgtggggaaagaaagctcagtctgtggcggacaccagaagtgtagtggcgcttccagactaacggcacgtctccctttgcttttttacatccacctgttttttaaaagccgcgtgtttggcgcagcagtaaataccttctgctcaacaccgacgtcaaacagctagggagcctattgctaaagtttgccagagcctaatcgcaaggccccattaaattaacgactgccagaaaaaggccactctcgcctcctaatccagtcggtgctcgttcggccccggagcctttaagtg

SEQ ID NO: 29017 - DNA, 53 bp, Homo sapiens; identical to SEQ ID NO: 7444
  misc_feature 1..53: note = chr4:85417666-85417719
  misc_feature 1..53: note = hyper
  source 1..53: mol_type = genomic DNA

SEQ ID NO: 29018 - DNA, 270 bp, Homo sapiens
  misc_feature 1..270: note = chr4:85417953-85418223
  misc_feature 1..270: note = hyper
  source 1..270: mol_type = genomic DNA
gggtgttgagctccacgatgtccccaaatgtgcccggacgcagcgtgtgccagcccccagagtggaggcaggtgggaaagcgcgggcccagcgctggtgagcggctggaagcgctcgccctgccctggggacgctggactgtcttcaatgggctcacccaggccgagtgtactcgggcggcgagggcgaagaggtgaggtggggacaccccaggcggagacgtgcatgcaaatacactcacttcccgggcggtggagggctcaccgctgc

SEQ ID NO: 29019 - DNA, 106 bp, Homo sapiens
  misc_feature 1..106: note = chr4:85418264-85418370
  misc_feature 1..106: note = hyper
  source 1..106: mol_type = genomic DNA
cgaaggcggaatggggcgctggacgacagggaggagccgggaaagcagagatgcagtggcctctcctcccctctcctccccatctttctaatccaggccaggcctg

SEQ ID NO: 29020 - DNA, 62 bp, Homo sapiens
  misc_feature 1..62: note = chr4:85418521-85418583
  misc_feature 1..62: note = hyper
  source 1..62: mol_type = genomic DNA
cgagctcagaaaagcgagaatccctttctggaagccctggcccaacctaactggtgtgattc

SEQ ID NO: 29021 - DNA, 521 bp, Homo sapiens
  misc_feature 1..521: note = chr4:85419120-85419641
  misc_feature 1..521: note = hyper
  source 1..521: mol_type = genomic DNA
cggggggctgccgagggatgagagcccccccgtggccgggggcttcaggccgcctgggttgtgggtgcccagaggcggggagggcgacgaggaggacgacgacgaggacgaggaggagggggggccggcaggcagcgggggatacgcggcagggtacagcggggtcttcatctcggccatgctgtgcagggcggccaggggagggctgctgagcaggaatgcgctctgccgggtgccctccattgcccccaccgctaacatcccacggccacgccggagaccgtagccttgcagcgagggcgctggctggtgccccccgcggggctcagaggagccggaagcgccgagggcgcgagcggagaggcactcggcgcgcccggaggcgagctgccaactgaaccaaaaatgccgctgccgggagttgctcgcctagctgcgcagcagagatgtccaaaccctccacgcgggaggcggcagctcgccgagaaaagcaggcgtcccggcgggctaggcagtccttt

SEQ ID NO: 29022 - DNA, 230 bp, Homo sapiens
  misc_feature 1..230: note = chr4:85419661-85419891
  misc_feature 1..230: note = hyper
  source 1..230: mol_type = genomic DNA
cgatccctggctattctctcttcctcacttttcctagctgttcaaagtgcgctacttctcatcttctgcccccgggaaataagcaaaacaaaacccaggctggctccggagagtttgtagcaaagttagttgccgaatctccactttgaagttggagggtgggggtggcttgctttctttggggaggttcaaaggacgccttgtgcagcccgtggcgctcctctgatctt

SEQ ID NO: 29023 - DNA, 279 bp, Homo sapiens
  misc_feature 1..279: note = chr4:85422188-85422467
  misc_feature 1..279: note = hyper
  source 1..279: mol_type = genomic DNA
taaggtgaagtccttcgtcagcatgaatagtgctaaggagtcaagccaagacttgcttcagaagagagctgatgtgcggaccttctgcatttccacgcggggatccagtgcttgggtctaaaccccagcgccctgccacctcggccaggaagctgcgggaggatggtggcaggcatagcccgtcctagccttgaaactggggggcctatgtctctggcttcgttacaaacgaaacgtttctcgccttcggacactccaccctggcggtggtacccaacc

SEQ ID NO: 29024 - DNA, 80 bp, Homo sapiens
  misc_feature 1..80: note = chr4:85422972-85423052
  misc_feature 1..80: note = hyper
  source 1..80: mol_type = genomic DNA
cgctgggcagcacgggaaggcaggccggtgcctcctgccaggtgctagttgtagtggatctgctgcctgtctacagctgg

SEQ ID NO: 29025 - DNA, 197 bp, Homo sapiens
  misc_feature 1..197: note = chr4:85423633-85423830
  misc_feature 1..197: note = hyper
  source 1..197: mol_type = genomic DNA
cagtctaacccttgacgcagaaatgccaagcgcgttttgatacttgttttaagttaaaagaatagccaccaaattcaaggtaactaacggaaggaatgcaaatgaactctcagctaaacgtactaacattctgaagggagggatgataacggttttgccccaaatacagtaatgtcaaatgtcgggatactcaagtg

SEQ ID NO: 29026 - DNA, 331 bp, Homo sapiens
  misc_feature 1..331: note = chr4:85424176-85424507
  misc_feature 1..331: note = hyper
  source 1..331: mol_type = genomic DNA
tttgcttcctataaacgccgtagagtggaaactgcacctttgccacaacttctgctgcccagcacttaaggtagagatttgggaagaattgaagcagacagcgtggaaaagcgccgtaggatcttgcgttcggcgctctcccagtggaggccaacaccaaacaagtggggaagcgaccagtgtaaacagccccatccattctaccacagaaaagatctcgaagtccaggacctccctcagcgatatcgtcagtgagagagaggattacagctctccatagagtcgcagaatacgtacctgggagttaagtgcgctccgaagggtggcttct

SEQ ID NO: 29027 - DNA, 301 bp, Homo sapiens
  misc_feature 1..301: note = chr4:85504300-85504601
  misc_feature 1..301: note = hyper
  source 1..301: mol_type = genomic DNA
cgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagc

SEQ ID NO: 29028 - DNA, 61 bp, Homo sapiens
  misc_feature 1..61: note = chr4:85887114-85887175
  misc_feature 1..61: note = hyper
  source 1..61: mol_type = genomic DNA
ctccccaggaggcagcggaggactagggccaggccgcccaccctggcggcggcggcggctc

SEQ ID NO: 29029 - DNA, 127 bp, Homo sapiens
  misc_feature 1..127: note = chr4:87281168-87281295
  misc_feature 1..127: note = hyper
  source 1..127: mol_type = genomic DNA
gaaaccattgtgcagcgtgatgctgcctgtaccattgtggaacctaccagaggagacggacagagggcttggggaatggggttgctatggcaaccgaaaggagcacacatgacgtcaaagcccagag

SEQ ID NO: 29030 - DNA, 835 bp, Homo sapiens
  misc_feature 1..835: note = chr4:87515216-87516051
  misc_feature 1..835: note = hyper
  source 1..835: mol_type = genomic DNA
agcctctggctagtccgaagaacgcgaaaagccaggcccaaggcactggttgtcatggcaaccggggcgctggtctccctggcgacctcgtccctagggaggaggtggagctggatgccaggcgggccaatgaggtcgaggggagctcggggtgggagatctgcggtcctcccagtgccggggaatggttgagtgacaggaccgggggggcggagccggcgcggctgcccgaggtggagccccagtggtgcgagtagctccagcggccacgctgaggcgagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcttggagaggcgtcgagcacagtagggcggcgggggtgcgttgagcgctcgggggtcaggcagtcggccgggatcgccgctggggagcgtttccgaggcgaggaggaggaggaggagatgctgctcctcttctccccctccccaggctccttctacagctccttcagcccacgcccgcagccgcttgtgggagaagtggtggtggctctcggcgcccgcggcggctgccggcggcccgccccgacgccgcgtccctgcagccctcgcccggcgctccagtagcaggacccggtctcgggaccagccggtaaggacgagagccgccctgggctctgcgctgcatgtgcagaagtgcaaaacaaagtacattgcgctcgttctcttcctcctctctctgctttcgctccagtccctaa

SEQ ID NO: 29031 - DNA, 30 bp, Homo sapiens
  misc_feature 1..30: note = chr4:87813050-87813080
  misc_feature 1..30: note = hyper
  source 1..30: mol_type = genomic DNA
cgtggcagtgctgagcgaccaaaggctctg

SEQ ID NO: 29032 - DNA, 287 bp, Homo sapiens
  misc_feature 1..287: note = chr4:89378338-89378625
  misc_feature 1..287: note = hyper
  source 1..287: mol_type = genomic DNA
gcctgaggcagtgggcgcgctcagtcccgggaccaggcgttctctcctctcgcctctgggcctgggaccccgcaaagcggcgatggagcggaggtcgcggaggaagtcgcggcgcaacgggcgctcgaccgcgggcaaggccgccgcgacccagcccgcgaagtctccgggcgcacagctctggctctttcccagcgccgcgggcctccaccgcgcgctgctccggagggtggaggtgacgcgccaactctgctgctcgccggggcgcctcgcggtcttggaacgcg

SEQ ID NO: 29033 - DNA, 30 bp, Homo sapiens
  misc_feature 1..30: note = chr4:89378867-89378897
  misc_feature 1..30: note = hyper
  source 1..30: mol_type = genomic DNA
caggcgcggggtgagcgggatactggcgac

SEQ ID NO: 29034 - DNA, 208 bp, Homo sapiens
  misc_feature 1..208: note = chr4:90757517-90757725
  misc_feature 1..208: note = hyper
  source 1..208: mol_type = genomic DNA
tcattatttgccaaacgcagcttgcttactttacagagaaaaaccaagagagcgggcagacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaa

SEQ ID NO: 29035 - DNA, 822 bp, Homo sapiens
  misc_feature 1..822: note = chr4:90758090-90758912
  misc_feature 1..822: note = hyper
  source 1..822: mol_type = genomic DNA
agtgggaggcaaacccgctaacctgtcgtcgaatggccactcccagttctccgctcacgagggtggaaaggcagaaggcttgaaggcaaggcgtgagggagcgcccaggacgctctcggaggggccgggccggggtctgcgctgcagcccgcacgcacctcacttccgcgtcgcggcgctcggtcgctcgccccctctcttgggccccttctggtcgtcgccgtcctcctcctcctagtcctcctccttctccttctcctcggctctccgcccccaccgctgatttgtcagcgcttctgcccgcccctctcccggcgctcgctgctttccctgcagcgtgctcctcgtccctatctcggatggggatggggcagggggcgcggggtgagccatcaactccagccgcctgcctggccgcgcaaggcgggaaagtgggggcgcttttgcgcctcacgttaagtttagggtcacgagcactcttgtggagatcgggagcggttgggctagggatgatgcctcttcctctttccccttcccctcccttcttgtccccgcctttcctctgggtcctcccggggaccaccccctacccctcgtcagagtcgccctgggagagccgagggcctgagggtcgaccaccaagggcagagcctatcccttggggagctgctggaggagacaggcagcgccgggaggtggctcacaccgcaccgccgagagcgctttgccctcgcatcgctgaaatttaatcacggtcacaggttacaacgttaggggtcgctttagttcaaatatcttcaaggttttcgtttgctcttaatc

SEQ ID NO: 29036 - DNA, 56 bp, Homo sapiens
  misc_feature 1..56: note = chr4:90759319-90759375
  misc_feature 1..56: note = hyper
  source 1..56: mol_type = genomic DNA
cccccacccaccacacgcacatgcacacagacatacacacgcgaacttcaagacaa

SEQ ID NO: 29037 - DNA, 95 bp, Homo sapiens
  misc_feature 1..95: note = chr4:93225325-93225420
  misc_feature 1..95: note = hyper
  source 1..95: mol_type = genomic DNA
accagtgattctctgcgggctgtaggggcgggggcgggggtcttttttggtccgagagggtgcggggaagggggcacatccggcgtgaggggggt

SEQ ID NO: 29038 - DNA, 30 bp, Homo sapiens
  misc_feature 1..30: note = chr4:93226097-93226127
  misc_feature 1..30: note = hyper
  source 1..30: mol_type = genomic DNA
tgttttgcagtgattcgtggaatgtggctg

SEQ ID NO: 29039 - DNA, 30 bp, Homo sapiens; identical to SEQ ID NO: 7459
  misc_feature 1..30: note = chr4:93226479-93226509
  misc_feature 1..30: note = hyper
  source 1..30: mol_type = genomic DNA

SEQ ID NO: 29040 - DNA, 38 bp, Homo sapiens
  misc_feature 1..38: note = chr4:94750202-94750240
  misc_feature 1..38: note = hyper
  source 1..38: mol_type = genomic DNA
ggcgagagagcatcccgtctacccgcctgagctgtccc

SEQ ID NO: 29041 - DNA, 30 bp, Homo sapiens
  misc_feature 1..30: note = chr4:94750621-94750651
  misc_feature 1..30: note = hyper
  source 1..30: mol_type = genomic DNA
tgcgcaatgttatcccgtcgttcaacaacg

SEQ ID NO: 29042 - DNA, 735 bp, Homo sapiens
  misc_feature 1..735: note = chr4:94750864-94751599
  misc_feature 1..735: note = hyper
  source 1..735: mol_type = genomic DNA
gccagcggccgaccccgcccgggagttgccggactcgcttctcagccccagcttctgcgggagggtactcggtgcagctggacgctctgcacttctcgactttcgaggacagcgccctgacagcgatgatggcgcaaaagaatttgtctccttctctccccgggagcatcttgcagccagtgcaggaggaaaacagcaaaacttcgcctcggtcccacagaagcgacggggaattttccccccattcccattacagtgactcggatgaggcaagttaggaaggtgacagaagcctgaaaactgagacagaaacaaaactgccctttcccagtgcgcgggaagccccgcggttaaagatccccgcaccctttaatttttgctctgcgatggtcgttgtttagcaacgacttggcttcagatggcagctacatttgatggtttgcaaatgccgccgctgttccaaacttcctacggtccatattgtttgatgaaaactttctgttaaaattgtgtcctttccgcccaccttctgctccccctttagatagatacggtataattgtaggtacccgtatatggcatcattattctagttccctgctgccaatacgctgctaaaacgtcgcatcttctctgtcactggtttgggtttaatttattttacgccctgggcatccatccttgtgtgttgcgcactcaagtgtgggagatttagtcttccgaagttgttttcca

SEQ ID NO: 29043 - DNA, 20 bp, Homo sapiens
  misc_feature 1..20: note = chr4:94752906-94752926
  misc_feature 1..20: note = hyper
  source 1..20: mol_type = genomic DNA
ggaaaagctaatagtcgtgc

SEQ ID NO: 29044 - DNA, 166 bp, Homo sapiens
  misc_feature 1..166: note = chr4:94753279-94753445
  misc_feature 1..166: note = hyper
  source 1..166: mol_type = genomic DNA
taatgcactagggagcgcaggttctggtctccttaagtaagaaactgcagaaccagctttttactgaccacctgggtatctgtggctttcagcggaagccgaccaagagatgcagagaacgtccgccagctctctgggagaagcgagcaggcggctggtgacactt

SEQ ID NO: 29045 - DNA, 30 bp, Homo sapiens
  misc_feature 1..30: note = chr4:94755600-94755630
  misc_feature 1..30: note = hyper
  source 1..30: mol_type = genomic DNA
aaaggggaaactgagcggagaatgggttaa

SEQ ID NO: 29046 - DNA, 43 bp, Homo sapiens
  misc_feature 1..43: note = chr4:94756066-94756109
  misc_feature 1..43: note = hyper
  source 1..43: mol_type = genomic DNA
gcaaccagcccagcacgcaaagaagctgcgcaaagttaaagcc

SEQ ID NO: 29047 - DNA, 136 bp, Homo sapiens
  misc_feature 1..136: note = chr4:95678866-95679002
  misc_feature 1..136: note = hyper
  source 1..136: mol_type = genomic DNA
gtcggctccgcactccgcacacaggcggcggcgctggggccgctccaagtgcgttgagaagtgtaatccctccgctaagtacttggctctcagtctccaatcactagtgggagctggagagggcaagtgaaaaaaa

SEQ ID NO: 29048 - DNA, 76 bp, Homo sapiens
  misc_feature 1..76: note = chr4:95679062-95679138
  misc_feature 1..76: note = hyper
  source 1..76: mol_type = genomic DNA
ccgcggtggcggcggcggcggcggcggagcggccgcggcggccagaagttgacggcgcagccgggcgcggggcgcg

SEQ ID NO: 29049 - DNA, 56 bp, Homo sapiens
  misc_feature 1..56: note = chr4:95679689-95679745
  misc_feature 1..56: note = hyper
  source 1..56: mol_type = genomic DNA
cagggccagcccaggcgggacccgcaggcacccacctgccccggacgcctcccgag

SEQ ID NO: 29050 - DNA, 56 bp, Homo sapiens
  misc_feature 1..56: note = chr4:96469013-96469069
  misc_feature 1..56: note = hyper
  source 1..56: mol_type = genomic DNA
cccatccccaactcccggccacactcttcccaacccggcttcgcccagggccccgg

SEQ ID NO: 29051 - DNA, 30 bp, Homo sapiens
  misc_feature 1..30: note = chr4:96469768-96469798
  misc_feature 1..30: note = hyper
  source 1..30: mol_type = genomic DNA
tccagttgaaagcaacgaggcaaattgagg

SEQ ID NO: 29052 - DNA, 30 bp, Homo sapiens
  misc_feature 1..30: note = chr4:96470085-96470115
  misc_feature 1..30: note = hyper
  source 1..30: mol_type = genomic DNA
gctgaatccgtgcaccgcgaagcagtccga

SEQ ID NO: 29053 - DNA, 64 bp, Homo sapiens
  misc_feature 1..64: note = chr4:96470823-96470887
  misc_feature 1..64: note = hyper
  source 1..64: mol_type = genomic DNA
acgccgggagtgcagcgggcgcgccccgggccactaggctgtgtccagtggagctcagcctgcc

SEQ ID NO: 29054 - DNA, 73 bp, Homo sapiens
  misc_feature 1..73: note = chr4:96470888-96470961
  misc_feature 1..73: note = hyper
  source 1..73: mol_type = genomic DNA
cctgccaccttcttcgccgcgccggcaaagcctcagccgaattccctaggactggactcggtctacgacttcg

SEQ ID NO: 29055 - DNA, 328 bp, Homo sapiens
  misc_feature 1..328: note = chr4:101111259-101111587
  misc_feature 1..328: note = hyper
  source 1..328: mol_type = genomic DNA
ccggcgtcccgggagcgaactagcggaggaactcctttgccaaaggggtggaaccggcctctgcaactcaatttgacaaagccctgggagcggagccgcaacctgaaactaactcaacagttcgcaaaacttggaagcgacctgccccgcggagcgccccccggccccgctgcccccaccaaggccgcagcttcgctcacctgccaggagttcgcgggggcctgcgcgctcgctgccgggtaaacacaggcaggtggcttcttaggagtcccctctcctggggactcggtgacctgcagaccccagcagccagcggcaccctgctcac

SEQ ID NO: 29056 - DNA, 75 bp, Homo sapiens
  misc_feature 1..75: note = chr4:101111797-101111872
  misc_feature 1..75: note = hyper
  source 1..75: mol_type = genomic DNA
aagcctgtggtagagcggacacctgttgcttccagggtagatctcgggccactgggaccgcaattccgggtgcac

SEQ ID NO: 29057 - DNA, 97 bp, Homo sapiens
  misc_feature 1..97: note = chr4:101111873-101111970
  misc_feature 1..97: note = hyper
  source 1..97: mol_type = genomic DNA
actcgtcaaagcctgaacctgattgttcagtgcgacccctccccgagcgtccgcgctttcacactcaggctgctcccggcagcgggaagctttaagc

SEQ ID NO: 29058 - DNA, 30 bp, Homo sapiens
  misc_feature 1..30: note = chr4:103997969-103997999
  misc_feature 1..30: note = hyper
  source 1..30: mol_type = genomic DNA
gcaggccgggcagcccgttacttgttttat

SEQ ID NO: 29059 - DNA, 645 bp, Homo sapiens
  misc_feature 1..645: note = chr4:107955181-107955826
  misc_feature 1..645: note = hyper
  source 1..645: mol_type = genomic DNA
aaaggatagctgaaacggttcacacttcaaagctctgggaagagttctggaactgcaaaactagcaaaactgcaaaattgtccccgtgagagggcagtagggggccaagcccgggtcttgtctctctgtccatcccagaatggctcggccctctcaaccaaccttcagccggctggctgcgctgtggacaggggcggcggaggacaccgagagcgcgcaaaacagcagcatcagtcggttccaaggaaactcggatctctggggcgtgggccgctgccaggggttgacacttgtgttgtgcgaggtgcgtgtgccattggtaaaatggctttctcagttttggcttcccacaaaaggagcggaagggggagctgtcatgattcccagtgcccacagagccccctctcctggccacagcgcgccagccacaactggtaccgagtgtgcgcgctcgtctctgtgcgtgtctatttgtataacagtttgcaagtggctttcaatctatctgtctgtatgacagagacagaggcgcctgcggaaagttccctctctcaaaaacgccttcagtgtcctgctgtatcgctggcgcctacgacgctgtcattgtcatctcatcattttgcttccttccgggtgatttatgta

SEQ ID NO: 29060 - DNA, 406 bp, Homo sapiens
  misc_feature 1..406: note = chr4:107956638-107957044
  misc_feature 1..406: note = hyper
  source 1..406: mol_type = genomic DNA
gagttgagtttggcccgcgaactgccgatctgtgagctctccaccatcagcaccgcggccagtaggagcaggcagcaggacgaatccttgctccgcatcaacgcggccatctcccggcgagggggtccccaggaagacgcaaagcccggaggggtgggaatgcaaagggagggaggaccccaacacggggcccctcacttgggtcgcgggggcttgcagattgtgttccctcaacccttcctggttcggggacccaggaccctatgaactcagtctcacgcctcaggacagaaattagcggaacccaagcgagacccgcttctccaccaggacaggaagttctgcaataactggaagcaatcaaatgcgaggcgctttctcgccaaggaggcgtgacccaaggtgc

SEQ ID NO: 29061 - DNA, 113 bp, Homo sapiens; identical to SEQ ID NO: 7472
  misc_feature 1..113: note = chr4:107957249-107957362
  misc_feature 1..113: note = hyper
  source 1..113: mol_type = genomic DNA

SEQ ID NO: 29062 - DNA, 240 bp, Homo sapiens
  misc_feature 1..240: note = chr4:107957363-107957603
  misc_feature 1..240: note = hyper
  source 1..240: mol_type = genomic DNA
ttgtcccctgactcacaagagacagcgaatcgctgccagcgcagcgatgcctagggagcggacttgcgctacgctcgccgcgggctcccgctttctctctctctgctctctccccagtcctctttgctttttatagcttcccacagtgaggactttttttttttttttacctccgcccccaattcaagagtgacaaagagtgaaaatttttctctcactccccaccgcttccgcccccct

SEQ ID NO: 29063 - DNA, 68 bp, Homo sapiens
  misc_feature 1..68: note = chr4:107957925-107957993
  misc_feature 1..68: note = hyper
  source 1..68: mol_type = genomic DNA
agaagtgagcatctgcgcatctgctcattagtattgtgttctttgtgagctcacgtttggttttagac

SEQ ID NO: 29064 - DNA, 112 bp, Homo sapiens
  misc_feature 1..112: note = chr4:107958393-107958505
  misc_feature 1..112: note = hyper
  source 1..112: mol_type = genomic DNA
attcctgtcagcccccgggtctctccaggtccaattcccttcggccgaaggtcgaaggctgctccgggaacgactgggacgcgctggcgcttgggggcgccagtggcagccg

SEQ ID NO: 29065 - DNA, 99 bp, Homo sapiens
  misc_feature 1..99: note = chr4:108853188-108853287
  misc_feature 1..99: note = hyper
  source 1..99: mol_type = genomic DNA
cagcgacttccacagcgtgcgcgaggcgctggtgcagcaggccgaggtcttcagcgaccgcccgcgggtgccgctcatctccatcgtgaccaaggagaa

SEQ ID NO: 29066 - DNA, 258 bp, Homo sapiens
  misc_feature 1..258: note = chr4:109088205-109088463
  misc_feature 1..258: note = hyper
  source 1..258: mol_type = genomic DNA
gcctccccttcctcccgcctgtggctctgctcgtctccacctaagcctttggtggtttaacgcacttttgcagagacatctaccaagagatagcgtgtgcactttgttttccgtcccacggaagaatttatcagtagcgttattcagccctactcgctttaaagcacggcacccctcagcccaacaaaaagaccgaaggcgaaacattgtgggttcctgcccgcgaaccaaccgttcagccaccgaaccccctaaact

SEQ ID NO: 29067 - DNA, 231 bp, Homo sapiens
  misc_feature 1..231: note = chr4:109089045-109089276
  misc_feature 1..231: note = hyper
  source 1..231: mol_type = genomic DNA
cgggcggaagcggggcgggcgagcgcggggccgccggccggcagccggagcagctgccgcggcgcccgaatcccggcggccgccgcgctttcccgcttcgcggagaccgacgcaggcgcccgcccccgaggccgaagggcactgggcggcgagggctgcggtagctggcgactccgggggcgtctgcgcggcgcgcgctagacgaggctgccccggcggccaccccgcgac

SEQ ID NO: 29068 - DNA, 30 bp, Homo sapiens
  misc_feature 1..30: note = chr4:109090379-109090409
  misc_feature 1..30: note = hyper
  source 1..30: mol_type = genomic DNA
acccaccgaaaggcacgctttgcccgcgtg

SEQ ID NO: 29069 - DNA, 122 bp, Homo sapiens
  misc_feature 1..122: note = chr4:109092563-109092685
  misc_feature 1..122: note = hyper
  source 1..122: mol_type = genomic DNA
gaaacagcaggaggacgcaggaggggcgaagtaaccccgggaagacgttcttccccctcccttacggattcagtgtagttcctggcataagcaattctgtcaccgggcggtcttttctaatt

SEQ ID NO: 29070 - DNA, 1141 bp, Homo sapiens
  misc_feature 1..1141: note = chr4:109093142-109094283
  misc_feature 1..1141: note = hyper
  source 1..1141: mol_type = genomic DNA
gagcccagccccgctcgggagcgggcaggagagacagggtagtgacccccactcacaccagaaaacccctccccccggcgattttgctgccaactcgagtcggctacagacagtccagtgagtccttaattacaaggacgagagaaaagcacggtgcccctcgagtcctctccgccccctcggtcctaacccccgcccaggctccaggtcttcccctttgtgtggcctggactctctcccagctacgactttggtgggatccaaaaggaaggaggtggcggggcctacggaagaggatacccaggagccagggagaagggctagaaaacgaataatgtgactccagaggcggaaccccgaccccctctatttcccaccccggcttcacccggagacgaaagctgtgggcatcttcagtttaacggacttcgcggaaaaggagagaaggggggcgagggaaatggcagtttgtgtcccaggggttcttccccttcttcttgccgcctcctaaagacaaacaaactcaaccccccaccctccggggtatcagggaactcgtgggaccgtgaaaaagtcgttcccaaatccggccgcctgcggacgtcggacttccgcggggccggcgcccgttggcgtctgtagctcggcgcagccacgcggggctccagcgagcggggtccgccacccctcgcgccctcctgcggctttcccagcgctgggccagtgcaggccgagccctgcgtccctgcctcgctgggtgggggtccggggcgcggctgtccacagggccgcctcctcctgcggcccgcggggaaggggcgcatcccaccccgctctgcaggccgcccttctgccagctgggaggcgagggcacacgtcctaaggctgcccaagggggagaggaatcgcgccggtaggagagcgcacgggaaccaggaacgcaaggcgggcacaggggagccgaaggagccagacagggcccggccacgcgccctcctcgctcggctgcgctccgtgacgggaacccaggctcccacgcacggggaatgcctagaacggagctagaatggaggtgggagctggagtcattttgcgggccacaggactgctcatttcgtgggcaggacgtgacattcttgtc

SEQ ID NO: 29071 - DNA, 55 bp, Homo sapiens
  misc_feature 1..55: note = chr4:109094529-109094584
  misc_feature 1..55: note = hyper
  source 1..55: mol_type = genomic DNA
agtcgcggcggctgccgctttcatcctttcttttttccctcgcaggcccctttgt

SEQ ID NO: 29072 - DNA, 190 bp, Homo sapiens
  misc_feature 1..190: note = chr4:109683609-109683799
  misc_feature 1..190: note = hyper
  source 1..190: mol_type = genomic DNA
gtttccaaaaactttcgagttgtgtgggggtggcggagcgctatccttcttccacccatctcccatccctggaatggtgtctgctagggctattggccgtcatccaccaacccctctagccggccggcagcccccgctagtccgccggctgcagagcgagccggggactttcgagcgggcaggaagccca

SEQ ID NO: 29073 - DNA, 70 bp, Homo sapiens; identical to SEQ ID NO: 7481
  misc_feature 1..70: note = chr4:109684016-109684086
  misc_feature 1..70: note = hyper
  source 1..70: mol_type = genomic DNA

SEQ ID NO: 29074 - DNA, 328 bp, Homo sapiens
  misc_feature 1..328: note = chr4:110223100-110223428
  misc_feature 1..328: note = hyper
  source 1..328: mol_type = genomic DNA
ctgttcggcaggggtcgggtcctcggatctgggctcccggccccctcctttccctgcgtgcttcttcagcagcatcgtggcggggtcggccgtctcggcttcgcttcccaccctctacacctcaaataatcctaaaaggaaagaaaaaggtcgattcctccaaagttcagtccctgtggctgcacaactagttggtggagtcaagcccacgagcggatacggacccctgccttgctcagcgtccagacccgcaggcgtgcaccatccccgctttcttctctcctcccagctggaagtgaaaagcaccctccgtccggggactgggtgg

SEQ ID NO: 29075 - DNA, 20 bp, Homo sapiens
  misc_feature 1..20: note = chr4:110223578-110223598
  misc_feature 1..20: note = hyper
  source 1..20: mol_type = genomic DNA
cggaggaccggacctgttgc

SEQ ID NO: 29076 - DNA, 368 bp, Homo sapiens
  misc_feature 1..368: note = chr4:110223599-110223967
  misc_feature 1..368: note = hyper
  source 1..368: mol_type = genomic DNA
cctctgtgagtttgccttatttctacctactcggtgtctttcggcacgccgacctgtttcccacctgcattcagttcaaggcaaaaaggctgtgagagcacgctacagcgcagcgcgaaaggggcgactaaggtggagaagagagaggaaaacgaaataaacccaaggaaccaatgctactcgcgaagccgaagtcgcggctgcccgaaggatctccgcagccccgcgtgcgcgatccttaaatacccttcgcgatgctcgcgtgagtgtgtgtgtgagtgtgtgagtgcgcgcgcgctccgagcacgacgtccctcccccgaccccctcccggcgcccggcgtccggcctgccgctcccgctgctgc

SEQ ID NO: 29077 - DNA, 393 bp, Homo sapiens
  misc_feature 1..393: note = chr4:110223968-110224361
  misc_feature 1..393: note = hyper
  source 1..393: mol_type = genomic DNA
cgccccccttccgaaggcaaagcaggagcccgccttattatcataatgtattcaccttggcccagcccgcgggccggcccggggaacccccaagggaggcgggaagcttgggtgggagcggggcaggaggtctgttattagcataatgtatgcaaatagctggagcggccaccgtgattggagaggagcctggcgacccctccccctgcgcggagtaacttcagcatctccgagggccacctctctggcctgggccggggccgaagcggggtcggctgcgcaagaggcggcaactttggcttatactgactcagcccagcgccccctttttatcccacataaaaatggagaaatggcctccgggaggaagatgtgaagcggcacgctctatct

SEQ ID NO: 29078 - DNA, 72 bp, Homo sapiens
  misc_feature 1..72: note = chr4:111531853-111531925
  misc_feature 1..72: note = hyper
  source 1..72: mol_type = genomic DNA
agcctaggacttcagcgcgacctcaagccaggacttctgcgaggtctcaggtccgagggccaggtcgggcgc

SEQ ID NO: 29079 - DNA, 28 bp, Homo sapiens
  misc_feature 1..28: note = chr4:111531943-111531971
  misc_feature 1..28: note = hyper
  source 1..28: mol_type = genomic DNA
cgcgcctccccttcgtccccaggccctg

SEQ ID NO: 29080 - DNA, 77 bp, Homo sapiens
  misc_feature 1..77: note = chr4:111532245-111532322
  misc_feature 1..77: note = hyper
  source 1..77: mol_type = genomic DNA
ccctcatttgtcctccgcttcctgcggctgaacggtccttgataagtggcctccagaagattcggtactttgggcca

SEQ ID NO: 29081 - DNA, 306 bp, Homo sapiens; identical to SEQ ID NO: 2439
  misc_feature 1..306: note = chr4:111532704-111533010
  misc_feature 1..306: note = hyper
  source 1..306: mol_type = genomic DNA

SEQ ID NO: 29082 - DNA, 32 bp, Homo sapiens
  misc_feature 1..32: note = chr4:111533328-111533360
  misc_feature 1..32: note = hyper
  source 1..32: mol_type = genomic DNA
cggttgacaagatggcccggccacccagagga

SEQ ID NO: 29083 - DNA, 30 bp, Homo sapiens
  misc_feature 1..30: note = chr4:111535304-111535334
  misc_feature 1..30: note = hyper
  source 1..30: mol_type = genomic DNA
ttcttcagtcaaccacgtttcttgcttccc

SEQ ID NO: 29084 - DNA, 258 bp, Homo sapiens
  misc_feature 1..258: note = chr4:111536248-111536506
  misc_feature 1..258: note = hyper
  source 1..258: mol_type = genomic DNA
agcgctcaaggagcacggcggcagtgcgctgaggccagtgaggcctgggcgcctccgggcccaacctcgagctcgccatttttgaacccaagcggggaaggttggtgctcatgctatagattatgttaaaggttcctttaagcactttaatacacaactagctcagaaatcattaagagacctagagaaggagaaaaaataccctcacactcaccggtaataagtgttgacatgcagcaaaaatcggttgagtggaac

SEQ ID NO: 29085 - DNA, 132 bp, Homo sapiens; identical to SEQ ID NO: 7487
  misc_feature 1..132: note = chr4:111536561-111536693
  misc_feature 1..132: note = hyper
  source 1..132: mol_type = genomic DNA

SEQ ID NO: 29086 - DNA, 32 bp, Homo sapiens
  misc_feature 1..32: note = chr4:111536943-111536975
  misc_feature 1..32: note = hyper
  source 1..32: mol_type = genomic DNA
gagacctaaatcctccgggcaggtctcgttag

SEQ ID NO: 29087 - DNA, 15 bp, Homo sapiens
  misc_feature 1..15: note = chr4:111537066-111537081
  misc_feature 1..15: note = hyper
  source 1..15: mol_type = genomic DNA
cggagaggccgggac

SEQ ID NO: 29088 - DNA, 117 bp, Homo sapiens
  misc_feature 1..117: note = chr4:111539478-111539595
  misc_feature 1..117: note = hyper
  source 1..117: mol_type = genomic DNA
cgacgggctactcaggttgttcaagttattcaggctgttgagactggagcccgggacgcctgtcactgctgagggcaccatgctggacgacatgctcatggacgagatagagttggg

SEQ ID NO: 29089 - DNA, 33 bp, Homo sapiens
  misc_feature 1..33: note = chr4:111539809-111539842
  misc_feature 1..33: note = hyper
  source 1..33: mol_type = genomic DNA
tttctccatttggcccgacgattcttgaaccaa

SEQ ID NO: 29090 - DNA, 193 bp, Homo sapiens
  misc_feature 1..193: note = chr4:111540186-111540379
  misc_feature 1..193: note = hyper
  source 1..193: mol_type = genomic DNA
cggggcagcaggcttttccaacccttcccggggcaccttgcaaacttgcttccattccaaagccacagacccacggatgaggagaaggggctggaagggcactagaggatcgctctttctcccacgcaattcctcccttccttccctgacctccactgtcgtcccccaccccctggtacgtgctcccttaaca

SEQ ID NO: 29091 - DNA, 49 bp, Homo sapiens
  misc_feature 1..49: note = chr4:111540595-111540644
  misc_feature 1..49: note = hyper
  source 1..49: mol_type = genomic DNA
gtttggctttgcaggcggccacccaggccggccggcttccacccgtgtc

SEQ ID NO: 29092 - DNA, 30 bp, Homo sapiens
  misc_feature 1..30: note = chr4:111542950-111542980
  misc_feature 1..30: note = hyper
  source 1..30: mol_type = genomic DNA
ggcaccgaagttcgccggccctttcccaaa

SEQ ID NO: 29093 - DNA, 156 bp, Homo sapiens
  misc_feature 1..156: note = chr4:111543190-111543346
  misc_feature 1..156: note = hyper
  source 1..156: mol_type = genomic DNA
tgctcgcgcccttagcgccccaggagccgggccggtcgagggagaactaaagggatgcggggtagtcaaaattccggctcccggaagttctgcggggagccaggcgaacgaccactcccaccacgcctccccccggaggggctgacttccttgggg

SEQ ID NO: 29094 - DNA, 293 bp, Homo sapiens
  misc_feature 1..293: note = chr4:111543403-111543696
  misc_feature 1..293: note = hyper
  source 1..293: mol_type = genomic DNA
cgccttacctgcggcctccgggctggaggtgtcggagatggtgtgcacctccagcctgtgcttggaggagtccagcgaccggggctgaccgggagccagaaccgaagccatggctaacggctggggatggtgacaggaagatgaggagacggccgacagcttggtccccgctgctcggtgctccaagtgaagcgggcctttcatgcagttcatggacgagggagcgcgacgctctactagtccttggctactgccccgccgagcccccgtagccgccgctgcccgctccgggt

SEQ ID NO: 29095 - skipped

SEQ ID NO: 29096 - DNA, 214 bp, Homo sapiens
  misc_feature 1..214: note = chr4:111543967-111544181
  misc_feature 1..214: note = hyper
  source 1..214: mol_type = genomic DNA
aataaggaaagctaacgccgaccgcgctctgcccgccccccccccacgcggcagccctgacagagaagtgtcaagagtgacagggacaggtaggtgatattagatcccctgcggcggcagcagccgctgcagccacgacgcggccctctgagcgcaccctccgcaacgcgcacacgcacacccctcgggcggtcgaacaggagccgggccttgc

SEQ ID NO: 29097 - DNA, 285 bp, Homo sapiens; identical to SEQ ID NO: 2443
  misc_feature 1..285: note = chr4:111544298-111544583
  misc_feature 1..285: note = hyper
  source 1..285: mol_type = genomic DNA

SEQ ID NO: 29098 - DNA, 30 bp, Homo sapiens
  misc_feature 1..30: note = chr4:111549751-111549781
  misc_feature 1..30: note = hyper
  source 1..30: mol_type = genomic DNA
ggattacagggtattcgcctagatgaagag

SEQ ID NO: 29099 - DNA, 188 bp, Homo sapiens
  misc_feature 1..188: note = chr4:111549982-111550170
  misc_feature 1..188: note = hyper
  source 1..188: mol_type = genomic DNA
agaaactttgtgtaccgagtcagcagcgaggaacgcgacctgtgaagaccacttttgcgggcagggatccgcagggactgactactttcggacaactggtacaatttcccctgggggtgaaaaaccacaacgcggcggggcacctttcaagtgagctgcagatttgattggcgcggggggtgggggag

SEQ ID NO: 29100 - DNA, 341 bp, Homo sapiens
  misc_feature 1..341: note = chr4:111550508-111550849
  misc_feature 1..341: note = hyper
  source 1..341: mol_type = genomic DNA
acgtagtatatgctccgcaaacattcgctgattgaatgagaggcgcgggggcggggcggcggagaggggtctgcggccgccaaggccgccagggttaacccaggtccttcgaagaaggttgggaccgagctgctgccgcgtgtgaaggtgtgtgtcgcggctgggggtgccacaacgggccatggagcccacctcccagagggaggaagtctgtgcacaccagcgacttgggtcgaacactttcagcccatccactgggccaaagctatttaacaattaatgcgttcctgggggaggccgggggaagtacccgccccttgtcgggacgcaaagccaggcgt

SEQ ID NO: 29101 - DNA, 957 bp, Homo sapiens
  misc_feature 1..957: note = chr4:111552994-111553951
  misc_feature 1..957: note = hyper
  source 1..957: mol_type = genomic DNA
cttcagggatgttgtcggccccccgcccctcccccaaccagccaaagcaaaccttcgccaactcaagtttcccttgcttgcctcccgcgatgaaccgcgcacccacaagtctgggtggggcgtggctgagagcctgagtgactgagtgggccctggtggtgctgcgcgcagcgggatataacgagcgacagaggtcgctgttggaccacttttccacgccagcctagacgccgaggtttgctggagcgtgcgcaggggatcagaccacagggagcgagcgagagggagagagaggtgttgggtctcaggagtgcagtataatttggggaaaggaattaacgtccctgggacggctgcttcccgtcccacccagaggcggagtgtctaagttcaagcagcaggcgcgtcaggtctggcggcctcgccttcttgcgcttcgcccgaggcccagagtcccggaggcgggtgcccagcgcgcggcctgcgcttccctcccggccttaccattggcgccaggatgctgccgcgggaagaacttgctgctggctgcctcttttcggctctcaggagagtccgtgaactcgacctttttgatttcggagtctttggagaagagacattcaacggccgccggctgcacgcctgggccacgcgcgcgcccgccccacgtgcggagagaggcgtcccggaccgcggccgaaaggagccggggacgggaggagggggaggggcgaggcaggccggaggagaaagagggacaaagagcaaagacccagttagaggaaagagctgacggcatccccgtcccccggaccctctggcaacccggggcaggatggcgtactctttctgcgcctccccggttgccggcggttccagccgggaggagtaggctggggggcttcggtacacagcgcgccgctgcttcctagtccaccgccccgccacagggagagg

SEQ ID NO: 29102 - DNA, 15 bp, Homo sapiens
  misc_feature 1..15: note = chr4:111554950-111554965
  misc_feature 1..15: note = hyper
  source 1..15: mol_type = genomic DNA
tccccctttctctcc

SEQ ID NO: 29103 - DNA, 537 bp, Homo sapiens
  misc_feature 1..537: note = chr4:111555259-111555796
  misc_feature 1..537: note = hyper
  source 1..537: mol_type = genomic DNA
gcggaggcacagaggcggggcagggagctgcgggcctgcctctggcctgagtaccgtttccctgcgtctcggcctctcctgaagggagctgggccctggggagcctctggccaaggtcgctgcctacaggaggggctgcccggcgctgtggcgtggggatccagggtggggacggccaggcggttcccccacccgctagcgagaacgcgggcggggactctgccgattcgatccttgtgggcccgtgggcccagaagtagcagtttggcggctccagatttagtgattctgcagtaaaatcacaggattagtccctgattgagatgtctgttcgtgagatattacaaaattcattatcacagctttctactaactcgatatgaagtaacacagatgggattttattagtccagacttcaaatgtttacttatgataatttcggaggaaatttgcatgtcatcatcatttcgataatcttttttttttatatgtctgaactggctgcattattagctggtagccggagcactgcagat

SEQ ID NO: 29104 - DNA, 815 bp, Homo sapiens
  misc_feature 1..815: note = chr4:111557628-111558443
  misc_feature 1..815: note = hyper
  source 1..815: mol_type = genomic DNA
tgctaatccttggcccgaggatttgttcctgcagtgttggcaccgagatttaagggaagatacctcgttttaaatgccagccacggtctggcttccctctcgacttcagcaccctgtagattgttagtgtctgtggcgggggacgaaaggaacagggctttgcaaggtctgtttgccgactgcgttaccttgggcgaaacttagccccaaaagccacaaatcacctacggtgaagattctccgaagtggaacaaatttccagactcgcattatctcacatccctgcgggatagatggcctccacttaccggctaccgggagagagctgctgtctccgcgtcccactgcttcccggggcgatttccagcgagccgagcctccggctgcacggcaagcgcccgaaagccgggcctgagaggactgcagggctcctgagggtgccaagttccgaaggagtccacgggtgcactggggcctccgaaatctagccgccactggcagtttctttctgctcctctccagctttctcgctcggtctcgcactctctctcctctccctccctctcatccctctctcttccctctgctcctactccgtgtggggagtgacgtgacgtcagcagagattccaccaaactccactgcacagtggcgcgcgggcggccggccgagcccggctgcgcggctggcgatccaggagcgagcacagcgcccgggcgagcgccggggggagcgagcaggggcgacgagaaacgaggcaggggagggaagcagatgccagcgggccgaagagtcgggagccggagccgggagag

SEQ ID NO: 29105 - DNA, 90 bp, Homo sapiens
  misc_feature 1..90: note = chr4:111558498-111558588
  misc_feature 1..90: note = hyper
  source 1..90: mol_type = genomic DNA
cggactcccactgtggaaaggaggaccagaagggaggatgggatggaagagaagaaaaagcaatctgcgccaacccggcagccctaataa

SEQ ID NO: 29106 - DNA, 448 bp, Homo sapiens
  misc_feature 1..448: note = chr4:111558803-111559251
  misc_feature 1..448: note = hyper
  source 1..448: mol_type = genomic DNA
agcaaagagggactgcggagggaggaaagtgagagaccggtagagggcgggagtggaggtgggcgcggtggggatgggagaggatgagtgaagagaaatctagaagaatggagtgagctagtgggagagggtgggagggccacagccgggagcgaacgagctaggcttgtcagctggggaaggccgggacgctgggcccagcttagctgggacaccgcgcccgaggtcaaggcgggtggaccaggcatgctgagagtgtcggcgcacaggtgggcacggccacgcactgacccagtgttcacgaagggtttgcactggacaaggctcagacgctcatagagtctagaatttcctctgctgtacctacattcaacaagttcaccctgggtcacggatatctcattttttaaaatgacgaggttaaggttcctggcgaggatggtattaa

SEQ ID NO: 29107 - DNA, 30 bp, Homo sapiens
  misc_feature 1..30: note = chr4:111560186-111560216
  misc_feature 1..30: note = hyper
  source 1..30: mol_type = genomic DNA
gggggaaaatgcccacgtgctgtttaattg

SEQ ID NO: 29108 - DNA, 277 bp, Homo sapiens
  misc_feature 1..277: note = chr4:111560442-111560719
  misc_feature 1..277: note = hyper
  source 1..277: mol_type = genomic DNA
gtagagattaagaggcgctcgtagcagaacggccttgccttcagctggtggcgaggataggcaatctcatggaaaagttggaagagaatgagaaaaccaaagacagaaagattcagagatccgcggagagacacagggagagggaagggagttgcgctgaaaagacgcaaagatacgcgcgtgcaactccctcccctttcaggtttcagaggtttgcaaaccagggctgagaggaaggggctcgggaagctcacgttcctctcgccccccttctgtc

SEQ ID NO: 29109 - DNA, 24 bp, Homo sapiens
  misc_feature 1..24: note = chr4:111562353-111562377
  misc_feature 1..24: note = hyper
  source 1..24: mol_type = genomic DNA
atctcgcactcaaaacggagtttc

SEQ ID NO: 29110 - DNA, 199 bp, Homo sapiens
  misc_feature 1..199: note = chr4:111562491-111562690
  misc_feature 1..199: note = hyper
  source 1..199: mol_type = genomic DNA
cggtggctcaggccctttgctcggaccgggaccttacagttctaacccaggagcgttaaactctggaagactccgggccagccctggaggtgcgtggccccgcaagtcgccaggccaagcttgctttttctgtctgcccctccggcaggctgggcgcgctatggcagtgagctttccgcgcaaacggagagctggaacc

SEQ ID NO: 29111 - DNA, 78 bp, Homo sapiens
  misc_feature 1..78: note = chr4:113430619-113430697
  misc_feature 1..78: note = hyper
  source 1..78: mol_type = genomic DNA
ctccaatttggatcccgggaggccgagcatctctcacgcggttgacacctctccaggctggagcgcgaagccggcgcc

SEQ ID NO: 29112 - DNA, 83 bp, Homo sapiens
  misc_feature 1..83: note = chr4:113431075-113431158
  misc_feature 1..83: note = hyper
  source 1..83: mol_type = genomic DNA
cccactcattccactcggggactaaagagcgactcacttcaacgtcctccataagatgaaccccatcccggctggaaaaatca

SEQ ID NO: 29113 - DNA, 132 bp, Homo sapiens
  misc_feature 1..132: note = chr4:113431723-113431855
  misc_feature 1..132: note = hyper
  source 1..132: mol_type = genomic DNA
cccaggctgggggagcgagaaaggggggtattggagccctcacgttttattggtctaacctaatttcactaattctcttttcacacatttcttttgcagattcggaggccgggactttcacgctcccgggag

SEQ ID NO: 29114 - DNA, 240 bp, Homo sapiens; identical to SEQ ID NO: 2445
  misc_feature 1..240: note = chr4:113431915-113432155
  misc_feature 1..240: note = hyper
  source 1..240: mol_type = genomic DNA

SEQ ID NO: 29115 - DNA, 278 bp, Homo sapiens
  misc_feature 1..278: note = chr4:113432226-113432504
  misc_feature 1..278: note = hyper
  source 1..278: mol_type = genomic DNA
cgcccagggccttcgcctcagctgggacaccaggagcgcccatccggctctggtccaggtgctgcgggcccgggaagcctcagcccctcctcctgcctccggctgagcctaggtccggctcccgtggcgggcccagcggttggcagtccgcctctctactttttttttcctccttcttggcactcagatggatgtatttaaaatctagtgaaggaaaaatgagccgtaacaaggcctgagcactttagaacaaataaatacagccagtcccggaacgc

SEQ ID NO: 29116 - DNA, 91 bp, Homo sapiens
  misc_feature 1..91: note = chr4:113432518-113432609
  misc_feature 1..91: note = hyper
  source 1..91: mol_type = genomic DNA
cgacgctccaatgagaacaggacccaccttcgcgcctctccgcacttaggaaaacgcgccgcagcgcgctagctggcgttggaaagatcta

SEQ ID NO: 29117 - DNA, 748 bp, Homo sapiens
  misc_feature 1..748: note = chr4:113435837-113436585
  misc_feature 1..748: note = hyper
  source 1..748: mol_type = genomic DNA
aggtgaggtgcatagcggtgcttgtcgggaggtgggggctgccaatagtccatgtctgacccggccgggctggcgggcgataaagtgcagctgtagggggaggtggaattggaggacacggaggaggacggcgcggggctgttggtgcaactccacgtggaggcgggcgaggggctgtctccgctgctgctcagggcggcgctggctcctcccgggctcagcaacactgcctcggagaagagcgcccccggcaggcccccgccgccgcccccgcagtgatccgccaggcgcagggtctcggtgagtgcccagatgtagttgtgggcgaagcgcagggtctcgatcttggtgagcttggcgtcctcggggaacgtggggagcacctcgcgcagcgcgtccagtgccgcgttgaggttgtgcatgcggtttcgctcgcggttgttggccttcagtctacgggtcttcttgatgcgctgcaccgtctcggccgtcttggcgcctcgggagacggcccgcgcccgggaagggcgccgtttgcaatcgtgtaccagacccagcagccgtgcgggccggcagccctccgcacccgcagccacgccgccccgcgccccctgcccggcctcagccccgcgctgccgacgcgccccgcctgacgcgcccggctcctcctcctcttcttcgtcggcgctggatgacagcggggtcagggccgccaaggcgggggaggccgatccgagcagcactaaca

SEQ ID NO: 29118 - DNA, 314 bp, Homo sapiens
  misc_feature 1..314: note = chr4:113436841-113437155
  misc_feature 1..314: note = hyper
  source 1..314: mol_type = genomic DNA
ccgggtcctgccctccgcgggcggtcctgcgttccctccccgagaagggactgcggcctccgcgacaaagattctgcgcggagcagagggcgtgcgggtgtggttggactgagtgcggggaaaccacctgcgtagttggaagcggtggctcgaatacttacttagttggctctaactgtgcctcagcgttgctgtgactttggcctgtgccgggaatctccgcgcagctgcgagcgcagcgccgggtccttcgcccggcgtgaaagctgcaagcccggcgctactgtggcgcagctccgcgggggacctctgcg

SEQ ID NO: 29119 - DNA, 579 bp, Homo sapiens
  misc_feature 1..579: note = chr4:113437622-113438201
  misc_feature 1..579: note = hyper
  source 1..579: mol_type = genomic DNA
ctcctgttggagctccgggctgcggccggagctggcgaagccgcagcggccgcagaggctcaagctgcggctgttgtcgccgccgctgtccattgtgattggtggctcgcgctcggctggagcgtgccgctaatttattaatgaatggaggtcgcgaggcgcagctggccaatcagggcgccctggactccgggaggcctgcgagccacgcgcaccggagcccgctccctttcagcagctcattaggggcccgagcgctgggggcggatggggggacccgtgctaccgcccccgccttcgtcctcgctgccgccgaggctccccccgcccggcgcgcgcgcaggcaccgcacccggcgctgccggccctcctaactcccgggtgatgggaactaggaattagttaatgggggtcagaatcccggggaaagcagttagccctgtggtgctgccgggcgtctcttggcaaagcctcttaggggttgtatcaaatagtaaacgattttaaaatggattcatttggttaggggaggagaatggcgtggatggagagatgtggacacctcgtgaacaagtgtgt

SEQ ID NO: 29120 - DNA, 198 bp, Homo sapiens; identical to SEQ ID NO: 7510
  misc_feature 1..198: note = chr4:113438506-113438704
  misc_feature 1..198: note = hyper
  source 1..198: mol_type = genomic DNA

SEQ ID NO: 29121 - DNA, 594 bp, Homo sapiens
  misc_feature 1..594: note = chr4:113441592-113442186
  misc_feature 1..594: note = hyper
  source 1..594: mol_type = genomic DNA
gttgcaggtgactgtcgggggcgcgaaagagggcgcccttccctgagaggacaaaagccaaggtttggctatccagcgagcctgtcccccaattcacagtaaaccaccgtcggccaaaggagatggcgtgtctactctctgctaaaataacaagatgaagtacctgacaagggggctttgtaacccaaatcctaatcctccgagtgagttctcagaaagatggaaagatggcgggaaaaagttggtaaatcctaaacatcttttacatcaacggtctctagttcttcgctgcaggctagaaacgcagcttccagagcaggagagcctggtatggaaacaattagctttctccgcagagcaccccttgcaacgctaggattcgttattgatagtggtgagcgctgggaatgagtgtgaattcggagtttctgacggtcccctatccgggagccaaggaagccaaggagaaaacaatgtaaattcgccccgatccccagttactgcatcccacatggtattctcggtctcccccacgttttccccttgaatcctgtccggggaggattcggcttgaacctagccctggagaggtcc

SEQ ID NO: 29122 - DNA, 279 bp, Homo sapiens
  misc_feature 1..279: note = chr4:113442246-113442525
  misc_feature 1..279: note = hyper
  source 1..279: mol_type = genomic DNA
cgtccgaggaatcggcatccaccacagcagacagaaggcagggaagatcatcccccaggccccaagccccactctagagaccctggccccaagcccgcacgacgtgctctggtgcctccaagccaaacattccgggattcggcttgacacacaaggtcagtcagcttgctagcgcggaatcggccccgcaggtgctaggaggctcacttccttcttcgcagacgctataccctatccccacctgctctggggaaggcaaagctccgcagacttcttatc

SEQ ID NO: 29123 - DNA, 284 bp, Homo sapiens
  misc_feature 1..284: note = chr4:113444011-113444295
  misc_feature 1..284: note = hyper
  source 1..284: mol_type = genomic DNA
tgttttatatatcagaaaaggatacgtgtatgtaacaataaaactgtgtaatgcaatagtgttgggagacgggggtatggtttattttcagggatctaaagatatactttagaatctaaaacattgggggttgacacttattgctgatttatccattctttctttccccccgaagtatttctcgagcgcctaccgagtgccaggcgcctagcgaggcgcagcgttagcaccaggcgcgaaccagacagctgtggcctgcctggtagaaacgaccctgcgataac

SEQ ID NO: 29124 - DNA, 152 bp, Homo sapiens
  misc_feature 1..152: note = chr4:113444296-113444448
  misc_feature 1..152: note = hyper
  source 1..152: mol_type = genomic DNA
cagttgctagtacagctctcggcggaggagccagggccgggtctccaggccgggagggggcggccgcggtgcgcccgggcagcgctccctgcgcaagtagttcttctatgtctttacacgcacttccaaaaaaacttcgcaagtcacagaaa

SEQ ID NO: 29125 - DNA, 500 bp, Homo sapiens
  misc_feature 1..500: note = chr4:113444944-113445444
  misc_feature 1..500: note = hyper
  source 1..500: mol_type = genomic DNA
cccctccctcatttacgccttcaagcagtatgggggcggagaagacttttaaaacaaaacacaaaacaagatcttttgcgagagcggtgtccgagggagccggagcgctgacaggtgtgcaggaggcgccccctacagcctgctgcccctctcggggttacactcccttcctgccgcacctgagcgttttcaggacgcgctctggtcctggagggccgggcccgcccgagggcagccgattcacggcgggcgcgctgcgaagtcggggcgccccctggtggggcacggaggtcgagggggtatcctgagagcaccgcggggcttcggggccgcgggggagctcccaagacagccggccaccgggggacagtggatttggggtctcctcgaggtcggtccggggacgccctctgggaagcttcacctgcggctcaggttacaaacgcacagtgcccagccacgtcctcacctgcagtttcaaaagccgaaagaaacaaaca

SEQ ID NO: 29126 - DNA, 99 bp, Homo sapiens
  misc_feature 1..99: note = chr4:113626580-113626679
  misc_feature 1..99: note = hyper
  source 1..99: mol_type = genomic DNA
aacaaagaatgtgtgcgcgtggaggctagaggtgggtgggtgggtgggtgggtgccttagcacaactccagcggagagtgagtgcggataggaaatgtg

SEQ ID NO: 29127 - DNA, 53 bp, Homo sapiens
  misc_feature 1..53: note = chr4:113627418-113627471
  misc_feature 1..53: note = hyper
  source 1..53: mol_type = genomic DNA
cgcgtcccccaagggcggggacctcaaccccaatgcggcggctcccctaggag

SEQ ID NO: 29128 - DNA, 64 bp, Homo sapiens
  misc_feature 1..64: note = chr4:114900586-114900650
  misc_feature 1..64: note = hyper
  source 1..64: mol_type = genomic DNA
gtttgccaatctccccgacactcaccaggcggcgaagtgaggaagaagccgtttcctgatctcc

SEQ ID NO: 29129 - DNA, 55 bp, Homo sapiens
  misc_feature 1..55: note = chr4:115520068-115520123
  misc_feature 1..55: note = hyper
  source 1..55: mol_type = genomic DNA
tcccggatacaattacgcggcagacacacactcaaactcgcgcggggcagccaag

SEQ ID NO: 29130 - DNA, 190 bp, Homo sapiens
  misc_feature 1..190: note = chr4:115520755-115520945
  misc_feature 1..190: note = hyper
  source 1..190: mol_type = genomic DNA
ggtggcagggtttcacgggtccccgcgccgatttgggaatggtacggggtgcccttgcattagagaagcctgtgcgggcccccgggattagagaagaggtgagcgcctgcgggcggggagagaaggacgcgctgctggcaaaaagaagggcgccttccatggactggaggagcggcgagggagcctggta

SEQ ID NO: 29131 - DNA, 51 bp, Homo sapiens
  misc_feature 1..51: note = chr4:117847235-117847286
  misc_feature 1..51: note = hyper
  source 1..51: mol_type = genomic DNA
gggcggccccgcgtccgggcggctctctgaggctacgcggtgcccggtgtc

SEQ ID NO: 29132 - DNA, 153 bp, Homo sapiens; identical to SEQ ID NO: 7517
  misc_feature 1..153: note = chr4:117847306-117847459
  misc_feature 1..153: note = hyper
  source 1..153: mol_type = genomic DNA

SEQ ID NO: 29133 - DNA, 21 bp, Homo sapiens
  misc_feature 1..21: note = chr4:117847469-117847490
  misc_feature 1..21: note = hyper
  source 1..21: mol_type = genomic DNA
cgggcccgctcgtcctgggac

SEQ ID NO: 29134 - DNA, 42 bp, Homo sapiens
  misc_feature 1..42: note = chr4:118955083-118955125
  misc_feature 1..42: note = hyper
  source 1..42: mol_type = genomic DNA
cggggccggtctcctcgcccagaaacccgatccgggcgcctt

SEQ ID NO: 29135 - DNA, 47 bp, Homo sapiens
  misc_feature 1..47: note = chr4:118955468-118955515
  misc_feature 1..47: note = hyper
  source 1..47: mol_type = genomic DNA
gcatctgtcttcccccgaagtggtaccaaagccggtcccttggcgac

SEQ ID NO: 29136 - DNA, 54 bp, Homo sapiens
  misc_feature 1..54: note = chr4:119273444-119273498
  misc_feature 1..54: note = hyper
  source 1..54: mol_type = genomic DNA
gcgccgtcggggctccgacaaaagttgtggcgctgtcctcgcagctgagcccag

SEQ ID NO: 29137 - DNA, 66 bp, Homo sapiens
  misc_feature 1..66: note = chr4:121843230-121843296
  misc_feature 1..66: note = hyper
  source 1..66: mol_type = genomic DNA
ctaaaggaaaagaggcgacagcggagcagcgtgcgcgcgggggaaaacacccgcccacgcgtgcct

SEQ ID NO: 29138 - DNA, 199 bp, Homo sapiens
  misc_feature 1..199: note = chr4:121844007-121844206
  misc_feature 1..199: note = hyper
  source 1..199: mol_type = genomic DNA
gggcgcgggcctgggcgctgcgggcgccgggacgccgctcgctgattggcccgaagttggcggctctgacccgcgcccgggcgcgaagcccggagcagggctgaccccagggcctcaaacccggaggcccgcgagctgcgcgggccgtcagcacccctagccccggcgcggcggcgtgcgttcccgcctttgtccagct

SEQ ID NO: 29139 - DNA, 624 bp, Homo sapiens
  misc_feature 1..624: note = chr4:121992072-121992696
  misc_feature 1..624: note = hyper
  source 1..624: mol_type = genomic DNA
gcccgcggcaaactccgaggagctgatgcggggcgggtccggggaactgccgggagctctcacgcctgggcctgggatagggtgcgggcagaaaggtgaaccgagagcgcacaatgcaacgaaaccgcactccaaattcagcagtttgcaaagtgcctccaagaaaacagctgggacctgcaatcactcgttcggactcctaggttatcggggccgcggcgactccgctcagttagaaaggtagcgcgggtgagagcgaaccccaactcacgcacagacaggacgagggcacgaagccgagtctcctggctggggccgtagggggcgtcacctcggtggccgctctgctctccggaagaaagtatgagccggtcccaggccacctcgctcagcccaaggaagtttctataacgatgctcgcctaccacgcagaggacaaatgaggagccagagcggttgggggtcgggccaaccgaactcccggccccggctgcgcagctcccagacgcccaccaagaactcgtgcgctgcctggacctctagcttttcgccctacacgcagacgccctctgcaaaaccccagtcccgcagactttccctagcggcgggcggagggcatgaacc

SEQ ID NO: 29140 - DNA, 280 bp, Homo sapiens
  misc_feature 1..280: note = chr4:121993436-121993716
  misc_feature 1..280: note = hyper
  source 1..280: mol_type = genomic DNA
atcccggggcagcgccgagaagcggcgggaggtccttttaaactgcagggagcgtgcgggggctgggcggcgggaggatgccgcagcgacccgcggggctggcgcgggcttcgccggccgccgctagtcgcacaggcgcctggctggagcgccgcgcggggtgctgggagagccgggcgcacggggcggcagcggccgtggcgggtgcgctgctcagttagctccactctctcgcggctggaagtggggagtgtgtgttcgctcccgagtgtcactgctg

SEQ ID NO: 29141 - DNA, 352 bp, Homo sapiens
  misc_feature 1..352: note = chr4:121993995-121994347
  misc_feature 1..352: note = hyper
  source 1..352: mol_type = genomic DNA
cccaaacaggaccctcgcgggcggcatcgcgagggacacgctgctgtcctaaccttagcgccactcggggagaatgaaggaggcccaccgagcccccgacaaagctgcaaaacccaggagacgcgcacgcgggaccatcacactgtcaagcagaccggggtgcacaatagagggaaactctggggttgatctgggggcagggagggggacgtgttaaatccagaaggttggtggttggaggcggaaagcagagtgtgcaaactgtgcattcatgtcccacttttcacccgaacgcctgcctatcacagccttcactcagggagcgcttccccctcggcgcagaccgagcctc

SEQ ID NO: 29142 - DNA, 291 bp, Homo sapiens
  misc_feature 1..291: note = chr4:122301422-122301713
  misc_feature 1..291: note = hyper
  source 1..291: mol_type = genomic DNA
ttaagagagaaggagcgaaggagcggggcgcgactcttaccccccagccagttgtcggaaatgttctggagcatggtgacgggaatgcagaagaaggtgatgagcaggtcactgagcgccaaggagcagataaagatgttggtgacggtgcgcatggccttgctgcgggtcaccacgtagaacaccagagcattgccaaagagcgccagggcgaagatgagcacgccggtgagcacgagggccagcttggcgcgtcccggcagctctggggtgtagacgagcggtcgcagc

SEQ ID NO: 29143 - DNA, 376 bp, Homo sapiens
  misc_feature 1..376: note = chr4:122301962-122302338
  misc_feature 1..376: note = hyper
  source 1..376: mol_type = genomic DNA
cgggaaaggagagcagctcagggatcaaacccacgataaagaggcgggaagccaaagcactgggagactcgatctcagtgaccaaaaaatgttcgcggttcaaataaagttcttcccttgctcttccctaaggcgaggcgccgccacggtctggggtgctggagcgccacgcgagggtcctggcgcctctggctccccgccttctggccatgcgatgcggacgccggacccgcttggggagcggtggagggtggggctgaactcggtgacgcctccctcacacccagcttcagtggcgccaacgccgcttccccgcaccctcagggcgagggaagacttccctggctcaccaacttgctgccgcccagcgcctttc

SEQ ID NO: 29144 - DNA, 46 bp, Homo sapiens
  misc_feature 1..46: note = chr4:122685845-122685891
  misc_feature 1..46: note = hyper
  source 1..46: mol_type = genomic DNA
accccatacacccaccgtccctggcacccgaacgcgctgcgagccc

SEQ ID NO: 29145 - DNA, 340 bp, Homo sapiens
  misc_feature 1..340: note = chr4:122686113-122686453
  misc_feature 1..340: note = hyper
  source 1..340: mol_type = genomic DNA
cgagaggcgcccgggctggagcgccccggccgtgttggccacggagttcttcagctgcttgatgaccacgaagagcaggaggaaaagtaagaagagcaggaagaagaagagcgccaggtagagcagcaagttgagttcccactccatgctggaggcgccggcgctcgctggccctgcgcgctcggcgcgggctgcagctggagggcgagcgcgccgcccgcacacccacctcccgcactcccgcccctcgcgagggcgtcccgctatgggcgccgactccggggtccgtgctttgcctcccccggctccgaggaaacgcgccaaggagctgaggaaatcc

SEQ ID NO: 29146 - DNA, 227 bp, Homo sapiens
  misc_feature 1..227: note = chr4:122686454-122686681
  misc_feature 1..227: note = hyper
  source 1..227: mol_type = genomic DNA
gcgcagactctcccagctggcaccaaagccttccgcttcgccgagatcctctcaggtgctcttgaggacgcgagcgacttccctaggagcgaacttccgcgggcacggacgccagaagaggtaacagctcagtcttccaggggaggtcgggactggtgttttgtaaatgatttaaaagttccacccccaacatccagtagggtccctagctccgctgcgttcccaat

SEQ ID NO: 29147 - DNA, 1252 bp, Homo sapiens
  misc_feature 1..1252: note = chr4:122871208-122872460
  misc_feature 1..1252: note = hyper
  source 1..1252: mol_type = genomic DNA
gaagtgagctggtggcgctttcatcccaaaggatataccttccctccatttcctgggccgtttccattccacgcttatcttcagcaataactgaaccacatcgggatgcgtcgctcatttaaaatcagaactcttccctatgggatctactcccagccactgattgtgttcctgtgttctaccggcaggtccagcctgaccaggcgcagactctgcgcgcgcggagcagcgcgcgatcctggggatgcaggggtcatcccggaggtctcggcctcgggcggtgggcctctcgccggcagcagggggcgctgcagaacctcggtccccatcctggagaaccacctccccggctcagccggtctgcgccgcccgccaccatccgaccccaagttctctacctagttctgagcgttcttcctaaaaaagacagtaaaccctgcggcactcccagtgttacgtgacagaaaaaatacagagcatctcaccctgtgaaaccgatcaccctctttttatcttctctgcgtctcgcactgattaaaagctgtctccaagattggaaattaagaaaagttgctctttctcatgcattagcgcgccgaccgctccttcgtttagaaagagagagagggaaagaaagaaagagaaaaagagagcccgcgcgccggggcgcgagccgctgaccctgcaccgcctgggaaccgcagtcaaagttatcactaaagcggttccccggctgcccgatgcccactctctccctcaggggaccctatagggcttcggttccagttttaccccaaatgtgactgaaccacagagagacgaggcgcctgggcaaaccttcaacccacaccctgtatcgcactgtcccctccctactccccacttctctgcccccgcccccgacgtcccagagcgtcggaggggacccaagtccacgctgggacgcccgggaggagttcagggttcaagtgcgcgcctgggtctgtgcacatcttccccttcctcggcctccctgggtaagctcgggaccccggggtccgtcttccaaggggtgcccagccctggcagcagtcgtgcgagctcctcggctctaatacagggagtggctgctcgccaggatgcttgtctgaagtcagtgtgcccgcctgcgggctgttccgtgtgcttgagcctggacagagcccctgccacgcactcggcagcccctgtgtccctccaccgcgcgggaccgagggggcgagcctccggccga

SEQ ID NO: 29148 - DNA, 497 bp, Homo sapiens
  misc_feature 1..497: note = chr4:122872667-122873164
  misc_feature 1..497: note = hyper
  source 1..497: mol_type = genomic DNA
ccgctgcgagggcgccgagcgcggctccagccccccgttgacgcccctccagccccggcggcggcgctgcggctccgcgccctcgtcctcgccctcgtcttcctcctcctccggcgccgggaaggtcacccttgcttgttctttgcacttcctgaccttggtggacatcgcgccggctgcggtccgagtgtgggggtgccggctgccggcctcctccgccttcgcggcagtgcagtcttcccgcggcgccccttcaccacctcccgcggcttccggggccccgggcggcccagggcgggaaggcaggagcggagagcgtcgcggcccgcgatccagcagttagaggctagcgccgaagccgagctgccgccgcccaccatcaaaccgtgggagcagctgccgcggccgtggctgcgacgaggaagcccggggccgagcggggctctggtgctgggagaggctctccagccccgcggcggcggcgatgcctcctcggc

SEQ ID NO: 29149 - DNA, 1100 bp, Homo sapiens
  misc_feature 1..1100: note = chr4:123747826-123748926
  misc_feature 1..1100: note = hyper
  source 1..1100: mol_type = genomic DNA
cttgcgtgttgtggccgaaccgccgaactcagaggccggccccagaaaacccgagcgagtagggggcggcgcgcaggagggaggagaactgggggcgcgggaggctggtgggtgtggggggtggagatgtagaagatgtgacgccgcggcccggcgggtgccagattagcggacgcggtgcccgcggttgcaacgggatcccgggcgctgcagcttgggaggcggctctccccaggcggcgtccgcggagacacccatccgtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacagtgagtgccgacccgctctctccgcctcatttccatttcgtgggttctcgcccgctctctcccctccagcctgcaccctcctcccggatcttcactgcgaccctagcgctccgtgtggtttctggccgcgcggccctcggcggtttcgggttcaccactcaccccctcctttccgggctgcggcgtaggcccgggtgtcccctgggctttggggtgtgccaatttgccctgtaaaccagtacccccggcccggagccgcggcgcgccggggcctcgcggactggctgtcttcccgcggacaacctgtcgcgtcggggatgcccgcggccccgccatgcagctctggccgcttctatctgctgcgtgctgtcccggggacaaagacaggaaggaccgcagcagaacgaaacggtctttac

SEQ ID NO: 29150 - DNA, 127 bp, Homo sapiens
  misc_feature 1..127: note = chr4:124426734-124426861
  misc_feature 1..127: note = hyper
  source 1..127: mol_type = genomic DNA
gggcaattataactacggcaaaaaaaaaaaaaaaaaaaaaagagttcgcagggacgcagcgctgccgccgccgccgccgaggccgcgaccacggcccgagccggccaccgcgcgtcaaaggagccat

SEQ ID NO: 29151 - DNA, 51 bp, Homo sapiens
  misc_feature 1..51: note = chr4:126235891-126235942
  misc_feature 1..51: note = hyper
  source 1..51: mol_type = genomic DNA
ttagcgcctccgcctcgctgtgctcccacaccagaccgcctacagccctcc

SEQ ID NO: 29152 - DNA, 30 bp, Homo sapiens
  misc_feature 1..30: note = chr4:126236943-126236973
  misc_feature 1..30: note = hyper
  source 1..30: mol_type = genomic DNA
agcggccactgccggcgccctgttggaggg

SEQ ID NO: 29153 - DNA, 32 bp, Homo sapiens
  misc_feature 1..32: note = chr4:126237355-126237387
  misc_feature 1..32: note = hyper
  source 1..32: mol_type = genomic DNA
atctctcttgcactccgcgttcaactggctac

SEQ ID NO: 29154 - DNA, 554 bp, Homo sapiens
  misc_feature 1..554: note = chr4:126237654-126238208
  misc_feature 1..554: note = hyper
  source 1..554: mol_type = genomic DNA
tactgtcattgcttccggggcaggcctgggtccacggggccgagccgcgccaggtgttccaagtgctggaagagcaacctccaggcactctggtaggcaccatccagacgcgccccggcttcacctacaggctcagcgaaagccacgccctgtttgccataaacagtagcaccggagccctgtacaccacctccaccatcgaccgcgagagcctgcccagcgacgtgatcaacctggtggtcctttccagcgcgcccacctaccccaccgaagtgcgagtgctggtgcgggacctcaatgacaacgcccccgttttcccggacccctctatcgtggtcactttcaaggaagacagtagcagcggacgccaagtcatcttagacaccgccaccgactcggacatcggctcaaacggtgtggaccaccgctcctaccgcatcatccgcggcaatgaggcggggcgcttccgtctggacatcaccctgaacccgagcggcgagggagcgttcctgcatctggtgtccaagggcggactggaccgtgaggtcactccg

SEQ ID NO: 29155 - DNA, 341 bp, Homo sapiens
  misc_feature 1..341: note = chr4:128544048-128544389
  misc_feature 1..341: note = hyper
  source 1..341: mol_type = genomic DNA
tgtccctggccaaggcggcctcgctgtcctggaagggagggtgaagagctgcatcccgcactaggcggcgaaagagggcagcgccaagcggcggggtccggaggcgctcgacggctcgcgcccagcgccggagacgggctgtgtgttgggccagtggaagacaccggagaaacccagacgtggaagaccgggcagcctggacttcgcgagccctggtggggctggcggcccacagagcccccacctgccccgagctcccacagcgaggagtggccgcgccgcccgccagtgcgccgggctccgagaccggcaggggagcacgcgggcgaaggaggggccgc

SEQ ID NO: 29156 - DNA, 160 bp, Homo sapiens
  misc_feature 1..160: note = chr4:128544646-128544806
  misc_feature 1..160: note = hyper
  source 1..160: mol_type = genomic DNA
gtcagtgcagggccccgggacgcggggcgagaccgtcctcttgccccggaaatgttggcgagggaggggccgcttttctttctggggtctttctggaagcatctgacttgggattcgccttagtgcggcgctggccgcgaagggccgttgggacctgcac

SEQ ID NO: 29157 - DNA, 227 bp, Homo sapiens
  misc_feature 1..227: note = chr4:134067790-134068017
  misc_feature 1..227: note = hyper
  source 1..227: mol_type = genomic DNA
ggaagaagaccctaccgtcactccgccggtccctggctggcgccacaaagactagaagtcggagaggcgagacctctagggggcctgggctcagcgacgctggtgcggacacagacccctatgacccaagaaatcttgtagagcccccaaaaggcgagctctccaaagcaaaattctctggcctgccctatgctgatttcgccgctaggagacgcctgtaacccacg

SEQ ID NO: 29158 - DNA, 77 bp, Homo sapiens
  misc_feature 1..77: note = chr4:134068322-134068399
  misc_feature 1..77: note = hyper
  source 1..77: mol_type = genomic DNA
atacgtacaaatgaacgcattagaaaattaccgtcattttttaaaaggctccaggattctgacgagtcagcttgaag

SEQ ID NO: 29159 - DNA, 75 bp, Homo sapiens
  misc_feature 1..75: note = chr4:134068702-134068777
  misc_feature 1..75: note = hyper
  source 1..75: mol_type = genomic DNA
tgaaagagccaagtgcgggggccggggggacccggcgttgcggggagttggggcgcggaaatcagggcagtagac

SEQ ID NO: 29160 - DNA, 143 bp, Homo sapiens
  misc_feature 1..143: note = chr4:134068778-134068921
  misc_feature 1..143: note = hyper
  source 1..143: mol_type = genomic DNA
tgcattcgcgggactctcagaagcacgtctcaggctactatcacgcccatggacactagccctccttaactccttgccaggaggaaatggcaacgtatctccaggtcggaaaacgactctacttttcccgcaggttgtggtgg

SEQ ID NO: 29161 - DNA, 127 bp, Homo sapiens
  misc_feature 1..127: note = chr4:134069769-134069896
  misc_feature 1..127: note = hyper
  source 1..127: mol_type = genomic DNA
ctgcccgtctgtaagcgctgtcatccccacatcctttagcgtgaattcctccgctttttaggagtcacctccaccccctactccgtatgcttcgcgcctttcctcacggccccgtcagaccccctca

SEQ ID NO: 29162 - DNA, 150 bp, Homo sapiens
  misc_feature 1..150: note = chr4:134070219-134070369
  misc_feature 1..150: note = hyper
  source 1..150: mol_type = genomic DNA
ccccagccagcgcctcgggacctgcggggctgttctcgctctcacactcacactcaccccggccgctcgggcgagagttctgtcccgccccgcccggctgccgcgtgacgtgtctgtttggcggccagtttggccaatcatcggcagctc

SEQ ID NO: 29163 - DNA, 68 bp, Homo sapiens
  misc_feature 1..68: note = chr4:134070370-134070438
  misc_feature 1..68: note = hyper
  source 1..68: mol_type = genomic DNA
gtgggtggtgctcctgggcgattggttggcagaatgagggcgctgcgcaaaaacggagaagccgagcg

SEQ ID NO: 29164 - DNA, 1559 bp, Homo sapiens
  misc_feature 1..1559: note = chr4:134071052-134072611
  misc_feature 1..1559: note = hyper
  source 1..1559: mol_type = genomic DNA
gatgaggaaaggggacgcctgtcacccttcctgtgctaagatttaaaaaaaaatgaggctggattgcgggaagctctaaaatgaagcaaaaggagtaagatttttaaagacagaaagccacaggagcccccacgtagcgcacttttatttgtattttttcagatttttttttgtttcgtggtggtgggggaggtgattgggtggctgactggctgcgggaagctacttcctttccttttggagatgattgtgctattattgtttgccttgctctggatggtggaaggagtcttttcccagcttcactacacggtacaggaggagcaggaacatggcactttcgtggggaatatcgctgaagatctgggtctggacattacaaaactttcggctcgcgggtttcagacggtgcccaactcaaggaccccttacttagacctcaacctggagacaggggtgctgtacgtgaacgagaaaatagaccgcgaacaaatctgcaaacagagcccctcctgtgtcctgcacctggaggtctttctggagaaccccctggagctgttccaggtggagatcgaggtgctggacattaatgacaaccccccctctttcccggagccagacctgacggtggaaatctctgagagcgccacgccaggcactcgcttccccttggagagcgcattcgacccagacgtgggcaccaactccttgcgcgactacgagatcacccccaacagctacttctccctggacgtgcagacccagggggatggcaaccgattcgctgagctggtgctggagaagccactggaccgagagcagcaagcggtgcaccgctacgtgctgaccgcggtggacggaggaggtgggggaggagtaggagaaggagggggaggtggcgggggagcaggcctgcccccccagcagcagcgcaccggcacggccctactcaccatccgagtgctggactccaatgacaatgtgcccgctttcgaccaacccgtctacactgtgtccctaccagagaactctcccccaggcactctcgtgatccagctcaacgccaccgacccggacgagggccagaacggtgaggtcgtgtactccttcagcagccacatttcgccccgggcgcgggagcttttcggactctcgccgcgcactggcagactggaggtaagcggcgagttggactatgaagagagcccagtgtaccaagtgtacgtgcaagccaaggacctgggccccaacgccgtgcctgcgcactgcaaggtgctagtgcgagtactggatgctaatgacaacgcgccagagatcagcttcagcaccgtgaaggaagcggtgagtgagggcgcggcgcccggcactgtggtggcccttttcagcgtgactgaccgcgactcagaggagaatgggcaggtgcagtgcgagctactgggagacgtgcctttccgcctcaagtcttcctttaagaattactacaccatcgttaccgaagcccccctggaccgagaggcgggggactcctacaccctgactgtagtggctcgggaccgggg

SEQ ID NO: 29165 - DNA, 304 bp, Homo sapiens; identical to SEQ ID NO: 389
  misc_feature 1..304: note = chr4:134072676-134072980
  misc_feature 1..304: note = hyper
  source 1..304: mol_type = genomic DNA

SEQ ID NO: 29166 - DNA, 349 bp, Homo sapiens
  misc_feature 1..349: note = chr4:134073292-134073641
  misc_feature 1..349: note = hyper
  source 1..349: mol_type = genomic DNA
gcccctttcctccaccgccaccctggtggttcagctggtggatggcgccgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcctctgctgctgctgctgcggtggcggaggttcgacctgctgtggccgccaagcccgggcgcgcaagaagaaactc

SEQ ID NO: 29167 - DNA, 126 bp, Homo sapiens
  misc_feature 1..126: note = chr4:134074030-134074156
  misc_feature 1..126: note = hyper
  source 1..126: mol_type = genomic DNA
ttagcttatgtgtatcgttgtgggagcagagatgggcggtcaccttctcccactccttcgtgtgtaacctaactttcgcgttgttccaccctttcacatttattttcattccgtccccttggtact

SEQ ID NO: 29168 - DNA, 565 bp, Homo sapiens; identical to SEQ ID NO: 390
  misc_feature 1..565: note = chr4:140200592-140201157
  misc_feature 1..565: note = hyper
  source 1..565: mol_type = genomic DNA

SEQ ID NO: 29169 - DNA, 361 bp, Homo sapiens
  misc_feature 1..361: note = chr4:140201192-140201553
  misc_feature 1..361: note = hyper
  source 1..361: mol_type = genomic DNA
cgcccgtcctcctctccgggctagacctccttactcaccgtcctttccgagcggcgcggggttggggggcgccctcagcggcagcgccagagtcttggagaccgccctgcggagatacatcgcgcccgctgtccgccgcgcagcagcctcggtacccaggcgcaggctgcccttccacagagaggctgagagcctggcagcgccccgcccggaggaggcacgtcgaccttcatccagccccgcctccgcggcccccgggaggtggggagacctttgtagtcctcaccatcctcccctaacccatctccagctctgttgctatccctgaggtctctagagctgaccgcggcatctcagaaaa

SEQ ID NO: 29170 - DNA, 629 bp, Homo sapiens
  misc_feature 1..629: note = chr4:140655870-140656499
  misc_feature 1..629: note = hyper
  source 1..629: mol_type = genomic DNA
atttataaatctgtgcgtagggaagctttatttttctgaagtgttttcaagaacatgcatagtgtttgggtgagaggggccagccttgctggcggcgaaccaaagagcagggaatcacaaaagacggccggcggcgagcaggctggggtgacggggaccccgtggataacgggcttgaggacgcccagggcttcagccttttccaggcgtccctcgccggggcaacgcagagcagctgccgttcttcccgcgccccagcagatggtggtgtcagcccggcctcgtgcccggccgccgctgcgcccgcgccccctcccctcgcagatggcttaatcagggctcccgcccgcccctccgcggcccccgccccgcgcgtctgggcgagcgctgcgaacgtggagccaggcagtcaagtgttactgcgtacagcaggtagcctggcaactgagagcacaataccgagcagatggtgttcgcacggcgtgatggacatcacacacgacagcctgagacaatccaggaattccctggtgactcgaggccctctttgcacaaaatgagttctctctccattgccgtgtatctctggggttatctgcccccctcctccgactgacactgaactggtt

SEQ ID NO: 29171 - DNA, 149 bp, Homo sapiens
  misc_feature 1..149: note = chr4:140656999-140657148
  misc_feature 1..149: note = hyper
  source 1..149: mol_type = genomic DNA
gcgggcaggggcggtgcggcggcgctcgggagacccgcgaggggccctggaggtcctcggcccgcgcgcgccgctcgggagcccgcgaggctgcggtgtgctccagcgggcgcatttcccaggccccgccacatcgtgtgtgttagtgg

SEQ ID NO: 29172 - DNA, 47 bp, Homo sapiens; identical to SEQ ID NO: 7547
  misc_feature 1..47: note = chr4:141294349-141294396
  misc_feature 1..47: note = hyper
  source 1..47: mol_type = genomic DNA

SEQ ID NO: 29173 - DNA, 218 bp, Homo sapiens
  misc_feature 1..218: note = chr4:141294633-141294851
  misc_feature 1..218: note = hyper
  source 1..218: mol_type = genomic DNA
ggcaaaggtggatcccggtgctttgagattggacgactggggtgaggcgggcagctaatgcgcaggcgtgtattctcgagtcaggattggcgggcgagcggctgggacgggatgggattcttctcacggcgcacgttctgtgggcggagtgggcggagctgccggggtcagttggtccaagtgtcccggcctgaggtgtcggccggatccctccttct

SEQ ID NO: 29174 - DNA, 208 bp, Homo sapiens
  misc_feature 1..208: note = chr4:141295066-141295274
  misc_feature 1..208: note = hyper
  source 1..208: mol_type = genomic DNA
tttttctcctgttttcgttgtcaggcccaggcgttctttgggagagggacctctcgcggtccctgacgcagacatcgtgtagctttctccccgcagctcctgggtcgggagccgctttgcagctctcggctctggaattggactgcgggaggggcgtttgggtggaatgggacctggcacgcctggaccttcccgtggctgctctgcg

SEQ ID NO: 29175 - DNA, 394 bp, Homo sapiens
  misc_feature 1..394: note = chr4:141348031-141348425
  misc_feature 1..394: note = hyper
  source 1..394: mol_type = genomic DNA
cccagccctttcgcccgccccccggcggcgcacaatgggctctgcgcgggtatcgagggagcggccaacagtccctggccccaccgccgtgaagtggggtcccttcgcttccacataggtggagactgagacagccgagcctattttgatctcgtttgggtttctgtaaggagcagtcagcagagtgagcagcgcccagacgcgccccgggccccctctacaaccattgggagagcgccccgggctcaagcgtggaacggggctgcaatggcaaccgctggaataacggcctcggctcccggtggctcctcaagcccgcaggggaggccggccgggctaggcacctagctgtccccgtgctcgtccgccccagcccgggcgcagcaggtggatg

SEQ ID NO: 29176 - DNA, 590 bp, Homo sapiens
  misc_feature 1..590: note = chr4:141418867-141419457
  misc_feature 1..590: note = hyper
  source 1..590: mol_type = genomic DNA
gaaggaggaaagatgcggacagatgctggctgtgtaagagcagttcttggggtcagacagccatagtttcgagaaggaagaacaggagaggggaaaagcagtgcacagacggggtccttgaacctttgaggaaaagggagcggcgggtaccctgggccagatgcgttagcgcgcgtgcaggccggacgcggccctggaggaggaggtcggggcgcgggttacagcccagccgccgctgaccggggtaggcgcggcctcgggaaggcaccgacgcgggcctcccagtgccagcgcgggcggccgccgccagcttcccgcatcgcctccgcacccgccgaccctgccccgcctgcattcctgcagccccgaagcccccgcggcgggaaaggaggcgggaggagggcccgccgcttactggtttgagttatcctgtagatggagaagcaagagaagctgaacaacgcgacggcgaccagggtgatcagcaagttcacctgcttggtcctcatggccctggccaggctgcgggaggccggcgggtggaggcggcggataatgccagggacggggttgagcgcgcagagccccct

SEQ ID NO: 29177 - DNA, 266 bp, Homo sapiens
  misc_feature 1..266: note = chr4:141488816-141489082
  misc_feature 1..266: note = hyper
  source 1..266: mol_type = genomic DNA
atatgaatgttttctcgccaatttgttatgaaaaccactcctctgtgtgttacactttttggaacagagcggagcccaaggcttttctgcccctcccaggaacgctcacggcttactttctttccctgcggtgaggaactcctggaccgtgtcgtagaggccgatcctgagagaggcggagctgatttgccgctgaagccccgcaggcagcccgctgtagagtttcatccgcccttctgtttttaccacagcggtgattgttccca

SEQ ID NO: 29178 - DNA, 749 bp, Homo sapiens
  misc_feature 1..749: note = chr4:142053505-142054254
  misc_feature 1..749: note = hyper
  source 1..749: mol_type = genomic DNA
tggtgttggagcccacgttgaagatgaccacggctgaggcgttctgcaggaacgcgttccggatcttatccctgtacgtgcagttgcccttggggatgagggctatccagttcttgccgcgggtcggggcggcgaacttggtgttggggtcgcaggccaggcggtcgtgggccgagctggccatgaccacctccccgcgggcgtcctgcttgggcgagtgctctccgtagcgcccgcactccgtcttctccgtgtgcagctccgcgccgccgccgcccgccgccccggccccggggtccggcgcgggctcggcgtaggtgatgttcacgaaggcggtgtaccattcctccttctcggccacggtaaagtccaggcagagcagatgcacgaaacaaaaggaaagcagccatgttgagagagccagactgcagcacgcttggatgagagacattgccatctttatccgccggggccccctccccgcccccgcgccctccctccgtcccgtccctcctccccagccccggccaaccccgggccgctgcctctcctcctgctgctgctcactcccgggccggaggggccgcggccgggacgcgcagccgccgcggggaccggattccgggcgagcggatggcgctggccccttcccctctcagctgtagcgcggtggttgcattttgcttcttgggcgcccggggggcgcgggaacagagggcccgcggggcttgcggaggagtcctgctgcc

SEQ ID NO: 29179 - DNA, 419 bp, Homo sapiens
  misc_feature 1..419: note = chr4:142054255-142054674
  misc_feature 1..419: note = hyper
  source 1..419: mol_type = genomic DNA
agcgtcctgctccttcgcccggcttcgccttctctcataagggtggccgggggcccacgaacttgcagggtggcggccctgcgccctccagccccggcggggacgggcacgattgctcgtagtctggggtgctgcggtgcggggtgctgcccagggtgtcccggccgccgccactgagcgctggggcgcgcgaatccagctgcagccgctgctgccctgcgccggttccctcaggctgcgggcgctgcgctcctgatctcgccggtggctgcgcctgggcacgcacttgccgcgggcggggcgggcttggggacagtgggagcgagcaggcagagcggagtaagcggtccgtgtgtgtgtgtctgtatgtttgtgtgtgtgtgtgtgtgtgtgtataatgtgtgcgtgcaaggaggagc

SEQ ID NO: 29180 - DNA, 303 bp, Homo sapiens
  misc_feature 1..303: note = chr4:143766796-143767099
  misc_feature 1..303: note = hyper
  source 1..303: mol_type = genomic DNA
aaaaaacaaggcaaccgggaccaccaacatcagtcaccctcactccccaccactgcctctattccttaaggacttcttcccaggccggcggcggcggcggcggcggcggcggcagcttgcgatcatcaggattggaagtgagagcgagtgcccgggccaacctcagcgtctctcagggacagcgcaggtgggcgcagccttggaaggtcagcgaggccagagctcagagttccacgggggcccggagagtgtgcgtgtgtgagtgagaatgcgaaaacgcgcgcgcgccgggcagaggggcgc

SEQ ID NO: 29181 - DNA, 32 bp, Homo sapiens
  misc_feature 1..32: note = chr4:143767625-143767657
  misc_feature 1..32: note = hyper
  source 1..32: mol_type = genomic DNA
ctcgcctaccagccccgcgcgcgccccagaga

SEQ ID NO: 29182 - DNA, 358 bp, Homo sapiens
  misc_feature 1..358: note = chr4:143767920-143768278
  misc_feature 1..358: note = hyper
  source 1..358: mol_type = genomic DNA
cgtgtgctcacaccccgtaccccgacccctttctgcggcccctctgcccgctgggtcgcccacccagactgggctgtgggatcaccgctaccgcgacgaggggggacccgaggccgccacgctgctgcgggggcaggagaaaccacagagaaagaacccgcgggaggaagaaagcgccccagaccccggcctatggcagcgcagtccctagaccgagggtttttggaaggggcttgggatccctgctgtcactgcctgcgtctaggcatccattcacgcctgctggaccccagtctgcagccgcgctgggacccctgtctcttgcccctcctcccccttgccccgggcagaggtcggg

SEQ ID NO: 29183 - DNA, 42 bp, Homo sapiens
  misc_feature 1..42: note = chr4:144480322-144480364
  misc_feature 1..42: note = hyper
  source 1..42: mol_type = genomic DNA
tagaatacagaaaggcgcaggcagtcacgtaggactaggccg

SEQ ID NO: 29184 - DNA, 30 bp, Homo sapiens
  misc_feature 1..30: note = chr4:144620978-144621008
  misc_feature 1..30: note = hyper
  source 1..30: mol_type = genomic DNA
cacccgcggacccagcgtcttggccctcag

SEQ ID NO: 29185 - DNA, 142 bp, Homo sapiens
  misc_feature 1..142: note = chr4:144621298-144621440
  misc_feature 1..142: note = hyper
  source 1..142: mol_type = genomic DNA
accaaaggcctgttacgcgtcaccagctccagctgggagaagaccaagtccaccgccagcgtgaagggcagcaccagagtgtgagtcggggcgtcgtagcgcagctgcagcagcacccgggcgcgtccggggctgtgggagc

SEQ ID NO: 29186 - DNA, 383 bp, Homo sapiens; identical to SEQ ID NO: 394
  misc_feature 1..383: note = chr4:144621514-144621897
  misc_feature 1..383: note = hyper
  source 1..383: mol_type = genomic DNA

SEQ ID NO: 29187 - DNA, 250 bp, Homo sapiens
  misc_feature 1..250: note = chr4:144621981-144622231
  misc_feature 1..250: note = hyper
  source 1..250: mol_type = genomic DNA
cggctgctgcaggtaacggcagcgggggaaggggctctgcccacttcctgctcagccccggtcgcaagtctctctctgctggcttctggggaccccagatacgcgcccagcgcggcgagacttagcgagggtgcagcgctgtcccctccgctcctgggcgcttcacccagcctaccttacacaccttctcgccgggagccgtggccgccgcactgctgcccgcgctgccagactccgaccagctgtctgg

SEQ ID NO: 29188 - DNA, 30 bp, Homo sapiens
  misc_feature 1..30: note = chr4:145567357-145567387
  misc_feature 1..30: note = hyper
  source 1..30: mol_type = genomic DNA
tcatctagagcccagcgctggccctgcctc

SEQ ID NO: 29189 - DNA, 127 bp, Homo sapiens
  misc_feature 1..127: note = chr4:145567810-145567937
  misc_feature 1..127: note = hyper
  source 1..127: mol_type = genomic DNA
gctgctctgggcagacgatgctgaagatgctctcctttaagctgctgctgctggccgtggctctgggcttctttgaaggagatgctaagtttggggaaagaaacgaagggagcggagcaaggaggag

SEQ ID NO: 29190 - DNA, 377 bp, Homo sapiens
  misc_feature 1..377: note = chr4:145568226-145568603
  misc_feature 1..377: note = hyper
  source 1..377: mol_type = genomic DNA
ataacttttctatagcgctaacgtgattccgttgtgtgttcctctggggtaagcaagtagcatttcctcccccagagtccgcggtcgggatgctgtgcaaacttgcctatctctgaaaacagacgtttctgcggtacccgcaccctgggctgggtaaatattttaaaagaatcgcgatgaacagtgtgttttggatcgaatggggcattggctgcggtgaaactgtaaattaaggtggctgtggtttccggcttatttttctagggtaaaaagatttgtgctgttttctccacgtgctcggttagggagaggattgaatcgtaaaggatgttgaagcatggttggtttatgatccccagccccgtcagaggggggtg

SEQ ID NO: 29191 - DNA, 266 bp, Homo sapiens
  misc_feature 1..266: note = chr4:147558116-147558382
  misc_feature 1..266: note = hyper
  source 1..266: mol_type = genomic DNA
gctaggagttcccttcggctactatttattattttcctccacacaggggaagagaaagggaagcccgagaggatccagggaaagcagaagggggttaaggaccatggacagagcccgtcgcgcgctcgttgctgccgccttccccagcactctggcggctcctgaggacagcggtcccatcttgaaaccgctattccgcccggctgaggtcaggggtggacaggcggtcccctactctccaccgccgcttccgggagctgaccacc

SEQ ID NO: 29192 - DNA, 140 bp, Homo sapiens; identical to SEQ ID NO: 2466
  misc_feature 1..140: note = chr4:147558476-147558616
  misc_feature 1..140: note = hyper
  source 1..140: mol_type = genomic DNA

SEQ ID NO: 29193 - DNA, 889 bp, Homo sapiens; identical to SEQ ID NO: 396
  misc_feature 1..889: note = chr4:147559190-147560079
  misc_feature 1..889: note = hyper
  source 1..889: mol_type = genomic DNA

SEQ ID NO: 29194 - DNA, 286 bp, Homo sapiens; identical to SEQ ID NO: 397
  misc_feature 1..286: note = chr4:147560133-147560419
  misc_feature 1..286: note = hyper
  source 1..286: mol_type = genomic DNA

SEQ ID NO: 29195 - DNA, 52 bp, Homo sapiens; identical to SEQ ID NO: 398
  misc_feature 1..52: note = chr4:147560459-147560511
  misc_feature 1..52: note = hyper
  source 1..52: mol_type = genomic DNA

SEQ ID NO: 29196 - DNA, 231 bp, Homo sapiens
  misc_feature 1..231: note = chr4:147560915-147561146
  misc_feature 1..231: note = hyper
  source 1..231: mol_type = genomic DNA
ttgtaggcgcggcgacggtgtcgagccctgggccggggcttccggagagagggcgtacaattccctgctgagcgtaatgtgtgccttctacttacaattgcagagcaatatattcggcgggctggatgagagtctgctggcccgcgccgaggctctggcagccgtggacatcgtctcccagagcaagagccaccaccaccatccaccccaccacagccccttcaaaccgga

SEQ ID NO: 29197 - DNA, 591 bp, Homo sapiens
  misc_feature 1..591: note = chr4:147561359-147561950
  misc_feature 1..591: note = hyper
  source 1..591: mol_type = genomic DNA
cgctgtggtgtccacgccggctcacgcgccgcacatggccaccatgaaccccatgcaccaagcagcgctcagcatggcccacgcgcacgggctgccgtcgcacatgggctgcatgagcgacgtggacgccgacccgcgggacctggaggcattcgccgagcgcttcaagcagcgacgcatcaagctgggggtgacccaggcagatgtgggctccgcgctggccaacctcaagatccccggcgtgggctcgcttagccagagcaccatctgcaggttcgagtccctcacactgtcccacaataatatgatcgcgctcaaacccatcctgcaggcatggctcgaggaggccgagaagtcccaccgcgagaagctcaccaagcctgaactcttcaatggcgcggagaagaagcgcaagcgcacgtccatcgctgcgccagagaagcgctcgctcgaagcctactttgccattcagcctcggccctcctctgaaaagatcgccgccatcgcggagaagctggacctgaagaaaaacgtggtgcgcgtctggttctgcaaccagaggcagaaacagaaaagaatgaaatattccgc

SEQ ID NO: 29198 - DNA, 96 bp, Homo sapiens; identical to SEQ ID NO: 7563
  misc_feature 1..96: note = chr4:147561999-147562095
  misc_feature 1..96: note = hyper
  source 1..96: mol_type = genomic DNA

SEQ ID NO: 29199 - DNA, 243 bp, Homo sapiens
  misc_feature 1..243: note = chr4:147568636-147568879
  misc_feature 1..243: note = hyper
  source 1..243: mol_type = genomic DNA
ttttcaggaacaaatcgatgagatagggatgcgagagagggaagatgaaggcttttcccaatctaggtcacttctttgcggagaggccttctcagagctttgggtaagtgaagaggcgccttaagttcgcggtcccagctgctcaggctccgcagcctggaggcgggaaagggaacagtgagactgagaagcaggacgcggggacagcgatctcccagaagctttcctcgcttttggtggcta

SEQ ID NO: 29200 - DNA, 151 bp, Homo sapiens
  misc_feature 1..151: note = chr4:147569117-147569268
  misc_feature 1..151: note = hyper
  source 1..151: mol_type = genomic DNA
ctcgctggaggagctcgcccggtccccgaggggcccccagagctggggaagcaggcgtctcgccaggcgctcagcaaggaacccgcaagaaagagaggcccgggcgcctcgcccccttgcattttactaatcacgtctatttaaattctag

SEQ ID NO: 29201 - DNA, 257 bp, Homo sapiens
  misc_feature 1..257: note = chr4:147569278-147569535
  misc_feature 1..257: note = hyper
  source 1..257: mol_type = genomic DNA
cgcgctctcaccgggaaagctctggagaactggacccatcaattattctgaaaaaatccctgactacgtgaggcttccagccagcgggagggaggcggcgggaggaggtggagaacccagcccctacccctctcccctcctccccgcccctcccagcgcggcctcttgatatacactcatcttcagggttctggggccccagggagacttgtgcgcattttcagggttcgagcttttgtggacgaggaaggaaggtg

SEQ ID NO: 29202 - DNA, 30 bp, Homo sapiens
  misc_feature 1..30: note = chr4:147569897-147569927
  misc_feature 1..30: note = hyper
  source 1..30: mol_type = genomic DNA
tgcttcccccacccccgcccagcttcaccc

SEQ ID NO: 29203 - DNA, 156 bp, Homo sapiens
  misc_feature 1..156: note = chr4:147576046-147576202
  misc_feature 1..156: note = hyper
  source 1..156: mol_type = genomic DNA
gcggtgacagatgagcggctgggtcaggaaggagcccagttggtggaaatgacactctttccccgctccgggtcccctcccccaccccattcgcgttttctctctcggcctctcctccctcctcgccttgccctcaggcagccgaccggggacaca

SEQ ID NO: 29204 - DNA, 515 bp, Homo sapiens; identical to SEQ ID NO: 2470
  misc_feature 1..515: note = chr4:147576329-147576844
  misc_feature 1..515: note = hyper
  source 1..515: mol_type = genomic DNA

SEQ ID NO: 29205 - DNA, 356 bp, Homo sapiens
  misc_feature 1..356: note = chr4:148402241-148402597
  misc_feature 1..356: note = hyper
  source 1..356: mol_type = genomic DNA
cgcgtacagtcatcccgctggtctgacgattgtggagaggcggtggagaggcttcatccatcccacccggtcgtcgccggggattggggtcccagcgagacctccccgggagaagcagtgcccaggaggttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtcggtgcaagtctttcttatcggggactgggactggggcgggtgcggggatggcggagacgctgcctg

SEQ ID NO: 29206 - DNA, 46 bp, Homo sapiens
  misc_feature 1..46: note = chr4:149365169-149365215
  misc_feature 1..46: note = hyper
  source 1..46: mol_type = genomic DNA
ggagtccccgccgagcgtcccaactttcccgcggggcccaccgtca

SEQ ID NO: 29207 - DNA, 139 bp, Homo sapiens
  misc_feature 1..139: note = chr4:150999450-150999589
  misc_feature 1..139: note = hyper
  source 1..139: mol_type = genomic DNA
ggaagcctcctccagcgctgacagcctgtcggcggcggagggaggccagagcgcggatgcttgccagtgggccgggcctgaccgctgcgtgggaggcgggctgcattatttcccgctagggccgcgctccagggaagga

SEQ ID NO: 29208 - DNA, 57 bp, Homo sapiens
  misc_feature 1..57: note = chr4:151000206-151000263
  misc_feature 1..57: note = hyper
  source 1..57: mol_type = genomic DNA
gagcactttgaggaacgggacaaaaggccgcggccggggtcgcggagaggggccccc

SEQ ID NO: 29209 - DNA, 202 bp, Homo sapiens
  misc_feature 1..202: note = chr4:154143837-154144039
  misc_feature 1..202: note = hyper
  source 1..202: mol_type = genomic DNA
agagccatttggagccgaggacacccggtgaaagccattcagagtccagccaggaggccgactttcctcctctggtctgtttttactacttgagccgctcgctcagaaaacggccttagataaagcagtttcaccttcagatcgcctgaggctgcagaagggcggctgcgggggaggaaggaggaggcggagaggagcgggt

SEQ ID NO: 29210 - DNA, 79 bp, Homo sapiens
  misc_feature 1..79: note = chr4:154144397-154144476
  misc_feature 1..79: note = hyper
  source 1..79: mol_type = genomic DNA
ctcccaggccctgcccgcggagctctcccgggagtcgcggacctctgccgtcctcagtcacccgcgtcatgcaggatag

SEQ ID NO: 29211 - DNA, 195 bp, Homo sapiens
  misc_feature 1..195: note = chr4:154680759-154680954
  misc_feature 1..195: note = hyper
  source 1..195: mol_type = genomic DNA
gagggactggcaccccgcacggtggcatcttccagaaggtcatgcgtccgtccccacgtctttccagggccggttctccccggtggggcccggggtcttggagaccagtctgtgcagcctgcccggcaccagcgtgagccccgggaccccggcctggcgtcccccacgcccgcgcccccgcgccagtacctgctc

SEQ ID NO: 29212 - DNA, 21 bp, Homo sapiens
  misc_feature 1..21: note = chr4:154681176-154681197
  misc_feature 1..21: note = hyper
  source 1..21: mol_type = genomic DNA
gggagcctcccggcacgcccc

SEQ ID NO: 29213 - DNA, 139 bp, Homo sapiens
  misc_feature 1..139: note = chr4:154681198-154681337
  misc_feature 1..139: note = hyper
  source 1..139: mol_type = genomic DNA
cctccgccccctgcacgctggccagcgtcctccccagcagcggcctcgaggtcccggtcgccagcaccccggttccttcagaacctcaggcctcccattcagccagccattgtcgccgataaagcgtcttgagccctac

SEQ ID NO: 29214 - DNA, 93 bp, Homo sapiens
  misc_feature 1..93: note = chr4:154709106-154709199
  misc_feature 1..93: note = hyper
  source 1..93: mol_type = genomic DNA
aaacaccacttccaacgctctgcgcagctccagtgctagcatctttaacaataatcgtgtatctatttttttttaaaccgccgttcagttctt

SEQ ID NO: 29215 - DNA, 135 bp, Homo sapiens; identical to SEQ ID NO: 399
  misc_feature 1..135: note = chr4:154709476-154709611
  misc_feature 1..135: note = hyper
  source 1..135: mol_type = genomic DNA

SEQ ID NO: 29216 - DNA, 70 bp, Homo sapiens; identical to SEQ ID NO: 400
  misc_feature 1..70: note = chr4:154709758-154709828
  misc_feature 1..70: note = hyper
  source 1..70: mol_type = genomic DNA

SEQ ID NO: 29217 - DNA, 769 bp, Homo sapiens
  misc_feature 1..769: note = chr4:154709829-154710598
  misc_feature 1..769: note = hyper
  source 1..769: mol_type = genomic DNA
atgccgtggcacagctgcaggttggcagggatgggcttgcaattgctgcgcttgtaggagaagtcgggctggccaaagaggaagagcccgcgcgccgagcccaggcagcagtgcgaggcgaggaagagcagcagcagcgagccagggccctgcagcatcgtgggcgcgcgaccccgagggggcagagggagcggagccggggaagggcgaggcggccggagttcgagcttgtcccgggcccgctctcttcgctgggtgcgactcggggccccgaaaagctggcagccggcggctggggcgcggagaagcgggacaccgggaggacagcgcgggcgaggcgctgcaagcccgcgcgcagctccggggggctccgacccgggggagcagaatgagccgttgctggggcacagccagagttttcttggccttttttatgcaaatctggagggtggggggagcaagggaggagccaatgaagggtaatccgaggagggctggtcactactttctgggtctggttttgcgttgagaatgcccctcacgcgcttgctggaagggaattctggctgcgccccctcccctagatgccgccgctcgcccgccctaggatttctttaaacaacaaacagagaagcctggccgctgcgcccccacagtgagcgagcagggcgcgggctgcgggagtggggggcacgcagggcaccccgcgagcggcctcgcgaccaggtactggcgggaacgcgcctagccccgcgtgccgccggggccc

SEQ ID NO: 29218 - DNA, 19 bp, Homo sapiens
  misc_feature 1..19: note = chr4:154710599-154710618
  misc_feature 1..19: note = hyper
  source 1..19: mol_type = genomic DNA
ggcttgttttgccccagtc

SEQ ID NO: 29219 - DNA, 186 bp, Homo sapiens
  misc_feature 1..186: note = chr4:154710728-154710914
  misc_feature 1..186: note = hyper
  source 1..186: mol_type = genomic DNA
cgtgtgccctgtgatggagcccgggacctgcccgcccgaggccgcctcggcgaacttcgttttccctcgaatctccagccaccgttcagcagcctgtcggtgtgctccccaatgccgtaaaaaaatcagaattataaatatattcgtatgagcagaactttacatggaaaacgaaatactaataaa

SEQ ID NO: 29220 - DNA, 708 bp, Homo sapiens
  misc_feature 1..708: note = chr4:154712003-154712711
  misc_feature 1..708: note = hyper
  source 1..708: mol_type = genomic DNA
agagctaataaagagcgtgagctctgagagatgctacgacttgggcctgggagtgggataagggccctctcgctttcacgcccccccaaccccccgccggccccggccaacccctaaatccccaacgccctccgctggggtcgcctcctccccgcagagccccttgttgggagttcaaggagcccgaagctggtctggctggtttgagccccgcgctgccgcacgcccggaagtggctggcggcccccgcgctccgcgcgccggctgcattgttttgggagccctcgctgcccggcttgccgccaggaggtgctgggagtcgcgcctgagtctccatccctgccgtgcgcagtgtccacctctggccagcttgtttgcccggcccgcggcgtcccctgcggcccatcgctgctcctcccggaacccacgccacttagtctggtcccgaccctgcactcgctgctgctgcctttcccacctcaagtcgctctccccactcccttctgcttttgggctaagaccggtccaattgatcactggggaacagggcaataacctcccgcggaggctgggacgcgggcacggagctctgcccatatgagcagcgcagggatgggacactgggtgcccatcccagcgcgcctccccagactggtccctgggatgctcacacgtggcgcggcaccgcggcggcgccttcacgaaccc

SEQ ID NO: 29221 - DNA, 257 bp, Homo sapiens
  misc_feature 1..257: note = chr4:154713532-154713789
  misc_feature 1..257: note = hyper
  source 1..257: mol_type = genomic DNA
cctgtcgcgacttgtcgggtgtctccaaccgcgttgccgcctggctttcagccgtgcgctggccagccgggcgggtgacgtcacctctccccgggtccgtgcacccaggccttccctgctccgggtgagtattttttcatgggattcagccatctgggggcgccatttcccaaaacagagattgtccctttgaggttgcaagtcaggttcctttacgctgagatcccttacatttttacttttaggaaggttttttc

SEQ ID NO: 29222 - DNA, 220 bp, Homo sapiens
  misc_feature 1..220: note = chr4:154713790-154714010
  misc_feature 1..220: note = hyper
  source 1..220: mol_type = genomic DNA
aggggtggggggatgacctcattccttcgcctttggccctccctctacccggccccacaacgaggacgcccctgcagctggctgggccgcttcctcttgccacgcggggggacctgtgcccgcggccgtgcacctccgtgtacgcttctgctcctcggaccccatcggttcagacgcggatttccgagaacgagaccagagtctgcgtctggagagcctt

SEQ ID NO: 29223 - DNA, 283 bp, Homo sapiens
  misc_feature 1..283: note = chr4:155254047-155254330
  misc_feature 1..283: note = hyper
  source 1..283: mol_type = genomic DNA
cagcatttgtgtcatcggtgagagagactcactgacttccacttgatagaccaaatgttcgaaagtccaggatgggctgtgttcgcgtttctcgataacgactgtcagcaccagcagggctgcctgaggatgcacgccttggtcctcggccctgagagtcagcgtgagctcccgctgctcgcccgcgcccaggctgccgttgaggaacagcacccccagggctctgtcgatggcaaagacgcctggctgcgggctggcgatggagtaccggatgagtccgttc

SEQ ID NO: 29224 - DNA, 56 bp, Homo sapiens; identical to SEQ ID NO: 7579
  misc_feature 1..56: note = chr4:155411438-155411494
  misc_feature 1..56: note = hyper
  source 1..56: mol_type = genomic DNA

SEQ ID NO: 29225 - DNA, 429 bp, Homo sapiens
  misc_feature 1..429: note = chr4:155412014-155412443
  misc_feature 1..429: note = hyper
  source 1..429: mol_type = genomic DNA
gcgagtggtcattcacgtcgttgacgcgaatctccacctgcaccacagcgcccagcagcgtggcggcgacgaagctgtagtggtcccgccgctcgcggtccaggcgccgcgcagtgcggatgatgccggtgtccgggtgcacgtggaagtcgtccagcagcggggagtcatcggagtcctccgacagaaagaagccgctcccctcctgctgctgcgcggccggcagcccggcgcggatgtcacctaccagcgtgtccgggggaagcccctcatctacggaaagggtgaggttgaacaactgggcagaggagcccgaggccgcccacagccacacgtgcaccaagagccagagcagggagcgctgcgtcctggcgccgctgctgcctgaccgcccatggggtgtatctctcctcccggggagcagaagga

SEQ ID NO: 29226 - DNA, 185 bp, Homo sapiens
  misc_feature 1..185: note = chr4:155413374-155413559
  misc_feature 1..185: note = hyper
  source 1..185: mol_type = genomic DNA
gcctgactcttggctcgcgctgagccaagagggtagaggttatcatcactttggggtgccaaacttgtgttctccatttggcgagagggactcccgtccgcagcggaaggacagatggagtcaaaggccgatgcatagctggggccaggatggctttaaaggggagaaggcggaacttggaaaag

SEQ ID NO: 29227 - DNA, 258 bp, Homo sapiens
  misc_feature 1..258: note = chr4:155548046-155548304
  misc_feature 1..258: note = hyper
  source 1..258: mol_type = genomic DNA
ctgttttctgggctccggcccccagcccagcccagccgccgcaggagcgctcggccagtaggtgtctctgctcctcgggcggccttgagcagtgcctaacgttgagcgtgaggctcgtgctccgggtctcgcgggcggccgcctcgggcgtcgagtcccggagattggacagacaccagagcctggggaccgcggagtgaccgggtggggctggagggcggcgccgcgccttctggggagacgcggaggtatcaggta

SEQ ID NO: 29228 - DNA, 446 bp, Homo sapiens
  misc_feature 1..446: note = chr4:155663475-155663921
  misc_feature 1..446: note = hyper
  source 1..446: mol_type = genomic DNA
atgtgatgcgcaatcgtttgtgaatgaacaaaagtcaccggcaagcagggagacggggacagatcgctgacggcagattgagggtggcagcaaaggcccggcctccaaggataatggggagccgttttccctcacgcctggtctctatggcccccttcgtcttccaggtaaaatgaatgttccttcatccatcatccgcagagtaccctcaggcgtgcgtagaatctgctgatgaaacctattagcgccgactgggcagctttgtggagccacccgaggctctccattgtggcctttgtctgcagaatttaagcatttacataatgcattagcacggaactcagcacccggtggggacatcgcgtgccaagcctggcgcggccaacgcttcagcggctccctcacccggcagctccctaggaccaccctcgaggaggcattggagt

SEQ ID NO: 29229 - DNA, 110 bp, Homo sapiens; identical to SEQ ID NO: 7583
  misc_feature 1..110: note = chr4:155664194-155664304
  misc_feature 1..110: note = hyper
  source 1..110: mol_type = genomic DNA

SEQ ID NO: 29230 - DNA, 90 bp, Homo sapiens
  misc_feature 1..90: note = chr4:155665385-155665475
  misc_feature 1..90: note = hyper
  source 1..90: mol_type = genomic DNA
cgcagcacccctgcccggcgagcttaacttgcccagcccggcccctgccggagtggcaccggcacctctccaagacgccctcttccctgc

SEQ ID NO: 29231 - DNA, 57 bp, Homo sapiens
  misc_feature 1..57: note = chr4:155665721-155665778
  misc_feature 1..57: note = hyper
  source 1..57: mol_type = genomic DNA
acagacgacatggggcgcacgcagaaggtggtctccaacaagcgtctcatcctgggc

SEQ ID NO: 29232 - DNA, 159 bp, Homo sapiens
  misc_feature 1..159: note = chr4:156129228-156129387
  misc_feature 1..159: note = hyper
  source 1..159: mol_type = genomic DNA
cgccccagccctgggcgagggtgcggaggatttgttctcggtgcaatcctgctggcgcttttccggggttctgcgcggatccagctccccatctctgctcctacacacacaaaagaaaacaactctcgattggaagttgtggaattttctcagccccta

SEQ ID NO: 29233 - DNA, 854 bp, Homo sapiens
  misc_feature 1..854: note = chr4:156129443-156130297
  misc_feature 1..854: note = hyper
  source 1..854: mol_type = genomic DNA
cgctcgcctgccttgctagggaccgcagtccctcagccgcagctgggtctgtccgccccgcctttgccctcgccttttcccggggcggatttggtgaagtcggcctcaagtccaggaggtctgtcttcgccgggccagctctcgcggaactggggggtagagagcaaagggagagattcgtggaagggaagggaggtaggggtggcgcaaacgcccagagtatcaaacttgggggtggcacagtaggtgacagcagcagctgcaggtggtggctggggacccgcgagggggcgcccctctgggtagggtctggctgagcgggcttgcaagcccgggaggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagtaagtgtaattcctaactctgatcacctcctgggaacaagaaaatccctagaggagcgctcggttcctatgaaga

SEQ ID NO: 29234 - DNA, 169 bp, Homo sapiens
  misc_feature 1..169: note = chr4:156297387-156297556
  misc_feature 1..169: note = hyper
  source 1..169: mol_type = genomic DNA
cttcaaaataagtcacgtcttatttaaaaggccatcaaaaggatcgtcggcgtaaaaattatgagcaccaccaccaaaaaaaaaatgtatctatatatttgcatacagcgctattcaaagaaaaagatcgtaatgctaacccgcaaacagccagcgagatgtattgcaa

SEQ ID NO: 29235 - DNA, 42 bp, Homo sapiens
  misc_feature 1..42: note = chr4:156297941-156297983
  misc_feature 1..42: note = hyper
  source 1..42: mol_type = genomic DNA
cgcccgcagagccggtcctggaccgagcgaggaggaggggct

SEQ ID NO: 29236 - DNA, 30 bp, Homo sapiens
  misc_feature 1..30: note = chr4:156588105-156588135
  misc_feature 1..30: note = hyper
  source 1..30: mol_type = genomic DNA
gatctcaccatggtgcgttttggctgctac

SEQ ID NO: 29237 - DNA, 227 bp, Homo sapiens
  misc_feature 1..227: note = chr4:156588456-156588683
  misc_feature 1..227: note = hyper
  source 1..227: mol_type = genomic DNA
gcctgccacccctgacgcctgctctctttctccattcgcagtgcggatttgcgaggcgcgccctggagctgctagagatccggaagcacagccccgaggtgtgcgaagccaccaagtaagtggtcgctgcatccccacgcgggtcggggttcttcagacaggcggtccctcttccgggacccccgcttgggctgggtctccttcctctcctgagaaaccttcggtac

SEQ ID NO: 29238 - DNA, 355 bp, Homo sapiens
  misc_feature 1..355: note = chr4:156588684-156589039
  misc_feature 1..355: note = hyper
  source 1..355: mol_type = genomic DNA
ctcccagttgcccagccctgggaagccagcatcgggttcccacgctggggaggagcgagaggaaaggagaggacgcccgaggggccggcccagggcccgggggacccgcggcgcccgagggaggagcacagacgggggtgggcgccgagcagcgccgcgccggctgctgagctcgcggggccgggccgtgagaacgcgcggggcgcgccggggccgctggtctcccacggccagggcgcctgggccccagagcccatcagccgcgtgcagcgctgcggcctccggcgcgccggcaggcaagcgagcgggcgcagctgggggatgcctggaccccggaggcagcagggctggaggc

SEQ ID NO: 29239 - DNA, 69 bp, Homo sapiens
  misc_feature 1..69: note = chr4:156589040-156589109
  misc_feature 1..69: note = hyper
  source 1..69: mol_type = genomic DNA
gtggcgggcttcagggcaacttcacccggccggctgcggcgtgggtaagaggcgcgtcctcctccacag

SEQ ID NO: 29240 - DNA, 45 bp, Homo sapiens
  misc_feature 1..45: note = chr4:156680338-156680383
  misc_feature 1..45: note = hyper
  source 1..45: mol_type = genomic DNA
cggccggcctggcagcgagggaactggccgcgcagccggagcttg

SEQ ID NO: 29241 - DNA, 70 bp, Homo sapiens; identical to SEQ ID NO: 7591
  misc_feature 1..70: note = chr4:156680699-156680769
  misc_feature 1..70: note = hyper
  source 1..70: mol_type = genomic DNA

SEQ ID NO: 29242 - DNA, 200 bp, Homo sapiens; identical to SEQ ID NO: 7592
  misc_feature 1..200: note = chr4:156680770-156680970
  misc_feature 1..200: note = hyper
  source 1..200: mol_type = genomic DNA

SEQ ID NO: 29243 - DNA, 130 bp, Homo sapiens
  misc_feature 1..130: note = chr4:156681218-156681348
  misc_feature 1..130: note = hyper
  source 1..130: mol_type = genomic DNA
cgagggcgagaaccgcggaaaggagcccctaggggtcaccacggcttcccgacccggcctgagcgtgggaacgcgctgccggcgctcccaggctcagcaggccgggcagctcccacgcgtgcagagcccc

SEQ ID NO: 29244 - DNA, 41 bp, Homo sapiens
  misc_feature 1..41: note = chr4:157892721-157892762
  misc_feature 1..41: note = hyper
  source 1..41: mol_type = genomic DNA
gagcgcagttggccccgggttcggagcgccgcagcacggat

SEQ ID NO: 29245 - DNA, 49 bp, Homo sapiens
  misc_feature 1..49: note = chr4:157997406-157997455
  misc_feature 1..49: note = hyper
  source 1..49: mol_type = genomic DNA
ctccacgatctcgcccggcgattgtgggcaggggcgcctccgggtaagt

SEQ ID NO: 29246 - DNA, 30 bp, Homo sapiens
  misc_feature 1..30: note = chr4:158141576-158141606
  misc_feature 1..30: note = hyper
  source 1..30: mol_type = genomic DNA
tgggcgcgacagccccggagacccgaggtc

SEQ ID NO: 29247 - DNA, 30 bp, Homo sapiens
  misc_feature 1..30: note = chr4:158141957-158141987
  misc_feature 1..30: note = hyper
  source 1..30: mol_type = genomic DNA
attcagccagtcctccggacttctggagcg

SEQ ID NO: 29248 - DNA, 201 bp, Homo sapiens
  misc_feature 1..201: note = chr4:158142822-158143023
  misc_feature 1..201: note = hyper
  source 1..201: mol_type = genomic DNA
gctatttcctaggggcgccgatcaagaatacagtgcatttcgagtagggatggttcagttttccacttcggagttcagactgacaccccacatcgacaatttggaggtggcaaacagcttcgcagtcactaatgcttgtaagtaatgaatattcatgcctttcgggtgctgcacgcggaaggccagcgagtgtgagtgtgt

SEQ ID NO: 29249 - DNA, 97 bp, Homo sapiens; identical to SEQ ID NO: 7594
  misc_feature 1..97: note = chr4:158143369-158143466
  misc_feature 1..97: note = hyper
  source 1..97: mol_type = genomic DNA

SEQ ID NO: 29250 - skipped

SEQ ID NO: 29251 - DNA, 30 bp, Homo sapiens; identical to SEQ ID NO: 7595
  misc_feature 1..30: note = chr4:158144242-158144272
  misc_feature 1..30: note = hyper
  source 1..30: mol_type = genomic DNA

SEQ ID NO: 29252 - DNA, 241 bp, Homo sapiens
  misc_feature 1..241: note = chr4:164252966-164253207
  misc_feature 1..241: note = hyper
  source 1..241: mol_type = genomic DNA
gcttcgggtgtctatcggggcgcagcgccacactcgaagcgcccggtactgcggagcgcggctcgattgcagccgagaagcgcggaacccgcaagtgggggtgggcttgcgcgctggggtccgcgccgagggctactcccacctccgccagctcccagcccgacacctgccgcgggacccgtgcgacgctgggcgacgcgccaagcccacccttctccggctcatcccagccagttactcc

SEQ ID NO: 29253 - DNA, 208 bp, Homo sapiens
  misc_feature 1..208: note = chr4:164253208-164253416
  misc_feature 1..208: note = hyper
  source 1..208: mol_type = genomic DNA
cgaaaactccggtgcggccagagccagcgcctccagccagctcaagacacgtaaggaaaatgagcgggtgtgggataggcgaactcgggcgccttcccagtgcctcggccttttaaagagaaccggggtaaaggaaaacttggatccccatccagaaattccccgggagcaggtggtgggaaagcccgaactccgcgtagggtaccct

SEQ ID NO: 29254 - DNA, 30 bp, Homo sapiens
  misc_feature 1..30: note = chr4:164253751-164253781
  misc_feature 1..30: note = hyper
  source 1..30: mol_type = genomic DNA
gaagctaggaagagacgcctccttaaagcc

SEQ ID NO: 29255 - DNA, 183 bp, Homo sapiens
  misc_feature 1..183: note = chr4:164264670-164264853
  misc_feature 1..183: note = hyper
  source 1..183: mol_type = genomic DNA
ataaaacctgagagtcgaagcttgttctcaggaatactaagaacttaggggcacagccatcctcacaccagtccaagacttctcagagttcactacacagggttgagggctggaccggcaaaactcgatttgcccatcaagttaacttggtcggcctgggacccgaggccagggtgaagggac

SEQ ID NO: 29256 - DNA, 250 bp, Homo sapiens
  misc_feature 1..250: note = chr4:164265192-164265442
  misc_feature 1..250: note = hyper
  source 1..250: mol_type = genomic DNA
gggtaggcctgcaccgaggggccgtggcgggtccccgcgcgggctgcgagtctgcgcaggtccctgggagcccgcacccgtctctggtgccagggcgttgtcgggggtcccaagagagcggggtggggaaggtgaagggagcgcggctggaaaaatggggattagggtggcggaacaggcacttgtcaggagtgaagagacagcggagagggtactgggctgaattctttcgtgccgagcaggtccctcc

SEQ ID NO: 29257 - DNA, 297 bp, Homo sapiens
  misc_feature 1..297: note = chr4:164265443-164265740
  misc_feature 1..297: note = hyper
  source 1..297: mol_type = genomic DNA
gttcccaactcacccgggtggagcaggcgcgggccgaacccgggaggagagtgtcggggatccgcgaaggagcctcctggggatggggcgggggatggacaaagcgctgcccccggctggacgcgctctggctgcagcccggctggcatccggagctgggaacagcagcccgcggggtgcccgggtcagggctcaaccctagcgggtctctggcgaggccgggggcgcagcccgcggggcgccactcaggccgtccagctgccgcgcggtccagcgctgacccgagcccgggaggca

SEQ ID NO: 29258 - DNA, 567 bp, Homo sapiens
  misc_feature 1..567: note = chr4:165304457-165305024
  misc_feature 1..567: note = hyper
  source 1..567: mol_type = genomic DNA
cagttgcagtgaacccgactcagggttgagcgcatcagcgctaaacccaagacaaaggctgccctgtgtcttccgtactcagcgctctcctttggtaatcggtccccgtccccttcaagcccacactaggagcgcgtgagcctgtgaagtggctgtcatcgactccgcgctttccgaggggtgcggctccgtgactagtaccacgccggtgtaaacagcgcgccgcgcactggggatccgccagaaacggcgcgcgcgcagagcgggcgctgggggccaatagtagcaactaccccaggctgcgggctggagccgcctcctctcaccagagaggcgcctactgggcgagcccgccgcccgcaggttgggtggcagcacccgccgcgaaccccagccacgctccccagtggacccaccaggcaaaggcacctgctgcctgccctccagggctgatgctgtgccaagccccgctcgggatcagggacaagccgcccaggactaccagccggagagaaggggctcccagtgaggctgattgaatgaatgatgtttgcagtcacttaccgg

SEQ ID NO: 29259 - DNA, 131 bp, Homo sapiens
  misc_feature 1..131: note = chr4:165305059-165305190
  misc_feature 1..131: note = hyper
  source 1..131: mol_type = genomic DNA
cgtgcggccggcatcccggggcgcgggcattctcccatcctttgtcagttgcgggtggagcgctcctccccagctagcggacgagcagccgggtggcaggcagcccggctctggctcggctccccagtcct

SEQ ID NO: 29260 - DNA, 492 bp, Homo sapiens
  misc_feature 1..492: note = chr4:166299918-166300410
  misc_feature 1..492: note = hyper
  source 1..492: mol_type = genomic DNA
aatattttttccatacgcagtgacgtgggtgggtcatgggtgtctcaatgacagtaacgttcccgaaccccggaccttagctgtcatttcacctgcgtcgtcccggacgccatttggctgttgacgtggttccgagccagcaaataacgccagcagccctcccagatccacgccggcccgtctctccgccggccccctcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgt

SEQ ID NO: 29261 - DNA, 71 bp, Homo sapiens
  misc_feature 1..71: note = chr4:166793784-166793855
  misc_feature 1..71: note = hyper
  source 1..71: mol_type = genomic DNA
atagcgccagcccatcggcaaggtctcagcgtttcctgctgctgcaatctgtaactcgattttggattttt

SEQ ID NO: 29262 - DNA, 466 bp, Homo sapiens; identical to SEQ ID NO: 7605
  misc_feature 1..466: note = chr4:166794697-166795163
  misc_feature 1..466: note = hyper
  source 1..466: mol_type = genomic DNA

SEQ ID NO: 29263 - DNA, 32 bp, Homo sapiens
  misc_feature 1..32: note = chr4:166795606-166795638
  misc_feature 1..32: note = hyper
  source 1..32: mol_type = genomic DNA
ccctctcccccagggcgcggtttcccagcgct

SEQ ID NO: 29264 - DNA, 159 bp, Homo sapiens
  misc_feature 1..159: note = chr4:166796117-166796276
  misc_feature 1..159: note = hyper
  source 1..159: mol_type = genomic DNA
cggctcgtgtccgggcttcgggagctcctggttccttgctctattgggctgtggctgaggtgatccgcgctcagtgtggacgcacaagtaacttcgtaaaggttgcatggtggttggggctaacctagcagagcggtttgtaagcggaaggcacgttag

SEQ ID NO: 29265 - DNA, 14 bp, Homo sapiens
  misc_feature 1..14: note = chr4:168155110-168155124
  misc_feature 1..14: note = hyper
  source 1..14: mol_type = genomic DNA
ggggatgtgggtgc

SEQ ID NO: 29266 - DNA, 383 bp, Homo sapiens; identical to SEQ ID NO: 7607
  misc_feature 1..383: note = chr4:168155125-168155508
  misc_feature 1..383: note = hyper
  source 1..383: mol_type = genomic DNA

SEQ ID NO: 29267 - DNA, 72 bp, Homo sapiens
  misc_feature 1..72: note = chr4:168155795-168155867
  misc_feature 1..72: note = hyper
  source 1..72: mol_type = genomic DNA
tccctccccgacctccgtttttttcctcttccacctcctcctatcccaccttcctctcgctggatcccagct

SEQ ID NO: 29268 - DNA, 443 bp, Homo sapiens
  misc_feature 1..443: note = chr4:170947424-170947867
  misc_feature 1..443: note = hyper
  source 1..443: mol_type = genomic DNA
tcgccatggccagcccgacagcggccgctgcgccgcactctgcgccggacgcccggtagcgcctactgcgggcgagccgcctccgccggcgcctcacagcgttgcgagctgcgccgccggctgccgggagcgcggagcttcccacctacaggagcctgggccggccggggccgagcatgcccagtgcggctcgccgggcggcgcggaggcgcgggtgtagccgccgggttttcgcggcagccgcgggcgggggcagcggggcgggcggtgcggcgcgagccagtcggtgctgcggagcggccccgcggaggagccaccggaggctgtagttgccggggagtcccgcattcagtccgctcagcctctgggccgggcctcggcggcccccagagccccacacccgcaggcccagggcctccgcggcagcgcgggactctcactcc

SEQ ID NO: 29269 - DNA, 552 bp, Homo sapiens
  misc_feature 1..552: note = chr4:172733596-172734148
  misc_feature 1..552: note = hyper
  source 1..552: mol_type = genomic DNA
aagaggtgaccatggcgtttatttttggctccagacaggcggattcagcctgcattgcatgcatgcatgtctgtcacctcatctaagtccccattccttccggagttgtgagctccagatccaagagtgcccagtgcacggtgctgggcacgctgtcccttggcgaggctgccacaggttcctgagtgtgcggtcaggggcgttggtgcattgatacgttaggcggagggaggagtaccatctgccagagtcttatctcgagtcccacgttttctggccatcgcggaggagtgtgcgaggacaggtagccctcgcagtgacaaggcgcgcggagtgcggtcgtgcaaggcgggggaggagcggggtggccctgccgaatcttaaccggggccccgggtgtttgcagacccaaataaagccgccttgggtctccacggtgtcctccagaagctgctgcctgagaactctgagcctcagctctgtcttgcttcgggatcctcttcctcctccttccccaccccctacctggcctgaacggcggaacgcgcggct

SEQ ID NO: 29270 - DNA, 88 bp, Homo sapiens; identical to SEQ ID NO: 403
  misc_feature 1..88: note = chr4:172734188-172734276
  misc_feature 1..88: note = hyper
  source 1..88: mol_type = genomic DNA

SEQ ID NO: 29271 - DNA, 115 bp, Homo sapiens; identical to SEQ ID NO: 404
  misc_feature 1..115: note = chr4:172734277-172734392
  misc_feature 1..115: note = hyper
  source 1..115: mol_type = genomic DNA

SEQ ID NO: 29272 - DNA, 51 bp, Homo sapiens
  misc_feature 1..51: note = chr4:172734591-172734642
  misc_feature 1..51: note = hyper
  source 1..51: mol_type = genomic DNA
ggggagtggggcgcgggcgaccgtgtgcagccgcggcgcatctccgccttc

SEQ ID NO: 29273 - DNA, 15 bp, Homo sapiens
  misc_feature 1..15: note = chr4:172734845-172734860
  misc_feature 1..15: note = hyper
  source 1..15: mol_type = genomic DNA
gattgatgggcagag

SEQ ID NO: 29274 - DNA, 185 bp, Homo sapiens
  misc_feature 1..185: note = chr4:172735016-172735201
  misc_feature 1..185: note = hyper
  source 1..185: mol_type = genomic DNA
cgcgcgagggtccggcacttcgtggacctccatccgaaccggagttctgcccggatcccgagtccctggatcccggtggagcccgccggcaagctggctccggagggagttgaacttgagttcaggtgggttatcccaaggggagcacaggaaaagatgttcagggaagacgaagaaggtgacgc

SEQ ID NO: 29275 - DNA, 40 bp, Homo sapiens
  misc_feature 1..40: note = chr4:174429648-174429688
  misc_feature 1..40: note = hyper
  source 1..40: mol_type = genomic DNA
cggacctctgcagtccgtcgcaggacgcccaaaccacagg

SEQ ID NO: 29276 - DNA, 321 bp, Homo sapiens
  misc_feature 1..321: note = chr4:174430233-174430554
  misc_feature 1..321: note = hyper
  source 1..321: mol_type = genomic DNA
tattattccacttcacgagtactaaggaggagtccagaattggtggccgtcctccctcttgttttctcatgcaaataactcaacactctaatcgtaaatcaaagctccagggcctacttttgcgaggggcactggagaaagaagagagggttgcgcgcgcgcgtgcgggagcttcggaagctaaatctcactcgcggggaggatgggacgcgtggggactgaaggcggcatctgcctgaataaagccctcgcgcgctctgagcctcccactctgtcctggaggcctgaacctcgcgagtagagcctggcgcttttcctccc

SEQ ID NO: 29277 - DNA, 357 bp, Homo sapiens
  misc_feature 1..357: note = chr4:174430793-174431150
  misc_feature 1..357: note = hyper
  source 1..357: mol_type = genomic DNA
ggaacccgctcctgggccgcgcggctgcagccgggagcgcggactcggggtgtcgggcggtgtccgcgcccctccccaccccagggcccttctcgggggagatatccaggagctgaaagagattcctcaggaggaagtggaaacctctgaaaggagaggaaaccgactcttttgcaagaaaactgagcgccggctggaaggcaaggaagccgaggcggccggggagattcacccacatgcctgttgactcgggcccagtacctgcgtctccttccttctctttctggccctcatttcccctgcttctcactttagttcactgctgttttaaaaattcatatgcgggctcatttaaaa

SEQ ID NO: 29278 - DNA, 498 bp, Homo sapiens
  misc_feature 1..498: note = chr4:174437937-174438435
  misc_feature 1..498: note = hyper
  source 1..498: mol_type = genomic DNA
cgcaccgggttccgactccaccgcggcgccgagggggccagaggctcccagttcttccccgcatagttcgacaaagccctactttgcttccctgggtctgggatctcaacgtgaagggggccgagagagcggtgataaggtgctagaaaggaaacggcaagaggaaactaaaaaagtggagagaaattttgtgcgccgtagtgcttagcaagctggggaaacgaggagaaaacgagcaaagtctacaggggagggagagagggaggaggcagggaaggagaggaccacgaggctcccggcgcccaggccgccacttgggaggtcccggccccaaagcaggccgggccaaccgtccccccgggaggctcggggctcgggcggggtcacaattacacctcggctccaggcgaggacttaaaaaccaagtggtggggactgcagtctggaagcaaggccctgcggtcatcggaggggggccaggcccgtgcacaggaacct

SEQ ID NO: 29279 - DNA, 526 bp, Homo sapiens
  misc_feature 1..526: note = chr4:174439822-174440348
  misc_feature 1..526: note = hyper
  source 1..526: mol_type = genomic DNA
gtttcccaatcccagcggttagcccctgcgccccctttttggtctccactttgccgttcgaaaatgcctaggttggtggatcgaccctccgcggagcaaagacggatggctggcaggagcaggttcaggagctgggccaaggtattctctgcttccgcctttgtgtccgcccccccgccccctgctccccgcttcccgccagcatctctccttttctgctcaggagtgtttggcccggcggtccaccccggcttcccgagatacgctagagttgcccccacgtcctgtccgccgcgcccctacccaccgggttgccttcggggcccttcggtgctgtgtagtcggcgtggcgctgtgagctaggcgaacaggaacccccaggcccgccacgtctacgctattagcagccaggtagccctgcgggtcgaagatgctcagaggaggagtaaatgcagagaaaaaatagaggaaggaataaaaaaaaaaacaaaacaaaaacacgtaacatacacgcactcaaaaccaa

SEQ ID NO: 29280 - DNA, 113 bp, Homo sapiens
  misc_feature 1..113: note = chr4:174440647-174440760
  misc_feature 1..113: note = hyper
  source 1..113: mol_type = genomic DNA
ccacgcacacagccacggcccctcgcgtcttcgcggcacgttaattaaatgcggaaaacagacagaggctgatgtcattgctctcacaagatcataaacgtaaaagagtcatc

SEQ ID NO: 29281 - DNA, 30 bp, Homo sapiens
  misc_feature 1..30: note = chr4:174443212-174443242
  misc_feature 1..30: note = hyper
  source 1..30: mol_type = genomic DNA
ggaaggctttccaggcggaatgctccagcc

SEQ ID NO: 29282 - DNA, 522 bp, Homo sapiens
  misc_feature 1..522: note = chr4:174443551-174444073
  misc_feature 1..522: note = hyper
  source 1..522: mol_type = genomic DNA
agatgtccctaatagcggagataaagacggacagagcggccgggaataaatttgtaatcagggctctaccatctgatcatcaaagcggcccaaatgccgggagaatttgaagggaatgcgtgtgaggggggtcgcttgggggaagaggtgagggtgcacttcgcgatgggaactggcttcggtagggtagagcagggagaacagggcgagagatctgtaagttcggtgcacgtaagtcggatactcggtgctctttaacctccattagccctcagaccgaagccgtttagcggttccaggctgattggagctgcgcagttgctgtgcgggaagcacgcgttgcgcagcggctgggtggtaaggcggcgcgatgagaactgtccggcccccggaaacgtgggattggtttcctctcccggagttctcccctcccccttctttctaaacatttaaaaaacacgtagtccgtctcccccaacccccattcccggtagacttaatcccaacagcaattcattgcac

SEQ ID NO: 29283 - DNA, 155 bp, Homo sapiens
  misc_feature 1..155: note = chr4:174448460-174448615
  misc_feature 1..155: note = hyper
  source 1..155: mol_type = genomic DNA
cggccagcccgtccggcctttggttttcttgtcgttgctgctcactgtgcttttcaagatttcgttctggacagaggaaaggcgagggcgagaaaagtggaaagagaaattcagagaggatacctggttccacaccaacccggagcttcctgcgc

SEQ ID NO: 29284 - DNA, 38 bp, Homo sapiens
  misc_feature 1..38: note = chr4:174449624-174449662
  misc_feature 1..38: note = hyper
  source 1..38: mol_type = genomic DNA
gtactaggggagcagcgataacccggaggtaagatcac

SEQ ID NO: 29285 - DNA, 475 bp, Homo sapiens
  misc_feature 1..475: note = chr4:174449933-174450408
  misc_feature 1..475: note = hyper
  source 1..475: mol_type = genomic DNA
tgccttgaaggcctccgcctcgccattctggtcgtccttggccagcaggtccatgaggtaggcgatgtagctggtggccaggcgcagggtcttgattttggagagtttggtgtcggcgggtacgttggggatgcactcgcgcagttcggcgaaggcgctgttgatgctctgagtcctgcgccgctccttgcggttggcggtgcctcggcgcttcaccgggcgcggcccccccaggcccgggggcccggcgcccggcggcacccccccgtaatgggagtggtccaggccggcggcgccgctggcatactcggggctgtaggacagggccatgctgtagtcggggggcgacatctcggggtggccgatgagccagccatggaagtaggggttctcctcatggctgcagcggctggcggcggcggcggcagctgcggcggcggcggcggcaaacgggtagccctcgtggtgcaccacc

SEQ ID NO: 29286 - DNA, 318 bp, Homo sapiens
  misc_feature 1..318: note = chr4:174450409-174450727
  misc_feature 1..318: note = hyper
  source 1..318: mol_type = genomic DNA
ggtggtggggaaaaccacctaccagactcatttcgccctccgcgcccctccacgcgccccagcgtgcgcgcagccccgccgcgccctcggcccgggcccctgcctcagcgctcggcgtcctcccccaccccccaccccccagcccccgggcgcccgggcccgcccggcagccgcagagggggctgctgcagcccgggccccgtccccccgcctggccagccgggcccgcctcagcagcgctgcggccgccggctccccatggggcgcggcgagctggtcctggcaccgtgcgcccctggccgccgccgccgccgcctc

SEQ ID NO: 29287 - DNA, 569 bp, Homo sapiens
  misc_feature 1..569: note = chr4:174450751-174451320
  misc_feature 1..569: note = hyper
  source 1..569: mol_type = genomic DNA
cgcgcttcggctcctgcttcccgggctgctgcgcggaggcagaatcctctcgtgctcatacaaaggtgccggggctcccgcgaggctggtacgcggagtctcgggaatccaagcccgggccgcggtcctggcaccgaagctaacccggaatccaggggcgagtctgagccgcggctggaggagccggtccagctgtgccggggggcggcggggtcgactgctcactgcaaagctacctccgtgcgaccctccccttcccgcctcttcccctccccccaccagcccgatctgggttcttgggcgcttattgttttaatgaaatttttggttgttgttgttttggtccttaaatgtgattttagctgcgagtaacgtgtcctcgctcctctcgcgctctctcggagggttttcagagaggtctcagtgcatccattttctcagatcctctcctttcggggcaaggatctggggccctgaatgagccttggagctcgaagaccgcggctcgggctctcggagggctctgcgcggtggccgaggaagctccggggtgacggcggtggttctcc

SEQ ID NO: 29288 - DNA, 445 bp, Homo sapiens
  misc_feature 1..445: note = chr4:174451728-174452173
  misc_feature 1..445: note = hyper
  source 1..445: mol_type = genomic DNA
aagaaagaaagaaaacgcaggtattgcttttcgaagtgctttgtaggtaatcgaggtaagaaaatatacgcaggcagcctcttacaattttatgcaggggcgccgggagcctcgtgacgggcggtgggggcccccacaaaggcgcggctgggagctggcgctctttgccccagcagggacgaggagcggctggagaagggtgtttctttgacccgtttacaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctgttatttccacatccttcagggacaccagtccctacgaagaccttgggcgattttgaagtgcgggcacctcgattc

SEQ ID NO: 29289 - DNA, 61 bp, Homo sapiens
  misc_feature 1..61: note = chr4:174452696-174452757
  misc_feature 1..61: note = hyper
  source 1..61: mol_type = genomic DNA
taaattagagggaggcgagggcctgcggcgccagcgcgggacagggcggcctggggctcgc

SEQ ID NO: 29290 - DNA, 190 bp, Homo sapiens
  misc_feature 1..190: note = chr4:174459185-174459375
  misc_feature 1..190: note = hyper
  source 1..190: mol_type = genomic DNA
gcctctggtttcttccgttccgttctagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggc

SEQ ID NO: 29291 - DNA, 124 bp, Homo sapiens
  misc_feature 1..124: note = chr4:174459527-174459651
  misc_feature 1..124: note = hyper
  source 1..124: mol_type = genomic DNA
cggttccccacacccaggaggccggttctccgccgctcaggctgggagaggtcaccgctccgggcagggtggacccccagctccgtctcggaggacctttcgccggaggcgagcaggaaggggt

SEQ ID NO: 29292 - DNA, 144 bp, Homo sapiens
  misc_feature 1..144: note = chr4:174459923-174460067
  misc_feature 1..144: note = hyper
  source 1..144: mol_type = genomic DNA
ttctcctctgcgctccgggcgggtggaggaagcgacccgcggagtcactgcagggaggagagggggacgcgcgcggggggaggcggcggagggcggaggagactcgcttgcaccccagggccgcgggcacgcagagctgtgttg

SEQ ID NO: 29293 - DNA, 116 bp, Homo sapiens
  misc_feature 1..116: note = chr4:175133085-175133201
  misc_feature 1..116: note = hyper
  source 1..116: mol_type = genomic DNA
ttctctaagggctgccgcgggttccgcaaagactcactccagaatccccagctccctcgcgtcagcgaatgtcccgctggtccaggcagccttttcctgcgcggttcttcagttcc

SEQ ID NO: 29294 - DNA, 135 bp, Homo sapiens
  misc_feature 1..135: note = chr4:175134868-175135003
  misc_feature 1..135: note = hyper
  source 1..135: mol_type = genomic DNA
cctctgggtccttaccgaaagggaaggtcccaaaggaccaccagcgcgctctcggaggctccaggactagacattggactcccacagcgcaacaccatagggactccggtgttcggttcccgtggccctctcctt

SEQ ID NO: 29295 - DNA, 457 bp, Homo sapiens
  misc_feature 1..457: note = chr4:175135253-175135710
  misc_feature 1..457: note = hyper
  source 1..457: mol_type = genomic DNA
ctcagccgtcgggtgcgggaggaacgcccttgccaacctcagcctttttgatcttccgcgggcagagactcatcagagccaggaggactgtaactacccccggggcgtgtaccgccgaagcctgaagaggctggttgggccaaaatagcagtcgctgcaggcaccagtttcagcccgtcacctgagtgccggttcctgtgggcgcgccagtctcgcaggcagcgcgcccaagctcgcggatcgccctctcacatttttagaagccaagaaaagcacttttgaaattcactccttcgaccgtgggcagaggagcaggtgggcgccgagccctagctgagggtggggggtcgcggaggagaggaactggaaaatgggaaataggtgtctgctgacctagagttcttcggctttgattttaagcggcagtgaggctgggtggtttcgcccccctcatccc

SEQ ID NO: 29296 - DNA, 131 bp, Homo sapiens
  misc_feature 1..131: note = chr4:175136030-175136161
  misc_feature 1..131: note = hyper
  source 1..131: mol_type = genomic DNA
tgcctctaacttgaacggggcaggagaaatattggggtgatttggaagacggtgataagggaaagcacaaaataaggattggagggccgcagtgaggtcattagtgaagctgatgccggagataaaagctg

SEQ ID NO: 29297 - DNA, 30 bp, Homo sapiens; identical to SEQ ID NO: 7627
  misc_feature 1..30: note = chr4:175137723-175137753
  misc_feature 1..30: note = hyper
  source 1..30: mol_type = genomic DNA

SEQ ID NO: 29298 - DNA, 1172 bp, Homo sapiens
  misc_feature 1..1172: note = chr4:175138513-175139685
  misc_feature 1..1172: note = hyper
  source 1..1172: mol_type = genomic DNA
acgtacagggaactgcgccgcagttaatgcagaggacttatcctctgacctgcaatgtctccccacctggtgctctacagctccagagagcagggatttcagcttttcctccctcattggatccaatttcaatcccctcggttaactgaaagtgtgttgacttccacccagccggcaggaccctaagggcgcctggagcagtctggtgcgggtcctggctgcagcatgcccagcagagctccgggtgcaggaggctgcaaagccaccgccgcgtccaggccccttgagcggaggtgggaacgatccgccttagagttcaaggtgaattgctgtgacagtggcgggtggaggaggggagttcgagccgttcgcctcggggaagaattatccccgatcatttatttttagatctgaattcctccagaacccagcagaggctgtggccagagccccagggccaggcaagcggccaagctgcgctctcgataaaggagccagaatggttccatctggttacaaacatatctttttattaaaaagcaatcagatcctgaagcgcttcccttgcggtttaccgctctccgcaggctgcttctccgaagccagcggtggtagcgcccactcggttgagcccacgcctccgccaggcagcgcctccgccaggcagacctcctgcgggacattttgtggccaggggggttcctgcccagggacctctaatagggtcggtggaagctaatttgaatcttcccagttccttccctgtttatttctcaacccagcagttcaaaaattcactttataacggtcccctaacaaaaacacgagtaagaaagatagcaaagaattaagctggacaggcacccatgttgcgaaaaaggttttgcttggagactgcaggagagggctatccctctttacaattcacgacgttactaccaactttgccattgagtggttcctctccctgcccgaattcctggccatcttcgttccagagagcgatgcaatcatggccttgaaaccgaacggggcgtaacgtgccattcctctccagctcccgagccccactcccacccttgccgttgaaactgtgaaaaagccgccaaagtttgggcacccagcctggcagtcggaagacagtgagataaagaatgcgatagtaagtcctt

SEQ ID NO: 29299 - DNA, 30 bp, Homo sapiens
  misc_feature 1..30: note = chr4:175749823-175749853
  misc_feature 1..30: note = hyper
  source 1..30: mol_type = genomic DNA
aacaagtggttgcaacgtaatgcacaggct

SEQ ID NO: 29300 - DNA, 416 bp, Homo sapiens
  misc_feature 1..416: note = chr4:175750264-175750680
  misc_feature 1..416: note = hyper
  source 1..416: mol_type = genomic DNA
caaaggaagaatgttcgttcttccctgactgagacccaggattggaggaagaagagcagcaacagccggaaagaggacgcctctccacctgctccaagcgccgcccgccggaatccagctctccaccttgggttaaaacccgagacccggagcgcggcaaagggaagcgggggtggggccggacaacccggtcctgtcgaccaatcacgaccgcacagcgggacggagtgacaggccacttacgacggtaggcggggcttagcgcttcaccctttaacaaaacccaaacaaaccaaacggcgactggagcgaggtgggcggaaaaagccacctgggaaagtcagcggttttgtggattaggtagtgtaaccccgcaggagggaccctttagtattcccttccgggaaaaggcacac

SEQ ID NO: 29301 - DNA, 15 bp, Homo sapiens
  misc_feature 1..15: note = chr4:176922653-176922668
  misc_feature 1..15: note = hyper
  source 1..15: mol_type = genomic DNA
gttcttcctcccctc

SEQ ID NO: 29302 - DNA, 50 bp, Homo sapiens
  misc_feature 1..50: note = chr4:176922729-176922779
  misc_feature 1..50: note = hyper
  source 1..50: mol_type = genomic DNA
cggaccctgcctggaaacttgagcgaagctgaactgcgccgaactccacc

SEQ ID NO: 29303 - DNA, 301 bp, Homo sapiens
  misc_feature 1..301: note = chr4:176922780-176923081
  misc_feature 1..301: note = hyper
  source 1..301: mol_type = genomic DNA
tccagtgacccgagccagtgtggacgcccttttaatcacgctgtttacccaggtggaatttaggaagaatcagccttcagcctcaacctcaaaccttttgtgcaaatgggcacttcgtttggaaagggactagaaattgtccccagtctggccctgcaccagcaccttcctctgctcaaacctgtacaaagtggaagttttaggaagtttccatttctcgtgccccgtttcaacttgctccccaaagagaacatgaaaacgtgggaactcgggaggacagagatctccctgtaatcgcctc

SEQ ID NO: 29304 - DNA, 561 bp, Homo sapiens
  misc_feature 1..561: note = chr4:176923082-176923643
  misc_feature 1..561: note = hyper
  source 1..561: mol_type = genomic DNA
ctattcggatcctgggtctcttagtctttctttatttcccaaataccgcccccagcacggtagaccggacccccaggcttgggtcctggggccggcgcagaggatcagcgcccaagcgcagccccccaccctcccgacccactgtaaacagtcgggcaccctccctcgcctccaggtgccaccccatcgccatcgcctctctcccagaaaaaaaagtccggagacaagagggcggggggcgggggacgccaggcgcggggggaacagagctgggaaggacgcagtctgaggccgaggaacattcattttctttctataatgcccattcccgaggccgagcctttgggcgaggtgtacgcgcccgcccgcgcactcacccatggcccgaggtcctgcttctctgcagtccccagaggagagcgagtgaccagacgctgcgcggggccaagttctccaagccgcgctgaggctcctcgcgccctggcaagtgacagcctcgcccctcccagcggagacaactcgcagggcgcctggcgactctgcgggcgcacagacccctcc

SEQ ID NO: 29305 - DNA, 124 bp, Homo sapiens; identical to SEQ ID NO: 2495
  misc_feature 1..124: note = chr4:176987050-176987174
  misc_feature 1..124: note = hyper
  source 1..124: mol_type = genomic DNA

SEQ ID NO: 29306 - skipped

SEQ ID NO: 29307 - DNA, 107 bp, Homo sapiens; identical to SEQ ID NO: 2497
  misc_feature 1..107: note = chr4:176987206-176987313
  misc_feature 1..107: note = hyper
  source 1..107: mol_type = genomic DNA

SEQ ID NO: 29308 - DNA, 42 bp, Homo sapiens
  misc_feature 1..42: note = chr4:176987314-176987356
  misc_feature 1..42: note = hyper
  source 1..42: mol_type = genomic DNA
agaggggctctgacctccctgtgatcgcggaccagggtaatg

SEQ ID NO: 29309 - DNA, 70 bp, Homo sapiens
  misc_feature 1..70: note = chr4:177713240-177713310
  misc_feature 1..70: note = hyper
  source 1..70: mol_type = genomic DNA
ccccgcgcaggttctcgggtccgccgcagaccctaacgcaaactctcgggttctccgcaaaccctaacgc

SEQ ID NO: 29310 - DNA, 614 bp, Homo sapiens
  misc_feature 1..614: note = chr4:177713605-177714219
  misc_feature 1..614: note = hyper
  source 1..614: mol_type = genomic DNA
cggcgggagcgggtccggggctccgcgttcccaactttgcagggcgccctcccagccagtgccggggaaaggcggcgggtgtcaggtaaaagcctcacaggaaaccggacatccgagctccccgcattcggagcccgcgaggtgaagcgagggcgagggaggacgccgccgcggtccgcgtcggtgtagctttttggagaggcggggcgggggacaccagaacaccccgcgatgttcagcccctccaaacccgccagagccctcgtccccctcctccctccccttccccgaagtgagaggagccgggccgcgggcgctgcggcgggggcgctggcggcggtgccgggggcgggaggagggcggcggggcggctggcggcggcggggcccgggagcgccgcggcgcaggatcctccagagcgcgccgggctgagcggcggcggcggcggcggcgggcgcaggggcagggcatgactgacgcgccctctgcctgcgcttatgtgagagaaagcggccgagggagggagcgtgccgagcccgggctgccctcccctctcactctccctcggaagccgtctccctggagctccccgtttccctcgcctcctccccggc

SEQ ID NO: 29311 - DNA, 357 bp, Homo sapiens
  misc_feature 1..357: note = chr4:180979270-180979627
  misc_feature 1..357: note = hyper
  source 1..357: mol_type = genomic DNA
cagcagagccactgccgccctggctcttgtaggtgggtctggagtgtcacgtaggcaccccaactcgcgccgggggccgtggtccgcagactcccacttcattgccccggaggcctgagcccgccccgcccggctgtggctgcacctttcccgagagtcggggcagcggcggctcgaaagtggaggcagcctaaccgcgtagcgctgaaaccaccattcacaaatgcaaacccctgtcttctgtggataaacggtggcggcgcgcgtccgagcgtccccgaggggctgtggggagcccccggggagagcaggaaaggaagcggggtggcggtggctaggaagcgactgagccttctc

SEQ ID NO: 29312 - DNA, 74 bp, Homo sapiens
  misc_feature 1..74: note = chr4:180980278-180980352
  misc_feature 1..74: note = hyper
  source 1..74: mol_type = genomic DNA
gcgcctttggcgaggcggcggccgctcggccctgcgcccggccgcggcggcggcggctccgctcgccccgggag

SEQ ID NO: 29313 - DNA, 91 bp, Homo sapiens; identical to SEQ ID NO: 7642
  misc_feature 1..91: note = chr4:183062455-183062546
  misc_feature 1..91: note = hyper
  source 1..91: mol_type = genomic DNA

SEQ ID NO: 29314 - DNA, 307 bp, Homo sapiens
  misc_feature 1..307: note = chr4:183063666-183063973
  misc_feature 1..307: note = hyper
  source 1..307: mol_type = genomic DNA
gtttctggttctgcacggtagttaaaaatgcaagtggatttcctaacggccgagtacaggtacaggtggaggtcggcggaatcctctgctctgaagctgaaagtggagggtggcgcgaggcggctggcgcgacgaggctgagagcgcaccagtctccgccacgcttccaaggacaggttggcgacggccggggcaggcctggtcgcgggctcctagccctccacgggcagactgctggtcccaggagagggcggggagatgctcgggcgcgcaccagggagccgcactcactcggcagccccaagca

SEQ ID NO: 29315 - DNA, 876 bp, Homo sapiens
  misc_feature 1..876: note = chr4:183064617-183065493
  misc_feature 1..876: note = hyper
  source 1..876: mol_type = genomic DNA
ttctgcctcggaatccgtcttcccggcagtgtcttgcactgccacctcctcgggtgactcagctgacctgaaatgcccaccctacggaagatcaagaaaagtagttttctaagaaggttagaggtttgattacacagagaagtgtttccacttaagtccaaagcaattacccgccccctcccccagggccgcctccccgccacccgcagcagaaaaggacagacccccacgcacgtacccccattttgttggtgcgtgtgaatttcaaatggcgcagtaagttcattagtgttttcaatcggcggcgggcagacccctcatcagagccgaaagccggcaagagccattcatcagcgtgaagtgttattcacggatgacccctaaatcacggcgagagtagtaaaggcactgattggtcacagcatgggagcctcggtgctttcccgaacccgacgcggccgggaggagggaaggagggaggggcggcgaacgtggttcagtccggcaaatcccatttgacagaaaaaggcagtaaacggggaatctctttttttgaataaagaagaagaagaaataaagtacctgtcatcttgacaagtggcggagcggaggagtcaaggattataaatgatcacagccaggtccagctcgccccgtgattgggctctcccgcgatctgcaccgggggaagcgcatggtaggctcctctcctctcctcctctccctcgcacactcccgcacacacacacacacacacacacacggacacgtgtacgcgcccgggctcgggcacactcggcccggcgcgtcccccgccgcacaattacggtcctggatgccgctccctggccgggcgtcccgcgggcctcctcacct

SEQ ID NO: 29316 - DNA, 297 bp, Homo sapiens
  misc_feature 1..297: note = chr4:183369261-183369558
  misc_feature 1..297: note = hyper
  source 1..297: mol_type = genomic DNA
ttcagcccctggtaccgtcttctctccccgggtcgcgacactgactcgtcaacgttaatgggggtccgcgactgctgcggggacgagggcgcagagcagcccccgccacgggccggtccacgcaggggccgagaaagtggcggagaggcggtggccgaggcccaggggcgagcgcgggctgagctggtccctgctgcgttcacgagcgacacccaccccttcgctgcggacgccccgcgggcgccaggctgggggccctgcgaccgacccctcccgcccccgaggtaccgccgggcc

SEQ ID NO: 29317 - DNA, 37 bp, Homo sapiens
  misc_feature 1..37: note = chr4:183369966-183370003
  misc_feature 1..37: note = hyper
  source 1..37: mol_type = genomic DNA
ggcgagggggtgaggcggcggccgagccggggcgctg

SEQ ID NO: 29318 - DNA, 40 bp, Homo sapiens
  misc_feature 1..40: note = chr4:183727758-183727798
  misc_feature 1..40: note = hyper
  source 1..40: mol_type = genomic DNA
aaaccgaagagaaggcgccgccgctcgccgctcgccactc

SEQ ID NO: 29319 - DNA, 67 bp, Homo sapiens
  misc_feature 1..67: note = chr4:184019249-184019316
  misc_feature 1..67: note = hyper
  source 1..67: mol_type = genomic DNA
gaccctgaagcttggcgtccaggccccgccagcgctgcacccggcattgtcccgcctggggcaggcg

SEQ ID NO: 29320 - DNA, 30 bp, Homo sapiens
  misc_feature 1..30: note = chr4:184019532-184019562
  misc_feature 1..30: note = hyper
  source 1..30: mol_type = genomic DNA
ggaagggactagagtcggggcgcgtccacg

SEQ ID NO: 29321 - DNA, 62 bp, Homo sapiens
  misc_feature 1..62: note = chr4:184020126-184020188
  misc_feature 1..62: note = hyper
  source 1..62: mol_type = genomic DNA
ccccgcggggcagtgcgtccgagctggtgcggcgacgccggcagcggcggggttaagctcag

SEQ ID NO: 29322 - DNA, 156 bp, Homo sapiens
  misc_feature 1..156: note = chr4:184020571-184020727
  misc_feature 1..156: note = hyper
  source 1..156: mol_type = genomic DNA
cggcagccgcgttcccgccgcgtcccgcgcccggtacctatggaggcgccgctcgccggcgaggccgccgaccatgcctaggagggccgggagcggtcagctgccgctgccccggggctgggaggaggccagggactacgacggcaaggtcttcta

SEQ ID NO: 29323 - DNA, 75 bp, Homo sapiens
  misc_feature 1..75: note = chr4:184021203-184021278
  misc_feature 1..75: note = hyper
  source 1..75: mol_type = genomic DNA
aggccgtccttggcgcgggagcctgggctgcgagctcttggcgggggcgcccagactggccggaggtcccgagct

SEQ ID NO: 29324 - DNA, 216 bp, Homo sapiens
  misc_feature 1..216: note = chr4:184718199-184718415
  misc_feature 1..216: note = hyper
  source 1..216: mol_type = genomic DNA
tcattaaccagtcagcgaatccacttgttccagcgagaggtgggaggtgggggcaggggtggagcgtggggaggagcgacactcgccgctccggaatccgtgccttccaagtgtcgccgttgcgtcccccgcaacccccgctttctgatctccctcgaggcccaacacccaaaggctcacccctaggccatccgcgctccccgaccacctccctca

SEQ ID NO: 29325 - DNA, 100 bp, Homo sapiens
  misc_feature 1..100: note = chr4:184718735-184718835
  misc_feature 1..100: note = hyper
  source 1..100: mol_type = genomic DNA
ccctgccctgggggacggtcgcgctccccgctggtcttgcagccacgtcccggcggctgttcctgggagcggcgggaggcggcctcggtgagccaggtcg

SEQ ID NO: 29326 - DNA, 154 bp, Homo sapiens
  misc_feature 1..154: note = chr4:184719233-184719387
  misc_feature 1..154: note = hyper
  source 1..154: mol_type = genomic DNA
cccgtcccttcccaccggatcgcgtccgtgccgtgcggtcgcgggtgccccgccctgccccagcccgccgcgggcaccgccgaggctcccctgggtgcccgcgtccctgccgggggaggagccgggggccctctgcgagcgtgggattggggaa

SEQ ID NO: 29327 - DNA, 100 bp, Homo sapiens
  misc_feature 1..100: note = chr4:184826238-184826338
  misc_feature 1..100: note = hyper
  source 1..100: mol_type = genomic DNA
tttgaaaacccaaatcgaggagataaccgtttttgaatgaacggcagtgcaaagcgtggtcggggttagcagcaacgtggctgggcgcctttaactcggc

SEQ ID NO: 29328 - DNA, 74 bp, Homo sapiens
  misc_feature 1..74: note = chr4:184826583-184826657
  misc_feature 1..74: note = hyper
  source 1..74: mol_type = genomic DNA
gcgtcttccaggctgcgtggacccggcgccccggcgtgtgcggttgtgggggagctcgccgtggcctcccctcc

SEQ ID NO: 29329 - DNA, 102 bp, Homo sapiens
  misc_feature 1..102: note = chr4:184827100-184827202
  misc_feature 1..102: note = hyper
  source 1..102: mol_type = genomic DNA
acccagccatccacccgcgcgcacgcacagcgcccggagcctcggcaaggggaagattgacgaggcgctgcagtcgcggggacgacgcgggctcttcctgga

SEQ ID NO: 29330 - DNA, 56 bp, Homo sapiens
  misc_feature 1..56: note = chr4:184827574-184827630
  misc_feature 1..56: note = hyper
  source 1..56: mol_type = genomic DNA
ctcccattgccttcacgctgcaagtctcggcgcccccaccccgcccgccccctccc

SEQ ID NO: 29331 - DNA, 70 bp, Homo sapiens
  misc_feature 1..70: note = chr4:185089642-185089712
  misc_feature 1..70: note = hyper
  source 1..70: mol_type = genomic DNA
gctggaagctttgcacgggggtgaaagttacaggcagacactgcccgcggggctccggacagcaaggagc

SEQ ID NO: 29332 - DNA, 32 bp, Homo sapiens
  misc_feature 1..32: note = chr4:185937387-185937419
  misc_feature 1..32: note = hyper
  source 1..32: mol_type = genomic DNA
gccccctcacctgcacgcgggtacttttagcc

SEQ ID NO: 29333 - DNA, 340 bp, Homo sapiens
  misc_feature 1..340: note = chr4:185937644-185937984
  misc_feature 1..340: note = hyper
  source 1..340: mol_type = genomic DNA
taatctctttgtgtgcgagtgaatatcctgaaatcgacaacccctgagagggcactcgcggctggcagagcaacctgggagggtgcggatcgtgtccaatctggcgtgaagcagaaaggaaacatcgtgaggagactagaggcaggaccgagagggacaccctaggggtgcgaggtgcagaccgagccctcacatctcccaggccgcagcaggtgggccgatggcttccccgaggcctggcaccccaggcctggctctgcgccctgaggctcccaggtcccaccagctagaagagcgccgcctacccacccctgccaaggtctaacgaccccaagggggg

SEQ ID NO: 29334 - DNA, 516 bp, Homo sapiens
  misc_feature 1..516: note = chr4:185938230-185938746
  misc_feature 1..516: note = hyper
  source 1..516: mol_type = genomic DNA
ggcagcaagtgtgagcgaggcccgtcctgggggaggtggcctctggccgcggggccaggttgccctcagaggcgcaggcggccaagagagttcccagccgccgccgcccccctccttccccttgggcccgtccagcaaatttcctccctcgtttctgttcgtgccttccctccctcctcctccccccgatattttcgctttctaaaaccataaaaaagagatcaacttcccaaacttcacagggcccttttcagtgacaaatattgatgcccaaagtgtctgcgctctcccgcccccaaacgttaagaaaagacgccagcgaaagggagacataaaaagttaacaatgctgtgaaaatatgtttgcagaaaatagacaatcgttggattaaacgtattcaagtatgaaataatgcctttttgtgtcaaaacttgggcgatgggcgggtacaaaagttccctgtggcagctacttgctccctttgtgagccgtgcgctttggcgtctccacttgggc

SEQ ID NO: 29335 - DNA, 212 bp, Homo sapiens; identical to SEQ ID NO: 7652
  misc_feature 1..212: note = chr4:185939694-185939906
  misc_feature 1..212: note = hyper
  source 1..212: mol_type = genomic DNA

SEQ ID NO: 29336 - DNA, 166 bp, Homo sapiens
  misc_feature 1..166: note = chr4:185940294-185940460
  misc_feature 1..166: note = hyper
  source 1..166: mol_type = genomic DNA
ctgcctggaggctggcggccacctccccaaaggcctgggtagggtggctggaaggggagcgcgccagcgcgggcgtcagaaggcagagctcacctggcccgagcgtggcgggccaggagtcccttcctagagcgaatctgagcagtgtgcgcggctggagaggcgg

SEQ ID NO: 29337 - DNA, 30 bp, Homo sapiens
  misc_feature 1..30: note = chr4:185941006-185941036
  misc_feature 1..30: note = hyper
  source 1..30: mol_type = genomic DNA
ggttagggaatgggacgcctgggccaggcg

SEQ ID NO: 29338 - DNA, 701 bp, Homo sapiens
  misc_feature 1..701: note = chr4:185941560-185942261
  misc_feature 1..701: note = hyper
  source 1..701: mol_type = genomic DNA
ttgcagtccaaggcccgcctgggcgcggagcccgcctttccgccgctgggttcgctcccggagccggatttctcctatcagctgcaccctgcggggcccgaattcgctggtcacagcccgggcgaggccgctgtgttcccgcagggctctggtgccgggcctttcccctggccgcctggcgcggcccgcagccccgcgctgccctacctgcccagcgcgccagtgccgctcgctagcccagcgcagcagcacagccccttcctgacaccggtgcagggcctggaccggcattacctcaacctgatcggccacgcgcaccccaacgcccttaacctgcacacgccccagcaccccccggtgctctgacgcccactcgcccgccagatttctcctcgctttgggcgcttttaggagaaatgctgtatatattgtacacataatgtgtaaatattgtaccccaaaaatctgggctgggggaggcaaagagcgaatgagtcttctgaaggatctccccctggtaataaacgttttctgataaagacccaaagagagggatttatgtattaccttctgctcatccacacccgtcccctccgcggtgcccagggcgcaaggctgacagggttcaaggtaacagccctcagtaacttggtgaggggcccgctgtggagtctgagggagggggacgttaaatggaggtt

SEQ ID NO: 29339 - DNA, 443 bp, Homo sapiens; identical to SEQ ID NO: 7656
  misc_feature 1..443: note = chr4:185942491-185942934
  misc_feature 1..443: note = hyper
  source 1..443: mol_type = genomic DNA

SEQ ID NO: 29340 - DNA, 225 bp, Homo sapiens
  misc_feature 1..225: note = chr4:186048748-186048973
  misc_feature 1..225: note = hyper
  source 1..225: mol_type = genomic DNA
ttgctgagttatgtccgggcgagatcggtgtccttcagggtgggaggctcagaaacccagcgcgcgagcctctgggcagtggtaagggcgggttgggagtcgggttcggcgagtccaaaggaggctcccgggctgcagaggccccggcaggctgtctccgccccacgagccccttctcctgcggtctcctggactgcggcgacgaagcgtcggggctggggctcc

SEQ ID NO: 29341 - DNA, 561 bp, Homo sapiens
  misc_feature 1..561: note = chr4:186049504-186050065
  misc_feature 1..561: note = hyper
  source 1..561: mol_type = genomic DNA
ccccgcgccctccccttgcggagattcggcctggaaagctccgcggctctggccggcaccggtttccttcccgcctccccgcactcccacccccgctcctagttcagagcgctggtggcgttacccacagccgcggaatcccctttactgttcccggaggagctgcgaggtggaactggccgcgcggtgggggctttccccggccccgggacgagcactcagcgtcccctccccgcgacgctccctcggaatcccggggaagagcgcagcagaggcggggaggaggcgcgagcggaggggaccgacttccaccgcacctgggtgtcgccagccccgcctggccctcggcgccgggaccccgacgcaccccgcgcatagcgactggtggcctggtgggggactgcgcctgcgaggccttcttcgcgcagagatatcggggttctctgaaccccagaaatgggcctggcaggggaaggaagctgcaagaaaggagttaatctgcaggatgctcaattctttctatgacaaatcgcttcactccccgctcggcaggtcagagct

SEQ ID NO: 29342 - DNA, 214 bp, Homo sapiens
  misc_feature 1..214: note = chr4:186456012-186456226
  misc_feature 1..214: note = hyper
  source 1..214: mol_type = genomic DNA
gctgaacttttcatccggacgagaaaaacgctcagatgcgcgccagctccagggaatgccggggggtgccagtccctcgcctctcccacccgggacccatcatttgttacggaagggcgatggggtgtgttttatttctgttatcacatataaaacatttaaaacctaaaggggaggaggcactcgagcctggcagcctcgccttccctgagcc

SEQ ID NO: 29343 - DNA, 34 bp, Homo sapiens
  misc_feature 1..34: note = chr4:186456784-186456818
  misc_feature 1..34: note = hyper
  source 1..34: mol_type = genomic DNA
cgggagtgcgcagcccggccggctggggcagcct

SEQ ID NO: 29344 - DNA, 163 bp, Homo sapiens
  misc_feature 1..163: note = chr4:187026723-187026886
  misc_feature 1..163: note = hyper
  source 1..163: mol_type = genomic DNA
gaaccctgttccttacgctgcctgacatcggcgaggagggggcctcggacggcgactccggggatggcgaagcgtgagtagcagcgtggtccgggcgcgtgtaccttttgccgggacccccgacccctccgcctgccgcactcaccttcgcaggtgcacttca

SEQ ID NO: 29345 - DNA, 31 bp, Homo sapiens
  misc_feature 1..31: note = chr5:53156-53187
  misc_feature 1..31: note = hyper
  source 1..31: mol_type = genomic DNA
cttgttcgggaccgccgggtggagacaagga

SEQ ID NO: 29346 - DNA, 116 bp, Homo sapiens
  misc_feature 1..116: note = chr5:53500-53616
  misc_feature 1..116: note = hyper
  source 1..116: mol_type = genomic DNA
cgagtccccttctcaggcaggctgtgggggttggggttgggcttcgcgagcccaagcggacgccgcaaagagaatgagaacctcggagcgctcggggcgggcgggcccagcccagg

SEQ ID NO: 29347 - DNA, 57 bp, Homo sapiens
  misc_feature 1..57: note = chr5:53842-53899
  misc_feature 1..57: note = hyper
  source 1..57: mol_type = genomic DNA
acgtgaaggggacctcggtgcccggagctgctgcccaggtaaccgcgctgcgcccgg

SEQ ID NO: 29348 - skipped

SEQ ID NO: 29349 - DNA, 42 bp, Homo sapiens
  misc_feature 1..42: note = chr5:54390-54432
  misc_feature 1..42: note = hyper
  source 1..42: mol_type = genomic DNA
ttgctttagcccccacgctcctgtgtgcgagaggggcctggt

SEQ ID NO: 29350 - DNA, 229 bp, Homo sapiens
  misc_feature 1..229: note = chr5:91895-92124
  misc_feature 1..229: note = hyper
  source 1..229: mol_type = genomic DNA
tagaccaggggaaatcggggtcccgtccgggtacactggcagaactcaggggtcagatcctctgccctggagcattcagatttgtgcctctacgttatggaaaccaggggcccgtccgggtgcaacgtggcatccacaaaatggcaggtccccgagctccgggctccgagagaacaaaagcagaagccactgccgcccgcgctcggggaggagccgcccaggtgggcgc

SEQ ID NO: 29351 - DNA, 546 bp, Homo sapiens
  misc_feature 1..546: note = chr5:320788-321334
  misc_feature 1..546: note = hyper
  source 1..546: mol_type = genomic DNA
cgccagtgacagcctcggccgcgttgctgaaaaccgaccttgcgggatgaagagggcgcggttcccccggctgggatgaggaccgcggatgctgaggagcggactccagggaccaccgactccatggccggccccagcgagggcgagaacgggtggaagccggccagggtctgtggagacgtcagggtgcgaggccaggctgaggtgtccccagggatcccctgagggtacagggaattcagccagggcctgcgcgcccggacggaggactagagggggccaaggaccaccgggagggggaaggagaaggcgcagcccgaggtcggaggggccggcgggcgcgcagagggcgcggggtgagccctaaggacctgcaggcaggaccctgctctcggccgcgcggtcccgggtgccgaccggcggggtgggcggggcaggggcacccagggccgcacacctgccgcgtgggaccctgaaatgcccaggacgaagaacgtcgcacggacgaccctgccgtgcctggcgcgcgtccgcttcctgggaagc

SEQ ID NO: 29352 - DNA, 30 bp, Homo sapiens
  misc_feature 1..30: note = chr5:321585-321615
  misc_feature 1..30: note = hyper
  source 1..30: mol_type = genomic DNA
cctggaggggctcagcgcgcgacccccgcc

SEQ ID NO: 29353 - DNA, 148 bp, Homo sapiens
  misc_feature 1..148: note = chr5:321900-322048
  misc_feature 1..148: note = hyper
  source 1..148: mol_type = genomic DNA
gtgtgcctgagcctccgcgccccgcaggccctgggtaagtgtcctgggcgcccccgcaggcccccgccgcgtgccgcccgcggtggagacgggatgcgctcccgggtgtggggctgagggacgggcgccggcgtcgggaccctcctca

SEQ ID NO: 29354 - DNA, 191 bp, Homo sapiens
  misc_feature 1..191: note = chr5:322061-322252
  misc_feature 1..191: note = hyper
  source 1..191: mol_type = genomic DNA
cgtcgccaggcccggcggccccgggacggggcggacactctggggtgcggctggctggtctcacttaaaactcggacctcggagggaagccgcggcgcgtccacggttcgtggtcctcagcgtcccctcgagagtgttctgagccttcactccccgggcgttccgtgcgggccgcgctccctggggctggg

SEQ ID NO: 29355 - DNA, 138 bp, Homo sapiens
  misc_feature 1..138: note = chr5:322265-322403
  misc_feature 1..138: note = hyper
  source 1..138: mol_type = genomic DNA
cggagcggggccccgctgtcgggccgagggcgccaggtccggggggcctcacccccgggaaaggcccatgttcaggcttggtttcagtagcacccagtagcgctgaagtcttattttgagcggccagaattcccagac

SEQ ID NO: 29356 - DNA, 30 bp, Homo sapiens
  misc_feature 1..30: note = chr5:344257-344287
  misc_feature 1..30: note = hyper
  source 1..30: mol_type = genomic DNA
ggtgcccggagcccccggcgaggctcgtcc

SEQ ID NO: 29357 - DNA, 265 bp, Homo sapiens
  misc_feature 1..265: note = chr5:374088-374353
  misc_feature 1..265: note = hyper
  source 1..265: mol_type = genomic DNA
ggggcgcgcccctgccgccgcacctacgcgcttctcggggaaaaggccggggctgccgggtccgcggggcgcattgcgggtgggacggggtcggctccgctgcgggagcgacccctgcaatggggcttggctgcaccggccgcctgggtggtcggtctgtgtgcgggtgacccaggcgtgtgcccccacccgcgctgccccagcccgcggacctcggcggggagcgcccagggccagcacgggggtctcacggggcgaccccagc

SEQ ID NO: 29358 - DNA, 25 bp, Homo sapiens
  misc_feature 1..25: note = chr5:523778-523803
  misc_feature 1..25: note = hyper
  source 1..25: mol_type = genomic DNA
ctgctgggtttcatgcgggtagcac

SEQ ID NO: 29359 - DNA, 1004 bp, Homo sapiens
  misc_feature 1..1004: note = chr5:523856-524860
  misc_feature 1..1004: note = hyper
  source 1..1004: mol_type = genomic DNA
cgtttctctaaaaagcctgagaaccccgaaggaaacccggccccggggactccctgggcgcgagcagcctgcagtctgcggggctcggagcggaggcggggcggagaccccacagggacccgggagccgggagtccggggctccgaggctgtgcccccgccggggaggggagacctcgggacccgcaggggcggcttagcgcggccagagtcgctcccgagtctcgctctgctggacccgagagccggactctcccgggcggccgccgcgcggctccgacctgatgcgcgcggccacaacgaagcccccaggcccagcagaggcggccgcacaccccgcgggcagatccggagaccccggggccacttaccgatcttggccaagctggccacgaggatccagagcgcgatgacgtagggatcctgcacgtgggcccactcgaaggtgaccacctggaagcccccgctctcgccgtgcgcgccgccgggctccacctcgacgcccccggcccgcgccagcccgcccagcgccagcgccagcagcagcccccggtcggggccccgggccccgagtccccacattgccgcctgctcagcgcagggctgggacgcgcatgtcgcggggggtcccggctgggctgggccgacgcgcggggctgggacccggcgaggacccggcgcgctccggtgccggtaccggctacagtccgatccccgcccgccggggtggcctttaatcccgcggccccctcccgccccggggcggagcctgcccgcccccgccgcgcactcgcgagcgcagacaccgccgcagctcccggcacgcccgccccgcccgcgcacgcccaccccgcgctccctggtgcccaccctcccccggagcccgcggcctggaggtccgggaggtcgcggcaagagcgagcccgggactgcgcggccgccttcctggggcgtggggagcacagcgcggggcagcgggacaggcggttccgcgcagctcctggg

SEQ ID NO: 29360 - DNA, 32 bp, Homo sapiens
  misc_feature 1..32: note = chr5:926725-926757
  misc_feature 1..32: note = hyper
  source 1..32: mol_type = genomic DNA
ccctcctgggcccctcgcgtcccccttccctg

SEQ ID NO: 29361 - DNA, 154 bp, Homo sapiens
  misc_feature 1..154: note = chr5:1155721-1155875
  misc_feature 1..154: note = hyper
  source 1..154: mol_type = genomic DNA
gccggcccgccaggccgccgccgcccacctgcgcccctcgaggggaccggcacctgcgcgcacctaccgtagcggccgggctcgcggcagtagagcagaatgggaagcgggtcctcgtcaggcggctcgggcgcggctgcggggtccaggccgg

SEQ ID NO: 29362 - DNA, 55 bp, Homo sapiens
  misc_feature 1..55: note = chr5:1156350-1156405
  misc_feature 1..55: note = hyper
  source 1..55: mol_type = genomic DNA
caaccctggcagcaacgctgcagcccgcggtctctggcgacgcccaccgagggcc

SEQ ID NO: 29363 - DNA, 886 bp, Homo sapiens
  misc_feature 1..886: note = chr5:1294557-1295443
  misc_feature 1..886: note = hyper
  source 1..886: mol_type = genomic DNA
acgtcgtcgcccacgcggcgcagcagcagcccccacgccccgctcccccgcagtgcgtcggtcaccgtgttgggcaggtagctgcgcacgctggtggtgaaggcctcgggggggcccccgcgggccccgtccagcagcgcgaagccgaaggccagcacgttcttcgcgccgcgctcgcacagcctctgcagcactcgggccaccagctccttcaggcaggacacctgcgggggaagcgccctgagtcgcctgcgctgctctccgcatgtcgctggttccccccggccgccctcaaccccagccggacgccgaccccggggaggcccacctggcggaaggagggggcggcggggggcggccgtgcgtcccagggcacgcacaccaggcactgggccaccagcgcgcggaaagccgccgggtccccgcgctgcaccagccgccagccctggggccccaggcgccgcacgaacgtggccagcggcagcacctcgcggtagtggctgcgcagcagggagcgcacggctcggcagcggggagcgcgcggcatcgcgggggtggccggggccagggcttcccacgtgcgcagcaggacgcagcgctgcctgaaactcgcgccgcgaggagagggcggggccgcggaaaggaaggggaggggctgggagggcccggagggggctgggccggggacccgggaggggtcgggacggggcggggtccgcgcggaggaggcggagctggaaggtgaaggggcaggacgggtgcccgggtccccagtccctccgccacgtgggaagcgcggtcctgggcgtctgtgcccgcgaatccactgggagcccggcctggccccgacagcgcagctgctccgggcggacccgggggtctgggc

SEQ ID NO: 29364 - DNA, 95 bp, Homo sapiens
  misc_feature 1..95: note = chr5:1295604-1295699
  misc_feature 1..95: note = hyper
  source 1..95: mol_type = genomic DNA
cgctggcctgatccggagacccagggctgcctccaggtccggacgcggggcgtcgggctccgggcaccacgaatgccggacgtgaaggggaggac

SEQ ID NO: 29365 - DNA, 66 bp, Homo sapiens
  misc_feature 1..66: note = chr5:1444697-1444763
  misc_feature 1..66: note = hyper
  source 1..66: mol_type = genomic DNA
ggtgacaacctcaaccggcacgacccctccggtgggtaaaacacccgacgaaggggttccgcggcg

SEQ ID NO: 29366 - DNA, 405 bp, Homo sapiens
  misc_feature 1..405: note = chr5:1444851-1445256
  misc_feature 1..405: note = hyper
  source 1..405: mol_type = genomic DNA
cgctcctgaacgcggggcctcagaggcgagttttgggtctacacagcaaaatgtggcccgttagaaagcgtccttcctcaccgcgcccagaacaagaagcggcgctgcctggcgagtcctcgcccggcctccccgccctgcccagagcaccagcgcgcagcccgcgcccgccaccacccccaacacagacaaagcccccgcgagatggagcggcggtgtacaaaacccactccgatcggatctgggatgcgccgcacccctagtagggttaagttccacgagaagaaaccaggacccccgagtcacagccatagacacccacgcgtcccctaagccggtgactgcaccaggtgcccacccggttctgagcctggagcggggccaggggcagccctgcaccctcct

SEQ ID NO: 29367 - DNA, 76 bp, Homo sapiens
  misc_feature 1..76: note = chr5:1445485-1445561
  misc_feature 1..76: note = hyper
  source 1..76: mol_type = genomic DNA
gcacgcgagtcctggcgccgagagcgttccgcgaagcctcccctcccgctccgcagcgctgggcggtctcagcctc

SEQ ID NO: 29368 - skipped

SEQ ID NO: 29369 - DNA, 192 bp, Homo sapiens
  misc_feature 1..192: note = chr5:1445568-1445760
  misc_feature 1..192: note = hyper
  source 1..192: mol_type = genomic DNA
ggctcttatccagtagacagggtccgccccgccccgccctcccgccgacggggtcgccctcgcgtcctggctcctcctcctcacctccccgggccgcgcccccgcccccgcctcccggacgcagatggctgggagcaagcggcggccacggctccactgtcctgcgcgtcccggagcctcggacacggggtg

SEQ ID NO: 29370 - DNA, 261 bp, Homo sapiens
  misc_feature 1..261: note = chr5:1445840-1446101
  misc_feature 1..261: note = hyper
  source 1..261: mol_type = genomic DNA
cgcccgcacccctgggggctgccccgggcacccgctatcttcggacgcccagggctggcggctcccagctggacggggagggagccgagcggctgcgcgcggggaactgctgggaccccgtcgggccgacccttccctccctccccatcaggggcccctacggtggccccgcgctctggggaccacgtccctcccaccccgccgctccacgctctgaccagcgggctcgggaccccgccgaggactctgcacgcttcccgg

SEQ ID NO: 29371 - DNA, 126 bp, Homo sapiens; identical to SEQ ID NO: 2502
  misc_feature 1..126: note = chr5:1446236-1446362
  misc_feature 1..126: note = hyper
  source 1..126: mol_type = genomic DNA

SEQ ID NO: 29372 - DNA, 32 bp, Homo sapiens
  misc_feature 1..32: note = chr5:1446567-1446599
  misc_feature 1..32: note = hyper
  source 1..32: mol_type = genomic DNA
ttccagcctgcagcccgcgctcagcagtgagg

SEQ ID NO: 29373 - DNA, 366 bp, Homo sapiens
  misc_feature 1..366: note = chr5:1667728-1668094
  misc_feature 1..366: note = hyper
  source 1..366: mol_type = genomic DNA
cggggcgggggcgcgcgttctccctccgggcagcctcgtgggcggtagatgcagccaacgcgtccgtcaaagcggttcaggggcgctgggaagaggcggcggtgaccccgggacggcagtgggcccgaccgagcctcagtgggggtcccgcgtgtacgctggcctcgccctcccgcctcgcttctgggcttttgctccaactctcagccgccgtggagatcgcagggggcgtagggccaagccagggattccgctgtgccccgggctcgggagaggtgtcccgggagtctatggcagaatttccccctcatcctgcgctgggagaggggtctcgccccggatggaactccgcgttcccacctccag

SEQ ID NO: 29374 - DNA, 467 bp, Homo sapiens
  misc_feature 1..467: note = chr5:1851534-1852001
  misc_feature 1..467: note = hyper
  source 1..467: mol_type = genomic DNA
cgggctcctccggctgggagcgcacctgcgcagggagggtcctgtcccaccacacctggccccctggggaacagcgggtgagtgctgctgcaggaaggagcaggagagacgcactgctccccgctcctctctccgcttccctcctctcctcccacctcccccatctcctccgtcccctgtctccgcccctccttgtcctcaggaagccatatcccactctggtggagtggctcaggccgctgatgagggtgctcggggcagggctcttctctgagtgacgttggaggttttcacggtgaacacagaaaggggcactccgtccgagctgagcctcagggaccgtgaggcttgctcttggccctgctgctcatacagccctccgtgcctcgcttccctcccacagcaaggaaggatgacgggtgcggggtctgcacggtggcgcggggtggccgcgttgctcaggaggc

SEQ ID NO: 29375 - DNA, 1310 bp, Homo sapiens
  misc_feature 1..1310: note = chr5:1874997-1876307
  misc_feature 1..1310: note = hyper
  source 1..1310: mol_type = genomic DNA
ggaattatcttaggccgggcggccgggagagccgtatatctcccgcgcctgttcccttgtcgagcctgaatatgctgctgtcagactcgcttaatgaaaagtaacgcaccgctgattacagttttatttgggctctatgtaaagagcgccgttaatttgcatcccctccttggtgtgtttgaattcgccacgcctgaataaccgagcgcgccggccctgccggcctcccggcgccttcccagcccttctctgacaatctccctgggagcccagtcgcccgccccgacccttccccgtcacgcccccgccccactgacatcgacctccctggcgcgtccactcagacacctaaaattcaccccctccgtgtcacctctttgcaaacgccccctccccaccccgctccgacttcggaattgtcctgcctgacacctccccaccccacaagatcagccagagggtgtttgggggcgcctaaggcaaaccggctggactgtgccccaagggaagggtgtgggggaagcgcccagcgaggggatgccatttcctgcgcgtccccttagaatgtggctgaatccgcctccccacccgacgtctttatttaacacaatctcgcagcttattcaaataagccagctttgtcagccagttccaccaagatccgggggctccagcgagatggaattcctatggccagggccacggggaggggctggggtcccgagggcagcaagcttggctggcggcaggagccctgggtcctccccaggagagggacccagagcccagaccaagtccaacccgccaacctgcgccacccatgcgcgcactgggggctgcagagccccgccaggctgcccgcggccgggagcgtaaggccggggtccacgcctcgattttcagtgtccgcagcccctaccccgcctatctgcgacgcaaggcgaaaccttgtttttgcggaaaatgcctggctttgtctagggctggggtgggggcgtctgggcagccaccctcggccacattaaaattcctggcgccccagcctcgggcctcaacgctgtcccccgagacgccactttcgctattactgtcaagtacccttgactctttatttttgcccttttatctattacaactaattcgagttcttttgcccttttcagtctaagacgtgggctttctgcaaagcctccccctgccagcgagctctcggagcgcggagcctttagaaattgaggggtttactgtcaaaatgaaaatttcacttcaaattaccttggctgatgctcgctcgccaggccgggggctcc

SEQ ID NO: 29376 - DNA, 284 bp, Homo sapiens
  misc_feature 1..284: note = chr5:1876637-1876921
  misc_feature 1..284: note = hyper
  source 1..284: mol_type = genomic DNA
cgcaagacagtcctgcgtctccggctatcctgtcccaggcaagggcctgtggtcgcctcctcgccgcccccgggccgctcccgtagtccttgggacacctgggcctttgatgagcccagcagggcttcgggcggagggctcggggtggggggtggggggcgagaggagaggcctcaagtccgccaggcgcctgcgggggatgcggaaccgcctccgccgcggggatggggaggggagcccggatttctgagcgtagccacggcttggccgggccccccgagccc

SEQ ID NO: 29377 - DNA, 14 bp, Homo sapiens
  misc_feature 1..14: note = chr5:1877089-1877103
  misc_feature 1..14: note = hyper
  source 1..14: mol_type = genomic DNA
ggaaataggagagc

SEQ ID NO: 29378 - DNA, 38 bp, Homo sapiens
  misc_feature 1..38: note = chr5:1877194-1877232
  misc_feature 1..38: note = hyper
  source 1..38: mol_type = genomic DNA
cgatgggctcccacgcccccccccgggacacggctctg

SEQ ID NO: 29379 - DNA, 211 bp, Homo sapiens
  misc_feature 1..211: note = chr5:1877818-1878029
  misc_feature 1..211: note = hyper
  source 1..211: mol_type = genomic DNA
tggcctcttctgctccgagagcctctccttccgcgtcccaaatttgggaatggcccggtcaggctcaggcccaggcggtggaggccccggcgtggcagcgccgggcttgtccatgttcccaggagtccaagttcagaagccccctctccggtgggttggcggcttcgcggtggccgcgctagtcttcctctggaaactcagtgaaaagagt

SEQ ID NO: 29380 - DNA, 354 bp, Homo sapiens; identical to SEQ ID NO: 2508
  misc_feature 1..354: note = chr5:1878223-1878577
  misc_feature 1..354: note = hyper
  source 1..354: mol_type = genomic DNA

SEQ ID NO: 29381 - DNA, 215 bp, Homo sapiens
  misc_feature 1..215: note = chr5:1878830-1879045
  misc_feature 1..215: note = hyper
  source 1..215: mol_type = genomic DNA
ggcggctctgcttccagcgggtcgaagtcgtccaagtcactaagctccagctccttctcctctttgcccacgggctctgcgggagagaatgcgtggccagtggagggagagggttggtaggtgaatcagaccccctgtccccgtccaccattatgaggcctgttcccgacgctacgaaaagcactcggggcctctcttcgcgtctcccatttcct

SEQ ID NO: 29382 - DNA, 135 bp, Homo sapiens
  misc_feature 1..135: note = chr5:1879527-1879662
  misc_feature 1..135: note = hyper
  source 1..135: mol_type = genomic DNA
ttgggacccccaagacgtcctagaaccgcagagaaggcactgtgcctgcactccagggcctcagcccccagtgacaacctcccaacccacctgcgttcttggagctcttgaggggctcctcccgcgcctcctcct

SEQ ID NO: 29383 - DNA, 36 bp, Homo sapiens
  misc_feature 1..36: note = chr5:1879689-1879725
  misc_feature 1..36: note = hyper
  source 1..36: mol_type = genomic DNA
cgtagggccgcttctcgtctgcgcacttgttccgcg

SEQ ID NO: 29384 - DNA, 503 bp, Homo sapiens; identical to SEQ ID NO: 2510
  misc_feature 1..503: note = chr5:1882419-1882922
  misc_feature 1..503: note = hyper
  source 1..503: mol_type = genomic DNA

SEQ ID NO: 29385 - DNA, 83 bp, Homo sapiens
  misc_feature 1..83: note = chr5:1883131-1883214
  misc_feature 1..83: note = hyper
  source 1..83: mol_type = genomic DNA
cgcgcagcccggcctggccgcagactcgccggtcactcgccggcggctcaggccgggaggggccaggacagtcccggccgcgc

SEQ ID NO: 29386 - DNA, 402 bp, Homo sapiens
  misc_feature 1..402: note = chr5:1883215-1883617
  misc_feature 1..402: note = hyper
  source 1..402: mol_type = genomic DNA
gtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacgctgaagatgtaatcaacagttaaaattagcccggcgctgcgcaggcggccggcccggcctcgcgctggcgcgctctgctccgagtggcaggaaggggctcgcaggcgccccgcacgcgtctcgtcactattgtttaatcgagaatcagcaacgcctcccgccggtttccaccctacgccggaatggactttcagaacccactg

SEQ ID NO: 29387 - DNA, 396 bp, Homo sapiens
  misc_feature 1..396: note = chr5:1883879-1884275
  misc_feature 1..396: note = hyper
  source 1..396: mol_type = genomic DNA
cgccggccgtgctccgccggcttccccctgcccctcgcggctaagccggggactgccgggcggccctgcgcgctcggaagagcaggttcctcaacccaggccccggcccctcccgctaagctcgtccctcccggcgccccgcagggctggctgcgagggagggggcgttgggtgcctggcggaggcgccctcccctgtccattttgcccagctttctgtctggggcgcacggagcaatcggaagaggggaccgagcgcccaccccaggactccctcggccagtaccctccctgggaccttgcccaagttcaaagcggaggccagtgagcaggcggcaagggggcggcaagggggcgcccgggccatcccgaacccgttccccgccttctgcgccat

SEQ ID NO: 29388 - DNA, 249 bp, Homo sapiens
  misc_feature 1..249: note = chr5:1884557-1884806
  misc_feature 1..249: note = hyper
  source 1..249: mol_type = genomic DNA
atataatatctgctgcgtaattgctttaatttacagatgaaaatacgagttctccgatcgcgttggaccggagcgggccacgtccgagctgcttgcagagggaaaccatcggaaataatgaatagccgctccatgcaaattattcagacagtttagcgtcggtagccgcgagaaatatataaagaacacgagtcaaatgacattaataattgtttctgaattctgtattgatttcgcggcaggccgcgt

SEQ ID NO: 29389 - DNA, 385 bp, Homo sapiens
  misc_feature 1..385: note = chr5:1885314-1885699
  misc_feature 1..385: note = hyper
  source 1..385: mol_type = genomic DNA
ccttccttccagacccggcggggcttaactggagccgaagccccagaacaggcggccattcatcttctgagcagagtctgggagaagcagcctccacttcccagggcagccagtacgtgggggccctttcgggggcttcctttgaccaccaccgccaccttctcctgttctcttttgcctttccagcctgtgtgcataaatcgacgctccagtccccaccagcgggcgaccctttctccgtgacccagaaacctggcctctgaatcggctttcccaggccgccgcacacacacgctccacttcctgcccgccagcaggccccagcgcctggggtccgggcccagtcacagtcaccctgcctcgggaagctcgcaactgcccagga

SEQ ID NO: 29390 - DNA, 42 bp, Homo sapiens
  misc_feature 1..42: note = chr5:1886035-1886077
  misc_feature 1..42: note = hyper
  source 1..42: mol_type = genomic DNA
ggtactaaatacacccgtgagcaggtgggccagaagtcagcc

SEQ ID NO: 29391 - DNA, 463 bp, Homo sapiens
  misc_feature 1..463: note = chr5:1886379-1886842
  misc_feature 1..463: note = hyper
  source 1..463: mol_type = genomic DNA
ggagggagctccttccagcccagagaagttaactccagccaaaggcgaagccgggagcccggggcaccaggcaagggcctttctttctgagacctggggccagagaccttgggggcgcctgtgcccgcccaccgctcgggacacccggctggggtgtgggtttgagaggcctcacggtcgctgacgccgcactggcgaacctcgaggttggcaggtcatttcctcacagccccgaggccccctcggagccagtggtaggagaaggagccacagggacaagcggtgaatctctggattcccaaccgccctccatgggggcccgcggccctctccctcctctctcccgctgcgcccccgccgcttgctccctgggtacggcctgaggctggacggagcgccgtccgggcgtccaggactcaggcctggccactccgagccccccaccccccgccccgcgccggcc

SEQ ID NO: 29392 - DNA, 149 bp, Homo sapiens; identical to SEQ ID NO: 419
  misc_feature 1..149: note = chr5:1886997-1887146
  misc_feature 1..149: note = hyper
  source 1..149: mol_type = genomic DNA

SEQ ID NO: 29393 - DNA, 36 bp, Homo sapiens; identical to SEQ ID NO: 420
  misc_feature 1..36: note = chr5:1887546-1887582
  misc_feature 1..36: note = hyper
  source 1..36: mol_type = genomic DNA

SEQ ID NO: 29394 - DNA, 370 bp, Homo sapiens
  misc_feature 1..370: note = chr5:1887655-1888025
  misc_feature 1..370: note = hyper
  source 1..370: mol_type = genomic DNA
cgtttgggctgccccacccagggacgcttgggccgggcgcgaagagcccggaaatagccacccttgtcgtcggcccggtttccctccgaggtcttagtatttcccccctcccccaccccccaaggcctgtggagggcgaggctgctgctccagccaaccctcggaattggctgcagggcgctcaggtcctgcctttcttcccctgcccctctcccaagcccctccgtgctaagcggcccagttctgggttctctcctggtgcccacgctagtccctagccggctcactctcaaaacagcaggctgtggcaggggcaaagcctaggtccgggcaccaggacccgggcaagtgggcgcgaatggaccacggt

SEQ ID NO: 29395 - DNA, 133 bp, Homo sapiens
  misc_feature 1..133: note = chr5:1930872-1931005
  misc_feature 1..133: note = hyper
  source 1..133: mol_type = genomic DNA
gtggtgaccaaggcccggcgcagtggccccggagcgtggaggggcagctgctgggcggcctcccgggggagggtgacggcttcacccgccaacgctgcctccctcctgggattaggccggaggaatcttggat

SEQ ID NO: 29396 - DNA, 223 bp, Homo sapiens; identical to SEQ ID NO: 423
  misc_feature 1..223: note = chr5:1931064-1931287
  misc_feature 1..223: note = hyper
  source 1..223: mol_type = genomic DNA

SEQ ID NO: 29397 - DNA, 133 bp, Homo sapiens; identical to SEQ ID NO: 424
  misc_feature 1..133: note = chr5:1931444-1931577
  misc_feature 1..133: note = hyper
  source 1..133: mol_type = genomic DNA

SEQ ID NO: 29398 - DNA, 382 bp, Homo sapiens
  misc_feature 1..382: note = chr5:1931617-1931999
  misc_feature 1..382: note = hyper
  source 1..382: mol_type = genomic DNA
cgcgcatcccgccgcccctcaccacgaagcgcagacacaggaggttgcagggtcagtgctgcggagaatcccagacggccccacagccgccgccacccgcggggcactcgcccgggctctgccgaggatgtgggggctttggtctccgcagagctgggactcccgaaggccttaccagaaactcaggagcagccccagccctgcagagcccgcgagggtggagacgggagacccgctgtggggcctgaggctgagatgccggcctgcggtgaagccggcgggacgttccaacccgctcagacccgcccactccgcagggcccgggcccaccccccggcctgtggcctgtgctgggctgcgcagccggcggtggagggacctg

SEQ ID NO: 29399 - DNA, 15 bp, Homo sapiens
  misc_feature 1..15: note = chr5:1952624-1952639
  misc_feature 1..15: note = hyper
  source 1..15: mol_type = genomic DNA
tggggcctggcaggc

SEQ ID NO: 29400 - DNA, 138 bp, Homo sapiens
  misc_feature 1..138: note = chr5:1952723-1952861
  misc_feature 1..138: note = hyper
  source 1..138: mol_type = genomic DNA
cggtgcagatcccaggagtttgtttaggagaagcggagccttgcctctggtgcttcctgtgaactacaatctgaatgacaatccggcagcccagagcctcccctggattccagggaagccgggaaaagctgcttcctg

SEQ ID NO: 29401 - DNA, 439 bp, Homo sapiens
  misc_feature 1..439: note = chr5:2038424-2038863
  misc_feature 1..439: note = hyper
  source 1..439: mol_type = genomic DNA
tgcactgttgaaaagcggcatttgcccaggcgtttcctctttacagacgagtcagtgtctttgccgtttggaaccttgtcttcactatgggatggcacttgatcgaggcggccccgcagcctgttccgcggtgctggcgtctccctctccctggcgaggctgccccgaacccctctgcaccctccctccaggtaccgcccctgggaggtccggtggggaccacggcccgcgacggccgccgcacagccacctcccggcgcgtgcagtgcgggcccggagccaacaggtggcacaaacgcatttgacttgggcatcgatcgccgcgcccgcccggggccgcacctccgccgccagcgtccctccagcccggccccgatgccgcgcaggcgcagtgctcttctctccgcgggccgggccgggtcagggtcaggatctgacc

SEQ ID NO: 29402 - DNA, 15 bp, Homo sapiens
  misc_feature 1..15: note = chr5:2038947-2038962
  misc_feature 1..15: note = hyper
  source 1..15: mol_type = genomic DNA
cgctggctccagcca

SEQ ID NO: 29403 - DNA, 314 bp, Homo sapiens
  misc_feature 1..314: note = chr5:2738816-2739130
  misc_feature 1..314: note = hyper
  source 1..314: mol_type = genomic DNA
ctcaccacccccagccgcacgcttgggcctccctcctcctgtgcctccgggaccgtctccccacctgcgggaggccaggtgtgtggctccagagaccctccacctgaactacccgctcccagagccccagtcagggccgccagaggtcgcggagggtgaagccaatgggcctggacgccgaggccggggagaggaaggagcgaggtaatggctgtggctggagaccctcttctgactccccaggctgccgggtaggcctactgtgggatgggactcaggcgaccagacgtgctctccgtcgcctccatcccggc

SEQ ID NO: 29404 - DNA, 145 bp, Homo sapiens
  misc_feature 1..145: note = chr5:2739210-2739355
  misc_feature 1..145: note = hyper
  source 1..145: mol_type = genomic DNA
cgaggggactcaacgcgctttgtagggcctgtgaaatccggcttgtcgcataagctccctgaagaagagaacaaacttcccagaccaggggcccgcggggagcggtgcagacaccgcggcaacccaccccgagcccgccggccct

SEQ ID NO: 29405 - DNA, 252 bp, Homo sapiens
  misc_feature 1..252: note = chr5:2739551-2739803
  misc_feature 1..252: note = hyper
  source 1..252: mol_type = genomic DNA
cggtggaaaagcgctgggcaggccggcctggggctttcgagctctgccgccgagcgcagcagaaatacggtgtgcaggcaggacccgaaacaggagagaccggggggaccggggaggagaggaaggctggctgtggcaggaacccgggcgctcggcacctcccctggtcccgggggccctgaacccccgccgccgtcgccgccggaccccgcgatcgtcctgaacccgggccgggcgctttcggtttcccgg

SEQ ID NO: 29406 - DNA, 175 bp, Homo sapiens
  misc_feature 1..175: note = chr5:2739860-2740035
  misc_feature 1..175: note = hyper
  source 1..175: mol_type = genomic DNA
cgggcctgaggctgagggccagggagcgaggcgagcacccggggccagccacggaggagtcccgaccaccacgggagcagggggactgggaggcaagaggtcgggggaggccggggtcagggcgggaggaacccgatgggtcccgctgcggcttcaggcgcggggtatagggtag

SEQ ID NO: 29407 - DNA, 58 bp, Homo sapiens
  misc_feature 1..58: note = chr5:2740243-2740301
  misc_feature 1..58: note = hyper
  source 1..58: mol_type = genomic DNA
aaactcatgaacaggcggccgggtctggggccgccggggcagtcgtggcgtgcggggg

SEQ ID NO: 29408 - DNA, 235 bp, Homo sapiens; identical to SEQ ID NO: 7705
  misc_feature 1..235: note = chr5:2740430-2740665
  misc_feature 1..235: note = hyper
  source 1..235: mol_type = genomic DNA

SEQ ID NO: 29409 - DNA, 43 bp, Homo sapiens; identical to SEQ ID NO: 2525
  misc_feature 1..43: note = chr5:2743617-2743660
  misc_feature 1..43: note = hyper
  source 1..43: mol_type = genomic DNA

SEQ ID NO: 29410 - DNA, 46 bp, Homo sapiens; identical to SEQ ID NO: 2526
  misc_feature 1..46: note = chr5:2743698-2743744
  misc_feature 1..46: note = hyper
  source 1..46: mol_type = genomic DNA

SEQ ID NO: 29411 - DNA, 62 bp, Homo sapiens
  misc_feature 1..62: note = chr5:2747745-2747807
  misc_feature 1..62: note = hyper
  source 1..62: mol_type = genomic DNA
gcagttagtcagaaccgaccccacagcctgctggctgcgcagaccaccgtgcacccaccatc

SEQ ID NO: 29412 - DNA, 198 bp, Homo sapiens
  misc_feature 1..198: note = chr5:2748292-2748490
  misc_feature 1..198: note = hyper
  source 1..198: mol_type = genomic DNA
ctttggcttccatctcgccctccgccctcactctgctaattctgggtcccaggagtggccccctggatcttcttcccggaccctccctcgggtctcccgggcgctccgcctccccggggctggctctccctcccctcccgggcgccgccggccgcgggccgcctacctttcttgggctcgtagccgccgcccggggac

SEQ ID NO: 29413 - DNA, 231 bp, Homo sapiens
  misc_feature 1..231: note = chr5:2748549-2748780
  misc_feature 1..231: note = hyper
  source 1..231: mol_type = genomic DNA
cgcggtgtgcagggcctcgccgggggccgcggccgcagagttgtaccgcaggagaccctggccctgcagcgccgcgttcaagttcccgtagtttgtgtagttgccgtagaagggcgacgtgtagtagagggggcggcccagcagcggcgaggcagggtagggcgagcctcctggcggtgccccggttgaggccggcgcggcggccgcgggcagccccggtggcccgcagcc

SEQ ID NO: 29414 - DNA, 227 bp, Homo sapiens
  misc_feature 1..227: note = chr5:2749180-2749407
  misc_feature 1..227: note = hyper
  source 1..227: mol_type = genomic DNA
gcacggtgggtggcacgaggggacagcgcaggcacctggagccccctccgccccctgtcctgcggcactgggccctccccacgggacccctcacctcgcccccacccggccacgtgacaggcggagcctgacctccccgggaagggcccgaggaatcgctcgctcaaatcccggcgaccccagggcaatgtggtgcggctggggctccggcccggacctggggtgtc

SEQ ID NO: 29415 - skipped

SEQ ID NO: 29416 - DNA, 128 bp, Homo sapiens
  misc_feature 1..128: note = chr5:2751854-2751982
  misc_feature 1..128: note = hyper
  source 1..128: mol_type = genomic DNA
gcgctcatctgcatattcgggggcccgcccctcccctgctccgcccgctgcagcctccgggccgcggccgggggaggggcagagagacgggagggaggcgggggagggcggaggcgacggaggcgggc

SEQ ID NO: 29417 - DNA, 322 bp, Homo sapiens
  misc_feature 1..322: note = chr5:2752120-2752442
  misc_feature 1..322: note = hyper
  source 1..322: mol_type = genomic DNA
ggagccacgtcccctgcccggctccggccggctcccaccgtccccggccaccgtcttcgcccctgcccggcccccgccccttccagccactaccccgcccccacccccttctccaccctcacggactaggcagaggccgcccgcggtcaggccaggccgggtccaattaggggactcacagcctgccccgctgtgcaccccgaggaggcccggcccctgtgtccaatccggaagtcgcagggaagtggggaggtcaggatggtggcgcccgcggctcgggtcttcctccgggcagtgcgcgcggctctcacttccacggtcc

SEQ ID NO: 29418 - DNA, 864 bp, Homo sapiens
  misc_feature 1..864: note = chr5:2752508-2753372
  misc_feature 1..864: note = hyper
  source 1..864: mol_type = genomic DNA
cggtccactccgcccagcatggacctggatccggggcgccttggttgcgaattgccaggagggccctgaggtgagctttctgcccccaaatccgcagcgcaacccccggggccctgaacgttacgactttccactgttgggaatgacgccagggcttcagctaagaagacgccgtcccctaaagagttttattttattttgtttttctaagttgactcctctttcagatttgtgttgtcaaaacactggggggatgattgttacctgacaaaccgcctctggcaggacctgaagcctcccagtcacgtcgagaacgggcaggagctcaggttggcgccgccggtgcagtgggcattacaggtagctcaggtgacgcgcggctggagtaggggggcggttgccttgcggggctcagaagcgaggcggttggcgagggttcctaggaccccagcttcctagaaccctctccccatcacgcttctccaacccttttccactcggggatggccgaagagggcgtctggctgcccactccgaagggtcacctatggggggcgctcagggggatggaagagtgtcaggtctgtgctggcctattgggagcacccacccagcaggtgcctctatcctcggaagccgtctcgggtgggtgcggtggagaagagagagcgcagtggcctggggcgggcctcagctcaggcctgcagccgactcctgcacccctgctggccctgcagcctgcggagcagccttagtgatctcaggacgcagggcatgttgcggcctccctgtggtgcggctgcagcggcgcggagggagcggagcccgggttgccagtctggtccagggcgcaagagaaacact

SEQ ID NO: 29419 - DNA, 30 bp, Homo sapiens; identical to SEQ ID NO: 7713
  misc_feature 1..30: note = chr5:2754590-2754620
  misc_feature 1..30: note = hyper
  source 1..30: mol_type = genomic DNA

SEQ ID NO: 29420 - DNA, 1283 bp, Homo sapiens
  misc_feature 1..1283: note = chr5:2755320-2756603
  misc_feature 1..1283: note = hyper
  source 1..1283: mol_type = genomic DNA
ggggacggaaggaggcgacgcaggccaggagtcgtgcgcgcgggcggcgagggggcgctgtggcccgtgtctgccggcccgagtcccggcaacggtgggcgcgacccacctcctcccccggcggcttaattcggggaagaagaaaaaacggcatcgaggcatttcaataaaacctaagcgactcctgatcctttctcattgtggttccttatgagctttcggtgtctggcggggaaacagttaccgttcgggggtgtggcaaacttttttggcaattaagatgaaacagacgcttttatgtgggtttcctttaatgaagtaacattggaaatgtaagtagtttcagtgcatcaaatcacatcgctaccgtattcgcggtcaccggccctcccgttccagggctccccgcgtttgtcgagggagagagcgaggcaggaacagggggccggggacatgagaagtttggctaagaaatttttcttttctttgaaaacaaaagcgttgttataaatggaacaaaatttaagtcaacatggaacccacatctctttcaaacgtcgtttctaggtctagtactctgtgagtaggttggactggatttcacgctcaaccggcatttctaggctctcaaagacgcttccgaggcctaaatgttttcctggaaaacacgtgcagaggagcatccgtggaagactgaaaggtccccgcagctccagtcctggcaggatgtgcaaggcctctcgaggttttcaaatgggcccccgaggcctgggagatccccgagtagccacgcgggcgccacttcagggacgcggggcggcggctactgtgggccgggagggcccccgcacgggctgctctgagcgcctggacccgggaccctgcgcgcgctcttttctttttctttcgtttctttctttcttatttataatttacattctagggacctcgtattcagctaaccagctcttgcttacttaactgccctgttttcagctccggatttctgggaggtctccccatggctaacttgtccctcccggcatcctttagcgctctgcaaaatttgccttcctcccacagatgccccgcctccgacgtgcttcctgaagtttctctcccgctcagggtgcccacaatcctgaattctccagcatctcgccgactccgtctctaccctcctctccttcctaatctcgcgctggcttcgcccttttctctctcctcctccttcctacgcgccccgccccctccccccaggtcgcacctctccccgcccgggt

SEQ ID NO: 29421 - DNA, 909 bp, Homo sapiens
  misc_feature 1..909: note = chr5:2756673-2757582
  misc_feature 1..909: note = hyper
  source 1..909: mol_type = genomic DNA
cggctctcacccggcataccgtggaaacggcgcgtcccgccagctgcggctccagcctgggagggagcgcagcgcggggagcctgcagcgtctggagagtgaggaaaagggacattccttggaaatggacagagccgagttccttaaagggatcgcagttgaaagagaccctcttcaaaatcagcaacgacctggcagccttagttcctcaacaggagatggttcgaagatgaaatgtttgaaactccgccgccgtttcacctttgcacacacgcgcacggcaggcccagatccgcacagagacgcagacacgcgcgcgctcgcgcttcccggagaggtcggcgcgtctcgctgaagctgttctggtcaagtggagttgtcagggctttgttttgtttttgttttgtcttttaaatgtgttttacaagacagtcttcagcagaacttagctccctcaaccctccgtccctccagcagctcctccgtggctctgcaatcttctgtttaaacaccagagcgcacctcggtgctggcctcggcgggggtgcggggtgcgggtcgcggggtgtgcggtcacccaggaggctgcgaagagtgcaggggtcagctccatcccgacgaaagcagataggactcctcgctcgcaagaaacactggagaaaagaaaataattcctcgagtgtttttacaattattttaatccaaccagcgaggctctaaagagcgtttgtcttgaggccgtgttgaataccctttgccaactgtaaattcggcgtgtgtgcccgaaactgctagccctgaccaggggctcggcagcacatggccaggcacacaccgaactcctccttcccaaatccttctgcaggatcctacacccctggagtatataggcagcgggaggggagggtt

SEQ ID NO: 29422 - DNA, 64 bp, Homo sapiens
  misc_feature 1..64: note = chr5:3122140-3122204
  misc_feature 1..64: note = hyper
  source 1..64: mol_type = genomic DNA
catggctgcatcccacgtgggcgacacacagtgccccagcgccaggcagcggggacaatggtcc

SEQ ID NO: 29423 - DNA, 163 bp, Homo sapiens
  misc_feature 1..163: note = chr5:3197731-3197894
  misc_feature 1..163: note = hyper
  source 1..163: mol_type = genomic DNA
tggctgcttgatttccgtagaaatcaatctaaagaacccgcggtcctgtggcgtgatttcctgggactgacttcctggagaggctactgcgggatgtgaggggctggcaggagcggccctccctggccttggccattgtctttccggagaggcattctgcccc

SEQ ID NO: 29424 - DNA, 24 bp, Homo sapiens
  misc_feature 1..24: note = chr5:3197991-3198015
  misc_feature 1..24: note = hyper
  source 1..24: mol_type = genomic DNA
cgcccggcacgagctccgtgacga

SEQ ID NO: 29425 - DNA, 308 bp, Homo sapiens
  misc_feature 1..308: note = chr5:3590350-3590658
  misc_feature 1..308: note = hyper
  source 1..308: mol_type = genomic DNA
gatgcaaacacaacacggagaggggatgtctcctgtctagagattccagggcagtttcagcttaaggctgcgggttaaggttagcgggacccgttgggaagccacagtgatcccagggctctgggtcactgcgggtgcgggtgcgggtgcgggtgcgcacagccagggatcctggcgggagccactgcggtttcagctgcatccgataggccccaagcgggaggcgattctgaggccagcgctggcccaaagaccagaggacctgagcaaaatgaaaagtcactttgttcctcacgccgtgcgcagcc

SEQ ID NO: 29426 - DNA, 100 bp, Homo sapiens
  misc_feature 1..100: note = chr5:3590803-3590903
  misc_feature 1..100: note = hyper
  source 1..100: mol_type = genomic DNA
cgtttgccggtgtacccgcgcaggcagctacacctgtactgagagaatttacatcgccttgcttcgggatggcattgatttgggacgggtgaaatacaaa

SEQ ID NO: 29427 - DNA, 325 bp, Homo sapiens
  misc_feature 1..325: note = chr5:3591123-3591448
  misc_feature 1..325: note = hyper
  source 1..325: mol_type = genomic DNA
ttacgtgtgtgcacacgcatgtaattcacttccttcgacactggggacggcgtcgtagcggcactccaggccaggccactgcggtccattcctctgccctgcgtttgtgggaaatacgggcccagtgccgcagctttagggcctgggtcgcccttggtccgcccgccgcgttcccgggtggtgtccccacgctgctgaggacctggttccgcgatgcttgccgcggggggcactccccgcagcctgcgaccgtcctgcgtccttcgcttctgggcgtttccttctggggtttccttggagcggctcgagtcgactcctcccgcct

SEQ ID NO: 29428 - DNA, 30 bp, Homo sapiens
  misc_feature 1..30: note = chr5:3591892-3591922
  misc_feature 1..30: note = hyper
  source 1..30: mol_type = genomic DNA
gcggcaggtctgtgtcgcctggttctcggc

SEQ ID NO: 29429 - DNA, 233 bp, Homo sapiens
  misc_feature 1..233: note = chr5:3592642-3592875
  misc_feature 1..233: note = hyper
  source 1..233: mol_type = genomic DNA
cgacccctagacctggttttgtcaggctcctcgtctttgtctctggcacagtgaccagggggcagccaccgggtgcggccagctccgccaggagcaacttccggagcagcggcagggcctgcctcagccaccccctttggaggcaggaaaagtggctgaggggccaacaaagtggctctctcctgcctcagaggtccagcgcctcacagctggggcgtcggtttcgaaggcca

SEQ ID NO: 29430 - DNA, 473 bp, Homo sapiens
  misc_feature 1..473: note = chr5:3594047-3594520
  misc_feature 1..473: note = hyper
  source 1..473: mol_type = genomic DNA
gaggaggttgaagatcggaaatctgtcttagggttagaaggtgtctggtggtaggctggggaacaggaaaaagctgcagttaggggcttcccggatttgtgtcaccaagaatccactccccaccaaccctcggcgtccccacaaacccagcccggaatctatgtaaaagcaggaaaggaaccctggaggttgtaggcggatcctggagtgtggaggggcgaattgagcgcgggaagcagcatgactagcaagacaatctgactcagagcagggaaaaatcaagcccgatgtcggagctggttattagtaattactaccatcacgggcattattgttgctaattataggcgatgtctcagtgtctgtcctcaggcccggaaaaccggagcccctcctgatgctgctgaagtccctgggcctcgaggctccgtgaagagagggaagcgaggcagggggtgaagggaccgcctggc

SEQ ID NO: 29431 - DNA, 15 bp, Homo sapiens
  misc_feature 1..15: note = chr5:3594777-3594792
  misc_feature 1..15: note = hyper
  source 1..15: mol_type = genomic DNA
cggagctctccagcc

SEQ ID NO: 29432 - DNA, 279 bp, Homo sapiens
  misc_feature 1..279: note = chr5:3595090-3595369
  misc_feature 1..279: note = hyper
  source 1..279: mol_type = genomic DNA
acctggtggacaaaccgggcgtccaggccacaccgtcttcccccttcgcgggggcgcgggggatgtttccctccggctgccagggggctttctgggtgaagagaaagcccctccccccgcgtctcccccacccctccctccgagaacccgcggcgccgactgcgcctgcttcccccgagctggcgacttctccgcgggatttgccctcgctcaaagtttgcacaattgaaagagcccgcagagctcggccgctccccgcttccccaagggcggcgaggc

SEQ ID NO: 29433 - DNA, 208 bp, Homo sapiens
  misc_feature 1..208: note = chr5:3595849-3596057
  misc_feature 1..208: note = hyper
  source 1..208: mol_type = genomic DNA
ggcgagggcgggcgggaggcagggagggggcgggaggggagccaggggcggggcctgcgctcaaggggatgccaatcaaagcatcaacttcaaattgtgtctgaaagccccgccgccgagcggagggcggccgccgcagtcggcgcgcgattgcggatccgggcgcagccgggagccgggcgcctgcgagcaccgggcagaggagccg

SEQ ID NO: 29434 - DNA, 170 bp, Homo sapiens
  misc_feature 1..170: note = chr5:3596555-3596725
  misc_feature 1..170: note = hyper
  source 1..170: mol_type = genomic DNA
cgggtcgcccgggagggagagactacgggtggacctggtccggaagaggaactagaaaggtccgggggcaggttcccggtggccgaggccgcggcccccggggacgcaagagggctgggaggccgggcgggtgacggctgggccatctcggcctgggaaagcggaaggcc

SEQ ID NO: 29435 - DNA, 108 bp, Homo sapiens
  misc_feature 1..108: note = chr5:3596824-3596932
  misc_feature 1..108: note = hyper
  source 1..108: mol_type = genomic DNA
cggccagggcgcccgggcaggcccacggggttcctgcaggtcggcccggcgtagcgtagcaggacttcccttcctggccgcgggttccactcgcgcggcctctttagt

SEQ ID NO: 29436 - DNA, 53 bp, Homo sapiens
  misc_feature 1..53: note = chr5:3597411-3597464
  misc_feature 1..53: note = hyper
  source 1..53: mol_type = genomic DNA
tcggtgcttaaacttcggacggctggtgaattgtgcggcgggcgcggggccct

SEQ ID NO: 29437 - DNA, 81 bp, Homo sapiens
  misc_feature 1..81: note = chr5:3599364-3599445
  misc_feature 1..81: note = hyper
  source 1..81: mol_type = genomic DNA
ccctggggtgcaccccgccaccttcgcagcccacacggcgccggcttattacccctacggccagttccaatacggggaccc

SEQ ID NO: 29438 - DNA, 106 bp, Homo sapiens
  misc_feature 1..106: note = chr5:3599502-3599608
  misc_feature 1..106: note = hyper
  source 1..106: mol_type = genomic DNA
cgagcaccgcaagaatccctaccccaccaagggcgagaagatcatgctggccatcatcaccaagatgaccctcacgcaggtctccacctggttcgccaacgcgcgc

SEQ ID NO: 29439 - DNA, 85 bp, Homo sapiens
  misc_feature 1..85: note = chr5:3600390-3600475
  misc_feature 1..85: note = hyper
  source 1..85: mol_type = genomic DNA
cgtccacctgtcccctagctgggaatgcagaggcctggctaggtgtggtagcgtggggtgcagcatgagccgggagggtaccagg

SEQ ID NO: 29440 - DNA, 21 bp, Homo sapiens
  misc_feature 1..21: note = chr5:3600732-3600753
  misc_feature 1..21: note = hyper
  source 1..21: mol_type = genomic DNA
cgtccccaggccagattcgcc

SEQ ID NO: 29441 - DNA, 137 bp, Homo sapiens
  misc_feature 1..137: note = chr5:3601025-3601162
  misc_feature 1..137: note = hyper
  source 1..137: mol_type = genomic DNA
ggcgtcgcccggcgctgcgtcccccactcacagtgcccctgtcttcttgtctcgctgtgtttcccatgcagctctctggccccgcaggagggaacgccgcggatcctagcagccctcccgtccgcctgattaagggt

SEQ ID NO: 29442 - DNA, 459 bp, Homo sapiens; identical to SEQ ID NO: 7726
  misc_feature 1..459: note = chr5:3602804-3603263
  misc_feature 1..459: note = hyper
  source 1..459: mol_type = genomic DNA

SEQ ID NO: 29443 - DNA, 167 bp, Homo sapiens
  misc_feature 1..167: note = chr5:3606268-3606435
  misc_feature 1..167: note = hyper
  source 1..167: mol_type = genomic DNA
ttaataagtttctcacgaagaaggagtctgccttaggcccacggaagtcaccacgtggcctgggactgaggaggcttcaggagcgacctaaaatgttaggattgctctaaatgaggaggcagagaaagggcggccttgaacccgggagggagcaagggatggagctg

SEQ ID NO: 29444 - DNA, 191 bp, Homo sapiens
  misc_feature 1..191: note = chr5:3606711-3606902
  misc_feature 1..191: note = hyper
  source 1..191: mol_type = genomic DNA
cgccctctccgcggctgctgttgggcttctgaagacgcagcgggtgtctctgatcccctaatccatttatccagagtcccgagcgcaatggctggtgcggggacacaacggcaggaggtggcgggggtggagggagaccgggcactcagctagcgccaccctcctcccgccccacccgagacgctgagcca

SEQ ID NO: 29445 - DNA, 45 bp, Homo sapiens
  misc_feature 1..45: note = chr5:3607103-3607148
  misc_feature 1..45: note = hyper
  source 1..45: mol_type = genomic DNA
aggtcacccaggctgcggacgccctgatagcggggtgacagcctg

SEQ ID NO: 29446 - DNA, 247 bp, Homo sapiens; identical to SEQ ID NO: 7729
  misc_feature 1..247: note = chr5:5139753-5140000
  misc_feature 1..247: note = hyper
  source 1..247: mol_type = genomic DNA

SEQ ID NO: 29447 - DNA, 425 bp, Homo sapiens
  misc_feature 1..425: note = chr5:5140031-5140456
  misc_feature 1..425: note = hyper
  source 1..425: mol_type = genomic DNA
cgagtccccagccccaaggcagggcaggagcgcgcaccggccggaggtccatgctgagcatcgcccgcgccggtgcccggcagcctctccaactgtgtggtccccgcgcgggcagagaggcacggactgcaggccgtgggcagctccatcttcccgcgtcctcctcctctggcgctgcccgctgtctcccgccttccctctgctccccgctcgcctccgcctcagcgccccgctgacctcgcctcctcccctctgctctttgtccctgcactctcccctcctcggtcctctgacccccccgccctcacctcctcccctcctctctcccctgcccgccccgcgctctcccaccgctcccgccgcccccgccgccgcggctgccactccgccccccgcgccgcacggagcttcagtaataaccccgg

SEQ ID NO: 29448 - DNA, 231 bp, Homo sapiens; identical to SEQ ID NO: 7732
  misc_feature 1..231: note = chr5:5140527-5140758
  misc_feature 1..231: note = hyper
  source 1..231: mol_type = genomic DNA

SEQ ID NO: 29449 - DNA, 24 bp, Homo sapiens
  misc_feature 1..24: note = chr5:5140849-5140873
  misc_feature 1..24: note = hyper
  source 1..24: mol_type = genomic DNA
cggagcggccgggctggatggaaa

SEQ ID NO: 29450 - DNA, 844 bp, Homo sapiens; identical to SEQ ID NO: 427
  misc_feature 1..844: note = chr5:6448738-6449582
  misc_feature 1..844: note = hyper
  source 1..844: mol_type = genomic DNA

SEQ ID NO: 29451 - DNA, 529 bp, Homo sapiens
  misc_feature 1..529: note = chr5:6583189-6583718
  misc_feature 1..529: note = hyper
  source 1..529: mol_type = genomic DNA
cccggcctagggcggcgccggcccgggactcgcgtgtctccccgcggcgccgcgcaggacccgggcctcggagcccggcagcatcccctgctggccgctgggctgaggagccgcgggaggcggggaacgcggggccgcgggggctgggcgggccggagtgcgcggtagagggggcggcgcggccggggtgcgcggtagagggggcggagcggccggggtgcgcggtaaagatggggcggcgcggccggggctcgccagcaccagccctggaaccccatgggggacctcgacaacagcgcctttgcggcgtgggcccctttctgcagctcctccacccgcgcgctgtcggctccgggacactggggctttgaagggcgccagttcccagccgcacctgcacgcctaggagggcgcaggccgcgtgtccctgtgggaggaaggccccggcaacctgcaaagacctcacgtcacagaaacttgcggcgtttgcccccgatgcgcgcgtcaggtgctccgtcccttccaggtg

SEQ ID NO: 29452 - DNA, 321 bp, Homo sapiens
  misc_feature 1..321: note = chr5:6687127-6687448
  misc_feature 1..321: note = hyper
  source 1..321: mol_type = genomic DNA
cgcttcctaataaaacggcattccaggttctagaaagcatttcggtaaaacaggctcagaaacaccagattcaagagaataaccattatatgtgaatacatttaaaaatagatcacacactctaacaactgaaatgtacagaaaagatgaaagtgcatccgttaacgtttaaatgcccatttctactgatggcattcatctgcacgctcgcacagcggagcagctaacctttaggacagcgcccggggcagagccagctcggagccagcgctgcacagctgtgaggggccggctttaggctcacaccgcctgtatctgaaa

SEQ ID NO: 29453 - DNA, 30 bp, Homo sapiens
  misc_feature 1..30: note = chr5:7394911-7394941
  misc_feature 1..30: note = hyper
  source 1..30: mol_type = genomic DNA
gggccggaccacactcgaataggaggaaac

SEQ ID NO: 29454 - DNA, 131 bp, Homo sapiens
  misc_feature 1..131: note = chr5:7395263-7395394
  misc_feature 1..131: note = hyper
  source 1..131: mol_type = genomic DNA
tatgacaggcttatacggcacctccaaagtgtgactgaagctgagcgtgcagggcgcaacggacgctgcccccgcgaggccgtggcgggggctcccagtgcagtcactgccgcttcacttccacatggtgc

SEQ ID NO: 29455 - DNA, 207 bp, Homo sapiens
  misc_feature 1..207: note = chr5:7395433-7395640
  misc_feature 1..207: note = hyper
  source 1..207: mol_type = genomic DNA
cgccctcgcagggagccccggccctctcaagagggtggagaggatgggggagccctcaaccctgctacgctgaggggaagaagggctggacggcaaaccggtgcccaccgcggggaggcgggaagggtgggaaatcctctccagctccccaaaagagtgaaaaggagggagaccccgctgtcctctgacccgcgtactaaaggaggg

SEQ ID NO: 29456 - DNA, 134 bp, Homo sapiens
  misc_feature 1..134: note = chr5:7395952-7396086
  misc_feature 1..134: note = hyper
  source 1..134: mol_type = genomic DNA
ctgagtgtgggaggccggcgggcgaggacgaccccgggccggggcgcagcgggagcccctcagttcgccactccccccaccgtacagcccccgccgtccccagcctgcagccgggccgtcgggtgggggccgac

SEQ ID NO: 29457 - DNA, 211 bp, Homo sapiens
  misc_feature 1..211: note = chr5:7396534-7396745
  misc_feature 1..211: note = hyper
  source 1..211: mol_type = genomic DNA
gcagcacccgctcatcgtcttcctgctgctcatcgtcatgggctcctgcctcgccctgctcgccgtcttcttcgcgctcgggctggtgagtggcctccccgcgggtccagcgccgcgccttccccggccctgagaggagcccggccagccgagccgcgtcccgctccgggctgcccctcggcccgcggcagcccctcggcccgcggcagcc

SEQ ID NO: 29458 - DNA, 16 bp, Homo sapiens
  misc_feature 1..16: note = chr5:7396962-7396978
  misc_feature 1..16: note = hyper
  source 1..16: mol_type = genomic DNA
ggaataggtcttcccc

SEQ ID NO: 29459 - DNA, 56 bp, Homo sapiens
  misc_feature 1..56: note = chr5:7396979-7397035
  misc_feature 1..56: note = hyper
  source 1..56: mol_type = genomic DNA
actcagccctgggcttcctgggcgagtcgctgtctcctgcccggttccactggcat

SEQ ID NO: 29460 - DNA, 30 bp, Homo sapiens
  misc_feature 1..30: note = chr5:7850282-7850312
  misc_feature 1..30: note = hyper
  source 1..30: mol_type = genomic DNA
gctgacactggtagtcgcctgagctgtact

SEQ ID NO: 29461 - DNA, 100 bp, Homo sapiens
  misc_feature 1..100: note = chr5:7850518-7850618
  misc_feature 1..100: note = hyper
  source 1..100: mol_type = genomic DNA
tgtgagctctgtccccgatccctagcggtgcagcccctcccagggcccctcctcgttgtgagctcctctctccagtccccggcggcgcatccctgccccc

SEQ ID NO: 29462 - DNA, 377 bp, Homo sapiens
  misc_feature 1..377: note = chr5:7850922-7851299
  misc_feature 1..377: note = hyper
  source 1..377: mol_type = genomic DNA
gcccagccgcccagccgcccagccgcccagccttccggtctccgcgcccagtccgcggtcctcacccgcgccgggcggtagtagtagctgtgctctttggggtccaggcgccgcggcgggatgtagctgaaggcggactgcgccgagacgggcggcggcctgggcttgccccgcagcgtggacgcggtggtctcctcctcgtcgtcctccatgccgccaccgtccagcgcccccgccttggccgcggtccgtcccgcccgcccaggggcccagtcggagtctgcaggcctcaggttgctcagcgccagcgtctagcccgcgtctgtgttcggtcgttgcctggaaaccgccgcctggcgacccggagctgccctgca

SEQ ID NO: 29463 - DNA, 150 bp, Homo sapiens
  misc_feature 1..150: note = chr5:9544685-9544835
  misc_feature 1..150: note = hyper
  source 1..150: mol_type = genomic DNA
ggactcccgcccactcgcccaggacccagcaactgcctgtggcgcctcgtcctccgagcgctcgctcgcagcgccccctgccgggaatcccgaggacgccgcaggcgcaggaaagttaaatcccaactccggccgcggcatcctggtaca

SEQ ID NO: 29464 - DNA, 43 bp, Homo sapiens
  misc_feature 1..43: note = chr5:9545077-9545120
  misc_feature 1..43: note = hyper
  source 1..43: mol_type = genomic DNA
ctggtgaaaggggctcgcctagctgcagcgcacctggctggtg

SEQ ID NO: 29465 - DNA, 76 bp, Homo sapiens
  misc_feature 1..76: note = chr5:9545555-9545631
  misc_feature 1..76: note = hyper
  source 1..76: mol_type = genomic DNA
ctgatggatcccacccgagatcggcaccacccaccagccgaccgctgcagtccccgggtcccggccagcggcgcgg

SEQ ID NO: 29466 - DNA, 124 bp, Homo sapiens
  misc_feature 1..124: note = chr5:9546564-9546688
  misc_feature 1..124: note = hyper
  source 1..124: mol_type = genomic DNA
gacgtggctgcaccccggaggggggcgccggccgagacctgagacgtggcgctccctctctgccggcctcggcttcaggtacgtgcggttccctcggctaaatctggcccgggggatggggggc

SEQ ID NO: 29467 - DNA, 97 bp, Homo sapiens
  misc_feature 1..97: note = chr5:10307612-10307709
  misc_feature 1..97: note = hyper
  source 1..97: mol_type = genomic DNA
gggaagttccttacccgtgcacgcggcaaagaccttctttgccatagtcagaacacacgcgggagttcagaggagcggggcccgggcttgtgtgggc

SEQ ID NO: 29468 - DNA, 602 bp, Homo sapiens
  misc_feature 1..602: note = chr5:10333530-10334132
  misc_feature 1..602: note = hyper
  source 1..602: mol_type = genomic DNA
ctgccgaccttagaccgcgggggtgtggggcgccggggaaggagacagaaggacaggcgccgcccagggccgcggggacacttggggctgcgtcctgggtgggcgcgatgctcccccagaacgactggagatggagagtgtcggggagggaaacgggacccacgaattcagggcgctgagtcggcggaatgcgccctgactccccctggccgagagccggctcagaatgaaagagcgcggagtgggaggtctgggaaatggcagtatttgtattagggagagaaggaaacaggagtgggagccgcacggcttggggaacgcgggagatcgcggattgcggggatagcgcagcgcggctgcccggggctgctgggaggggccggacgaggccagggcgagcggggtaactgcggccggccggacggcggcggtaaccggctgcaccgaggtggttccaccaccgcgctgggcgcttgcggttcgtctgctccaacgaaagccgcgtcccacgctccctgccgccgcgtggttttgcctcctcagaggggcagcggcgacccaggggctggcggtggatgtcaggagtgcgctttccttctagg

SEQ ID NO: 29469 - DNA, 134 bp, Homo sapiens
  misc_feature 1..134: note = chr5:10442381-10442515
  misc_feature 1..134: note = hyper
  source 1..134: mol_type = genomic DNA
ccggccgacgtgctgcggtggtccgcggggtaagcgcccttggcccggggagctgtccggtctacatgcccaagccagacgagcccagagagccctcctcccggaccaggggccttacgcggcactcagcgtcc

SEQ ID NO: 29470 - DNA, 30 bp, Homo sapiens
  misc_feature 1..30: note = chr5:10563541-10563571
  misc_feature 1..30: note = hyper
  source 1..30: mol_type = genomic DNA
cccagtcgcagcctccgggggtgagtccgc

SEQ ID NO: 29471 - DNA, 70 bp, Homo sapiens
  misc_feature 1..70: note = chr5:10564589-10564659
  misc_feature 1..70: note = hyper
  source 1..70: mol_type = genomic DNA
tggccgggaccgggccggagggcggcggggcgcgctgcatgaccccaccaccgccgtccccaccccgggg

SEQ ID NO: 29472 - DNA, 428 bp, Homo sapiens; identical to SEQ ID NO: 429
  misc_feature 1..428: note = chr5:10564800-10565228
  misc_feature 1..428: note = hyper
  source 1..428: mol_type = genomic DNA

SEQ ID NO: 29473 - skipped

SEQ ID NO: 29474 - DNA, 456 bp, Homo sapiens
  misc_feature 1..456: note = chr5:10565264-10565720
  misc_feature 1..456: note = hyper
  source 1..456: mol_type = genomic DNA
tgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagagtcagggcatagggagagccccagagccgcgggcatccacccgggtagggcaggaggcgtggaggcaggcacaggctatcctttcgttatgaccagatt

SEQ ID NO: 29475 - DNA, 518 bp, Homo sapiens
  misc_feature 1..518: note = chr5:11385070-11385588
  misc_feature 1..518: note = hyper
  source 1..518: mol_type = genomic DNA
gcgcggcgtaggtggcgccctcgggggccgagccgccgcgctgcagcttggtgggcgaaccgccctggggcgcggccagcggggagcccccgcgcggcggcgcgggcagcgtggagctggagtagtagagcgcggcggcggcggcggcgggcggcgcgtcgggcaggtggaaggcgctgcccaggctgggcgcgaacggctcccgcggcggcggcggcggcggcggcgcgggctcgggccccgccaggtggccggcgcggctggtcgtgccctgtgcccgggagaggagagaacacgcgcacttagcgagggagaagcacacggcccacccggcccagcccggccccgagagcagaggcacaccggggatgccgcgggcgcccggcggctctgcgatcccagctgcgctcggggcagtacgcgaacctgcgccccgaactctcctggggcggatttcttgtcctgacactggcacaggccagctgactactggagggaagtcacgtttgacaaatgag

SEQ ID NO: 29476 - DNA, 180 bp, Homo sapiens; identical to SEQ ID NO: 7749
  misc_feature 1..180: note = chr5:11903545-11903725
  misc_feature 1..180: note = hyper
  source 1..180: mol_type = genomic DNA

SEQ ID NO: 29477 - DNA, 293 bp, Homo sapiens; identical to SEQ ID NO: 7750
  misc_feature 1..293: note = chr5:11903821-11904114
  misc_feature 1..293: note = hyper
  source 1..293: mol_type = genomic DNA

SEQ ID NO: 29478 - DNA, 59 bp, Homo sapiens; identical to SEQ ID NO: 7751
  misc_feature 1..59: note = chr5:11904115-11904174
  misc_feature 1..59: note = hyper
  source 1..59: mol_type = genomic DNA

SEQ ID NO: 29479 - DNA, 185 bp, Homo sapiens
  misc_feature 1..185: note = chr5:11904195-11904380
  misc_feature 1..185: note = hyper
  source 1..185: mol_type = genomic DNA
cgagcgcagcgccccctgcccggctccgcgggctccacgggctcctgcgggctcctcggggctccgggcgccgccgccagccggccgggctgagagagcagccgccgcgcccgcagctccgctcagccggctgtcgccgcgggcgcgagcctggggccgccgcggcgcccggcgccgagcgctcc

SEQ ID NO: 29480 - DNA, 290 bp, Homo sapiens
  misc_feature 1..290: note = chr5:11904455-11904745
  misc_feature 1..290: note = hyper
  source 1..290: mol_type = genomic DNA
cggcgcgcggcagcctcagcctccacctaaacctcggcggccggcccgggcgcccggctagtgagggagcgtccgccccgccgccgaaaccggccccgggtgcggagcatgcccagtgccgccgcgagagcggcgcttcgccgcgcgcgttccacttctcctggttttcgcggcagcagcggcagccgcgggagagaggggaggaggccgcgggttgggagagggccgagcatccttgggaacgcacgccctggacctgagatgggtggatgctccggagctaggcgaaa

SEQ ID NO: 29481 - DNA, 30 bp, Homo sapiens; identical to SEQ ID NO: 7754
  misc_feature 1..30: note = chr5:11904962-11904992
  misc_feature 1..30: note = hyper
  source 1..30: mol_type = genomic DNA

SEQ ID NO: 29482 - DNA, 30 bp, Homo sapiens
  misc_feature 1..30: note = chr5:14142742-14142772
  misc_feature 1..30: note = hyper
  source 1..30: mol_type = genomic DNA
ggcctccccagaccccgtcatcttccccat

SEQ ID NO: 29483 - DNA, 30 bp, Homo sapiens
  misc_feature 1..30: note = chr5:15499838-15499868
  misc_feature 1..30: note = hyper
  source 1..30: mol_type = genomic DNA
ctgtcttccattttccgccccagtctccaa

SEQ ID NO: 29484 - DNA, 119 bp, Homo sapiens
  misc_feature 1..119: note = chr5:15500570-15500689
  misc_feature 1..119: note = hyper
  source 1..119: mol_type = genomic DNA
ggccccgcctggagccaccgggggtgccaggaggggacgcagcaccccctcccactggagtgcggggacctctccaggccggaggtcggccccggagcttgggggggatgtgcagctaa

SEQ ID NO: 29485 - DNA, 98 bp, Homo sapiens
  misc_feature 1..98: note = chr5:15500735-15500833
  misc_feature 1..98: note = hyper
  source 1..98: mol_type = genomic DNA
cgccgcagctatggagtgtcccgggagacggcgggcatgacggctacaggatgggcgcgaacaatggcaaacagtacggcagtgagggtgagtgggcc

SEQ ID NO: 29486 - DNA, 460 bp, Homo sapiens
  misc_feature 1..460: note = chr5:15500834-15501294
  misc_feature 1..460: note = hyper
  source 1..460: mol_type = genomic DNA
cccgtcctcagactcccggatcgcgtccctcctcccctttccctcgccctcccgactgggaagggaggttctcgcccgcggccgtgacgcaccccatttggcaccctgtctgggtcaccaccttctcctttggcagtgagtgaccagtgagtaggtcaggcgccccgaggatgcttttccactgtgggggtctctttaagcaacttcccagtttgtctttgggaaggctcaagttgcatctctgctgtgtttctgagcacatatgccttaaccttccttccctgggcatctggggtttaggagatgatggtttggcagatggcggaagacgtttttgaaaaataactcagtgaaaactttcccgggcctttgtgctccagccccctggactctactgtagcagaaaaaacttctggaaggagaagttaagtttccattctttgctcgctgctcctgctct

SEQ ID NO: 29487 - DNA, 93 bp, Homo sapiens
  misc_feature 1..93: note = chr5:16179060-16179153
  misc_feature 1..93: note = hyper
  source 1..93: mol_type = genomic DNA
taggcgtgcgctgtccgtggtgctgaaagcttgaccggcgcgagctggagccgccaccggctgcctcggggtctcgccgggccttacctgctc

SEQ ID NO: 29488 - DNA, 141 bp, Homo sapiens
  misc_feature 1..141: note = chr5:16179266-16179407
  misc_feature 1..141: note = hyper
  source 1..141: mol_type = genomic DNA
cgggctggtctccggcgccccgccgctcgcgctcgccgcccgcgccggcctcagactccccggggccgcctttcgctgctgccgcctccgggaggcgcctcggaccttccccggagtcgccggccgccgccacttcctggc

SEQ ID NO: 29489 - DNA, 100 bp, Homo sapiens
  misc_feature 1..100: note = chr5:16179554-16179654
  misc_feature 1..100: note = hyper
  source 1..100: mol_type = genomic DNA
cggggaccggggccggctctcccggcggcggcgtcggcggcggcggcgggggaggttgcgggggaggctcggcgtccccgctctccgccccgcgacaccg

SEQ ID NO: 29490 - DNA, 139 bp, Homo sapiens; identical to SEQ ID NO: 2540
  misc_feature 1..139: note = chr5:16180182-16180321
  misc_feature 1..139: note = hyper
  source 1..139: mol_type = genomic DNA

SEQ ID NO: 29491 - DNA, 399 bp, Homo sapiens
  misc_feature 1..399: note = chr5:16180371-16180770
  misc_feature 1..399: note = hyper
  source 1..399: mol_type = genomic DNA
cgcgggacccgggactgtaaccgccacttccaggccctcgctccccgcgcttggagccctcaagggcactctcagggatcctcgagagccttaaaacagaagtctctggaacctgtgtcctctccctgtctgtcccgccctcgaatccctgtgtcctcctcacccgctccctcctgcagtgagcatcccgggttgttggtaaagatcttggtgcctgggaggtcggagcttcgtctcctgaaatggtttatactagtgaaccctggcgccacgttctgtggcttataatcactttcgtcgttgccgcatgaggaagcaaatgacaccgccccttaccctggaaaagtggctgcagccttccccggatcttagttttactcaccccgaagtcaatttctc

SEQ ID NO: 29492 - DNA, 30 bp, Homo sapiens
  misc_feature 1..30: note = chr5:16934552-16934582
  misc_feature 1..30: note = hyper
  source 1..30: mol_type = genomic DNA
gaactcactgtagcccgagggtcctttacc

SEQ ID NO: 29493 - DNA, 159 bp, Homo sapiens
  misc_feature 1..159: note = chr5:16935883-16936042
  misc_feature 1..159: note = hyper
  source 1..159: mol_type = genomic DNA
ggagcgcacttacctcggtgaagaagttatccattgttccagcgcagtcccggactcgccgagtgccgctccgactcgcggaagtcagcgccgccgcgggtccggggaaaccatgcgtgtcacggcgccactcccgaggacgcgcgcccgcggggctcc

SEQ ID NO: 29494 - DNA, 37 bp, Homo sapiens
  misc_feature 1..37: note = chr5:16936738-16936775
  misc_feature 1..37: note = hyper
  source 1..37: mol_type = genomic DNA
catgtttagcagacccgggaaccggctcaacacggat

SEQ ID NO: 29495 - DNA, 333 bp, Homo sapiens
  misc_feature 1..333: note = chr5:17216805-17217138
  misc_feature 1..333: note = hyper
  source 1..333: mol_type = genomic DNA
gcatcctccgaggggcgacgtctctcgccccaccagctggacctcggcgaccgcgcctcccccgaagctgcagccttcggggctgagccccgcgggtgcgggtgcaggtgcggagccgcccaaggtgcgcaactcgtttgcagcggcgcagcccagacgcgcctgcagctggggctcaccccaacctcgctgccagccgaggtagcggaatcgtagtcgacgtcgggagcgggctggactggggtctgagaagggtagctggtgccagggggtgtcattcatcacctcgaggcagctccctaagtctgagcgagagcccgagcacttcttatc

SEQ ID NO: 29496 - DNA, 184 bp, Homo sapiens
  misc_feature 1..184: note = chr5:17217681-17217865
  misc_feature 1..184: note = hyper
  source 1..184: mol_type = genomic DNA
gaaggggagggggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccc

SEQ ID NO: 29497 - DNA, 943 bp, Homo sapiens
  misc_feature 1..943: note = chr5:17217991-17218934
  misc_feature 1..943: note = hyper
  source 1..943: mol_type = genomic DNA
cgccccgcagcccccgggctctcccttcatgcagcgggcagcagggatgtgggcccggattggacggcaagggcctggggtccctctgtgagggctccgtcgcacttcggggatcccgggtgatggggggcccagaagtgggaggcttcagccgctcgcatggtggaggggtgaggggggcggcgaggttggtaaacggagctggggggagggggctgtcggggagaggagctgcgggtgacgggaggaattgccgaatgcgaaaccccctcagtgcgttgagtcccggggagacggttctgtgggctgaagggagcgcttccgtcatcggagcccttaccagcctgggagaaagcgctcggggcgaggggcgcagcagccaaagatggagggtgggggtggggtggggcgggagtccggggagaaagaagatggggaatctggcccgatcagaaggaagtgggtggctttttgctttggcaaacgggttttctcgacccatgggactcctggatcttggttctggggccaaggaatacgaggttcacacggcgacgtgcactcagaagcacctcccgagcagatcggagccccagcctcgtcagtggcggaattgccttcctacgaacccgtgggctgcctcggagcagtttgttttttcgagcctttggttccaagaatgcgccaggcgcctccgccctgggtcccggccccggcccgggcccggggggtgtgggcttgaacctgacagcgcgcggccctaactgggctcagccccgctgggagcgtagggttggggttgagcagcttttgcccaaagcgctaaagctgaaacccggcgcccggttcctgctccccccgcccccgtcccccctccatttccagaaaaataaaaattgcggaatcctggatccgatcgcacgcacaatgcgcggctgcaaac

SEQ ID NO: 29498 - DNA, 234 bp, Homo sapiens
  misc_feature 1..234: note = chr5:17218985-17219219
  misc_feature 1..234: note = hyper
  source 1..234: mol_type = genomic DNA
cgtccccagagacatttccgccttgaaacgaactcggtggacagcccttgcccatgtaattctcactctgctgaaattagcacagcacacatgggtgcattttttaggaccttgtacaggttgacaacacctctgtctcccccgcggccactcgcactgtggggcgggctaaaacccaacactagcgtcgaaatggccttctgctatagggttgtggaccgaccccccaccccc

SEQ ID NO: 29499 - DNA, 152 bp, Homo sapiens
  misc_feature 1..152: note = chr5:22853104-22853256
  misc_feature 1..152: note = hyper
  source 1..152: mol_type = genomic DNA
gcatgcaccctgaagcgatcacacacacgcggtgcaatcccaatcaaaaacggaagccttacctgatggcagaaaaggcagctgcaggagcagcagcaccgacggccgcagcagggtgccaacagctcagccttgcgcggaaggtgagaccc

SEQ ID NO: 29500 - DNA, 30 bp, Homo sapiens
  misc_feature 1..30: note = chr5:22853539-22853569
  misc_feature 1..30: note = hyper
  source 1..30: mol_type = genomic DNA
caaaacaaaacacagcgtgcctttgacaca

SEQ ID NO: 29501 - DNA, 185 bp, Homo sapiens
  misc_feature 1..185: note = chr5:31193883-31194068
  misc_feature 1..185: note = hyper
  source 1..185: mol_type = genomic DNA
ccgcgacagcaagaacggcagagccggcgaccgcggcggcggcggcggcggaggcaggagcagcctgggcgggtcgcagggtctccgcgggcgcaggaaggcgagcagaggtgggttcgggctccgttggctatgcatacatctccctttttttttttttaattctgtagcgttgatagaagcca

SEQ ID NO: 29502 - DNA, 15 bp, Homo sapiens
  misc_feature 1..15: note = chr5:31194276-31194291
  misc_feature 1..15: note = hyper
  source 1..15: mol_type = genomic DNA
gggggcaccgggaag

SEQ ID NO: 29503 - DNA, 102 bp, Homo sapiens
  misc_feature 1..102: note = chr5:31194311-31194413
  misc_feature 1..102: note = hyper
  source 1..102: mol_type = genomic DNA
cgctgcctttctctacgccggcagaggctgccaggggagctctggcatttgcaaagttggctggtcaattaccaaagggcgctggtgcgtgcaggtcccgcc

SEQ ID NO: 29504 - DNA, 291 bp, Homo sapiens
  misc_feature 1..291: note = chr5:31639641-31639932
  misc_feature 1..291: note = hyper
  source 1..291: mol_type = genomic DNA
gtttagctacaaatccgggtgcgggaatcccagccctggcagggcggggagtgaggacgccgaaccggggtcccacgttgggcggcgcaaactcctctagcatccggccggggacggggagggcgcagcccaggggagggggctagacagagcgggaccgagacagcgggacaaccggagacgcactgccgggggtactcaagacagggccgggacctcctgctcgggcgcgcatcccgggtccccatccctgggccgtcttctggtcccttcctccgacaggagtggagg

SEQ ID NO: 29505 - DNA, 35 bp, Homo sapiens
  misc_feature 1..35: note = chr5:31854940-31854975
  misc_feature 1..35: note = hyper
  source 1..35: mol_type = genomic DNA
tgagcaggggagtggcgagccgagtttaggattgc

SEQ ID NO: 29506 - DNA, 270 bp, Homo sapiens; identical to SEQ ID NO: 7769
  misc_feature 1..270: note = chr5:31855221-31855491
  misc_feature 1..270: note = hyper
  source 1..270: mol_type = genomic DNA

SEQ ID NO: 29507 - DNA, 589 bp, Homo sapiens
  misc_feature 1..589: note = chr5:32710192-32710781
  misc_feature 1..589: note = hyper
  source 1..589: mol_type = genomic DNA
agttccattttgacccgccccgccgcgcggcggactcccgcgatgctcctctggtcacggacttctccagagccgcttccctccggtctccaccgctgctgtggctatggccagtgggaggactgggtctccgaggcaggacctttcttggagtcgcggaaccccagcacagtgcctcgagcgctccagagaaggagcggttggatctttgagcactcaggttggaggggagcgtgtgtcgtacccgggggacctaccgggaacgttttgggaaagacagtccctttatttaggtacctggtttagcaaacaaagccccgaggacgctttggggatgctttccaagctttgtgacacctccagaagttgaaccattccctcgcctttgggagcaacaagtttcactttcctgctctcagtgcgctgacagagggtccgtgagctgggacactgtgacctcggcaccgctgcgattccagcgcaaacctgcgtggcccagggggagggggctggcgcggggctgaggaaggcggggtgtaggtgacgcccgggccagccgggcacaccaggtccgcgatggagccatctg

SEQ ID NO: 29508 - DNA, 327 bp, Homo sapiens
  misc_feature 1..327: note = chr5:32711102-32711429
  misc_feature 1..327: note = hyper
  source 1..327: mol_type = genomic DNA
gggagaggcggtgatcgcacaggcacgcggcgtggtgggggctcttgccggtgcagacgtgggcgatttcagctttaaggaaaaggcagagggcctgcggggagtggtggttagggacaggggcgcgatgggtagtgaaggggtgcagggaggagccctgatgtaagaatgttaatgagagactcccccagcccagcccccacatctccccacccccacccaccccacccgctggaaacacaagcccggcctcggcgcgccatgtgtggtaacacgctcagccgctgccacgctatttaaacgcgggctatggatccaggaaccggc

SEQ ID NO: 29509 - DNA, 49 bp, Homo sapiens; identical to SEQ ID NO: 7773
  misc_feature 1..49: note = chr5:32711430-32711479
  misc_feature 1..49: note = hyper
  source 1..49: mol_type = genomic DNA

SEQ ID NO: 29510 - DNA, 117 bp, Homo sapiens
  misc_feature 1..117: note = chr5:32711753-32711870
  misc_feature 1..117: note = hyper
  source 1..117: mol_type = genomic DNA
tctattttgttaaagcgcccaagggggcgcagggaccttggagagaagagtggggaggaaagaggaagggtgggtggggggcagagggcgagtcggcggcggcgagggcaagctctt

SEQ ID NO: 29511 - DNA, 25 bp, Homo sapiens
  misc_feature 1..25: note = chr5:32712077-32712102
  misc_feature 1..25: note = hyper
  source 1..25: mol_type = genomic DNA
ttgttttcactcacccgggtgcggc

SEQ ID NO: 29512 - DNA, 563 bp, Homo sapiens; identical to SEQ ID NO: 2546
  misc_feature 1..563: note = chr5:32712289-32712852
  misc_feature 1..563: note = hyper
  source 1..563: mol_type = genomic DNA

SEQ ID NO: 29513 - DNA, 502 bp, Homo sapiens
  misc_feature 1..502: note = chr5:33892054-33892556
  misc_feature 1..502: note = hyper
  source 1..502: mol_type = genomic DNA
gggtgcatggtcaggcgcgagaaggcagcgactgcaaagctgcccgcgatctccctgtgcttttttaagcagaaaggagctagacacctttttcccctccctcctcctaaaaggggagtgattcagctgacagtgtccgctttcggcggggtgtggaatgggccagagcgggagggcgcagcccaccccggtccccacccctccgcctcccgcatgccccgcggcctcgcagcccgcccgctcggtgcatcttcctcccggactcccacccccgcgctcctccggccccgccccgaacgccaggcccagctggccgagccggccaaataggggagacccgggagagccgccctgggaggcactggaggaagctgcgagtgagaggcccccaggccagccccccggcgtgcttaaatacaagctcaaaatgaggagaacagagttgaggcagaggggggccccactccctccatccttccgcgctcagcgctgccccctcccc

SEQ ID NO: 29514 - DNA, 24 bp, Homo sapiens
  misc_feature 1..24: note = chr5:33936208-33936232
  misc_feature 1..24: note = hyper
  source 1..24: mol_type = genomic DNA
cccctcgcggcgccccgggattac

SEQ ID NO: 29515 - DNA, 129 bp, Homo sapiens
  misc_feature 1..129: note = chr5:33936233-33936362
  misc_feature 1..129: note = hyper
  source 1..129: mol_type = genomic DNA
catgctccttggggcccgccgccttggccgtgcaagtgccaccgtaactggtgagagccgctggcaacccacccggagttgacaaccgcggagagacgcagacacccactgacctccaggaagctgagc

SEQ ID NO: 29516 - DNA, 327 bp, Homo sapiens
  misc_feature 1..327: note = chr5:33936363-33936690
  misc_feature 1..327: note = hyper
  source 1..327: mol_type = genomic DNA
tggtggatggaactctacgatctctttctctccaaggacggaaacctcatccaagcagtcccagaggaaacggataaaggtatttgaaagggagcgagcggccccaaatcgcacaattgagcggctgggggagttatgcgccagtgccccagtgaccgcgggacacggagaggggaagtctgcgttgtacataaggacctagggactccgagcttggcctgagaacccttggacgccgagtgcttgccttacgggctgcactcctcaactctgctccaaagcagccgctgagctcaactcctgcgtccagggcgttcgctgcgcgcc

SEQ ID NO: 29517 - DNA, 37 bp, Homo sapiens
  misc_feature 1..37: note = chr5:34655873-34655910
  misc_feature 1..37: note = hyper
  source 1..37: mol_type = genomic DNA
ccaattggttcagtccggagaacgtgagcacattcta

SEQ ID NO: 29518 - DNA, 30 bp, Homo sapiens
  misc_feature 1..30: note = chr5:34656932-34656962
  misc_feature 1..30: note = hyper
  source 1..30: mol_type = genomic DNA
atgaatgagcagacccggagatgcaccctg

SEQ ID NO: 29519 - DNA, 41 bp, Homo sapiens
  misc_feature 1..41: note = chr5:35230049-35230090
  misc_feature 1..41: note = hyper
  source 1..41: mol_type = genomic DNA
tgcctttgacaaaggcgaatgcgagccgagtgcagtttgta

SEQ ID NO: 29520 - DNA, 30 bp, Homo sapiens
  misc_feature 1..30: note = chr5:36607079-36607109
  misc_feature 1..30: note = hyper
  source 1..30: mol_type = genomic DNA
aggatcaaggttgagcggatctgcttaaaa

SEQ ID NO: 29521 - DNA, 133 bp, Homo sapiens; identical to SEQ ID NO: 7780
  misc_feature 1..133: note = chr5:36690192-36690325
  misc_feature 1..133: note = hyper
  source 1..133: mol_type = genomic DNA

SEQ ID NO: 29522 - DNA, 30 bp, Homo sapiens
  misc_feature 1..30: note = chr5:37371493-37371523
  misc_feature 1..30: note = hyper
  source 1..30: mol_type = genomic DNA
aggtgggagctaggtcgtgtgtctggccta

SEQ ID NO: 29523 - DNA, 122 bp, Homo sapiens
  misc_feature 1..122: note = chr5:37834615-37834737
  misc_feature 1..122: note = hyper
  source 1..122: mol_type = genomic DNA
cgcaccccttgcccacgggtcggtaggccacacagccatcaggctggcttggggtacgtgcggggctggctgcgggtgggggtgcgagggggtccgccggcggcccccccgcggggagggaa

SEQ ID NO: 29524 - DNA, 2308 bp, Homo sapiens
  misc_feature 1..2308: note = chr5:37836649-37838957
  misc_feature 1..2308: note = hyper
  source 1..2308: mol_type = genomic DNA
agctaggttctgggtcgcgatgtgcagacacaggaaaactgcaccaggccatgcaaaatgagcccagaaaggtactttggcagctaggacctggggaacgcgagcttcccccctcaagccccccgccggtgccagctcccgggtgcgtgcgaaatggctggcggtccgaccggaggagcatggaggcgcggggttaatgcgccattccaaatcgcggtgcccgccagcaggaagccacagaggcactagatttcccttccgtcttaagagggttttcccttttttcctgcttggccgacggagggctttttaaattggacgtggagatcctcaattagaagtgtggcgaagctggcaaaagactacacagtggaaaactccccgcgtcgccagaggaggctcccggctgcggttcccgccctcggccgagcgccgccagcgcccggatcgagctcccctcttcccccgggacagggagggcgcattcttccctctgagcgccgccgggaccggctccagtccgaggggctctttcgttctcggtatttgctgggcgggggaaaaggggggaggttgggggactcggcacacacagcgtctactaggacgtttttcttagagtccgtgtgggctccacccctcggcttctcagtttgtctctctatcgctttcccaaaacacatctacatctgcccgacgcgcttctcctcaaccatgggcctttgcccgcggtgcaaactgctttacgcgccgccacgtgcgagaaccaagctctgctcctcaagtgacgggggctctgctctgccaggtgaccgcgcaccatttctcgtgcctggcaagctggtccccttctgggtccgggaccaccacgtcccggcagggcaaaagcagcaggccgtgggcgccggcacctgtgggtccccaggcctggggaggcaaggacgcccaggaaagccacagaagtgctcgcagaagcagccgctcgccgcgaggcacttctgagttcccggcagcagggggcaccagaaaccgtctgagccgtgtcgcgcccacgcggcccggaggctgtgttatcattttagttataaaaccggagaaccaccactccctctacgagcctcccgaaatcccattagcccgggaacctgtggaggtccttactggcatctctgcttttcaggctcccacccctccattctcgctggttttcctctccccacttcacctgagcgggtttcttggcaacctgctttcagaccatccctcaccccttccacgcgtcaccgtgacagattcgcaggaggcagcgctcccgccgtcagtgcccccgcaccttcttgtgcctggcaggctgggaggtttgtttgggctttgccttcaagatccaggtctcagagagagaaaaaggaggcggtggggcggggagacgggtttgctataaactcggtttttttttttttttttttggcggggggaggtagagacagaaattgctggaagatctattgcttttcttaactatgcttcgtgtccttgactgacagaggacttattctcccctcaaccccccataactgcggggcccaagatgagggaaggaaaaagaatttgggacacttctcgcaggcaaactgggaaagcggtctgtttaaagggccaggttccaggcccgagagcacccgaattgctagcgggaaagggctagggacacggcggacttcccagagatcggacacttgttacttgttgaaaaggcgccaccttccctgacaaagcgaaggcgcagcgaaacagtacgagtttggtcgaggccggctttgacggctttgcgggactgggtgcgtgaatgaggttggaagaaacatctcttccttgaaatacctaagcatatattccaaacactgagcaagagtcgagcgcgttctaacatctccgcagcaggggccggaagagttgcctttgtccccgcctatgagcagaagggtcgcgagctctgggatgggtaagccccccgggggcgcgcacatgggtcctggcggcggattctaccaaagccgaaactagctgggccccaggaagctggcgggaacccgcgaaagtccgtttccagcccgaagagggttcgtttttcttcgttggggcaggaaacaaaccaccagtgcggaattagcctcgaggtggtgtaaagtagtggcagtggtggtggggtgtttttggaaggcggcacagagtacaggagaaaaaggggtcattaaaataataacctcaatggcctagtggagtctcaagaatacgttcgagacagaga

SEQ ID NO: 29525 - DNA, 499 bp, Homo sapiens
  misc_feature 1..499: note = chr5:37839237-37839736
  misc_feature 1..499: note = hyper
  source 1..499: mol_type = genomic DNA
cgacggcggtgggttcgaagatgacccaagccctgaatcgttctgtgacttgacggaagagcacctggccgagtcggggaaggaaactgcccctcttgggcattccgggtccaggcgcatctggggctccacagatctttgcccacgtggaaaaggcaacatgcccctccgaaaggccggcctctctccggttctacttttctctctcctcgcatagcttaggttccctctagtctttccactttctactctcaccgtttgctctggggtccagacgcacccctctgactagggcgcccttcagccggccgcacccacccgcgacgcaggcaccacccgctccctgctccccggcccgctccctcacttacctcggatcgggtctccgcagaccctaggttggacattaactccaggtgccccaagtcccagccaggagacccatccgggctgatggctggagcgcggagccccgcccaacaggtcaggggcaagagtt

SEQ ID NO: 29526 - DNA, 268 bp, Homo sapiens; identical to SEQ ID NO: 2549
  misc_feature 1..268: note = chr5:37839807-37840075
  misc_feature 1..268: note = hyper
  source 1..268: mol_type = genomic DNA

SEQ ID NO: 29527 - DNA, 144 bp, Homo sapiens; identical to SEQ ID NO: 2550
  misc_feature 1..144: note = chr5:37840076-37840220
  misc_feature 1..144: note = hyper
  source 1..144: mol_type = genomic DNA

SEQ ID NO: 29528 - DNA, 96 bp, Homo sapiens; identical to SEQ ID NO: 2551
  misc_feature 1..96: note = chr5:37840267-37840363
  misc_feature 1..96: note = hyper
  source 1..96: mol_type = genomic DNA

SEQ ID NO: 29529 - DNA, 210 bp, Homo sapiens
  misc_feature 1..210: note = chr5:37840529-37840739
  misc_feature 1..210: note = hyper
  source 1..210: mol_type = genomic DNA
ggtgcagggcagcgccgggctttcctcgcgcctgtcgaaggccggccttcccgctcgggtgtctcgccctctcgcttctccgcagggcaggaggcagtggcgagaaaaggagctgccggccggagttctagcaccgagaaggagaggtgcggagcggccgggtgagggaagccgagtatttgccaggggacgctgcgagtggggatgaat

SEQ ID NO: 29530 - DNA, 97 bp, Homo sapiens
  misc_feature 1..97: note = chr5:38257444-38257541
  misc_feature 1..97: note = hyper
  source 1..97: mol_type = genomic DNA
tgtgaagagccaggacgcccaccgagtcctggcagcgttgcaaggtggggagggggcgggcgcggtcctgtcgctagtgactgcagatttcctctgc

SEQ ID NO: 29531 - DNA, 367 bp, Homo sapiens
  misc_feature 1..367: note = chr5:38257542-38257909
  misc_feature 1..367: note = hyper
  source 1..367: mol_type = genomic DNA
gggcacttcctacggcctttgatctttccccaggaactgccgagggccgcgtttgcctctaagtttattccctcttggtttatttattgtatctgctttctcttctcgctggtttggaggtcagaacgccagtatgcaacgggacttgtgtcccaggcagggtctcccctctccaggcactaccgcgaaatctggcaaaaggtacattttactgagtcctagggcagcaaattcagcggcggagaaagagtctttctccattcaggagacaacccaggaagcccgatcccgggatcagaggccaggaccccgccccggccccctgccccaggcccagctgggcgccgcccaggggcttttctcggtc

SEQ ID NO: 29532 - DNA, 15 bp, Homo sapiens
  misc_feature 1..15: note = chr5:38257944-38257959
  misc_feature 1..15: note = hyper
  source 1..15: mol_type = genomic DNA
cgccaggcttaactt

SEQ ID NO: 29533 - DNA, 496 bp, Homo sapiens; identical to SEQ ID NO: 7793
  misc_feature 1..496: note = chr5:38258174-38258670
  misc_feature 1..496: note = hyper
  source 1..496: mol_type = genomic DNA

SEQ ID NO: 29534 - DNA, 287 bp, Homo sapiens
  misc_feature 1..287: note = chr5:38258671-38258958
  misc_feature 1..287: note = hyper
  source 1..287: mol_type = genomic DNA
ccgacctcccggctgcagtcctacctcttggaactacccgtgtttccgggcccagccctcgcagccccccacctcctcgccccggcccggggatccgttggggccgcgtcccccacgcgcccccggagacgccctttccgtgtgcgcccgggacttggtgaaactttgcaggcgccggctgcgaaatggatttaatccgaggcgtcttgctccggctcctgctcctggcttccagcctcggacccggcgcggtgtcgctccgagcggccatccgaaaaccaggtaat

SEQ ID NO: 29535 - DNA, 111 bp, Homo sapiens
  misc_feature 1..111: note = chr5:38556250-38556361
  misc_feature 1..111: note = hyper
  source 1..111: mol_type = genomic DNA
agggtgacccaagggcgcgcggagagcggcgggacccggagcggcgctctccggggtcactcccctaggacgctccgcagagctgggagcgctgccccaccccgcccgggc

SEQ ID NO: 29536 - DNA, 24 bp, Homo sapiens
  misc_feature 1..24: note = chr5:38556411-38556435
  misc_feature 1..24: note = hyper
  source 1..24: mol_type = genomic DNA
cgcccacccgcccccaggactcac

SEQ ID NO: 29537 - DNA, 238 bp, Homo sapiens
  misc_feature 1..238: note = chr5:38556436-38556674
  misc_feature 1..238: note = hyper
  source 1..238: mol_type = genomic DNA
gtacgctcccgcgccgctatcttgccatcccctgccgccggctctgtagcctcggccgccgccccggggctgcccagatcccacagccgcccgggggcaggagccgccaaggagggggccgggcacaatgcgccgccgcctccgcagccgccgtctcgcctcccctgtgtcggcgcgaggctgcttgaggcggccacgggcgaagggcggcccgctgcgctccgcgaaccccgcgggc

SEQ ID NO: 29538 - DNA, 134 bp, Homo sapiens
  misc_feature 1..134: note = chr5:38556773-38556907
  misc_feature 1..134: note = hyper
  source 1..134: mol_type = genomic DNA
cgccgctcggctgggggcgcagcgggcccggccccgcccctgacccgcccctgcccccggccccggccccgccccaacccgcgcgcccccgccgatccccggccgcgcgcccgcgcgcgcgggtgctccaagga

SEQ ID NO: 29539 - DNA, 51 bp, Homo sapiens
  misc_feature 1..51: note = chr5:38557292-38557343
  misc_feature 1..51: note = hyper
  source 1..51: mol_type = genomic DNA
tggggctcccctgcccgagatggccagcgggcgcgccgagagtatcctgga

SEQ ID NO: 29540 - DNA, 38 bp, Homo sapiens
  misc_feature 1..38: note = chr5:38845834-38845872
  misc_feature 1..38: note = hyper
  source 1..38: mol_type = genomic DNA
cggagcctcggccgccgagttttcggtttccaagtttc

SEQ ID NO: 29541 - DNA, 560 bp, Homo sapiens
  misc_feature 1..560: note = chr5:39425003-39425563
  misc_feature 1..560: note = hyper
  source 1..560: mol_type = genomic DNA
gccggccgggagcttcggagccgcgcggccactcccggcgagagatatggttctaatcagatgctggcagctgaggactccccaggaatgtgccaggatgtttttgctgcctgggcttggtaactccccctcaacgtgtctgcagagtcttccaaacttaactgtttattaactcgcgctgcagcggcgcagaggaccccgctcccctgagctccgcgagccccaccagctgggggcgatcgcagggacccagcgacgggaggggaaatgtgttcggggagaagtcaaaagccccagaccgacgcgggcggggggcgggtgcaaataaggacaggaaagggaagctctggaggaaaggggtgggatccaccgagcttcgtttcacagatccgttccctggattgccactgcgagtgatgtggcacacggagtcatcctaaccaacccgttggggccctttgaacaaaggactgcctttactcctgacttttctgacaagggacaacggttcctgcgcagatctgcagtttctaaagttgatcgcgcgattggatttgctc

SEQ ID NO: 29542 - DNA, 70 bp, Homo sapiens
  misc_feature 1..70: note = chr5:40680557-40680627
  misc_feature 1..70: note = hyper
  source 1..70: mol_type = genomic DNA
tgccaccgctgctgccgctacaggtgagatggcgttgggctgacgttggggtcaacgggtagagaacgca

SEQ ID NO: 29543 - DNA, 78 bp, Homo sapiens
  misc_feature 1..78: note = chr5:40681150-40681228
  misc_feature 1..78: note = hyper
  source 1..78: mol_type = genomic DNA
gcccagtgaccatcccggcggtgatgttcatcttcggggtggtgggcaacctggtggccatcgtggtgctgtgcaagt

SEQ ID NO: 29544 - DNA, 579 bp, Homo sapiens
  misc_feature 1..579: note = chr5:40681261-40681840
  misc_feature 1..579: note = hyper
  source 1..579: mol_type = genomic DNA
cgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgc

SEQ ID NO: 29545 - DNA, 14 bp, Homo sapiens
  misc_feature 1..14: note = chr5:40682069-40682083
  misc_feature 1..14: note = hyper
  source 1..14: mol_type = genomic DNA
gcctttaggtcggg

SEQ ID NO: 29546 - DNA, 34 bp, Homo sapiens
  misc_feature 1..34: note = chr5:41510835-41510869
  misc_feature 1..34: note = hyper
  source 1..34: mol_type = genomic DNA
agcttttgttcctgacgtccgtgctcagctctct

SEQ ID NO: 29547 - DNA, 38 bp, Homo sapiens
  misc_feature 1..38: note = chr5:42423455-42423493
  misc_feature 1..38: note = hyper
  source 1..38: mol_type = genomic DNA
tgctttcatttggaacgggcaggcggagaggaaggaag

SEQ ID NO: 29548 - DNA, 30 bp, Homo sapiens
  misc_feature 1..30: note = chr5:42423828-42423858
  misc_feature 1..30: note = hyper
  source 1..30: mol_type = genomic DNA
agctgccaagcagggcgcagccatgggaag

SEQ ID NO: 29549 - DNA, 487 bp, Homo sapiens; identical to SEQ ID NO: 7800
  misc_feature 1..487: note = chr5:42424672-42425159
  misc_feature 1..487: note = hyper
  source 1..487: mol_type = genomic DNA

SEQ ID NO: 29550 - DNA, 88 bp, Homo sapiens
  misc_feature 1..88: note = chr5:42950080-42950168
  misc_feature 1..88: note = hyper
  source 1..88: mol_type = genomic DNA
cataagaagcggagtcgccagacagaacccgggacctggcagcagcaagtctgagaccgagatcggctccccgcgtcctgagcatgca

SEQ ID NO: 29551 - DNA, 274 bp, Homo sapiens
  misc_feature 1..274: note = chr5:42951038-42951312
  misc_feature 1..274: note = hyper
  source 1..274: mol_type = genomic DNA
attgtgactattccacgacttgaacaaggggtagaaatcgcaggcaccgcgaaatagaaacttcctaggaccaagaagccaacgacgcccgaaaccgtggggtcctgtcacagaaaccccagcagcgcagccaccggactgggttctggaggccgagccgcagtccgtgcggcggcgctgggaagagaaggcgccccggcagctcccctgccaccggccccgaggagcggctggctcccccagcccagcgccgccgccgcccggtaactccagg

SEQ ID NO: 29552 - DNA, 693 bp, Homo sapiens; identical to SEQ ID NO: 433
  misc_feature 1..693: note = chr5:42951419-42952112
  misc_feature 1..693: note = hyper
  source 1..693: mol_type = genomic DNA

SEQ ID NO: 29553 - DNA, 457 bp, Homo sapiens; identical to SEQ ID NO: 434
  misc_feature 1..457: note = chr5:42991785-42992242
  misc_feature 1..457: note = hyper
  source 1..457: mol_type = genomic DNA

SEQ ID NO: 29554 - DNA, 180 bp, Homo sapiens; identical to SEQ ID NO: 435
  misc_feature 1..180: note = chr5:42992375-42992555
  misc_feature 1..180: note = hyper
  source 1..180: mol_type = genomic DNA

SEQ ID NO: 29555 - DNA, 42 bp, Homo sapiens; identical to SEQ ID NO: 436
  misc_feature 1..42: note = chr5:42992556-42992598
  misc_feature 1..42: note = hyper
  source 1..42: mol_type = genomic DNA

SEQ ID NO: 29556 - DNA, 243 bp, Homo sapiens
  misc_feature 1..243: note = chr5:42992782-42993025
  misc_feature 1..243: note = hyper
  source 1..243: mol_type = genomic DNA
cgctgggctaggggagcccgccgctcctccaagccggtgacaggggagctgcccgggcgccgtctcttcccagcgccgccgcagaacccgcagaacagctcgacctccagaaccctgtgctgtggcggcggggctggcgtgtctgtcgcaggaccccgcagattcgtctgtcgttggcttgttggtcctaacaagtttcgatttcagggtgcctgcgtttctttttcttttctcttcttttcc

SEQ ID NO: 29557 - DNA, 240 bp, Homo sapiens
  misc_feature 1..240: note = chr5:42993325-42993565
  misc_feature 1..240: note = hyper
  source 1..240: mol_type = genomic DNA
tacgatttctatcccctggttcaagtcggggaatagccaaaatgtgatttctcaacccaagcaagtacccacttaggacaaacaccagcctagccctggcggcgatttctaggtcgtaggaagtcgatgtttcgccacagaaaggctgagtgaccctgtgactcatttcccagcaactccgggtttcctgtagcctaatcataacaaacgcagagttagccctgcctcaagtttcttttt

SEQ ID NO: 29558 - DNA, 280 bp, Homo sapiens
  misc_feature 1..280: note = chr5:42993865-42994145
  misc_feature 1..280: note = hyper
  source 1..280: mol_type = genomic DNA
aagtcgtggcaagttccggcttcctactagtacggcttgctttagctgcgcaggagatgttcaactcctgtagaaatctgtgtaccagcgaatgcgattcatttaggtttagcgatgaccagtttagcagtgcctgggagctcttacaccaaggctagctgcgcaacatcaagtcccgccttagctatgttggtgttttttaaactcccatggaagtcaggaaatgccggcaaaagcgatttctggtttacgaagctcggtttgacgatagcaatttccg

SEQ ID NO: 29559 - DNA, 53 bp, Homo sapiens
  misc_feature 1..53: note = chr5:42994670-42994723
  misc_feature 1..53: note = hyper
  source 1..53: mol_type = genomic DNA
gctctgcttctaatgcggagctggcggttttgcagcaacgcttttgccagtag

SEQ ID NO: 29560 - DNA, 679 bp, Homo sapiens; identical to SEQ ID NO: 7809
  misc_feature 1..679: note = chr5:43007818-43008497
  misc_feature 1..679: note = hyper
  source 1..679: mol_type = genomic DNA

SEQ ID NO: 29561 - DNA, 199 bp, Homo sapiens; identical to SEQ ID NO: 7810
  misc_feature 1..199: note = chr5:43008737-43008936
  misc_feature 1..199: note = hyper
  source 1..199: mol_type = genomic DNA

SEQ ID NO: 29562 - DNA, 224 bp, Homo sapiens; identical to SEQ ID NO: 2563
  misc_feature 1..224: note = chr5:43017953-43018177
  misc_feature 1..224: note = hyper
  source 1..224: mol_type = genomic DNA

SEQ ID NO: 29563 - DNA, 384 bp, Homo sapiens
  misc_feature 1..384: note = chr5:43018326-43018710
  misc_feature 1..384: note = hyper
  source 1..384: mol_type = genomic DNA
cgtcctccagtgccggggtcatggtcgcagcacccggcgttcccgttggctcttttgccgctgcgcggagccggcggtttttctgtcacagcacttgtacggagtttctcggcggccgaacgtctctttttttctcagagacgacggtttcttggtgacagtaccgttggttgcgccgtaacgaatgttctccttgacagccccaccagctggcgtcactcgcaggctccagacgccgccatttcgccaagccgaggtctcttggttgcggcactgcttctggctcggtgcctgtattttctcggtgcctacagcgcccaggtcgccgatctgagggcttcggagtaccggccgggcgcggtggctcacgcctgtaatcccagc

SEQ ID NO: 29564 - DNA, 337 bp, Homo sapiens
  misc_feature 1..337: note = chr5:43019010-43019347
  misc_feature 1..337: note = hyper
  source 1..337: mol_type = genomic DNA
atgcgattttttttaggtttaccgatgatcagtttagcagtgcctgggagctcttataccaagtttgttttcgcaatattgagtcccaccttagctaagcttgtgtgtattttaaactcccatggaagtcaggaaatgtccgcaaacgcgatttctggttaccaagctccgtttggcaatagcaagtcctgccgaacgcgactttttcctcttgtggaccaagtctgaatagaccagctactgcgatttttaagtcgtagtaaaaaaggtttaaccgtgactgcttttttttgttggtgttgtttgtttttgtttttgttttcgtaggaaatgtaga

SEQ ID NO: 29565 - DNA, 237 bp, Homo sapiens
  misc_feature 1..237: note = chr5:43019650-43019887
  misc_feature 1..237: note = hyper
  source 1..237: mol_type = genomic DNA
ccggggagccgagctcggtctcagtctccctgctgtcaggtgccaggttgtgtctggtggctctccttcgtatgcggagctgatggttttgcatcagcgcttttgccagtagagccgactagcgttttctcagttacggcaccgttcttagcgcccagtgtgacgtttcccattcgccaggtccttatgttctctgtgctgtcactttcttggttctcgcaccgctagtatctgcta

SEQ ID NO: 29566 - DNA, 166 bp, Homo sapiens
  misc_feature 1..166: note = chr5:43040862-43041028
  misc_feature 1..166: note = hyper
  source 1..166: mol_type = genomic DNA
acacaattactagtgcgaacagcggctcggtgcaatcaccgttctgcacggcaaaacggggttcaggaagttcctaggagatactagcggttgtaggagcgaaaaagtgacagcactgagaacctaaggaccccgcgaacgggaaatgtcacgttgggtgcagcaa

SEQ ID NO: 29567 - DNA, 32 bp, Homo sapiens
  misc_feature 1..32: note = chr5:43043256-43043288
  misc_feature 1..32: note = hyper
  source 1..32: mol_type = genomic DNA
atggtggggggcacccgcgaaattgtgaaacc

SEQ ID NO: 29568 - DNA, 267 bp, Homo sapiens
  misc_feature 1..267: note = chr5:43191854-43192121
  misc_feature 1..267: note = hyper
  source 1..267: mol_type = genomic DNA
aacctaaaccctgcccgactcacccggaggagctgtcacggtggtttgctggaaaccccctttctgttgggaggattactgggtcacggtttcccaaggacatggaaacccttgctgaagcgctggaaccgctcggcacgaggcgtacgtcggtgggagctgtgtcagcccgctttcggccgtgtagctgctcccatccagactctagaaggggtcctctttgcgtcaggcccaatcacccccctccccgagcgactgcactgggtg

SEQ ID NO: 29569 - DNA, 682 bp, Homo sapiens
  misc_feature 1..682: note = chr5:43192458-43193140
  misc_feature 1..682: note = hyper
  source 1..682: mol_type = genomic DNA
gcgcgcctagcctggcgccgtgcagcgaagcccaagagctggcctcgccacgaaggtaagcgaggggctgggggactcgccgccagcacccccaccccgccacccttcctctgctaggctgcagacctgggtggctgaggaggaggcgcctctcctccccgcgacccaaggaagaaaggaagccctgccacggggtgtctgcgaagtggggtcagaagaaggttaggcgctttctggggcgtacccccacacctgcccaggccgatccgcaagcgagaggagggggcattagagccagggcgagagcgtgctcgcgcgtgtgtgcccgtgtcatgtgtggtgcccgtgtcatgtgcggcgcccatgtctatgtgcgcgcgtgtgtgcacccatgtctctgtatggtgtggacactcgtgtctgcgtgcgcgtccacacgtgagccgaggagcgcagcttagcgcctagcgttgcgcacagcgggtgcgctggaccagagccctaaggcaccagaccaaatctggagcgtttgttacaagggcagaagaccggcgtgatctccccacgcgcgccggccggtgctgctggtggagagaactgacatctaacgcatgtggcccaggagaacaaaaccttccattgcaccccacgccgcgactctccccagcgaaaggtgcttctt

SEQ ID NO: 29570 - DNA, 261 bp, Homo sapiens; identical to SEQ ID NO: 7818
  misc_feature 1..261: note = chr5:43396969-43397230
  misc_feature 1..261: note = hyper
  source 1..261: mol_type = genomic DNA

SEQ ID NO: 29571 - DNA, 160 bp, Homo sapiens
  misc_feature 1..160: note = chr5:43397305-43397465
  misc_feature 1..160: note = hyper
  source 1..160: mol_type = genomic DNA
gcacgcctggacccgggggagccggctggggcgcccaggaccaggcctagcctaccgcgggctgcccttcacagagctgcaggagaaaacgttgtattgtgcacgcattccctaacccttactagtttttttttttttaattgatcggccagcttttgat

SEQ ID NO: 29572 - DNA, 369 bp, Homo sapiens
  misc_feature 1..369: note = chr5:44388243-44388612
  misc_feature 1..369: note = hyper
  source 1..369: mol_type = genomic DNA
gggatgtgaagggagcgcgcttaggggaggggatgcggcagcacaatgtatacacgggggttggggggtgaattagtgtgaaagtattccacttaatcattttacaggggttggggacgtaaatatttagctggccacatctggaacagatttttcccccccgtgtgggctgggggtggataattggaaggaggggagcatgcatttgttacttactgtacgggcagttctccttcttggtcccgctgaccttcccgttcttctcaatcttgagaaagtacttggtgaaagagaatagctttctccagcggacatctccttgaaggtgattgtagctccgcacatgccttcccgcgctggaaggagagg

SEQ ID NO: 29573 - DNA, 65 bp, Homo sapiens
  misc_feature 1..65: note = chr5:44388856-44388921
  misc_feature 1..65: note = hyper
  source 1..65: mol_type = genomic DNA
ggcaaggagagagctcgaggtggtggctgctggttagctccctctgggcgcggatctggccagaa

SEQ ID NO: 29574 - DNA, 174 bp, Homo sapiens
  misc_feature 1..174: note = chr5:44389326-44389500
  misc_feature 1..174: note = hyper
  source 1..174: mol_type = genomic DNA
aggcagctgcccagtcgccgttgttttcttccctctcttcctttctgtttttagtggtgcctgccgatttgaaggctgccgaaagtcactttttgttttgggggacggcggctggtgttttgtatggccctatctcccacccccttcctttggaaagtccgcttgtaaacaggt

SEQ ID NO: 29575 - DNA, 561 bp, Homo sapiens
  misc_feature 1..561: note = chr5:44389793-44390354
  misc_feature 1..561: note = hyper
  source 1..561: mol_type = genomic DNA
tagctctgtctaattcgctgctaaagcgtcctatgcttgcagcgcgggccacggcgctgacggtatcttcccgctttccgaattttgctgtcttccagcctgaaccaatcccttctggggagcccctttctcacttgctttccagcgtaggatctcctccccccacccccatttcttttggcagtgaagtacttgagagccacctggagcctggtgcttggctgacttttcctcccttctcactcccagaagaggagagggctgggagaaagcagaagatgctgaggattttaaaccgtccaaagcagcaggttataaactggtcagaacgagcacagaaaaggaagacataattagtgtcctttcctcctctgctgccagcttccaaggaggtctcctctttaatgaatcactgatttctcgcttccgttgctgaagtaaaaagttcacactttggccctctctgccttttaagctcagggagatttatcgtcacccttaaaagttgcctctctcggcgcaaatgaaatcagggacccaaataaccgatttctaattgct

SEQ ID NO: 29576 - DNA, 97 bp, Homo sapiens
  misc_feature 1..97: note = chr5:45695143-45695240
  misc_feature 1..97: note = hyper
  source 1..97: mol_type = genomic DNA
tttggtgagacctcacgtcagggactatccaagtgcaaattgcccttcttttgcctgccggccgctgtttctgagtaaacacagcgaggataaccag

SEQ ID NO: 29577 - DNA, 295 bp, Homo sapiens; identical to SEQ ID NO: 7824
  misc_feature 1..295: note = chr5:45695313-45695608
  misc_feature 1..295: note = hyper
  source 1..295: mol_type = genomic DNA

SEQ ID NO: 29578 - DNA, 24 bp, Homo sapiens
  misc_feature 1..24: note = chr5:45695648-45695672
  misc_feature 1..24: note = hyper
  source 1..24: mol_type = genomic DNA
cgccggcagcgccaccccccgccc

SEQ ID NO: 29579 - DNA, 28 bp, Homo sapiens
  misc_feature 1..28: note = chr5:45695936-45695964
  misc_feature 1..28: note = hyper
  source 1..28: mol_type = genomic DNA
gcccctcggcgtcttcgaagccccccgc

SEQ ID NO: 29580 - DNA, 142 bp, Homo sapiens
  misc_feature 1..142: note = chr5:45696313-45696455
  misc_feature 1..142: note = hyper
  source 1..142: mol_type = genomic DNA
tcgcggcggcggcggcggcggcggcggctgctgcttcccgaccgcgccgctgctagctgcgcgcctggctcccgccgccgccgctgcccttagtggctgcggtccgggctccggtgcggctggtgctgaagctgaggctgcc

SEQ ID NO: 29581 - skipped

SEQ ID NO: 29582 - DNA, 57 bp, Homo sapiens
  misc_feature 1..57: note = chr5:45696466-45696523
  misc_feature 1..57: note = hyper
  source 1..57: mol_type = genomic DNA
aggctcagctcggctcagccctcgcgccccagcgcctcccctcggctgccctctgtt

SEQ ID NO: 29583 - DNA, 386 bp, Homo sapiens; identical to SEQ ID NO: 7826
  misc_feature 1..386: note = chr5:49736592-49736978
  misc_feature 1..386: note = hyper
  source 1..386: mol_type = genomic DNA

SEQ ID NO: 29584 - DNA, 201 bp, Homo sapiens
  misc_feature 1..201: note = chr5:49737098-49737299
  misc_feature 1..201: note = hyper
  source 1..201: mol_type = genomic DNA
cgcgggtaggacgctgaagaaaaggcggaatgggaggggcccggccgccttgccccactcccccgagacgctcttaccgcgcccggccctccatcagttatgcagccctcagccggctgctggcgttcccggatgtgcggtggcggtgctacttcccggctgcagcctctccggcctccgccctctcggctctagcaggtc

SEQ ID NO: 29585 - DNA, 157 bp, Homo sapiens; identical to SEQ ID NO: 440
  misc_feature 1..157: note = chr5:50263484-50263641
  misc_feature 1..157: note = hyper
  source 1..157: mol_type = genomic DNA

SEQ ID NO: 29586 - DNA, 111 bp, Homo sapiens
  misc_feature 1..111: note = chr5:50264180-50264291
  misc_feature 1..111: note = hyper
  source 1..111: mol_type = genomic DNA
ttgcttatctgtattcgaggggttagtctccatcctaggattgtccctttcaaaaaaaattttttggatgcatctgttttcactttgcactttcaacgggctggagcagac

SEQ ID NO: 29587 - DNA, 350 bp, Homo sapiens
  misc_feature 1..350: note = chr5:50264500-50264850
  misc_feature 1..350: note = hyper
  source 1..350: mol_type = genomic DNA
gaggaggggctaaggcgagggtccaggcatttcgggaaaagatcaaggacaaggagagttaagaaactgaccgtgggccagggaagaccggagagagagaaagtaaagtgtccaggactggaactcacgtccctgaggcaggggacagtaagtttgcttgtaacacagacagttttccttgactgcaggaaacaagaaaaatagtaatcataaaacaagcacaaatcccccaaacatcaggggggtaaaacccccattattagccatcacaaaccaaaacccaaaccgagtcttttctgctgaattgctgcaagatcacaagagaccaagagatccggagtcaggctgtg

SEQ ID NO: 29588 - DNA, 96 bp, Homo sapiens
  misc_feature 1..96: note = chr5:50265070-50265166
  misc_feature 1..96: note = hyper
  source 1..96: mol_type = genomic DNA
tatcagtgaaagcatcggagggactcggattgaacgcggcagctccggaactggacaacagctgcgtggtgcagccaatcccggggcctgtgggaa

SEQ ID NO: 29589 - DNA, 482 bp, Homo sapiens
  misc_feature 1..482: note = chr5:50265190-50265672
  misc_feature 1..482: note = hyper
  source 1..482: mol_type = genomic DNA
cgggcgagagcaaggagcctcccggccacacagccacaggcgctgcggaacccagcccggactctccccggctggagtgtgcgaagggcttcccgcccaggggcccagggtggtcttagtgaaaaagggatggcgctgcagcactgaccacgttgccctggtttctccatttctccttcccaagtctctgcctctgtttccccatgacccggaggacgcgcctacggaagagacgtctggtcgagggggtgccggggagcggaagggggaggggaaggtctcatccctgggacgctgacacccccctccccgcggcactccagctccgaagagcgagcttcggttccgcccgccctccagaccatttgcttattctcactattgttttaatttattgtgcagcctgttgcgccgcgggcccggctgagccatttggggccctctagatgccctgcagggcgcctgtctccggacgaccacca

SEQ ID NO: 29590 - DNA, 160 bp, Homo sapiens; identical to SEQ ID NO: 7831
  misc_feature 1..160: note = chr5:50265720-50265880
  misc_feature 1..160: note = hyper
  source 1..160: mol_type = genomic DNA

SEQ ID NO: 29591 - DNA, 48 bp, Homo sapiens
  misc_feature 1..48: note = chr5:50675007-50675055
  misc_feature 1..48: note = hyper
  source 1..48: mol_type = genomic DNA
gagaatacaaatttccgtcctcgcttggccgaacgcctccctgcaatc

SEQ ID NO: 29592 - DNA, 32 bp, Homo sapiens
  misc_feature 1..32: note = chr5:50678159-50678191
  misc_feature 1..32: note = hyper
  source 1..32: mol_type = genomic DNA
aaatccctccctactcgcgcccttagactaat

SEQ ID NO: 29593 - DNA, 286 bp, Homo sapiens
  misc_feature 1..286: note = chr5:50683270-50683556
  misc_feature 1..286: note = hyper
  source 1..286: mol_type = genomic DNA
ctgtacttctctccccgctctgggccgcctccgctcccccctcccccgcacaggttgtacgggatcaaatgcgccaagtgcagcatcggcttcagcaagaacgacttcgtgatgcgtgcccgctccaaggtgtatcacatcgagtgtttccgctgtgtggcctgcagccgccagctcatccctggggacgaatttgcgcttcgggaggacggtctcttctgccgagcagaccacgatgtggtggagagggccagtctaggcgctggcgacccgctcagtcccctgc

SEQ ID NO: 29594 - DNA, 143 bp, Homo sapiens
  misc_feature 1..143: note = chr5:50685653-50685796
  misc_feature 1..143: note = hyper
  source 1..143: mol_type = genomic DNA
cgggcctcagtccccgtgtgatccgggtctggtttcaaaacaagcggtgcaaggacaagaagcgaagcatcatgatgaagcaactccagcagcagcagcccaatgacaaaactgtgagtggctctggggccgggcagggaatg

SEQ ID NO: 29595 - DNA, 229 bp, Homo sapiens; identical to SEQ ID NO: 7833
  misc_feature 1..229: note = chr5:50685846-50686075
  misc_feature 1..229: note = hyper
  source 1..229: mol_type = genomic DNA

SEQ ID NO: 29596 - DNA, 63 bp, Homo sapiens
  misc_feature 1..63: note = chr5:50694717-50694780
  misc_feature 1..63: note = hyper
  source 1..63: mol_type = genomic DNA
ttctacccccaggtgcgttgcccacgtccagcgggcagggcagcgcagcgcctgtctgcactc

SEQ ID NO: 29597 - DNA, 190 bp, Homo sapiens
  misc_feature 1..190: note = chr5:50695051-50695241
  misc_feature 1..190: note = hyper
  source 1..190: mol_type = genomic DNA
aatcagccgaagaggcgctccccggcccactccgctcggctcgcccgggtccggagccaccgctcgacgcagacggcacaacaaacagcacctgaggctttatagctcgctttattgtttaatggagaatgcggcataacattcatttgtcttcttggttccgcgacctggccgctttgcagccacagac

SEQ ID NO: 29598 - DNA, 113 bp, Homo sapiens
  misc_feature 1..113: note = chr5:50695350-50695463
  misc_feature 1..113: note = hyper
  source 1..113: mol_type = genomic DNA
cgccctcaggcccctggagaggtacccagctgcagcccctttcttgcttccaaagcccggaggcggaagggtggagggacagtgaaagaaagcttaggcgaggtgtctttgac

SEQ ID NO: 29599 - DNA, 343 bp, Homo sapiens
  misc_feature 1..343: note = chr5:52776466-52776809
  misc_feature 1..343: note = hyper
  source 1..343: mol_type = genomic DNA
aatcgcgcgggcggccggcggcgagcgcggggctgcgccgggatcgctgcgccctccgccgctggcctctgcgacgcgcgccgctcgcccgagccacccgccgccgcgccggctccccgcgccgctgcgctcctcgccccgcgcctgcccccaggatggtccgcgcgaggcaccagccgggtgggctttgcctcctgctgctgctgctctgccagttcatggaggaccgcagtgcccagggtaagcgagtggggatgcgctggggaggcttggctgaggacaggggggtcgacttttctgtggtctccacttggtctgttctgagcaacgctgctctcggaag

SEQ ID NO: 29600 - DNA, 30 bp, Homo sapiens
  misc_feature 1..30: note = chr5:52778616-52778646
  misc_feature 1..30: note = hyper
  source 1..30: mol_type = genomic DNA
ccgccgggtctccttcgctagccacctcgc

SEQ ID NO: 29601 - DNA, 297 bp, Homo sapiens
  misc_feature 1..297: note = chr5:54179796-54180093
  misc_feature 1..297: note = hyper
  source 1..297: mol_type = genomic DNA
cagcgccctcctccccgctcgcccaccctctccaagcgggctccgcgcggccggggatgggacgaggaggggaagtttggggcgcgtacctcctagcgccccgcagaaccccaggcaggcagccagtaggacgaggcggcgggccccgaaccgccccatcccgccgcggcggccccgcgtcccgcgctcactccccagcggcggccgagctacctgcgccgccgcgacccggagcccggcaagggggcgccgccccccaacatctcgggggcagggccggggcggggagagccattt

SEQ ID NO: 29602 - DNA, 44 bp, Homo sapiens
  misc_feature 1..44: note = chr5:54472206-54472250
  misc_feature 1..44: note = hyper
  source 1..44: mol_type = genomic DNA
tattcaactaatttccgagcagtgcaaaccggagagctccccat

SEQ ID NO: 29603 - DNA, 30 bp, Homo sapiens
  misc_feature 1..30: note = chr5:54472512-54472542
  misc_feature 1..30: note = hyper
  source 1..30: mol_type = genomic DNA
tgagggaaagcgccacgccagtgggggctg

SEQ ID NO: 29604 - DNA, 347 bp, Homo sapiens; identical to SEQ ID NO: 441
  misc_feature 1..347: note = chr5:54516334-54516681
  misc_feature 1..347: note = hyper
  source 1..347: mol_type = genomic DNA

SEQ ID NO: 29605 - DNA, 131 bp, Homo sapiens
  misc_feature 1..131: note = chr5:54516831-54516962
  misc_feature 1..131: note = hyper
  source 1..131: mol_type = genomic DNA
cgccccacttacatccagcaccgaggccaggtgccgggttcggctggcgagttccttcagctgcacgttccgctccttgagcgaggcgatctcctcctgtttctgggtcaatgtcacgtgcagctgcagga

SEQ ID NO: 29606 - DNA, 156 bp, Homo sapiens; identical to SEQ ID NO: 443
  misc_feature 1..156: note = chr5:54519133-54519289
  misc_feature 1..156: note = hyper
  source 1..156: mol_type = genomic DNA

SEQ ID NO: 29607 - DNA, 43 bp, Homo sapiens
  misc_feature 1..43: note = chr5:54519598-54519641
  misc_feature 1..43: note = hyper
  source 1..43: mol_type = genomic DNA
aaagcttctgttctgcgcacagccagtgcggcctccattgctc

SEQ ID NO: 29608 - DNA, 314 bp, Homo sapiens; identical to SEQ ID NO: 7839
  misc_feature 1..314: note = chr5:54527322-54527636
  misc_feature 1..314: note = hyper
  source 1..314: mol_type = genomic DNA

SEQ ID NO: 29609 - DNA, 648 bp, Homo sapiens
  misc_feature 1..648: note = chr5:57877892-57878540
  misc_feature 1..648: note = hyper
  source 1..648: mol_type = genomic DNA
gcggcagtgtgtgcgcgctaatgacggcggaaggtgcctgggggagggcctggggaggggctggccagcgctatcgcgcccctggcacttcctaagagactgagccctttctctgcagctgcagcttggattccacgctttccctccagaggaaagaagccctccatctaaatcagctgtcttctccacatccctcctttttctctccgccagacgccacccctaccccttctattgtgttgtgccttttcattttagccccgcttcctacgtagagccctaacctcctttgtagcgagggcacttgagaatttctgaacctcgagttgtaatggagctgtatggaaaggtaagcaggcgaaaggagttccttggggtgcttagccagaaatctcgctttcacgcacttcggtgtgcgggttgtgtgtgtgactatgtacgcgcgcgcgacttctcagtgcaattatgcggataaaccactttccttatgtgtgtaccgttaatcgtctttctcccctacgtttggtgaatgagattgtaaaactgccccactctgcctaaggaaacgtagaaactttcccgattcggatggggaggggtagggcggagagtcccagagaccagctctggcttcgtttgcattggaaa

SEQ ID NO: 29610 - DNA, 16 bp, Homo sapiens
  misc_feature 1..16: note = chr5:57878937-57878953
  misc_feature 1..16: note = hyper
  source 1..16: mol_type = genomic DNA
gtgcagagtgtggagc

SEQ ID NO: 29611 - DNA, 236 bp, Homo sapiens
  misc_feature 1..236: note = chr5:57878954-57879190
  misc_feature 1..236: note = hyper
  source 1..236: mol_type = genomic DNA
tggagcgccgggactgtgcacgcttgaccggaagcccagaccagtgcggtcctagccagagagaaaggacatttgccaacaatgagacacgaagcgcccatgcaggtgggtccataaagaaagagtggcctcgggaggaattgaaagagatgcttttccccttgctccgcgcacaagcagttcaacgtaaggaaaggtctaggcggtcacccgcggagatgcggctctgtgacatg

SEQ ID NO: 29612 - DNA, 204 bp, Homo sapiens
  misc_feature 1..204: note = chr5:58335149-58335353
  misc_feature 1..204: note = hyper
  source 1..204: mol_type = genomic DNA
ggctctagcggatggcgagggggtggcgagcgcgcttgggtgcccgccccgcagaggagcgtctggtccacagccggatctcctcggtccccaacccggagccgcggccccacgcccgccccgcctgccgagccttctgcacggcacttgaagtgaatgaatcagccgcggccgggtgcgcggccaccacgtttcctgttttct

SEQ ID NO: 29613 - DNA, 305 bp, Homo sapiens
  misc_feature 1..305: note = chr5:58335572-58335877
  misc_feature 1..305: note = hyper
  source 1..305: mol_type = genomic DNA
tccccccggcgcagccgggcgccactcgctttgaagtgcagacgaggaggcgcgggcgcgagcgtgtgtgtctgtggggctgctgtgggactgtctgtgctaggagagcggcggaaaacccggcgtggagcgcctgcagtccgccgtccggggtcgcgcccgccgcggggctcaggagggaccggcacgcaggcgcgcacggccgcgcacctgtctcgctagaaccccgcgcgccccgccgagccactgccctccaggttgcccagaccgctggagcctctgcgactccacgaccggctgcttcc

SEQ ID NO: 29614 - DNA, 30 bp, Homo sapiens
  misc_feature 1..30: note = chr5:59188418-59188448
  misc_feature 1..30: note = hyper
  source 1..30: mol_type = genomic DNA
tacttctccacctgacgaagagaaatgcga

SEQ ID NO: 29615 - DNA, 93 bp, Homo sapiens
  misc_feature 1..93: note = chr5:59188965-59189058
  misc_feature 1..93: note = hyper
  source 1..93: mol_type = genomic DNA
gaatgggggagggggcgctctccactcaccgcctgagtccctggaacgaggagggccaggacatcctggatttcttcaggccgggccggtggc

SEQ ID NO: 29616 - DNA, 310 bp, Homo sapiens; identical to SEQ ID NO: 7844
  misc_feature 1..310: note = chr5:59189188-59189498
  misc_feature 1..310: note = hyper
  source 1..310: mol_type = genomic DNA

SEQ ID NO: 29617 - DNA, 199 bp, Homo sapiens
  misc_feature 1..199: note = chr5:59189830-59190029
  misc_feature 1..199: note = hyper
  source 1..199: mol_type = genomic DNA
aagcagcagcaacggcggcggcggcagtggtagccgcctccagggcaccggaaccctgatcccggagctgctgaaaagttggacagctccaggctggcacgcccgagctgtgactttcaccaaaaccactccagccagtcaggagtcagacctgtcctcttgatccttcccctcgccgtgcccgcgcctccctcctcca

SEQ ID NO: 29618 - DNA, 128 bp, Homo sapiens
  misc_feature 1..128: note = chr5:63255115-63255243
  misc_feature 1..128: note = hyper
  source 1..128: mol_type = genomic DNA
caatcccaagagttccgcggcatcttgcgccactggctaaggcaaaaacctcaggtgtctacccgcgcttcagggcgccccagagcgtaggcggaggaacccagatcctgtaagtcagcagccgggag

SEQ ID NO: 29619 - DNA, 30 bp, Homo sapiens
  misc_feature 1..30: note = chr5:63257323-63257353
  misc_feature 1..30: note = hyper
  source 1..30: mol_type = genomic DNA
taagataattggccacgttctgcagggagc

SEQ ID NO: 29620 - DNA, 113 bp, Homo sapiens
  misc_feature 1..113: note = chr5:63257737-63257850
  misc_feature 1..113: note = hyper
  source 1..113: mol_type = genomic DNA
gctctcgcagtccagcgcgttcagaagctccagctgggaaactggagttggcctgaaagcagctccaggatctcccggcggcggagaggtggctggaacgtctgtctgtcgct

SEQ ID NO: 29621 - DNA, 171 bp, Homo sapiens
  misc_feature 1..171: note = chr5:63461448-63461619
  misc_feature 1..171: note = hyper
  source 1..171: mol_type = genomic DNA
cggttccgtctggcccgcggcgcttgtctgcctgcgcggggtcaaagcccggcgccgcccacgcgcggctcgggtgggaacccgcagacgtggggcgagcagggccgctggctgtggcgggcgagcgccggggcgccacgtccgaggccgcggggtcggggctgcaggcac

SEQ ID NO: 29622 - DNA, 205 bp, Homo sapiens
  misc_feature 1..205: note = chr5:63461914-63462119
  misc_feature 1..205: note = hyper
  source 1..205: mol_type = genomic DNA
ctgggctagggttgccgctggcctggccgcctctcgcccggcgggcctcaggtgacgcggccgcggcttaactttcgcacctgaggctctcggagcggcctcggggcgcgcccacctggaggttggaattacacagggtcgaaaaagctgagtcctggaggcgaggcgctgtaggtgtggcggaggaggccggggaaggtggggt

SEQ ID NO: 29623 - DNA, 464 bp, Homo sapiens
  misc_feature 1..464: note = chr5:63801808-63802272
  misc_feature 1..464: note = hyper
  source 1..464: mol_type = genomic DNA
caacgtcagccggaccgattctctgcgtctgccagtcccgccacagattcatctgggatcttcaaacagacaagcccttagagacgagggatcaaggcagccgattagagccaattgcttgctttggggacggccagtccttccaggcctggcgacagtggagggaggggaaagacgaaccgagtgccgctgcgggaagacactgaagcaagagcgacacccctttccgccccccaccttgcagcgcaggctttgaaagctgctcccccacctgaatggaaactcggaaccgccgggcggcgcgttccttctcgcccagccttgcaatccatgccgagaggaaggcagtgcgagcccgcgccagcgcccagctcccgggacagggtcggcaatgctgctgagcagaacttgatcgcgctccttcctcgctgctagtggaagcgatgctgcacggcacagctagc

SEQ ID NO: 29624 - DNA, 32 bp, Homo sapiens; identical to SEQ ID NO: 2574
  misc_feature 1..32: note = chr5:63802273-63802305
  misc_feature 1..32: note = hyper
  source 1..32: mol_type = genomic DNA

SEQ ID NO: 29625 - DNA, 206 bp, Homo sapiens
  misc_feature 1..206: note = chr5:63802339-63802545
  misc_feature 1..206: note = hyper
  source 1..206: mol_type = genomic DNA
cgcgcctcaggtccgggctccggctgcttggcggcggcgcccagggcaacaaccgggccgcccgcgccggggcgcactgcaccagcggcttcggcttggtggatgtgtatgcatgagttctgcaccgaatgggcgcaaaaagcgccccagccggtccacccgctcctcgatcttccagatcagcaagcccccgctgcagagcggag

SEQ ID NO: 29626 - DNA, 78 bp, Homo sapiens; identical to SEQ ID NO: 7850
  misc_feature 1..78: note = chr5:63986450-63986528
  misc_feature 1..78: note = hyper
  source 1..78: mol_type = genomic DNA

SEQ ID NO: 29627 - DNA, 393 bp, Homo sapiens
  misc_feature 1..393: note = chr5:63986569-63986962
  misc_feature 1..393: note = hyper
  source 1..393: mol_type = genomic DNA
cgacctcaagtactgctgcagcgagccgggcagctacttcccctacaagcacagctacatgtggagcctcaggtgggctgagagcccgcgcgtgcggcggctggccgagcccggggctagggaggcgacaagcggagccacgccagggccagggaggttcccccgcgtccccgctatccgccctaggttaggtccctacggaaggacgcggagcctctgagggcgggtgagggcagggagagaaatctcgccccggctcggagctcccccgggagccaggacaggaggcgaggcgcacgctggaggagcgcgggctttgcgcccagggcgcacttggggcccgcctggctggccccgctgagttccccgcccgcctcccgggagccgactgct

SEQ ID NO: 29628 - DNA, 30 bp, Homo sapiens
  misc_feature 1..30: note = chr5:65891802-65891832
  misc_feature 1..30: note = hyper
  source 1..30: mol_type = genomic DNA
gccctccttcttgtccgttttcttgattcc

SEQ ID NO: 29629 - DNA, 56 bp, Homo sapiens
  misc_feature 1..56: note = chr5:65893398-65893454
  misc_feature 1..56: note = hyper
  source 1..56: mol_type = genomic DNA
gagaagaggactccccgcgctccctcggtggcgctggcgtgcgcgcctgcagctcc

SEQ ID NO: 29630 - DNA, 291 bp, Homo sapiens
  misc_feature 1..291: note = chr5:67583945-67584236
  misc_feature 1..291: note = hyper
  source 1..291: mol_type = genomic DNA
ctgtgcatagtgcctcgcttcactgtcggctacttgagccccgcgagccagccagcgcgctcagcagccagtgagactattttaggtcccctcacaatggccttctcatttcccaggcgaaaatgagcaagttggtcttgcattggccacttgtcagccgatgacaactttgacttgggctcccctccccctcccgaaatccctagctcagcaaatatttgaacctgcccaagttaatcatgaagctgcgatctttatctaagggagacgtgcgagcgcctgggctccttt

SEQ ID NO: 29631 - DNA, 303 bp, Homo sapiens
  misc_feature 1..303: note = chr5:71014676-71014979
  misc_feature 1..303: note = hyper
  source 1..303: mol_type = genomic DNA
gcaaggcagggctggcgaggtggatgttgcagctgtcaccactgctaggtgttgggaaacgactctcctgcctgtgcattgacccgaaggcattttccatttcctaggcccctcccgcttcccgtccctcacctctagcccctcggcttcagctcaggcccctcggggagcatcccttgccgtgagactgacagcctttgggggcgcagggtcctgttctctgcgctctagcccatctgtgcgcagagcctcgttcccaggcgcctggaacccggcgggcattgacgtcaagcgccggcggag

SEQ ID NO: 29632 - DNA, 531 bp, Homo sapiens
  misc_feature 1..531: note = chr5:71015031-71015562
  misc_feature 1..531: note = hyper
  source 1..531: mol_type = genomic DNA
cgcctcctccctctttcctgcacgggggctcgggctcactataaaaggtgggagcgcgtggtgccccagcaacgacgagtttcagaacgatggagagctcccgcgtgaggctgctgcccctcctgggcgccgccctgctgctgatgctacctctgttgggtacccgtgcccaggaggacgccgagctccagccccgagccctggacatctactctgccgtggatgatgcctcccacgagaaggagctggtcggtattcccctcgctctcgacccccttgagctgtcgccttgtctcttctcttgcacgcctccctcctccccccacccccactcctattcccagagtcagggcgcggggagctgagcgcaacgcccaggcacccactgccatccgaagagcgtctcgagctcacgggctcctggcagtctgttgagcgaatccctcatcccggcccctctgagcaacagggaccccagcggctcagagacccgcggtcagtacctgggacagcgtccgctaagtttccacc

SEQ ID NO: 29633 - DNA, 40 bp, Homo sapiens
  misc_feature 1..40: note = chr5:71015825-71015865
  misc_feature 1..40: note = hyper
  source 1..40: mol_type = genomic DNA
caagagaaagtacaccgccttgaatcgtacacacagtctt

SEQ ID NO: 29634 - DNA, 30 bp, Homo sapiens
  misc_feature 1..30: note = chr5:71402862-71402892
  misc_feature 1..30: note = hyper
  source 1..30: mol_type = genomic DNA
ggtgtaggttgagagcgtcttcccccttca

SEQ ID NO: 29635 - DNA, 531 bp, Homo sapiens
  misc_feature 1..531: note = chr5:71403122-71403653
  misc_feature 1..531: note = hyper
  source 1..531: mol_type = genomic DNA
gtctccatataaaagcggcgccgcctccccgccctctctcactccccgctcctctccgccgcgcactctccgcggcgctgggagagggcggagggggaggcggcgcgcggcgccagaggaggggggacgcagggggcggagcggagacagtaccttcggagataatcctttctcctgccgcagtggagaggagcggccggagcgagacacttcgccgaggcacagcagccggcaggatggcgaccgtggtggtggaagccaccgagccggagccgtccggcagcatcgccaacccggcggcgtccacctcgcctagcctgtcgcaccgcttccttgacagcaagttctacttgctggtggtcgtcggcgagatcgtgaccgaggagcacctgcggcgtgccatcggcaacatcgagctcggtaagtggccccgcgcccccagagacgcgcgctgggagacgcgcaaacacgaccccacccagggcgcgacggtcactgcgctcctcccgcgcgccccgcacccatgcctct

SEQ ID NO: 29636 - DNA, 53 bp, Homo sapiens
  misc_feature 1..53: note = chr5:71403996-71404049
  misc_feature 1..53: note = hyper
  source 1..53: mol_type = genomic DNA
gattcatcctcaccacggctacctcagcccctgagaaacgccttttctgattt

SEQ ID NO: 29637 - DNA, 77 bp, Homo sapiens
  misc_feature 1..77: note = chr5:71404665-71404742
  misc_feature 1..77: note = hyper
  source 1..77: mol_type = genomic DNA
tccctttatccctggcgtcccggccctcccctcgctcctgacagaggtcgccgggtccctccgcagccccagcccgc

SEQ ID NO: 29638 - DNA, 112 bp, Homo sapiens
  misc_feature 1..112: note = chr5:71404743-71404855
  misc_feature 1..112: note = hyper
  source 1..112: mol_type = genomic DNA
ctctattctcctggggtggtgctgaagcgtttctccgggagacaccggttggtgggcgtggtgcagtccgcactgcggtctctacggcagcccgaggcggacaaagggcgtt

SEQ ID NO: 29639 - DNA, 19 bp, Homo sapiens
  misc_feature 1..19: note = chr5:72415904-72415923
  misc_feature 1..19: note = hyper
  source 1..19: mol_type = genomic DNA
tggccaaggccaaggcggc

SEQ ID NO: 29640 - DNA, 143 bp, Homo sapiens
  misc_feature 1..143: note = chr5:72416022-72416165
  misc_feature 1..143: note = hyper
  source 1..143: mol_type = genomic DNA
cgcgcccctatagaactgggcctcaggcctcgagggggagcgggcctcggcgggcggggcgcacagttccgccagccggcgggggcatctcaactcgccggccccgccaggtgtgcgggccaggcagccgtggaaggtgccca

SEQ ID NO: 29641 - DNA, 207 bp, Homo sapiens
  misc_feature 1..207: note = chr5:72497943-72498150
  misc_feature 1..207: note = hyper
  source 1..207: mol_type = genomic DNA
ggacaaaggaggaaacgctagcggggccccagagccctctccaatgggacccaaagggacacatcccggcacagaccctccccactctaaggcagagcctttcgcagggcctatcacagggcggagggagggagggagggcggcaggaggactgctggcctgaaactctgctttcacaaagaggttacacttcgaagttagacctca

SEQ ID NO: 29642 - DNA, 97 bp, Homo sapiens
  misc_feature 1..97: note = chr5:72512278-72512375
  misc_feature 1..97: note = hyper
  source 1..97: mol_type = genomic DNA
agcgctggaagtggccgcaagggacgcgagggagagcagagctgtgaatcagccggaaagtcactccaactccagggaattccgctccgggaagaaa

SEQ ID NO: 29643 - DNA, 29 bp, Homo sapiens
  misc_feature 1..29: note = chr5:72526037-72526066
  misc_feature 1..29: note = hyper
  source 1..29: mol_type = genomic DNA
gctactgctagccctcgccccagactgtc

SEQ ID NO: 29644 - DNA, 20 bp, Homo sapiens
  misc_feature 1..20: note = chr5:72526395-72526415
  misc_feature 1..20: note = hyper
  source 1..20: mol_type = genomic DNA
gtgggcccaatgctccgggc

SEQ ID NO: 29645 - DNA, 179 bp, Homo sapiens
  misc_feature 1..179: note = chr5:72526491-72526670
  misc_feature 1..179: note = hyper
  source 1..179: mol_type = genomic DNA
cgcccgggactccccatcagacctttgagggggagcttctcaaaaagccctaaactcctcgaggatattctccgagtgcttctccttacccaagcgctgcttccagactccacgcctctagaactagctggcgtccacggtcggccagagcagttagggggctgcgctagcagggacat

SEQ ID NO: 29646 - DNA, 114 bp, Homo sapiens
  misc_feature 1..114: note = chr5:72528189-72528303
  misc_feature 1..114: note = hyper
  source 1..114: mol_type = genomic DNA
cggccgcccttaggagaccagtgatcatcccagccacctccctgcccagccccgggccgaactggaaaactcttaactttgggctttatttaaaacactcgggtttcgaaagcc

SEQ ID NO: 29647 - DNA, 30 bp, Homo sapiens
  misc_feature 1..30: note = chr5:72528599-72528629
  misc_feature 1..30: note = hyper
  source 1..30: mol_type = genomic DNA
cgctgggcttcgggccgccgcccagagaca

SEQ ID NO: 29648 - DNA, 728 bp, Homo sapiens
  misc_feature 1..728: note = chr5:72529098-72529826
  misc_feature 1..728: note = hyper
  source 1..728: mol_type = genomic DNA
ccgttgccctcgttgcgtttaattctcccgtcactccccagtcactaagggaggcctcctactcgcgcctcagcttcaagggcggatgtggctgggaccaccctgggactcgggtgtctccaaatgtggctcaggccgccccacgccgaacgaggtgggatcagatattcccgcttgtgagtgttggtggggctgaagagatcacacgcggcggggtgtggaacttcgaggggtgtcacggccagggctttgcggccccagacgtcccagcggctcgcagggggcgccaggtccgcgcttccccttgggtcttcgagaggcgtgtgcgcaggacgctgccctctgttgcccaaagcccgcaccaggctcctgggcttccgcgggcttccgcaggcctcaggcgaggggcggggacgccacccgcacgctcccgagcgcagggagggctgtcgccgaagcggtgacccacgcgtggaccccgcccgcgctgggccgggccggtcccctgcccacccgcagccctgctcggccgcgttcccagcagccgggaaagcttcctccctcggtcaccgatccaggccgctggtccagctgtcaaaacagggggtgtctctttcattctggctcacaaagtcccaaaggggaacagggggccttaatgcttgtgtttggacacaagcaattatccctaattattctttttcttttgagcctgcccgtcccgccgg

SEQ ID NO: 29649 - DNA, 446 bp, Homo sapiens
  misc_feature 1..446: note = chr5:72529889-72530335
  misc_feature 1..446: note = hyper
  source 1..446: mol_type = genomic DNA
cggcccgaggctcgggcgctttcatgtcactgcgggtttagagctgattcaaactcattgcgatgggggaattaaccccggggcccgggctttcaggggcctctgataagagattatacgtgttgatggcaagcttttcttggcaaaatgttttcaaagggcttggagttgttaaatcaaagcgccattgaattgctcgggaccaccccctcccccgcctcttgcccttcccccacctccatctttttcccttcatccctcctcccccatcaccgcccaggactgcccaaggcgagcggcccagcctccgggagtggcgagtcaccttccttggtacgattttcccccggtgcctcgcccgggaaggattgtttttgtaggtgctcctgctgctgggcactttggtaccccttcccttccccgcccctccccgccccttcacacac

SEQ ID NO: 29650 - DNA, 59 bp, Homo sapiens
  misc_feature 1..59: note = chr5:72530577-72530636
  misc_feature 1..59: note = hyper
  source 1..59: mol_type = genomic DNA
ttccacccccacccccgcggaatgacagaaagagttgggaggaccgtggggatgtagat

SEQ ID NO: 29651 - DNA, 61 bp, Homo sapiens
  misc_feature 1..61: note = chr5:72594776-72594837
  misc_feature 1..61: note = hyper
  source 1..61: mol_type = genomic DNA
aaaaggcaccgggcacggaggtttaatgtgaagcatgtgagcggggctcagtttacaggta

SEQ ID NO: 29652 - DNA, 150 bp, Homo sapiens
  misc_feature 1..150: note = chr5:72594867-72595017
  misc_feature 1..150: note = hyper
  source 1..150: mol_type = genomic DNA
cggcctcgaggatttcggggggtttgcgccgccgaggaaaccctacccggacgaggcgagcagcctggtggccctggcggccgcgagctcccggctgccaccgctaggcgcccccgcccggcccgccggcgctccgagggcaaacccggg

SEQ ID NO: 29653 - DNA, 676 bp, Homo sapiens
  misc_feature 1..676: note = chr5:72595046-72595722
  misc_feature 1..676: note = hyper
  source 1..676: mol_type = genomic DNA
cgcccaaggaaagggcttcccagtcaccctgcggcgacgcttctccctcccgggaatgacaccttcgctcgctttcacacagccaagccgttggagaggcagaaacagtgggtcccgagcccgcaggagaagttcccatcccgcccctctagccctcgggcgttggcagtggagtaacaaagacgctgccgcgccgttgaccccgaagaagctctgatgaaaaggagggcgggccgcgggataggagtttctacaattagttttttctgcctttacgttcccaagaagaagccgaggaagtagaaaggagagagatctgggaaaggcaagatccagaaatcaggagccattatgtttctcattttggagaaaaactgtaaaacagctcggcctcttgtccaccttgccccgaaggcaagtctggatatgaaaagaaaaaggcgggcaacggaggagatttatttttcattttaactttcctctcccaggcttcctcaccccctgcccccttcgattcctaggaggggcggccccagccctcggagccgattctcggcgctgcgctaggacatcagaggcgatacaggttcgatgttaaatgaaccttcaggccgccggacaatggcgcagacctcacacgggggcaccgcgccttcccccagccgtgctcggctcc

SEQ ID NO: 29654 - DNA, 15 bp, Homo sapiens
  misc_feature 1..15: note = chr5:72595773-72595788
  misc_feature 1..15: note = hyper
  source 1..15: mol_type = genomic DNA
cgaaccaatgggcag

SEQ ID NO: 29655 - DNA, 30 bp, Homo sapiens; identical to SEQ ID NO: 7871
  misc_feature 1..30: note = chr5:72596861-72596891
  misc_feature 1..30: note = hyper
  source 1..30: mol_type = genomic DNA

SEQ ID NO: 29656 - DNA, 72 bp, Homo sapiens; identical to SEQ ID NO: 7872
  misc_feature 1..72: note = chr5:72598030-72598102
  misc_feature 1..72: note = hyper
  source 1..72: mol_type = genomic DNA

SEQ ID NO: 29657 - DNA, 383 bp, Homo sapiens; identical to SEQ ID NO: 449
  misc_feature 1..383: note = chr5:72599059-72599442
  misc_feature 1..383: note = hyper
  source 1..383: mol_type = genomic DNA

SEQ ID NO: 29658 - DNA, 396 bp, Homo sapiens
  misc_feature 1..396: note = chr5:72599462-72599858
  misc_feature 1..396: note = hyper
  source 1..396: mol_type = genomic DNA
cgcgcaccctagggagatgcgcggcgtccgcgcgggtcagcgccccagtaccactccccagtgtactccccaggtacacgcttcccttgcgcggcgagtttcaactcaggtcagaacggagctgagcggtgggcggagtggagaaaggtcccggaaattggccaagagggggcggtttcgaggtagtgccttcgaagtgttgtccagaccagcagggagggtcgcctccacctgcggggcctcctccagctccacaaggtagccccgtagggacttgcagatctgccagacctagcagtgagaccactgctcccactgaatggcgccgcctgcgggctggcccaagctctatgcaccggctttatctcattttctcctcaccgttaataactggca

SEQ ID NO: 29659 - DNA, 30 bp, Homo sapiens; identical to SEQ ID NO: 7875
  misc_feature 1..30: note = chr5:72608427-72608457
  misc_feature 1..30: note = hyper
  source 1..30: mol_type = genomic DNA

SEQ ID NO: 29660 - DNA, 52 bp, Homo sapiens
  misc_feature 1..52: note = chr5:72677774-72677826
  misc_feature 1..52: note = hyper
  source 1..52: mol_type = genomic DNA
gggccagccaggtgcctcccggctggtgcgagaccccgggcctgctgggagg

SEQ ID NO: 29661 - DNA, 32 bp, Homo sapiens
  misc_feature 1..32: note = chr5:72677997-72678029
  misc_feature 1..32: note = hyper
  source 1..32: mol_type = genomic DNA
cgaagggtccgggtcaccgcgctcccggacgc

SEQ ID NO: 29662 - DNA, 39 bp, Homo sapiens
  misc_feature 1..39: note = chr5:72715309-72715348
  misc_feature 1..39: note = hyper
  source 1..39: mol_type = genomic DNA
gtttgtttggattgccgggccggcgcgggagcggccggg

SEQ ID NO: 29663 - DNA, 106 bp, Homo sapiens
  misc_feature 1..106: note = chr5:72715590-72715696
  misc_feature 1..106: note = hyper
  source 1..106: mol_type = genomic DNA
cggcccgggggagggcgaggcccggctgcctgcgctcgcgttcccaggccctcggaaccgcgcgccctcgaggccgagcgagccccgccgcgccgagcctcccggg

SEQ ID NO: 29664 - DNA, 15 bp, Homo sapiens
  misc_feature 1..15: note = chr5:72715730-72715745
  misc_feature 1..15: note = hyper
  source 1..15: mol_type = genomic DNA
cgcagtactgctctc

SEQ ID NO: 29665 - DNA, 78 bp, Homo sapiens
  misc_feature 1..78: note = chr5:72716058-72716136
  misc_feature 1..78: note = hyper
  source 1..78: mol_type = genomic DNA
atgtcccctaaagcacgggaagcttcgtgttttatgtttgggctgaatgaaaagaggaacgcacgctctttcctgccc

SEQ ID NO: 29666 - DNA, 30 bp, Homo sapiens
  misc_feature 1..30: note = chr5:72731806-72731836
  misc_feature 1..30: note = hyper
  source 1..30: mol_type = genomic DNA
aaggagggaactaggcgccttttttccact

SEQ ID NO: 29667 - DNA, 41 bp, Homo sapiens
  misc_feature 1..41: note = chr5:72732869-72732910
  misc_feature 1..41: note = hyper
  source 1..41: mol_type = genomic DNA
cggctgttgggtgatgtgcccgaggtttctctgcccttctc

SEQ ID NO: 29668 - DNA, 111 bp, Homo sapiens
  misc_feature 1..111: note = chr5:72733012-72733123
  misc_feature 1..111: note = hyper
  source 1..111: mol_type = genomic DNA
gctcgccacagccggcgggaggcggggaagggagcagcccgggtggcttggagaacactgaacctttaattgggctataaatcagacaggggagtgcggtggagtttatgc

SEQ ID NO: 29669 - DNA, 30 bp, Homo sapiens; identical to SEQ ID NO: 7879
  misc_feature 1..30: note = chr5:72733558-72733588
  misc_feature 1..30: note = hyper
  source 1..30: mol_type = genomic DNA

SEQ ID NO: 29670 - DNA, 218 bp, Homo sapiens
  misc_feature 1..218: note = chr5:72740121-72740339
  misc_feature 1..218: note = hyper
  source 1..218: mol_type = genomic DNA
cccgcgctcctggctcgcccatccagggtccacggctcactcgtccctcgcctgccccgcggcccacacctctcgcagctcatacctcacccgccccgcggccctgcttcccccagtctcatcctctcgggagcaggcccgcagggtctgcaaggccaagaacggaaccccaaacgcagagggtggggaggtgagcggcaggacgcaaaactcggaat

SEQ ID NO: 29671 - DNA, 232 bp, Homo sapiens; identical to SEQ ID NO: 7881
  misc_feature 1..232: note = chr5:72742850-72743082
  misc_feature 1..232: note = hyper
  source 1..232: mol_type = genomic DNA

SEQ ID NO: 29672 - DNA, 1092 bp, Homo sapiens
  misc_feature 1..1092: note = chr5:72743389-72744481
  misc_feature 1..1092: note = hyper
  source 1..1092: mol_type = genomic DNA
cgggggcggcgggggcgcgggcgggaagagcgcggcggcggctgccgggtcgcccgcgccccctgcggctcccgcgccgcgcagcagcagagactcggcggccgcggcgttgggtgggagcagcggctgccgcttgaagcgcttcctccggcgcaggaagctgccgttgtcgaacatgtcggcggactccgggtccagcgtccagtagttgcccttgcccgggttgccgggctcgcgggggatcttgacgaagcagtcgttgagcgagaggttgtggcggatgctgttctgccaggcggggaacttctcccggtagtaggggaagcggccgctgatgaactcacagatctcgctcagcgtcagccgcttcttggggctctgcaggatggccatagtgatgagcgcgatatacgagtagggcggcttcaccagcgggttcttggcgccgctacccgcgctcccgccgccgcccgcgccgccgccgccgccgcccccaccggctcctgcccccgccgccggggccgggcccgggggcgccggggagcccccagcaggcggggccagcaggatgtcatcgtcgtcctcctcctcctccagatcctccagctcgtcctccccggcgtacgagcgccgccgccgccgccgctgcgcggggacagccagccggggcccgccaccgccgccctcgtcgtcgtcctcctcttcctcgtcttcttcgtcctcgccctcccccaccacgtcgatgtctgtttcctcggcgaggccagaggcatcggacatctcagtgctcagggtcatagctgtggcgcggcggcggcggggcggcgcatgggggcgccgggctccgggctccctctgcgccccagcccgggtcccgggcggcaggcccggccggggggcgccacgctgggggcgctgcgactgcggctgccggagctgcgccggggctgccgggtggcggcggagtctcgcgcgccgactttataactcctgcgccgccgcggtagccgcgcggatgctgcgctccctgggctccgctcgcgcccggcccgggcggaggacttgaccttctcctctcggagcagcttttgc

SEQ ID NO: 29673 - DNA, 485 bp, Homo sapiens
  misc_feature 1..485: note = chr5:72744697-72745182
  misc_feature 1..485: note = hyper
  source 1..485: mol_type = genomic DNA
gaaatcagcccttctcgggagagaaaattcacccgtaggagggaggcagcagctgagaagagtggggaggagaggggacctcactatttcttgccaaagaggctgatgcccgaattacgcggctgtctgcaccgagggccgctgcacgagttagacttcccagcctcctcaattagtcctccaccctaacctcagaagcacacccgcgacactctggtttgacccctcgacagcctgtaggagccttccagccgggggataaccaccccatcctctgaggtggcccctgggggacgctctggggtcggttgggggtgtccagcccctccagatcgggcgagcggccccccattggatctgatgcgaagccccccaatttaagcacgataataattgtttattgaccctttaacccattctcttcggttttactccaaagacgtttgttttccgccatctgttaataaaaacgctgtgagactggc

SEQ ID NO: 29674 - skipped

SEQ ID NO: 29675 - DNA, 161 bp, Homo sapiens
  misc_feature 1..161: note = chr5:72746992-72747153
  misc_feature 1..161: note = hyper
  source 1..161: mol_type = genomic DNA
agtcgcgaaattccccgagcgcggaaactcaagcgattcacgtcttgcgcgacccccttgtctcccccatcgtcccctaccccgggcctccttctctacagcgctcccagctttcggccccagctggtaactctcccccggctccccgcccccaagctggt

SEQ ID NO: 29676 - DNA, 34 bp, Homo sapiens
  misc_feature 1..34: note = chr5:72747486-72747520
  misc_feature 1..34: note = hyper
  source 1..34: mol_type = genomic DNA
ggctttttccccccacgagcggtttgggccctcc

SEQ ID NO: 29677 - DNA, 67 bp, Homo sapiens
  misc_feature 1..67: note = chr5:74161713-74161780
  misc_feature 1..67: note = hyper
  source 1..67: mol_type = genomic DNA
cacacaaaatggtggcgccgaggcggaggccggcgcacctgggggcgccacacgccctacgggatcc

SEQ ID NO: 29678 - DNA, 87 bp, Homo sapiens
  misc_feature 1..87: note = chr5:74162506-74162593
  misc_feature 1..87: note = hyper
  source 1..87: mol_type = genomic DNA
atataaaaatagatgcggttaagccgcgggggctgcaacgctgattttgcgtattcctttaatgccgaccttcgcaggattctgttc

SEQ ID NO: 29679 - DNA, 30 bp, Homo sapiens
  misc_feature 1..30: note = chr5:74348254-74348284
  misc_feature 1..30: note = hyper
  source 1..30: mol_type = genomic DNA
tagcaccgtttcctacgtgaagactgcaaa

SEQ ID NO: 29680 - DNA, 57 bp, Homo sapiens
  misc_feature 1..57: note = chr5:74349876-74349933
  misc_feature 1..57: note = hyper
  source 1..57: mol_type = genomic DNA
acgaggagtgtcccacgcagccgcgagaaatattatcagcagcgtgggaaggtggag

SEQ ID NO: 29681 - DNA, 364 bp, Homo sapiens
  misc_feature 1..364: note = chr5:75377933-75378297
  misc_feature 1..364: note = hyper
  source 1..364: mol_type = genomic DNA
ccaccacaggagcaacgatttcggggacggcacacgcctgtgtgaccgcttcccactccacttgggttccgtgagcgcgcggagccggaggagtcagggacgtgaggatgccctacttcccgcagcatccggatggcagggtctgcgtcggaaggcccgggagggcgacgccctccactgctgccgcggggtgggtgcgccaggcctgggtgtggcctcacgggagcgagtttctctccagccgcctggcccaccgctttggaacagtgaagctcgagttggggtctcctgcacgccaaggggagaaatgtttgtttctgacaacacaagcaaaattctctctcctgcacgccaaggggagaaa

SEQ ID NO: 29682 - DNA, 30 bp, Homo sapiens
  misc_feature 1..30: note = chr5:75378559-75378589
  misc_feature 1..30: note = hyper
  source 1..30: mol_type = genomic DNA
gtagacttaacccagcgaagttttcttctg

SEQ ID NO: 29683 - DNA, 689 bp, Homo sapiens
  misc_feature 1..689: note = chr5:75379005-75379694
  misc_feature 1..689: note = hyper
  source 1..689: mol_type = genomic DNA
gagcaccgcgagtggcgcgcgggtcccgcctcccccgcgcgccgtgactccctgcgcaccgctggtactctcgccacgccgccgcccggcactgcagcaccagggggaggaggcaggcggaggagaggaggaggaccgcagcgtgcaagccgggagccactttcccgcccctcctctcgccgctgacacgctcagaggagtcaccactccgcgcgctgcaggcgagagtggcagacggaggcagcccggggaagcgagccggagcggcgcccgcactgaggcggctgcagtgctgacaccactcagggcaagggtgtccgacggctggagcggtgagtgggggaggtgaagcgggcatccgcggggagactttcccccgctgctggatttctcttcccgactggtggccgggcgctgcagcctggggaagtttttgcagcctttcggaagcgcaactttgccccgcctgcccccggggaagcggctgcaggtgcccgctgctttgtaggcgcctttgttggagagggaccaggaaagtaggggtaaaatagatgcagtgaccccagggttcgctagggtaggtctggggactgggtcgcactttatctgggattcccagaggaggtgggtgggcagcagcggggatgcaggggccgcatctgcagcgaccgccacgctcttttttgctt

SEQ ID NO: 29684 - DNA, 807 bp, Homo sapiens
  misc_feature 1..807: note = chr5:75380067-75380874
  misc_feature 1..807: note = hyper
  source 1..807: mol_type = genomic DNA
caggcgaagcagacccgaggctgtgaagctcagaggggagagggaccaatcgcagtaaataagctaccgaggtaatcttagatggcgatgagggcagcaaaagccatcagccgaccctctgaccctttctcttagtgggcttttccccttccgcctgggttctagaactgggaagacttttctccagagcgtcgcggggagcgccccgggctgggcccacggggactgcggaatacggggatgaacttggcttggggcagccagcaccccacggcagatgaacaatcgggagcagatctgtgggcgtgcggggaccttaggcggcgcgcgggggcggggggaggggctgagccacgggggctagaggtgccgcctggacggcctgagctgggggcgctcgcgtcaccttctacgtgtgcgagtgatgcaaatgcagacccgcgaggggcgggcgggggtggcgggcgggggcaggcgacggagtctccgtctgggagcgcgcgtgtgtgcgtcaaaagctctgggttgatggatgccccgcggcgcgcctggcgcggagagcggcgacccggcggggcagaggggggcgggaggactgcggcggcgcggggcggcgaggaaagccccgcacggcctgggctggcgggcaggcggctccgcagtgcgccgcagtgccgggaaggagccgcagctaccgggcgctccccgggggaccgaggagatgaggcgtcttttaaggctcatgagagccttaaggagatgagaccgggatgccgtgatggtctcctctcccgctgaacctaatcc

SEQ ID NO: 29685 - DNA, 48 bp, Homo sapiens
  misc_feature 1..48: note = chr5:75699645-75699693
  misc_feature 1..48: note = hyper
  source 1..48: mol_type = genomic DNA
ctccgcatacccaaacggggtgcgcgggcagtgcggggattgcgctct

SEQ ID NO: 29686 - DNA, 30 bp, Homo sapiens
  misc_feature 1..30: note = chr5:75700119-75700149
  misc_feature 1..30: note = hyper
  source 1..30: mol_type = genomic DNA
gccaggggctgccctcggaaataggttgct

SEQ ID NO: 29687 - DNA, 148 bp, Homo sapiens
  misc_feature 1..148: note = chr5:76011206-76011354
  misc_feature 1..148: note = hyper
  source 1..148: mol_type = genomic DNA
aagggaagagctccgcgaggccgcgcgggggggaagcgggagaagccgctcttcctattccactcgcagtctgcgtgtgggggaaacgagtgcccggcgtatgaaacgcctaacttcgcgaaataaagagagacgtataaaagttcaa

SEQ ID NO: 29688 - DNA, 30 bp, Homo sapiens
  misc_feature 1..30: note = chr5:76115162-76115192
  misc_feature 1..30: note = hyper
  source 1..30: mol_type = genomic DNA
atccgggcaggtgtgcgaaggctgttctgc

SEQ ID NO: 29689 - DNA, 114 bp, Homo sapiens
  misc_feature 1..114: note = chr5:76115495-76115609
  misc_feature 1..114: note = hyper
  source 1..114: mol_type = genomic DNA
gctttttgccaactccggagacttcctccgctggccccgcggggccggtggggttagcgagctgattgcgcagggcagggcggagtgggtgggaacccgcggcccgggagcctt

SEQ ID NO: 29690 - DNA, 357 bp, Homo sapiens
  misc_feature 1..357: note = chr5:76249314-76249671
  misc_feature 1..357: note = hyper
  source 1..357: mol_type = genomic DNA
ccctctctctttattcgctatgctgagtggcagggagggtgccccgctcctggtccccttttttatccccagcccttgaacttttccggactgacctatgtttcttgccagctgagggaagcggcggactacgatcctttcctgctcttcagcgccaacctgaagcgggagctggctggggagcagccgtaccgccgcgctctgcgtgagtcgaggctgcccggctcgcgggcgcccgggacgcggggaaggtgggactctgtgcggggggcagagggctcgcggacatctcggggaaggggctggccggaaccgccaggggcgcggtccccttagctaaggatcggtccgcggagg

SEQ ID NO: 29691 - DNA, 212 bp, Homo sapiens; identical to SEQ ID NO: 452
  misc_feature 1..212: note = chr5:76249695-76249907
  misc_feature 1..212: note = hyper
  source 1..212: mol_type = genomic DNA

SEQ ID NO: 29692 - DNA, 206 bp, Homo sapiens
  misc_feature 1..206: note = chr5:76249944-76250150
  misc_feature 1..206: note = hyper
  source 1..206: mol_type = genomic DNA
cgaggagttcattaccatccactacgaccaggtctccatcgactgtcagggcggcgacttcctgaaggtgaggcgcccacggccagccaacctagccggagggcggcacgggagggttggaaagggctggggcgctgcacccagcgtggggctgctgagcgtaggtagccagtggcacttcttagacacttcgctggtgcccgagt

SEQ ID NO: 29693 - DNA, 39 bp, Homo sapiens
  misc_feature 1..39: note = chr5:76250409-76250448
  misc_feature 1..39: note = hyper
  source 1..39: mol_type = genomic DNA
cttggttagaaggcccgccccacacgtctcacatctgag

SEQ ID NO: 29694 - DNA, 394 bp, Homo sapiens
  misc_feature 1..394: note = chr5:76476379-76476773
  misc_feature 1..394: note = hyper
  source 1..394: mol_type = genomic DNA
gcacaagcccagagccggcttcagggccccctttcagacacccaggtgctagggtggctttttttcttttcttttcgcccttagtccctgcgtgtcctagtgccaactacctccttcctttccaggcgggaagcacctcgagcgtctagtgtaaccgtcaggtttattattcccaataataattgaccacagacagccgccgttcgcgtccacctggcgcttctcagcaggagctggacctgtttctccgtcgggccggctcctcgggctgctgttgcgcctggtgttttccacgcttccccggcgcgggacggtggggcccctgcattcctcctcgtgcttccagtggctgcaaagctgcctccccttctgagtagtgagtcgccggcagccc

SEQ ID NO: 29695 - DNA, 30 bp, Homo sapiens
  misc_feature 1..30: note = chr5:76506145-76506175
  misc_feature 1..30: note = hyper
  source 1..30: mol_type = genomic DNA
gccgagccgcgggcacgctctgccctgtcg

SEQ ID NO: 29696 - DNA, 253 bp, Homo sapiens
  misc_feature 1..253: note = chr5:76506506-76506759
  misc_feature 1..253: note = hyper
  source 1..253: mol_type = genomic DNA
gtatgcgcgctcccccgctcggggaggaagatggcccaaaagggaaagttggggtgacgcgcgcggtccccggaggctcggcggggggcaccgcggccagcccgacggagcggcggacacacaggccggggggcgcgcagtccgggcgccgccgcggccgccccctcactgcaggtggcagcgggtgcgctgggtcccggcggccgcgggcgcgggcgggcgcgcgggggagcccggccgagggatgggctgc

SEQ ID NO: 29697 - DNA, 442 bp, Homo sapiens
  misc_feature 1..442: note = chr5:76506760-76507202
  misc_feature 1..442: note = hyper
  source 1..442: mol_type = genomic DNA
cccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaaggtaaatgccccgcgctggcacacgccgtgggggccgtccgccccgtcggcggggctcgcacgggtagggggctccggcggagttgggtgaccgtgaggcggttggtttggaga

SEQ ID NO: 29698 - DNA, 345 bp, Homo sapiens; identical to SEQ ID NO: 454
  misc_feature 1..345: note = chr5:76923679-76924024
  misc_feature 1..345: note = hyper
  source 1..345: mol_type = genomic DNA

SEQ ID NO: 29699 - DNA, 214 bp, Homo sapiens; identical to SEQ ID NO: 455
  misc_feature 1..214: note = chr5:76924086-76924300
  misc_feature 1..214: note = hyper
  source 1..214: mol_type = genomic DNA

SEQ ID NO: 29700 - DNA, 64 bp, Homo sapiens
  misc_feature 1..64: note = chr5:76924416-76924480
  misc_feature 1..64: note = hyper
  source 1..64: mol_type = genomic DNA
cgaagggcccacgcgttccaactggcgcgaatataaccattcccaagaccggcccctcccctcc

SEQ ID NO: 29701 - DNA, 167 bp, Homo sapiens
  misc_feature 1..167: note = chr5:76924754-76924921
  misc_feature 1..167: note = hyper
  source 1..167: mol_type = genomic DNA
ttcattcttagaaagcgcttctgttctctgggtttggatttgaccagcacatgcagaaagagctgattgtgtttctctgtacaaagttgcagggttgtagatgtccgagtgcccccatcggctgccagcaggtggccgaggggcacgagggacgacaggaccaccac

SEQ ID NO: 29702 - DNA, 978 bp, Homo sapiens
  misc_feature 1..978: note = chr5:76925454-76926432
  misc_feature 1..978: note = hyper
  source 1..978: mol_type = genomic DNA
gtgacctaggtgcaccgtgtctgtgcgcgcgcgtgtgtagcgtctgagcgtgagcgagagtgcgagtgtgtgtgtttctgcccacaaaccagtccattggtgtctgatttcagatcctgagtcgactccctggtacgtaaaatggcgggaaggatactttttgccgggcgcgggaggagggtcgcgaagtgtggggaaagaggggaccggaggggaggcggcgggcgaggggggtcgtaggcgtcgcgtcgaaggtgtgggtgggaacgccgcccgtcagaaggccaggaggagggcgcgagcacggccagcgcaagcagggaggccagggtggcgggaagggtgggctgaggcgctggagaccgagccgagggcgcagctgggtgggaagggaagaggggcggccgggagacgggggaccgcgggcgatcgaaatcaggcggaggggaggcctcgcgggctggggcttggggtgagcccgagcgagtggaggagagaggcgaggacgaaacgagacggggcgaaggccggggcgggacggggcagggcgccggggtccgggtgcgcgccggaagggcctcggggcggcccccggggcggtgctgggggcggagcgggccggggcgcggctgcattaagtgaagctcatagagactgtgtgctctagcgccttgcggcggagggaggcgatgctggtgccccgccacacgtcgctgctgtccggggagctgcagagctggggcgaaccggagacgttgctggggccggggagggaggcgggcaccatgccggggaaggcgggctggtagaggtgcgactgcagccccgcgccgttggaacccgccaggctgttggacaggcccatggagttgggcggcggaccggccgccaggctgcactgggacagcgactgcgccatggcctgctgcctgcccagcgccggcggcagaggcagctgtgacacgccaggcatggcgg

SEQ ID NO: 29703 - DNA, 128 bp, Homo sapiens
  misc_feature 1..128: note = chr5:76926728-76926856
  misc_feature 1..128: note = hyper
  source 1..128: mol_type = genomic DNA
gggaggaacaagtgccgtaggcccgacaagcccccatacccagccggagactgtggctccccaccaactcctggcaactggcgccccctgcacccaccaagcgcggagtcctgcgctcctaagagctc

SEQ ID NO: 29704 - DNA, 294 bp, Homo sapiens
  misc_feature 1..294: note = chr5:76928157-76928451
  misc_feature 1..294: note = hyper
  source 1..294: mol_type = genomic DNA
aatctggtcatctggcgtttactgtgcctaaatataaatgatgtaggacaagcccaggtactgagtttcctcttagaatttggccaacgcaatttgaccacgatatccgtggaaaaaaacgttgtgcatccgttaatctaacctatttagtgtttactctgcaagctaaagtatcaggggtatggacatacctgccctcggtctcggtgagccagcaatgttcagcggtgtgttcatgcccaggcaagcgtagacgcactctacgcttaccagtgtgaacggtgttgcagtcta

SEQ ID NO: 29705 - DNA, 262 bp, Homo sapiens; identical to SEQ ID NO: 2590
  misc_feature 1..262: note = chr5:76928678-76928940
  misc_feature 1..262: note = hyper
  source 1..262: mol_type = genomic DNA

SEQ ID NO: 29706 - DNA, 984 bp, Homo sapiens; identical to SEQ ID NO: 2591
  misc_feature 1..984: note = chr5:76932282-76933266
  misc_feature 1..984: note = hyper
  source 1..984: mol_type = genomic DNA

SEQ ID NO: 29707 - DNA, 55 bp, Homo sapiens
  misc_feature 1..55: note = chr5:76933464-76933519
  misc_feature 1..55: note = hyper
  source 1..55: mol_type = genomic DNA
cgcttcggcagcctgacgaactgtacctccggccctcagccgattccctcttact

SEQ ID NO: 29708 - DNA, 614 bp, Homo sapiens
  misc_feature 1..614: note = chr5:76934040-76934654
  misc_feature 1..614: note = hyper
  source 1..614: mol_type = genomic DNA
cctaacaaattatcacggggtatatcgcctttcgaaaaaaaaaaaaaggcgggggaggggggaagagaaaaataagaaaaacaaaaagtaacaacattccccaactcctttcttggatctacatattccatagatttttttttaaaggcgatgttaaatcaaattaaactttaatgcagcacaattacttttaaagaaattagtccatttaggtcgcattaaggtaaaataaggaacaaattgacaatttcctgccccggcttctcctggctgcccgggcgagaggcgcgcactcacctagcctggcgtccaggaggtcggcatgagacagcatcgcgcaccgctccagggcgaaagctgttcccccccaaattttagcggctttaagttatttaaaatagatataagctataagctatacgatatagatatatatagatcacctaaatgaaagaaaattcggtttgtggttaaaaagggggcttcttgcattataatgtcctttagagagacggggaggtgcttaacagttgaatgaacccgtgagcagctcggcgaggggaccaatcaggagggcagcctgcaaatgtcagcgcccggagagtcccccactc

SEQ ID NO: 29709 - DNA, 344 bp, Homo sapiens
  misc_feature 1..344: note = chr5:76934676-76935020
  misc_feature 1..344: note = hyper
  source 1..344: mol_type = genomic DNA
cgcctgaaggaggcggcggcggcagccctggcagctccagcccggagcaggagctaaagcagcctcagccgcctcggcctcgccctgagcttctgggcccggctccctctagttcttccctgcgattttctccaggctcccctttccttccccttggccggcgctgcgcgcttcgaaggcgtagctctgtgcctctgagctaacatcttcctagggcaggggcagagcaggggtcagagcgggccatgaccctggcgtgacctgagggtcgcccccacctgcgctctctgggcctgccgctcatattggcccgccagcccagggcgcgacgagggcacaccgcg

SEQ ID NO: 29710 - DNA, 23 bp, Homo sapiens
  misc_feature 1..23: note = chr5:76936016-76936039
  misc_feature 1..23: note = hyper
  source 1..23: mol_type = genomic DNA
ggctgagagcagatgcgagagga

SEQ ID NO: 29711 - DNA, 622 bp, Homo sapiens
  misc_feature 1..622: note = chr5:76936099-76936721
  misc_feature 1..622: note = hyper
  source 1..622: mol_type = genomic DNA
agggaccgagcaaggagacaaaggaggcggcaaagcgaactctcgggcagttttgtttcctccttccctcctgcagcccgttcgcctcctctcctgcacacacacgtgcgcgcgcacacatatgcacacacgtgtgaatgcagggtattggccacaccagtttcttctgagctgcggagaccgcttcccgggaagctccgggccggactgggtttcagcggctgctgcagctgctaccaacgcggcctatgtgggactgggcgccggggtcgtggactcaggctcgcggcgtgtctgggagccgctagggtttttggcaagcggccgcagcccttctgagaaacgctttgcctgggaggagaattccgagacctaaagcaaacaaagtctccccaataaaagctttctttgcccccaaacaaaacctcaaatctagaagctagagcgctgggagcgcacagcaaaaggaggccagacagcagcccagggaggggcggcgtgagctcaggacggtgactcgggagtacgcaccggcccgcgcacgtccagggactcgcaggaggtttctgcccacctgggtggggcttgcagggtgtccacaccggaacgcagggtcagaagt

SEQ ID NO: 29712 - skipped

SEQ ID NO: 29713 - DNA, 280 bp, Homo sapiens
  misc_feature 1..280: note = chr5:76939533-76939813
  misc_feature 1..280: note = hyper
  source 1..280: mol_type = genomic DNA
ttgtgtgtgcttgtgcgagcagtgcgtgttccttgcctgttcactcacacggagggggcatgccaggcgctgcggaggggcagaaacctgccccaaagagtctcatttcctatcccacccagaagcctttcgcaatacacgagctcgacatatacacttttttcttttctgcagtaaacagtttcccacacattcgagtttgcaaacttcaaccagacagtccacccgcctgacttttcgtgggtgcaagggccggtcccttgctcgttttttctcccat

SEQ ID NO: 29714 - DNA, 54 bp, Homo sapiens
  misc_feature 1..54: note = chr5:76940355-76940409
  misc_feature 1..54: note = hyper
  source 1..54: mol_type = genomic DNA
cgctcgcccactccccgctcgctccccgcccggctcctacgtcccaatcctttt

SEQ ID NO: 29715 - DNA, 641 bp, Homo sapiens
  misc_feature 1..641: note = chr5:76940857-76941498
  misc_feature 1..641: note = hyper
  source 1..641: mol_type = genomic DNA
ccctcgtcccctccccgcaacccgagtgcggctaattccgggcgtctatattcactcaattagagaaatctacagagaagatcgatcttccatctgcagacatgccagcttaacaaattagattcttgtttcgtgcaggtgatttggtgacagttggggaattagaagtaataagttgttgtgtttgagcccgggcccccgccccccgcccgcgcccctccccgcccgggggcccctcggccgcgcccgccgcccgggcaccccctaccgcaccccccagccggcccgcgccgccgccgccgtcgccgcatcccccgccgtaattagtgctgctgccctccatgtgggctcgattaaaccgtgatttagccgaaagaaatataattatggctgcaaataaaataatcagcattgaagagcgatttccttaatgagatggagcggttgcacgtcacggagtaaaggggtctcattaagaggtggtaatgaggcttgggtggatggtgcagttacaaaatagcccaactcctctgcaggccgggcccgtccgcccgaagtggccgccgcgtcgccttccagcggtccggaggtgccgcggtcccagaggggactcgggcccgccccgcccggcccccaggggg

SEQ ID NO: 29716 - DNA, 389 bp, Homo sapiens; identical to SEQ ID NO: 7912
  misc_feature 1..389: note = chr5:76941512-76941901
  misc_feature 1..389: note = hyper
  source 1..389: mol_type = genomic DNA

SEQ ID NO: 29717 - DNA, 184 bp, Homo sapiens
  misc_feature 1..184: note = chr5:77140527-77140711
  misc_feature 1..184: note = hyper
  source 1..184: mol_type = genomic DNA
gctgagccattttcccgcgaggcccccagcggcgcgggggctgtggggaggtggtgtgggagtacggtcgctgctgcgcggcgtggggagaactggagcggctgcccggacgcccccgccctggtcccgggtactttctcggcctggctgcagccgcgtggatgtctctcgaagcctccaccct

SEQ ID NO: 29718 - DNA, 124 bp, Homo sapiens
  misc_feature 1..124: note = chr5:77147526-77147650
  misc_feature 1..124: note = hyper
  source 1..124: mol_type = genomic DNA
gtgtgcgtgtgtgcacgcgcgagaagtgcgtgtgtaggcgcgtgtgcaagtgcgcgcgcgtgtgtttacacttccagaagtcaaatcctttctaggactcccccttgcttcacccggaagtgtt

SEQ ID NO: 29719 - DNA, 260 bp, Homo sapiens; identical to SEQ ID NO: 461
  misc_feature 1..260: note = chr5:77147872-77148132
  misc_feature 1..260: note = hyper
  source 1..260: mol_type = genomic DNA

SEQ ID NO: 29720 - DNA, 280 bp, Homo sapiens; identical to SEQ ID NO: 462
  misc_feature 1..280: note = chr5:77148393-77148673
  misc_feature 1..280: note = hyper
  source 1..280: mol_type = genomic DNA

SEQ ID NO: 29721 - DNA, 367 bp, Homo sapiens; identical to SEQ ID NO: 463
  misc_feature 1..367: note = chr5:77268367-77268734
  misc_feature 1..367: note = hyper
  source 1..367: mol_type = genomic DNA

SEQ ID NO: 29722 - DNA, 503 bp, Homo sapiens
  misc_feature 1..503: note = chr5:77268735-77269238
  misc_feature 1..503: note = hyper
  source 1..503: mol_type = genomic DNA
gcccccggggaccgcgagcaacaaaagcccggcccgcagcccctgctcctcgccttccttttcaattctcccctgatctcaggtggaattaggaggattaaagcagcaagtaaatgaggcgagtgtgcaaaatgactcctttctgaaccaaacggcatgctccgtgctggggaaatgagatgcacatttaaatctcatccatccaccgcctgcggccaccgccatgtacctgcctacttagcccaagggttaattaattgaggcttcaatgcactattgcaagagcattattgcatttgatactctacatctgtgatttaaaactctttcagtcccttgtcagcaagggagggtttttaactaggaaattagcattcagataagggaacgctctatttgcttctgaaaggaaggaaatattaaggatgctggtgcacaaaccgggctgtcatatcctgtcccatcctggagggagcgcgagggcccggctcctctgggagtgg

SEQ ID NO: 29723 - DNA, 71 bp, Homo sapiens
  misc_feature 1..71: note = chr5:77269263-77269334
  misc_feature 1..71: note = hyper
  source 1..71: mol_type = genomic DNA
cgccagcaccaggggcgggctggagggggaccggcgatcagggaaaccttactcctcgcaggcttcaacct

SEQ ID NO: 29724 - DNA, 114 bp, Homo sapiens
  misc_feature 1..114: note = chr5:78407604-78407718
  misc_feature 1..114: note = hyper
  source 1..114: mol_type = genomic DNA
taaagaggcaggctgcggactcggagcagctcggggctgcgcagcgggaaggctcgcctagtcggtccgcatccgtgtcgaccacctgtctggacaccacgaagatgccacccg

SEQ ID NO: 29725 - DNA, 94 bp, Homo sapiens
  misc_feature 1..94: note = chr5:78408181-78408275
  misc_feature 1..94: note = hyper
  source 1..94: mol_type = genomic DNA
gatatcccgtccccacggagcccctccgcatctgtgtccgaggccgccgcgagcgccctctgcacccggcgcgcccagaacagggaggagtgca

SEQ ID NO: 29726 - DNA, 45 bp, Homo sapiens
  misc_feature 1..45: note = chr5:78408297-78408342
  misc_feature 1..45: note = hyper
  source 1..45: mol_type = genomic DNA
cgcctggatctgcaccgcgggtgtcggggccgcctccccgccggg

SEQ ID NO: 29727 - DNA, 16 bp, Homo sapiens
  misc_feature 1..16: note = chr5:79330913-79330929
  misc_feature 1..16: note = hyper
  source 1..16: mol_type = genomic DNA
ctttctctccagcccc

SEQ ID NO: 29728 - DNA, 205 bp, Homo sapiens
  misc_feature 1..205: note = chr5:79330930-79331135
  misc_feature 1..205: note = hyper
  source 1..205: mol_type = genomic DNA
actgcccatcttcgcccctaccctcgcgcgtcggggccgtgtctacacccaccccaggacctggtccgtccaggctccttcccatcctcacacccgcgcctttctccctgcggccccggctcgctgctccagctgcccagctcttcccaggacaggggatcccgccaagggggccgcccccgccccggccctcccccgcccggcc

SEQ ID NO: 29729 - DNA, 108 bp, Homo sapiens; identical to SEQ ID NO: 7923
  misc_feature 1..108: note = chr5:79331229-79331337
  misc_feature 1..108: note = hyper
  source 1..108: mol_type = genomic DNA

SEQ ID NO: 29730 - skipped

SEQ ID NO: 29731 - DNA, 610 bp, Homo sapiens
  misc_feature 1..610: note = chr5:79864835-79865445
  misc_feature 1..610: note = hyper
  source 1..610: mol_type = genomic DNA
ctggcagcgtctccacggtccccgccgacccctggaaccaggcgcgtttcctcagtttttcctgagagcaggaggaagcgagctcaaggcgctgtcggagaagggcaaaggaaggtgactggggcgacagctccagggcaccgatgggggcggggtgcgcgtttcgtcgcctcatctctgagccagggcaggcagctggcgggctaaggcgatcaccatccatgaaaacgggttctgcccacagccgctgcggagcggtccctgcgccgctcgcccgccggccggacgcggccctcccttgggaaatggtgcgtctgaggggcgcagccactgcccccatcccggagcaggcgcacctctgcacccggctctctgctaagggggtccggtatcctggtgccaaggctgtgcgcacctgagaagggcgggaaccggctgcccgcccctgtgtggctcctggaagcaggagctcctggaagctgcaaagggctccgcagtccccagcccgcccccagcgcccagccggcacctcctgctgcccagctgccgaggcacctgcggagacgcgcccaagtcagcccctccggagacgcgcccaagtcagcccctc

SEQ ID NO: 29732 - DNA, 140 bp, Homo sapiens
  misc_feature 1..140: note = chr5:79865522-79865662
  misc_feature 1..140: note = hyper
  source 1..140: mol_type = genomic DNA
cgcatcctcctcgacaccccgcggccgggcagccctcgccggttcccgccgctcggcgaggctgagaaggaggcggaacccgcatccccgcggagtccaagccccagcggccgcaaaactggaaccgagaaccagtggga

SEQ ID NO: 29733 - DNA, 361 bp, Homo sapiens
  misc_feature 1..361: note = chr5:79866099-79866460
  misc_feature 1..361: note = hyper
  source 1..361: mol_type = genomic DNA
gcagatctcggtagatgccgcccagtccccgccctgcttgcggaaagaggcgggcgactgccgcgaagcgctggagctgggacccggagcgcacacctcgccagacgcccgggcagcgaggcgcttccgctgggggtgacgcgtcggctccaggctctgcgcaggtgagggcggcaaggctcctctggacccaggggggccagcagctgctggaagctccgccttctgtccccgtaagtcccacccccgtcccccgcttcggccaccgcgcttcggccacggcgacttggccaacaacagcggcagcagggtctccccattgagggaagcacgcacccctacgtcacgggctttggctcct

SEQ ID NO: 29734 - DNA, 300 bp, Homo sapiens; identical to SEQ ID NO: 7928
  misc_feature 1..300: note = chr5:80255775-80256075
  misc_feature 1..300: note = hyper
  source 1..300: mol_type = genomic DNA

SEQ ID NO: 29735 - DNA, 58 bp, Homo sapiens; identical to SEQ ID NO: 7929
  misc_feature 1..58: note = chr5:80256312-80256370
  misc_feature 1..58: note = hyper
  source 1..58: mol_type = genomic DNA

SEQ ID NO: 29736 - DNA, 138 bp, Homo sapiens
  misc_feature 1..138: note = chr5:80256428-80256566
  misc_feature 1..138: note = hyper
  source 1..138: mol_type = genomic DNA
cgtggggaaagggggcgcccttcgccggccgggacctgagcggtcgcgccctcgagggagccagctgggccatggccgcgaggcaggggtgagaccggcggccacccgtgagccctccgcacccgcaccatgcagaag

SEQ ID NO: 29737 - DNA, 59 bp, Homo sapiens
  misc_feature 1..59: note = chr5:80256887-80256946
  misc_feature 1..59: note = hyper
  source 1..59: mol_type = genomic DNA
cgcactcccttgccgtcctaatccggggatcaggggtcgggggtcgtgaaagagtgcgg

SEQ ID NO: 29738 - DNA, 122 bp, Homo sapiens
  misc_feature 1..122: note = chr5:80689673-80689795
  misc_feature 1..122: note = hyper
  source 1..122: mol_type = genomic DNA
ccctatccctggctgcgcagggttcagctctccgcaagtaccttcctcgccttcctaccccccccagcccccagccgccgccgctcccgcagccccggtcccgcgcctccccgcagccccgg

SEQ ID NO: 29739 - DNA, 275 bp, Homo sapiens
  misc_feature 1..275: note = chr5:80689879-80690154
  misc_feature 1..275: note = hyper
  source 1..275: mol_type = genomic DNA
cgccggctggatggcttggctcatgaccacctcgccgggcgccggccgctccatggccagggcgagagcgctacgcctgcggcccccgacaccccaccatgcccgctccgcccgccccgccctccccgcccagctccagagggcactggcgccgcccgcccgggccgcgaacccctggccgccaggtggtgggagctgcgagtgagggggcccgcactgtcatcccaggactatcgcgagtgggggaaaaccagcgctctcgggtctcaggagaa

SEQ ID NO: 29740 - DNA, 30 bp, Homo sapiens; identical to SEQ ID NO: 7933
  misc_feature 1..30: note = chr5:81075100-81075130
  misc_feature 1..30: note = hyper
  source 1..30: mol_type = genomic DNA

SEQ ID NO: 29741 - DNA, 639 bp, Homo sapiens
  misc_feature 1..639: note = chr5:82767171-82767810
  misc_feature 1..639: note = hyper
  source 1..639: mol_type = genomic DNA
ccagaactagctgcacggggggcggggaaatgggggtggggaaggagtgggagggcagtggtttccgcgagcagagcgatgttactgagtgagtccctgaatggggagcgctgctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattt

SEQ ID NO: 29742 - DNA, 1152 bp, Homo sapiens
  misc_feature 1..1152: note = chr5:82768217-82769369
  misc_feature 1..1152: note = hyper
  source 1..1152: mol_type = genomic DNA
ttgttgttcttaacacgctcgaggcaaaagtttgaatggggactaccaagacttgccacagacaagtccccgaagccgccttggtgcaggccacctggtttcccagcccctggtgtgtggtcagtgcctggtgttcctggaaagccactcccgggcagctcctgacagtgcgacccggcgcccaagcagcctgggaccttgcgcggacctgaccccttcagaccgcaggcagtctgggaggaggtccggccgggggaggtgcaggatccccgccgtgtctctttgacgacttggggactgtcacggttctctcccggcgcccctgggttcttttgtcctgcacgcggtgcgaaggggccagcagggaaggagcagaggatggggggtggggttgttggagccccgcggaggtctgggaggcccctgggcgggaaaagcctgttctgaatcggcagggatgtgcaacaatttttctcaccctgaagagtgaaatagggtctgtcgctcccatctcaacaagcaaaccggcacccagagcgcactgcagacaaaggtggctcggggacccgaatcaggggcctctgggtcagtcctctcgcccagactacaggagtcctccgtttccttacatattccccaccctctcctagttctccgctctagttgagcaactttactggcaggtctagcggcagcggcgcgcgcgtgtgccgggagccccgggggacgtcctcggctggagcgccccaccgtcctgcagaggcgtgggcgctgtagggcgacatccctggtgcgtgcagacctagggcatccgggttgttctggcccgcggtctgtgtcactgggcgtggagcggtctgggtgttaggcagaggagagcggggtagaaaaatagtgtcatagcctaaactatttgctctccaatccaactgcgtctcggcaagtcctgcatgtccctgggagatgctgcgggaagggggagaaatctacacggcgcctggagagttgtcctgccgcgcgcacacccgcggcagagtctctctgggtcgcgttcctcatctttgtgtctccctctgtctccatcttctctgcctcccttcccctctcccagcctctgttctctctctctagcttctgcgtcccctcccccac

SEQ ID NO: 29743 - DNA, 293 bp, Homo sapiens
  misc_feature 1..293: note = chr5:82769910-82770203
  misc_feature 1..293: note = hyper
  source 1..293: mol_type = genomic DNA
accacttgaacccaacgctagggccccgccccaggatattgcaaaagaagggctcctaatccaaaacttaaacttcctcaacttcagggcgggcgtcggacgggaaagtggagagaaggcgggcagtgggaggaaaaaagaaagggaaggaagggaagtggaaggaaagaggaccgtggaggggaggaaaaggagaaaggaacggagatggggcagatggcattcaaacagccaggaacggaccggaagggttcgtttcggggtttgggtctgaatttcgagactcgttttag

SEQ ID NO: 29744 - DNA, 112 bp, Homo sapiens
  misc_feature 1..112: note = chr5:83017828-83017940
  misc_feature 1..112: note = hyper
  source 1..112: mol_type = genomic DNA
ggctgttggagcagccgggaggagggagcggggctggccctgggactgaggacaagcaaacaagctcgaggggcccgcggccagggtggaggcgagacgcaggccgtccccg

SEQ ID NO: 29745 - DNA, 236 bp, Homo sapiens
  misc_feature 1..236: note = chr5:83678989-83679225
  misc_feature 1..236: note = hyper
  source 1..236: mol_type = genomic DNA
gaggattctattacccgcggatccctcacaaggggccgcccgcatctgtgagcgcaggagtggcacagctcccccaggcacagctcccactcgcctccccacacaccctgctgcccccgctgcccttttccggcgactacttcagccccggccagcggtgagacccaggtcagcacaagggtttgtatggacaagctgcacctcgcaggggacctggaagtcgcctaaactactcc

SEQ ID NO: 29746 - DNA, 56 bp, Homo sapiens
  misc_feature 1..56: note = chr5:83679587-83679643
  misc_feature 1..56: note = hyper
  source 1..56: mol_type = genomic DNA
ggccaaaacgcccagcgccgggtctgggtttgcgaacggctcagcccaggccctgc

SEQ ID NO: 29747 - DNA, 725 bp, Homo sapiens
  misc_feature 1..725: note = chr5:83679644-83680369
  misc_feature 1..725: note = hyper
  source 1..725: mol_type = genomic DNA
ccagagcaccgcacccgggggcggacggccctgcagctccccagcctcttcccgcatcaactagctgacgcccgggcgcactggcttcccccgctcccgcccgcacgaaagccctgcccgacgtctgcagtcagcatcgcccgcactgcctagggagggtttgcgccgagacccagtggccgagtgagccacagagtcgctggtcctggggacgctgtcttctaccgctccccaccgtcctcctctttcctgtatctcaccccggtaccccgcacccttctccccgctcggccccgcgcactctgctcagactttacaagcactttctcggggcacccaggactcgacgcctcctccgcgccgccagcggcgctcgccacccttggcacgccggagggaccgcctccggccccctgcgcggcgtttctcaggggactcccagcccatccctcacccagctgtccgggtcccgacgccttacctttgccgaactgggggacaccgaggctgagcccgaccaagagccagacggctaccgagcgcttcatgatcccgtctcccggacgtgaccccggctggtcaggggtcgtcgcggagggcagtgtagccgaggtggcagcgcagggcagcagcagactccgcccctactaaagaattcaagaagacgttctctttcctcagcgctttgttaaacaaattcttggagagggcgagagtggtgacta

SEQ ID NO: 29748 - DNA, 131 bp, Homo sapiens
  misc_feature 1..131: note = chr5:87436611-87436742
  misc_feature 1..131: note = hyper
  source 1..131: mol_type = genomic DNA
tcctgttccaggagccgacagggaacagcccacctggagcaggtcttgggccaccactcgccccgccccccgtctctactcctcactcgctctccccgctcctattaagcagccaacgctgggtgatctcc

SEQ ID NO: 29749 - DNA, 30 bp, Homo sapiens
  misc_feature 1..30: note = chr5:87955350-87955380
  misc_feature 1..30: note = hyper
  source 1..30: mol_type = genomic DNA
aaacagtaatcagaccgaaagtagttgagg

SEQ ID NO: 29750 - DNA, 63 bp, Homo sapiens; identical to SEQ ID NO: 466
  misc_feature 1..63: note = chr5:87955602-87955665
  misc_feature 1..63: note = hyper
  source 1..63: mol_type = genomic DNA

SEQ ID NO: 29751 - DNA, 101 bp, Homo sapiens
  misc_feature 1..101: note = chr5:87955839-87955940
  misc_feature 1..101: note = hyper
  source 1..101: mol_type = genomic DNA
cgcagagccggacctgtgccgggcgagttggatttagcccagttagagttaagatggtatcattagctgcgcacagcgtgacttcccgctaatcctctctg

SEQ ID NO: 29752 - DNA, 505 bp, Homo sapiens
  misc_feature 1..505: note = chr5:87956158-87956663
  misc_feature 1..505: note = hyper
  source 1..505: mol_type = genomic DNA
gcccagagtggcaagcgctcaccaacgccggccaccgagcaaaacttccccgcccccgccccccacccagcttccccgcagggagaccctttccgttagcagcttttcactaagttaataacggtgtgtgtgtggtggtggcggggaggggggatttgggggttacacaatatctatatcaatgatattgatcacgtccagggaagaagcctgggcaaaactagagacaccgagtgtcagcaaaagaaagcttcttaaccacaagttgcgtgccgcctgaggaaggtgccctgtggcagggggtggccgctgggagatgcctgcctctaaccgacgtccaggcgtgactaaacctcgacgccacccccattcacaagctcaactcagggattcccaagcaaccgcagaccggaggtggcgcagaggcagtgaccgaggtcgctgattaggggccgagaggctggcaaataataattttaaaaaaaaaaaaaaccggaatagcctt

SEQ ID NO: 29753 - DNA, 521 bp, Homo sapiens
  misc_feature 1..521: note = chr5:87956679-87957200
  misc_feature 1..521: note = hyper
  source 1..521: mol_type = genomic DNA
cgtgccaggcaaaggacagtctgacgacccgcccctgccgagccccgcagcgcggcgccggtgtccagcagcctccaaggcgccgagcgcgggcacgggaacttgagctagcgcaaacttgggcggcctcccagcctgctacccgggccgcagcgcgcccccggcctcccagtcgcgcgccaacccgggagcgcgcgcgccggcgcaccagctccatcagctagaggagcccgtctcccgggaaacaccaatcagacgcccgctttcaggcgagggccgcgagccgcagcagctgcaggaggactcgggcagttggcggtcaccgggaggcgtcgtcctgccccgcggcgggccagccgccttcgctgctgccactgcctagcctaaccgcatctgcagccagtcacagagtcggctgtctcctctttgcaccgcccacgccaagtaccttgcaaggcggctgctaagcctggctaattttagatctccagaatgcgctatgcccgcgctcaactaaaacc

SEQ ID NO: 29754 - DNA, 221 bp, Homo sapiens
  misc_feature 1..221: note = chr5:87962639-87962860
  misc_feature 1..221: note = hyper
  source 1..221: mol_type = genomic DNA
tctttcattctcacacgctccccggcgatcttgaaggagtttttactttcggttatctagctttatgaagaccaatacactcatacagctagataaccaaagataacaactcgcttcccacacaggcctctgtcttcctcttgccagactccaggtcctgatcctttctggcagtaccgaagagtggtcgtccaggatacttgccgcgcttaagattcctc

SEQ ID NO: 29755 - DNA, 55 bp, Homo sapiens
  misc_feature 1..55: note = chr5:87963456-87963511
  misc_feature 1..55: note = hyper
  source 1..55: mol_type = genomic DNA
aattgtggaccagcccggcaaggtcaaaggttcgagaccgcgggagaccaaggta

SEQ ID NO: 29756 - DNA, 326 bp, Homo sapiens
  misc_feature 1..326: note = chr5:87967773-87968099
  misc_feature 1..326: note = hyper
  source 1..326: mol_type = genomic DNA
aagaaagggaggaaacggaacccgactctgcggtgctgggcccaaggcagccacagctccaaaggggcccccggccgtggccgtgacttgacagagcctccggtctaacttctgatcaattccactgctctcctgacccctcaagacagtcccccattcaagcaccgcgggtacatttgcaagataaaacgccgcagacactaatgcaaatacattgcccgagttcccatcaccctgggttcctgcagataattccaggccacagaaaggagttcttgccttcctcagccgggtctagactctaagcaaaccgcaaagacctagct

SEQ ID NO: 29757 - DNA, 11 bp, Homo sapiens
  misc_feature 1..11: note = chr5:87968675-87968686
  misc_feature 1..11: note = hyper
  source 1..11: mol_type = genomic DNA
gcaccggctag

SEQ ID NO: 29758 - DNA, 148 bp, Homo sapiens
  misc_feature 1..148: note = chr5:87968772-87968920
  misc_feature 1..148: note = hyper
  source 1..148: mol_type = genomic DNA
cgatactcacttgatctccctgcgccaggcaatgctgccccccaaatccagctgggcaggaaccgaggcgccggctgaaagacaagatccaaagtcacagcacggccgcagcacacaaacaggcttctttcggcgtctccaaaaaaaa

SEQ ID NO: 29759 - DNA, 73 bp, Homo sapiens; identical to SEQ ID NO: 472
  misc_feature 1..73: note = chr5:87970041-87970114
  misc_feature 1..73: note = hyper
  source 1..73: mol_type = genomic DNA

SEQ ID NO: 29760 - DNA, 803 bp, Homo sapiens
  misc_feature 1..803: note = chr5:87970115-87970918
  misc_feature 1..803: note = hyper
  source 1..803: mol_type = genomic DNA
ggggtgcggggaggcggtgcaggaatccgtcccgccgagtgccgtcggcccctgtgggcctgtttgcgcgcctggggctggccgcattctgggcgcgggtgtctgcgtgccggggtggtagttccgagcctgcgcgcgtgcgaccgggtacgggagggggaagagtgccgtaaaaattcagacgagtggcccgtatgtaaatgcagcccgcggggagcagggaggcggtaatgacagccgctggcgctcagccccgccggcggcccctagctttcccgccaagtgcagccggaggacagacagccatgcgtgtccttggcgggagagcccccacccgccgcgcgcgcccgacccccgcgcacacgcacacactcccctcgcaggcgtggggcccaatggccacgaacatgtcaggaaaacaaagctggggctgcgaggtggaacgatgaaacggcacacttggcggccgagggcagagcggagaagtcgccaccacagccaccggcgcccctttcttgcctgctcgtagatctgccctccggcccagaagaggccgaggaccatttcttagctgccccagaggagggggcgagcagaggagggggcggatgtgcacagggaggtgccagcggtccggtgcgcgggcacgcacacgccggcgcgcagggctgccgcgggcggaaggaggggaatgacaaggcctcggccgcgtctcggagaggcactacctccgcgctgaggccgctgagtttcaagtgcaaaacaccaggccaaatccggcaaggcggcggctacagaatggc

SEQ ID NO: 29761 - DNA, 387 bp, Homo sapiens
  misc_feature 1..387: note = chr5:87971517-87971904
  misc_feature 1..387: note = hyper
  source 1..387: mol_type = genomic DNA
agggaagcaaaagaacgtgtgtgtggtggggctggaagctcagggcaagagtctgcgtgtgcggccggaaggctggcgagtctgagagccgcgcggtgcagaaagaaggcggcggcttgtcctcccccggggccggcactggtcccttggcaccccggcctgggctcggctactgccgccgccgcccgcgctctcgggctccgccggctgccgctccgtgttttcccccatcccggcttcacgttcaaggtttagctgcgaggtcacgtccattgacgtcagctccctgtctccctctacgtccggctacatttacatacatcaaggaaattagggcattaaaaaaatatgcaaatcctgcgcgaagaggagcgggtgcattcctgg

SEQ ID NO: 29762 - DNA, 18 bp, Homo sapiens
  misc_feature 1..18: note = chr5:87972106-87972124
  misc_feature 1..18: note = hyper
  source 1..18: mol_type = genomic DNA
gcataatcagggctccgc

SEQ ID NO: 29763 - DNA, 434 bp, Homo sapiens
  misc_feature 1..434: note = chr5:87974084-87974518
  misc_feature 1..434: note = hyper
  source 1..434: mol_type = genomic DNA
aatctcccttattggcgcatggtagtaacccaaagcgtgtgaaccgtcaccgtcgctgccgtgtgcgcgctgtggcttaccccgagggccggtggctcggtgactcgctggctaggtgggtgttggggaagagggtgggtagcgtcgctgccgctgccgccgcgggtccgggtgctctgtcccagcccggcagccgagcgcgcagtgtcggagccccctcccaccccgccctcacccccatcctcccctcccctcccttctgcgcctcccccaaccccccgccccgcattaccatatggaggccgagtccctgcgaatcacagcagcagcgggaggtatttgaataagccccgcaaccccgcgcagaccccaactcctccgagagcagcatgccctgcaccaagagccaccactctggccggtaacctggcagc

SEQ ID NO: 29764 - DNA, 30 bp, Homo sapiens
  misc_feature 1..30: note = chr5:87976608-87976638
  misc_feature 1..30: note = hyper
  source 1..30: mol_type = genomic DNA
acacacaggcacacacgcatgcccattttt

SEQ ID NO: 29765 - DNA, 100 bp, Homo sapiens; identical to SEQ ID NO: 7953
  misc_feature 1..100: note = chr5:87979725-87979825
  misc_feature 1..100: note = hyper
  source 1..100: mol_type = genomic DNA

SEQ ID NO: 29766 - DNA, 100 bp, Homo sapiens; identical to SEQ ID NO: 7954
  misc_feature 1..100: note = chr5:87979885-87979985
  misc_feature 1..100: note = hyper
  source 1..100: mol_type = genomic DNA

SEQ ID NO: 29767 - DNA, 156 bp, Homo sapiens
  misc_feature 1..156: note = chr5:87980430-87980586
  misc_feature 1..156: note = hyper
  source 1..156: mol_type = genomic DNA
ggaccctgacaggtacggactccgcgggaccccagtgtgcttacctcgagcgaggccctggcaaatggtggcccagaagcatcaagtttcctctcccagccgttgtgccagatttcccctcctgccttctgctcctctccgccagctcgtttctct

SEQ ID NO: 29768 - DNA, 636 bp, Homo sapiens
  misc_feature 1..636: note = chr5:87980646-87981282
  misc_feature 1..636: note = hyper
  source 1..636: mol_type = genomic DNA
tttagaggcaaaagcttgcttattcagaggagagagggagggggagagggagaaaggaggcgggagggaggagagacgggggagagagaagtaaaagggggatggaggatgaagaggaggtggagaatcagaaggtagtgcgggcgttgttagagaaggaggaggaagaggaggaggaggaggagggatgggaggggtagggtggagtaaccaaagatgggctgggatgggacggcgaggaataaattgctccccacccagctgcggtgcgacgcccccagcgtcccaggggagccggtgcgtcagctcacggctggccaaggcggggccgtacaaaagctagcgccgcgggacccccttcatgggcttctaccctagcagaccgagcgctggaggccgctccacgcgcgagctcgaaccacggagggctctcagctcggacaagcgtcgctgtctaagagctccaagctccacggaactttgattttatgcccgggagcccggtcatccacttctgcatctcagacaagcgccggaggctcgtgcagcttcctcgcgtcctcttcctggacgcggggcgcccaccttagtcatagcccctggtcccggcactgctcacgccgtcggtttccccac

SEQ ID NO: 29769 - DNA, 30 bp, Homo sapiens
  misc_feature 1..30: note = chr5:87983365-87983395
  misc_feature 1..30: note = hyper
  source 1..30: mol_type = genomic DNA
taggttctatggtgccggcactgaggagtg

SEQ ID NO: 29770 - DNA, 30 bp, Homo sapiens
  misc_feature 1..30: note = chr5:87984984-87985014
  misc_feature 1..30: note = hyper
  source 1..30: mol_type = genomic DNA
gccgccattccgcttcgtcttttcctgcaa

SEQ ID NO: 29771 - DNA, 179 bp, Homo sapiens
  misc_feature 1..179: note = chr5:87985348-87985527
  misc_feature 1..179: note = hyper
  source 1..179: mol_type = genomic DNA
aataatttgggactgcgataaaaaaaaaatagccgcagtttcgaagtcccagagctttatcaggaagcattggacgcccctttctcctccagactggggcgggcttccagggatgccccctccgaccccgtcaccagcggaggactcatctgccgcggggctgccggaagctctcactc

SEQ ID NO: 29772 - DNA, 122 bp, Homo sapiens
  misc_feature 1..122: note = chr5:87985922-87986044
  misc_feature 1..122: note = hyper
  source 1..122: mol_type = genomic DNA
acccttttgtcagaacgcgaattaatgtttccaagattttttctcaaaagaattaagagctctagaggcgcctcttccactcactagggcaccatgtcaaagggactcgtcatggcgattta

SEQ ID NO: 29773 - DNA, 63 bp, Homo sapiens
  misc_feature 1..63: note = chr5:87986310-87986373
  misc_feature 1..63: note = hyper
  source 1..63: mol_type = genomic DNA
cacccccctagctcccgcgttaaaatcaccagagtcaattcccggcgtcggtctccacagtca

SEQ ID NO: 29774 - DNA, 108 bp, Homo sapiens
  misc_feature 1..108: note = chr5:87988193-87988301
  misc_feature 1..108: note = hyper
  source 1..108: mol_type = genomic DNA
aggactggggttccacgcctggagcgcagttaccttgttgcgcccgcatgtgcctcgggaagtgcatctgcgaccctaggtcggggaccaccgcgttagtgagggaca

SEQ ID NO: 29775 - DNA, 135 bp, Homo sapiens
  misc_feature 1..135: note = chr5:87988516-87988651
  misc_feature 1..135: note = hyper
  source 1..135: mol_type = genomic DNA
gtctcgcagtaggctcgggtcacaggagggagggggtaggggttcagctccgccgaaagagttagctaccgtcccctcctttctcggccggagacgttaagagttcccggtgaatgacaccgtccagggtcagaa

SEQ ID NO: 29776 - DNA, 134 bp, Homo sapiens
  misc_feature 1..134: note = chr5:87990318-87990452
  misc_feature 1..134: note = hyper
  source 1..134: mol_type = genomic DNA
gaacccgaaaagcctcgcgttttttctcttgtgttttcctcacttttctttttctcaaactgcaaaattttagtgcctgaatggcgaatggggaaaaggactggccggagagtgaggcacggaagggaggtctg

SEQ ID NO: 29777 - DNA, 30 bp, Homo sapiens
  misc_feature 1..30: note = chr5:87991432-87991462
  misc_feature 1..30: note = hyper
  source 1..30: mol_type = genomic DNA
cgagtaataatctcccggcctcagtttcca

SEQ ID NO: 29778 - DNA, 121 bp, Homo sapiens
  misc_feature 1..121: note = chr5:88179851-88179972
  misc_feature 1..121: note = hyper
  source 1..121: mol_type = genomic DNA
caattctttattgcacgaaatgaagacaacacggcgagctgcggctccctgctcctctcgcggcgcctctgcggaggacgctcggagagaacctagtctcccgctgcggcgcgctcgcttg

SEQ ID NO: 29779 - DNA, 76 bp, Homo sapiens
  misc_feature 1..76: note = chr5:88180270-88180346
  misc_feature 1..76: note = hyper
  source 1..76: mol_type = genomic DNA
aatgttagtaatgtacgaaataataaaataattaccagtatttgagatctcgacttcatcgcggggccatgaactt

SEQ ID NO: 29780 - DNA, 534 bp, Homo sapiens
  misc_feature 1..534: note = chr5:88184853-88185387
  misc_feature 1..534: note = hyper
  source 1..534: mol_type = genomic DNA
taaaaaatctttacccggggttgtggtggaagtggggattaaaaatctcgtcctgcgttttggtgcccacttctttgtttggaaagcagagcgctgggactcaatccggacggccctcaaagacccagacgagggacgcctctagtttgagcaactcactccgctgagttattgattgcaggcagcaacaatccctccggttgatttgtgtgaaaagtgaatccgctctggctgggcgttcagcagaggcgcaacagctgcaacgccatccaattattgccgatcctcccctccaacactgctctcatcacctatatactcttctctctgcccgtctctgcttccccccccttccccccccccttttctcccggccgacggagctgaaggggcgggggttccttccttggagtgtttctagagctcggaggctgctggtagggggtgagtgcgccacgtgcgtgcgccacgggcgagcaggaggcaggctctgggccctcctggggacctgctggacctgctggacctgggtgc

SEQ ID NO: 29781 - DNA, 613 bp, Homo sapiens
  misc_feature 1..613: note = chr5:88185388-88186001
  misc_feature 1..613: note = hyper
  source 1..613: mol_type = genomic DNA
acgagtgggcggccacgctggtttggcgcggggaaggaagggggtgtgccgacttgtatttagttgggggttgtggaagtcacggctgggggaaaagcgtccggtggtttgttggtaaagagggtgcgtgatgggctctggggaatggaggagggcgcaacggctgtgggtggactgtggaaacgggcggtggcagtgccggggtagttgtcctgctggtctggttttgggatcctgggctggagaaatgcgatccaaaagagctcgggatgggctcagagcgacccacgaaaataccaggggccaagtaaaatgaacccaccctttaacagtgcacaaagcgctggcacacggtccacgtctggtgacgcaggctgcccgaagcgctccaaccattttgcaaacctgggagagcaagaggggctctgcaggtctagccgccgcccctgtcccactctggccagccggagtttttcacctgacagaccaataggaaagaacacgggccccaaactggattttatagtctgagctctcagcatctaaggaattatatttcaaaaaacaaaagccaactcatagctctattaagctaacgcgtgtgcgagttttg

SEQ ID NO: 29782 - DNA, 446 bp, Homo sapiens
  misc_feature 1..446: note = chr5:89854523-89854969
  misc_feature 1..446: note = hyper
  source 1..446: mol_type = genomic DNA
cctattggagcagagcgaggatgcagagggaggaggcaagggagggggagaaaggggaggaggatggagccctcctcctgatcctgtagtggtagtaagaatcagcagcgcgggcaaggagtacggacgggagtcagaggcagagcgagggtgtgtggagggccggcggggaccgccgggagcgcgcggatgtcggtgttcctggggccaggtaggctatggctgaggggtggtgctgcgagcatcgctgagccccaggggagcgcctcagcatcagcacctgttgctgcaggtgggcggcgagggcggcgcggagggcgggccacagccgggcccagggaggctgggcgcgcacccggcgccgcggcctgcgggtaatggggcatagctgcccgcgtcggttctgtccaaggctgcggttttgcagggagcgttaggttcctgca

SEQ ID NO: 29783 - DNA, 29 bp, Homo sapiens
  misc_feature 1..29: note = chr5:92915099-92915128
  misc_feature 1..29: note = hyper
  source 1..29: mol_type = genomic DNA
cgctagggtcacgccgggtcccaggggcc

SEQ ID NO: 29784 - DNA, 57 bp, Homo sapiens
  misc_feature 1..57: note = chr5:92915510-92915567
  misc_feature 1..57: note = hyper
  source 1..57: mol_type = genomic DNA
tcggctgctaggctgcgaatcccggtgctctctcgccgccgccgcaggttgtctgct

SEQ ID NO: 29785 - DNA, 328 bp, Homo sapiens
  misc_feature 1..328: note = chr5:92915837-92916165
  misc_feature 1..328: note = hyper
  source 1..328: mol_type = genomic DNA
ctccgcccgggcatccgtttcccgcctaggagagagagggaatagcgggtgggggtgggagcagcctgttttgaatgtggattgctgctcgcctggcacgatcctcccctccaaggaggcgcggcggccgcgatcctcgccttagcgctacggcgagacagaggccgagcgagggcaactcccgagcaggccccgaagaaagttctcctcgtcccgccctggctgcctagactctgctctcggcctgcggaggccgtgcgagccaagactgcctcccggccctgcccgttaccaaccccaagttcaagagaaacgacaaccattatgt

SEQ ID NO: 29786 - DNA, 24 bp, Homo sapiens
  misc_feature 1..24: note = chr5:92940177-92940201
  misc_feature 1..24: note = hyper
  source 1..24: mol_type = genomic DNA
ggggtgggccggggccggctgcga

SEQ ID NO: 29787 - DNA, 52 bp, Homo sapiens
  misc_feature 1..52: note = chr5:94620527-94620579
  misc_feature 1..52: note = hyper
  source 1..52: mol_type = genomic DNA
ggggtgggctggagccgtaaccgaatcccggccgcggcgcctgcaaagtttt

SEQ ID NO: 29788 - DNA, 277 bp, Homo sapiens
  misc_feature 1..277: note = chr5:94620857-94621134
  misc_feature 1..277: note = hyper
  source 1..277: mol_type = genomic DNA
cctaggtgggagggccggtaggagccgggtggagctaggtagggcccgaagccagcttgctccctaggatccggccacagttgcccaggcagctcgctgtgcgctggccgctggccgcgctggcgatcgtctgggtcggatgaagcgagctggagtggaaactatgtgccctcgatgggtctcgtgggggcgccgatcgtccacactgagcgatgaacccgacggagttctaaagctgaagacgtctgcccccgccccgttgcgctccctgggtcca

SEQ ID NO: 29789 - DNA, 1656 bp, Homo sapiens
  misc_feature 1..1656: note = chr5:94955586-94957242
  misc_feature 1..1656: note = hyper
  source 1..1656: mol_type = genomic DNA
ctgctgtgctttacacgtaaatagagaatggatgaggttctcagcgcccaggggtccgcggcttccgcgagggtagcgtcgggggccgctgcagagattggaagagtacccgccgggaatgggagggaagacgcggggaaggtggagaataggaatcatgtgtgttcctcgagtgtacaacccacatttgagtgacaaatcacgaggacaatcgacaaaaacaactaagcgcaaagccgcccgaatccatctccctctctgtgcgtgtgccttttcaactaactttgggaactcgtatagacccagcgtcgctccccgcgccgcctcgcctccactttggtttcccgcgtcctgcccgccctcttcggtgcctcctcttcctccgggacaaggatggaggatctctttagcccctcaattctgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcaggcaacaccacagtgctgtgccgcctgtgcggcggcggcgggccctgggcgggccccaagcgtcgcaagatggacttcctgctggtgcagctggccctggcggacctgtacgcgtgcgggggcacggcgctgtcacagctggcctgggaactgctgggcgagccccgcgcggccacgggggacctggcgtgccgcttcctgcagctgctgcaggcatccgggcggggcgcctcggcccacctcgtggtgctcatcgccctcgagcgccggcgcgcggtgcgtcttccgcacggccggccgctgcccgcgcgtgccctcgccgccctgggctggctgctggcactgctgctggcgctgcccccggccttcgtggtgcgcggggactccccctcgccgctgccgccgccgccgccgccaacgtccctgcagccaggcgcgcccccggccgcccgcgcctggccgggggagcgtcgctgccacgggatcttcgcgcccctgccgcgctggcacctgcaggtctacgcgttctacgaggccgtcgcgggcttcgtcgcgcctgttacggtcctgggcgtcgcttgcggccacctactctccgtctggtggcggcaccggccgcaggcccccgcggctgcagcgccctggtcggcgagcccaggtcgagcccctgcgcccagcgcgctgccccgcgccaaggtgcagagcctgaagatgagcctgctgctggcgctgctgttcgtgggctgcgagctgccctactttgccgcccggctggcggccgcgtggtcgtccgggcccgcgggagactgggagggagagggcctgtcggcggcgctgcgcgtggtggcgatggccaacagcgctctcaatcccttcgtctacctcttcttccaggcgggcgactgccggctccggcgacagctgcggaagcggctgggctctctgtgctgcgcgccgcagggaggcgcggaggacgaggaggggccccggggccaccaggcgctctaccgccaacgctggccccaccctcattatcaccatgctcggcgggaaccgctggacgagggcggcttgcgcccaccccctccg

SEQ ID NO: 29790 - DNA, 53 bp, Homo sapiens
  misc_feature 1..53: note = chr5:95067679-95067732
  misc_feature 1..53: note = hyper
  source 1..53: mol_type = genomic DNA
cagcttgttgctgaacgcggccagcacggtcgcgcgtccggtgttcaccgagt

SEQ ID NO: 29791 - DNA, 30 bp, Homo sapiens
  misc_feature 1..30: note = chr5:95768245-95768275
  misc_feature 1..30: note = hyper
  source 1..30: mol_type = genomic DNA
agttccctgaacaagcgtggagggattttt

SEQ ID NO: 29792 - DNA, 59 bp, Homo sapiens; identical to SEQ ID NO: 2617
  misc_feature 1..59: note = chr5:95769034-95769093
  misc_feature 1..59: note = hyper
  source 1..59: mol_type = genomic DNA

SEQ ID NO: 29793 - DNA, 811 bp, Homo sapiens
  misc_feature 1..811: note = chr5:100236202-100237013
  misc_feature 1..811: note = hyper
  source 1..811: mol_type = genomic DNA
tcacaagcttttccacgaacctttcatcctggagaaaaaggaaagtgctcagggagcctagctgccctcgcattgttcctggcagctccaactccttgcacagtcttggtctctcaggagaccaaggcagtcaggacgctacagggcacgggtgtaagcgcgacgttcgcggccagccctctgccttgccccactgtaattgcgggttttgattaagaaggaggagccagttgccgactgagctttgaaagtgactttgggtggggggtgggggtggggtgggggtggaaggaggggagggaccaaaagagcctgagtcctgcaataaaggtttccccctatcttctcactcattctttccccctcgccgccggcgctctggcagcaggggataaccccggtgcgcgcctctcttcctgtttggtttactcaagcgcctgccccaacgccttctcagtcaagctgggaggaaactgcttcagcttgaaaaggatgcgggcaaaagcccagcccgactagctcaaccgccgcgccagtgcccgcctcctcttccttaacgcctagggctgcgcccaccagccggcaacgtccaggaaagggccacaggagaaatgacacccgtgcaatgcggagtgtcccggctccgcttccccgcagggactcgaggtgcgctccttttcctggccacggtttagggaggctcggagatggacacctcggcagtatctggcgaccctcttctcactcgctccgcccactcctgctctccagggtcccagccaagggcccgaaccctcggagtcctagtgag

SEQ ID NO: 29794 - DNA, 150 bp, Homo sapiens
  misc_feature 1..150: note = chr5:100237567-100237717
  misc_feature 1..150: note = hyper
  source 1..150: mol_type = genomic DNA
acacatacacacacacgcaagggctgttttctttgttttaatcaatgtcagagaaaaatataaactgggcaggcatctctgctggtgtgtagtttctgatagaggacgcctccaaaccggaacagggaggatttccgaaacaggactttg

SEQ ID NO: 29795 - DNA, 115 bp, Homo sapiens
  misc_feature 1..115: note = chr5:100238283-100238398
  misc_feature 1..115: note = hyper
  source 1..115: mol_type = genomic DNA
tgacttctcctttggcgagagagcacccagggccaacacaactgtcaccacaaccacacagagcaagttgaactcatactgggaacagcttagagaagcacgcacatctcaacaa

SEQ ID NO: 29796 - DNA, 296 bp, Homo sapiens
  misc_feature 1..296: note = chr5:100238681-100238977
  misc_feature 1..296: note = hyper
  source 1..296: mol_type = genomic DNA
ggttgccccagctcccgcaccttctcttgatataaaggctccgttttggggagatagtcgcgggggtgaaatctgtaaaatgcgaggagagcttggagccgggatcccgggatcagatcactggggtcttctgtggccgagctccctctggtcctcgaacgctgcccagcgacctctcgccctgtttgcgccagctctgccagggtcgctccgcgccgcctccctggggctcaggtttcttttcagatgagacaccttgtgcattggaggtggcggcagcttctgcagctgggttc

SEQ ID NO: 29797 - DNA, 44 bp, Homo sapiens; identical to SEQ ID NO: 2619
  misc_feature 1..44: note = chr5:100238978-100239022
  misc_feature 1..44: note = hyper
  source 1..44: mol_type = genomic DNA

SEQ ID NO: 29798 - DNA, 97 bp, Homo sapiens; identical to SEQ ID NO: 2620
  misc_feature 1..97: note = chr5:100239023-100239120
  misc_feature 1..97: note = hyper
  source 1..97: mol_type = genomic DNA

SEQ ID NO: 29799 - skipped

SEQ ID NO: 29800 - DNA, 521 bp, Homo sapiens
  misc_feature 1..521: note = chr5:100239203-100239724
  misc_feature 1..521: note = hyper
  source 1..521: mol_type = genomic DNA
acacactctcctgggacatcaaagcatcagctctctggacctgggagctccaagatagtctatccgcatctaggtgagagggcacctcgcctggggacagattacaaaagcgtcccgccagaggaatgcttcaggtagagctaggggtggattgcaagaagagtaccttctttcaatcgcttttgctaaacacacaccctcacacgcaaaaacacgccctccaaggtggagtgaaacggggtgcgggggtggggacggcggtggaaggaagaagacttttattactcaatctggaaagtgcaaatacacacatgaacctgttagccgatgggcccactctgcatgggtggtggacgacgaccctggctcaggattctgcaggaaacaagtgatgatagaggtgtcattaggaactttatggatatttatgcgcctccctttcattgccatttggaaactcctcacgcagaagtcaaggaaactccaatcccacttaaacttcattgcggagaaacagagtt

SEQ ID NO: 29801 - DNA, 30 bp, Homo sapiens
  misc_feature 1..30: note = chr5:100240068-100240098
  misc_feature 1..30: note = hyper
  source 1..30: mol_type = genomic DNA
tgttggctggtaggtcgggaggcacctcta

SEQ ID NO: 29802 - DNA, 44 bp, Homo sapiens
  misc_feature 1..44: note = chr5:101631539-101631583
  misc_feature 1..44: note = hyper
  source 1..44: mol_type = genomic DNA
ctcccccggctggctcgccgtgcccacctcgctctccactggcc

SEQ ID NO: 29803 - DNA, 30 bp, Homo sapiens
  misc_feature 1..30: note = chr5:101632034-101632064
  misc_feature 1..30: note = hyper
  source 1..30: mol_type = genomic DNA
acaggcaggtgacagcgcccccgtgcggga

SEQ ID NO: 29804 - DNA, 141 bp, Homo sapiens; identical to SEQ ID NO: 7974
  misc_feature 1..141: note = chr5:107005171-107005312
  misc_feature 1..141: note = hyper
  source 1..141: mol_type = genomic DNA

SEQ ID NO: 29805 - DNA, 83 bp, Homo sapiens
  misc_feature 1..83: note = chr5:107005635-107005718
  misc_feature 1..83: note = hyper
  source 1..83: mol_type = genomic DNA
aaaacctaaagcttccgcttcccagcccccctcacttcccccagcccgtgcgctctctctgcgcgcaccgggaaaagagaagg

SEQ ID NO: 29806 - DNA, 104 bp, Homo sapiens
  misc_feature 1..104: note = chr5:107005983-107006087
  misc_feature 1..104: note = hyper
  source 1..104: mol_type = genomic DNA
ggtacctggcctttccgcggcggcttaacaaagaggggcgcgacgcgagcgcttcccgccgacgcctcaagccatcagcgcccgggcgacgcaggctccgaggg

SEQ ID NO: 29807 - DNA, 155 bp, Homo sapiens
  misc_feature 1..155: note = chr5:107006762-107006917
  misc_feature 1..155: note = hyper
  source 1..155: mol_type = genomic DNA
gttgcgcgccgcagccgcggggagacatacaccggcccgccgggcccggctcagcgtcggcgcagcaggctacgcacggctccgccaccgcccggggccctcgcactgcgccacgcttcgctccaagttactttggcggccggtgggaaactgca

SEQ ID NO: 29808 - DNA, 34 bp, Homo sapiens
  misc_feature 1..34: note = chr5:107007264-107007298
  misc_feature 1..34: note = hyper
  source 1..34: mol_type = genomic DNA
gcctcggggatttctcgcgcgtgctttccttggc

SEQ ID NO: 29809 - DNA, 554 bp, Homo sapiens
  misc_feature 1..554: note = chr5:110408656-110409210
  misc_feature 1..554: note = hyper
  source 1..554: mol_type = genomic DNA
ctttctccagggagacgccaggcattttggagagggagtatcctgctacgtgcagaactccgagaggtgcctgggctccgggacgccgccgccgggggaaaggggacatctgggctgtcagagcggggctgcgcctagcttgggacaacacttctgttccaatttagggagaggaagtctctatccggaggaaaggcaaattgggaactgggacgagggaacgttgttaggggcaccacctgctggggtccggcgcctccgcgctcgggctcggaattttggcagcctccgccccctggagacttgggaggagcgagcgtgggtgacagtcttttcgcgacgagtgccctccgccaccctcgccacgcccctgctcccccgcggttggttcttccttgctctactcaaccctgacctcttctctctgactctcgacttgtgttccccgctcctccctgaccttcctcccctcccctttcactcaattctcaccaactctttctctctctggtgttttctccttttctcgtaaactttgccgcctatgagcagcc

SEQ ID NO: 29810 - DNA, 174 bp, Homo sapiens
  misc_feature 1..174: note = chr5:110559554-110559728
  misc_feature 1..174: note = hyper
  source 1..174: mol_type = genomic DNA
taggtgggagggactcgccacggagacgcgctcaaggagggatgagttgcgccaccaccacctaggtccctctctcgctatccggcggggccgcccggacccaggtgctgccagggtacgcctggcgcccgccatcccagagcagcgtcccgctgcgcacggtctccctccagc

SEQ ID NO: 29811 - DNA, 80 bp, Homo sapiens
  misc_feature 1..80: note = chr5:110560039-110560119
  misc_feature 1..80: note = hyper
  source 1..80: mol_type = genomic DNA
ggcggcggcggtgggcgtgtgcgcgcgtgaaggacgccgcctctctctcgctcctgcgttcgcaggcggcggctggcggc

SEQ ID NO: 29812 - DNA, 414 bp, Homo sapiens
  misc_feature 1..414: note = chr5:110560138-110560552
  misc_feature 1..414: note = hyper
  source 1..414: mol_type = genomic DNA
cggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggtaaggcgcgggctccggctggggaagcccgcggcgtgcactgggggttgtccctctcgcagcgacggctcggagggtgcgggagcctgccttcgtgcccttcgatttctccctacctagttagtgtcttgagagagagctaaccttcattcaggtgcggctcgagtccttcccaccccaccagagcgcctaggccggtgcagctgtagg

SEQ ID NO: 29813 - DNA, 58 bp, Homo sapiens
  misc_feature 1..58: note = chr5:111754705-111754763
  misc_feature 1..58: note = hyper
  source 1..58: mol_type = genomic DNA
attcttccggaacagcgcagaaacagcccatgtcggttgtggtcgtctccagccagga

SEQ ID NO: 29814 - DNA, 30 bp, Homo sapiens
  misc_feature 1..30: note = chr5:112629248-112629278
  misc_feature 1..30: note = hyper
  source 1..30: mol_type = genomic DNA
tttgagggatgtgcccgaagcatccctaaa

SEQ ID NO: 29815 - DNA, 248 bp, Homo sapiens; identical to SEQ ID NO: 476
  misc_feature 1..248: note = chr5:112629488-112629736
  misc_feature 1..248: note = hyper
  source 1..248: mol_type = genomic DNA

SEQ ID NO: 29816 - DNA, 119 bp, Homo sapiens
  misc_feature 1..119: note = chr5:112630330-112630449
  misc_feature 1..119: note = hyper
  source 1..119: mol_type = genomic DNA
ggcagcggcggagcccgcgcggggaccctcccgcgcgcacccagcgccccgttccggggcagtgccaccctgggcgccgcctcgccactcctacggtgcctcgccgccccccattacca

SEQ ID NO: 29817 - DNA, 34 bp, Homo sapiens; identical to SEQ ID NO: 7978
  misc_feature 1..34: note = chr5:112824097-112824131
  misc_feature 1..34: note = hyper
  source 1..34: mol_type = genomic DNA

SEQ ID NO: 29818 - DNA, 30 bp, Homo sapiens
  misc_feature 1..30: note = chr5:113391377-113391407
  misc_feature 1..30: note = hyper
  source 1..30: mol_type = genomic DNA
ctctgcagctccccccggttaacacccgaa

SEQ ID NO: 29819 - DNA, 64 bp, Homo sapiens
  misc_feature 1..64: note = chr5:113391710-113391774
  misc_feature 1..64: note = hyper
  source 1..64: mol_type = genomic DNA
cccgcctgcaggactcgctcctgccagccaaggactcaagaaggagggagtccccagtcccggc

SEQ ID NO: 29820 - DNA, 243 bp, Homo sapiens
  misc_feature 1..243: note = chr5:113391775-113392018
  misc_feature 1..243: note = hyper
  source 1..243: mol_type = genomic DNA
gggcgcctgggattcggttcaatatttagcacagtcagtaccgaagcaggggcagccaggtgggagctgggcgcccaaaagttggaccccaatcagcagcgagtgggcagcgggggcctggctcgcccgcgcccgcgccccggagctctccggctggctctctgctccccgaagctggggagccgggggcgctctcccgggccgcaagcaggcacggaatttgacgcccgagaggcagatggt

SEQ ID NO: 29821 - DNA, 315 bp, Homo sapiens
  misc_feature 1..315: note = chr5:113696418-113696733
  misc_feature 1..315: note = hyper
  source 1..315: mol_type = genomic DNA
aataaataatgataccgaactccaacaaaactccagcactgtccgtgggcagcgactattcagcccaagctatcattcttaatttccctgccaggctgcgactaccggggtgaatcagcccgcgccaggcccctttcccacccgccgctgcagttaggacttggcaaagatgctcgatatttgcgtatttgtgaccggtctttgctttgtgtctgcgctgcaggtgaggaggaggaagagaagcagaagagcagctggaggccggcggtggctgagcagcccccacacctttgagcgagccgcctgcctctccac

SEQ ID NO: 29822 - DNA, 277 bp, Homo sapiens
  misc_feature 1..277: note = chr5:113696955-113697232
  misc_feature 1..277: note = hyper
  source 1..277: mol_type = genomic DNA
ccacccacccccggccggggtgccgaggcggttaaccctacccgcgccgcagcgcacttgggctagagcgccgcgcacccaatccagattccagagcctgccggctgggaaagatccggtctcggggtcggctatgatcccgcagcggccaaggcagggctcaggccccgggattctccccacacgctgctgcactggcgcagccggtcgccaaactttttctccccaaagccagtgcccccgcagttacttggcgggcagccggcagcccactctc

SEQ ID NO: 29823 - DNA, 265 bp, Homo sapiens
  misc_feature 1..265: note = chr5:113697471-113697736
  misc_feature 1..265: note = hyper
  source 1..265: mol_type = genomic DNA
agcccagctgcactgcgtgggggctctccatctccacgcaatcagcaggcggaatccctgccctggagcgccctggctctggactgcacccccctagggtttgtcctgcagattcccctccccatctttctctgccacacacgcttccctaagccgcgcgcgccgcaaactcagtctcggtccccgcaggtgatgtcatgcccattgttttggtgcgcccaaccaatcggactcgccgcctggattctaccggagccggcatggg

SEQ ID NO: 29824 - DNA, 140 bp, Homo sapiens
  misc_feature 1..140: note = chr5:113698000-113698140
  misc_feature 1..140: note = hyper
  source 1..140: mol_type = genomic DNA
ccagcagccggccagcggcggcagcagcccatgcctccggtgcaacagctgcgcctcctccggtgccccggcggcgggggcgggagataacctgtccctgctgctccgcacctcctcgcccggcggcgccttccggaccc

SEQ ID NO: 29825 - DNA, 13 bp, Homo sapiens
  misc_feature 1..13: note = chr5:113698141-113698154
  misc_feature 1..13: note = hyper
  source 1..13: mol_type = genomic DNA
cacctcctcgccg

SEQ ID NO: 29826 - DNA, 198 bp, Homo sapiens
  misc_feature 1..198: note = chr5:113698386-113698584
  misc_feature 1..198: note = hyper
  source 1..198: mol_type = genomic DNA
accaccaccaccacccgcacccggcgcaccaccagcaccaccagccccaggcgcgccgcgagagcaaccccttcaccgaaatagccatgagcagctgcaggtacaacgggggcgtcatgcggccgctcagcaacttgagcgcgtcccgccggaacctgcacgagatggactcagaggcgcagcccctgcagccccccg

SEQ ID NO: 29827 - DNA, 175 bp, Homo sapiens
  misc_feature 1..175: note = chr5:113698669-113698844
  misc_feature 1..175: note = hyper
  source 1..175: mol_type = genomic DNA
cgtggtgtctaagcccgagcacaacaactccaacaacctggcgctctatggaaccggcggcggaggcagcactggaggaggcggcggcggtggcgggagcgggcacggcagcagcagtggcaccaagtccagcaaaaagaaaaaccagaacatcggctacaagctgggccaccgg

SEQ ID NO: 29828 - DNA, 166 bp, Homo sapiens
  misc_feature 1..166: note = chr5:113698951-113699117
  misc_feature 1..166: note = hyper
  source 1..166: mol_type = genomic DNA
cgacaaggtacaggcttgaaccccagcccacgctaccggagtcgggcactgggtggttgggatgggcactggcggggaccctttgcgtgcggatccctagcctctccgggacgatcaagggagcccgccaggacagcgggcgcgtctaggacgcgcatccgtagtc

SEQ ID NO: 29829 - DNA, 156 bp, Homo sapiens; identical to SEQ ID NO: 7987
  misc_feature 1..156: note = chr5:113699401-113699557
  misc_feature 1..156: note = hyper
  source 1..156: mol_type = genomic DNA

SEQ ID NO: 29830 - DNA, 571 bp, Homo sapiens; identical to SEQ ID NO: 2623
  misc_feature 1..571: note = chr5:114515009-114515580
  misc_feature 1..571: note = hyper
  source 1..571: mol_type = genomic DNA

SEQ ID NO: 29831 - DNA, 61 bp, Homo sapiens; identical to SEQ ID NO: 2624
  misc_feature 1..61: note = chr5:114515610-114515671
  misc_feature 1..61: note = hyper
  source 1..61: mol_type = genomic DNA

SEQ ID NO: 29832 - DNA, 216 bp, Homo sapiens
  misc_feature 1..216: note = chr5:114515900-114516116
  misc_feature 1..216: note = hyper
  source 1..216: mol_type = genomic DNA
tgaaatgaaggccatcgagggctcccgggcagcctcgcccggcttgctaggatccgggtgcagcggtcggggctgcgcgatctaacggaacaaacgagggcggcggcggcggcagcagaggccgtgaaaccctcaccaggcggagccgggcgcgcggaggccccgcctcctcgggggtcgcggcagcggttcggaccgcagcggagacaaacaaac

SEQ ID NO: 29833 - DNA, 195 bp, Homo sapiens
  misc_feature 1..195: note = chr5:115151163-115151358
  misc_feature 1..195: note = hyper
  source 1..195: mol_type = genomic DNA
gggggctgaaaaaaacgacggtcgaatatttaatctgcgaaacttggcagtggatttgaataaacccacagtcggggaagttagttaaattggtttgggaaagggaacagcagaaattccgtagtggcagctgacggccacaagacgctattttacatgagtaaaaatgcttgctataaggtgcccggttgcagg

SEQ ID NO: 29834 - DNA, 736 bp, Homo sapiens; identical to SEQ ID NO: 478
  misc_feature 1..736: note = chr5:115151649-115152385
  misc_feature 1..736: note = hyper
  source 1..736: mol_type = genomic DNA

SEQ ID NO: 29835 - DNA, 61 bp, Homo sapiens; identical to SEQ ID NO: 479
  misc_feature 1..61: note = chr5:115152616-115152677
  misc_feature 1..61: note = hyper
  source 1..61: mol_type = genomic DNA

SEQ ID NO: 29836 - DNA, 47 bp, Homo sapiens; identical to SEQ ID NO: 2628
  misc_feature 1..47: note = chr5:115297186-115297233
  misc_feature 1..47: note = hyper
  source 1..47: mol_type = genomic DNA

SEQ ID NO: 29837 - DNA, 101 bp, Homo sapiens
  misc_feature 1..101: note = chr5:115297449-115297550
  misc_feature 1..101: note = hyper
  source 1..101: mol_type = genomic DNA
taagaaaaaccatcccgccaggccccttcttgtggtaacgcggtcctaaccctgctctgccccacaaccccatttcacccgggagacgcagacgccaggct

SEQ ID NO: 29838 - DNA, 58 bp, Homo sapiens
  misc_feature 1..58: note = chr5:115297928-115297986
  misc_feature 1..58: note = hyper
  source 1..58: mol_type = genomic DNA
tcatccaaatatccacgtttaaggtgtccggattcgtttggcttgaccaccccctccc

SEQ ID NO: 29839 - DNA, 378 bp, Homo sapiens
  misc_feature 1..378: note = chr5:115298204-115298582
  misc_feature 1..378: note = hyper
  source 1..378: mol_type = genomic DNA
cgatacaagagaggaggggcaggggtcgcagcactgaacaccctggccggggttttgacagctgccacagtctctgagctccagcctcgcgcctgaacccggtccctgccatggggcccccttccagctcaggcttctatgtgagccgcgcagtggccctgctgctggctgggctggtagccgccctcctgctggcgctggccgtactcgccgccttgtacggccactgcgagcgcgtcccaccgtcggagctgcctggactcagggacttggaagccgagtcttcccctcccctcaggcagaagccgacgccaaccccgaaacccagcagtgcacgcgagctagcggtgacgaccaccccgagcaactggcgacccc

SEQ ID NO: 29840 - DNA, 321 bp, Homo sapiens
  misc_feature 1..321: note = chr5:115298781-115299102
  misc_feature 1..321: note = hyper
  source 1..321: mol_type = genomic DNA
cgaggtgcggggacccctttccccgggcactgggaacgccacagtgggccgcgtgcccgtggacgacgtgtggttcgcgctggacacggaatacatggtgctggagctcagtgagcccctgaaacctggtagcagctacgagctgcagcttagcttctcgggcctggtgaaggaagacctcagggagggactcttcctcaacgtctacaccgaccagggcgagcgcaggtaagggctgtacagcccggggcccctctcggcccccgcccctgcgtcccggtgcaggctgcgggtccagctgactaccgtgtccaggtgcgc

SEQ ID NO: 29841 - DNA, 30 bp, Homo sapiens
  misc_feature 1..30: note = chr5:115908915-115908945
  misc_feature 1..30: note = hyper
  source 1..30: mol_type = genomic DNA
gacacagtgaggagtcggaacagagcccta

SEQ ID NO: 29842 - DNA, 42 bp, Homo sapiens
  misc_feature 1..42: note = chr5:115911133-115911175
  misc_feature 1..42: note = hyper
  source 1..42: mol_type = genomic DNA
cacagctattaattacgcacatacacacgttaataaagcatg

SEQ ID NO: 29843 - DNA, 30 bp, Homo sapiens; identical to SEQ ID NO: 7998
  misc_feature 1..30: note = chr5:115911931-115911961
  misc_feature 1..30: note = hyper
  source 1..30: mol_type = genomic DNA

SEQ ID NO: 29844 - DNA, 74 bp, Homo sapiens
  misc_feature 1..74: note = chr5:119799931-119800005
  misc_feature 1..74: note = hyper
  source 1..74: mol_type = genomic DNA
gggaggaggcgcaggcgcgctgctcgcccgtctgcagccccgagccgagcgccgcgtctcgggagttgatggca

SEQ ID NO: 29845 - DNA, 57 bp, Homo sapiens
  misc_feature 1..57: note = chr5:119800264-119800321
  misc_feature 1..57: note = hyper
  source 1..57: mol_type = genomic DNA
acagatcaagatcatcgtggaggatttggaattagtcctgggcgacctgaaggacgt

SEQ ID NO: 29846 - DNA, 960 bp, Homo sapiens
  misc_feature 1..960: note = chr5:119800546-119801506
  misc_feature 1..960: note = hyper
  source 1..960: mol_type = genomic DNA
aactagtgttttaatcgatggacctgggctggtgggagggatgaacgcacgcgtgtctctgaatctgtgtgtgtgacgacgggggagagggttagctgggggtgtgtcggcagaggaagtcgtgagcagcccggctggagcgtgcaagatgctcctctcctgccctattgcttccccagagtcctttggcaagtccgctgcctatctgtcagcctccccaagtcagggctgaagaggggccgggttctgggccctgggccagatcagggagggcagcctggaggaagcttggctcagactaccctccctgtctctcgagcctcgctgtagggaaggcgacccgggctgctggcagccttggggctaaggagggggtctgggactttctcactttctcagtttctgaagcatcccctgctctcctccgaacgtcgttaccagtaactctgggccttcccgccaccctacctctgcttccttccttccaccctgtcgccacttggcattgaacccgagaagcaggacgcgcaggagagtgtatgtgtggccggggtcttgccattggcgtcctggctctctgcagctgggactgcttcggttcttccccgcttttcctatcccacttcggttcagccctactcccgcccgcccctagccccaggtgatccagatggaaagaagcagagaaggtgtcagggctgaggctgcgtaactcaggcggcggctccgggcgggggcgggggccgggctgggaggggtggggtctcccgagccaggctggctgccggcggcgtcgcggagctggtagcagagtcccagcgcgccgctcactactgaatggggtcctggtgcggttctcggtgagggagtccgcagctccgctgcgtgagagctaagactagaacttcgaaggtggcggtggctgcagcgggaaaaggggtggggcgtagtctaggtcca

SEQ ID NO: 29847 - DNA, 505 bp, Homo sapiens
  misc_feature 1..505: note = chr5:121412800-121413305
  misc_feature 1..505: note = hyper
  source 1..505: mol_type = genomic DNA
gactgcagagtggagcggaggacagcaagagaactggggacgcccgggactgcaaagcaatgtgaaaaggaagcaggaggggccagacgcgcggtttgcactggattccagggctgccactgcaggcgcgtgggggagggatcggatctgcgaggaccggggcccgccgcgcccaggcagccacgtcgagaagccacatagctggggaccaggtgcacgggtgcttccagcggacttgggggtacttaccgtactggaagtagccagtgccgtatccgggccggtacctgcccccaggtctgggcctttcataagtatcgtagtagttgtaataagggttgtcgtcagagtacttgtaggggttgtaagggtcgtcgcccaccatgccgtccacgcggctgggcggccgcaggttactgagcgcaggaacttctcccggcgctgtctggttctccgcgcgcgaggcgccagcttcgcgggctctagatgtcgagtagccagcttg

SEQ ID NO: 29848 - DNA, 225 bp, Homo sapiens
  misc_feature 1..225: note = chr5:121413586-121413811
  misc_feature 1..225: note = hyper
  source 1..225: mol_type = genomic DNA
ggggctgctgttggccggcggcgggaggggcgcagtgcactagcgcgcagagctgcaaaggcccgagcaggagcacggtccaggcgaagcgcatcactccttttgccagattgaccccgctcgaggaggacgtggctcacagaaaataaaaacggggctcaaatcacgtgagggaaggagaaatcttcaaccaaggaggcgagcggagcacgggtatctcagtct

SEQ ID NO: 29849 - DNA, 159 bp, Homo sapiens
  misc_feature 1..159: note = chr5:121647435-121647594
  misc_feature 1..159: note = hyper
  source 1..159: mol_type = genomic DNA
gctggggaaaagcaacggcagtcgaggtaaaaagagcgaaaggtaaagaaagagcaggttcgtggacaggagccggcgggcaggccgggggatccctggtgaggaagcggcgagggaggggcgtgggccgagccgggggcgccgcggggagggtcgctg

SEQ ID NO: 29850 - DNA, 494 bp, Homo sapiens
  misc_feature 1..494: note = chr5:121647801-121648295
  misc_feature 1..494: note = hyper
  source 1..494: mol_type = genomic DNA
ggggggcccggggagcggcgcccgcggccgggccgcattgtgacgtagcggggccgcggcagcgcctccaccgcccgcctacttcggctgaggctgttctgctcctgccgctgcggtccgtcggtcggtcagtcagtcccttcgcgctcctgagccgccggcgcgccgggcgccccgggtgagtccaggtcccaagcggacgccgcggggaggcgggaggcgggcagccagcggctcagcctttccaagtttgcaccaggcgaccccggcgggtgtcgccccgtgctccccaagccccgggacccctttgtgccgcgagtctcggctgctccgggcagcagaggcgcctctgcagaaagggtttgagggggaggtctctatagtaacagtaacagtggtggcggcagcggctgctttactggggaaagggggaaacaacccccgcctcggtttccaaaggattgttcttttcatttgcccgcctcatgtggttc

SEQ ID NO: 29851 - DNA, 201 bp, Homo sapiens
  misc_feature 1..201: note = chr5:121648762-121648963
  misc_feature 1..201: note = hyper
  source 1..201: mol_type = genomic DNA
cgctactgcttgcagcgaagaaagtcttaggaaacaaaaaggcaacagcattgttgctcattttcaatggacggctaggaggggggaaacgtgttgttttttcctgtgggaacgttgctttccttgggaaagttaattaaggaagcattactgtcggtgccccttttcacttgctggaggcaggatcggattcctcttggc

SEQ ID NO: 29852 - DNA, 75 bp, Homo sapiens
  misc_feature 1..75: note = chr5:122422240-122422315
  misc_feature 1..75: note = hyper
  source 1..75: mol_type = genomic DNA
gggtccagcttacgccgctgcgcgcccttgtgcgcaccgggtgaggatgccgagctctgcgggcatcccggaagc

SEQ ID NO: 29853 - DNA, 218 bp, Homo sapiens
  misc_feature 1..218: note = chr5:122422616-122422834
  misc_feature 1..218: note = hyper
  source 1..218: mol_type = genomic DNA
ttcttccctggaccccgcagcgaggggaaccaaatctctcccatgatagcccctctggcgtcagtctggaccgagtggctacaggttggactagggtaggcagaagatgcacttggcaccttaccgaacggtatttgaatccgtctccattactcattaatggcgtgaccttaggcaacccatctaaactttccgaacctcagcggtccccatctaca

SEQ ID NO: 29854 - DNA, 48 bp, Homo sapiens; identical to SEQ ID NO: 2630
  misc_feature 1..48: note = chr5:122423328-122423376
  misc_feature 1..48: note = hyper
  source 1..48: mol_type = genomic DNA

SEQ ID NO: 29855 - DNA, 187 bp, Homo sapiens
  misc_feature 1..187: note = chr5:122423874-122424061
  misc_feature 1..187: note = hyper
  source 1..187: mol_type = genomic DNA
ggcaagtgcctccttcgtgggtgcgagactgcatcgaagggctgccctggcacaaagtctggggagaggacatggtggaggtggggctgcactcccaccctgcccctctaacaccaggttttgggtagagaaacctatgcgtgacctcctgcggcagccgcaggcagctgaccgcaaacagcctcgc

SEQ ID NO: 29856 - DNA, 252 bp, Homo sapiens
  misc_feature 1..252: note = chr5:122424436-122424688
  misc_feature 1..252: note = hyper
  source 1..252: mol_type = genomic DNA
caggaaaaactgagccgggcaaaagcgcaaacccggtcctggcggcgcgggcttgctccagcgcggacaccacagcgtgtgcggagatgcattcccgttgccgcatttccactgctttcaagatcagggcactgagctgggacccagaaaagacatatcatgggcagaaagagacaacaggctagcggcagacgtcacgccaaaaaaacaggggatgggagggcggaggagtttgtgcgggaaaggcgctct

SEQ ID NO: 29857 - DNA, 421 bp, Homo sapiens
  misc_feature 1..421: note = chr5:122424911-122425332
  misc_feature 1..421: note = hyper
  source 1..421: mol_type = genomic DNA
acccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcacgcacccaccggcagcaccgagttttcaggtaaggtgaggctggtctgggacttaagagtctagggcttggtagataggaaggttggtggtcctaggttgggggcgggcggcgagactgttctgcctcctggcgcctgaggccaacg

SEQ ID NO: 29858 - DNA, 79 bp, Homo sapiens; identical to SEQ ID NO: 8010
  misc_feature 1..79: note = chr5:122425562-122425641
  misc_feature 1..79: note = hyper
  source 1..79: mol_type = genomic DNA

SEQ ID NO: 29859 - DNA, 192 bp, Homo sapiens
  misc_feature 1..192: note = chr5:122425701-122425893
  misc_feature 1..192: note = hyper
  source 1..192: mol_type = genomic DNA
cgccggacatgctgaagcccggagaccccggcggttcggccttcctcaaagtggacccagcctacctgcagcactggcagcaactcttccctcacggaggcgcaggcccgctcaagggcagcggcgccgcgggtctcctgagcgcgccgcagcctcttcagccgccgccgccgcccccgcccccggagcgcg

SEQ ID NO: 29860 - DNA, 304 bp, Homo sapiens
  misc_feature 1..304: note = chr5:122426110-122426414
  misc_feature 1..304: note = hyper
  source 1..304: mol_type = genomic DNA
caaggaactgtgcctcggcgccacctccggccccgggcccgtcaagtgcggtggtggtggcggcggcggcggggagggtcgcggcgccccgcgcttccgctgcagcgcagaggagctggactattacctgtatggccagcagcgcatggagatcatcccgctcaaccagcacaccagcgaccccaacaaccgtacgtagccgcagcccgcgcgctctctcccggggcgccggcgccggcgccggcgggcgcgggtgcctgtcagggaggcgggtcggataggagtgacacggggccgggtgggt

SEQ ID NO: 29861 - DNA, 53 bp, Homo sapiens
  misc_feature 1..53: note = chr5:122426796-122426849
  misc_feature 1..53: note = hyper
  source 1..53: mol_type = genomic DNA
cgggccgcggggttgtgggggaaccggcgggagctgttcgctggccaggcctc

SEQ ID NO: 29862 - DNA, 117 bp, Homo sapiens
  misc_feature 1..117: note = chr5:122430742-122430859
  misc_feature 1..117: note = hyper
  source 1..117: mol_type = genomic DNA
tcccaggagctgggccgccccgcagggtcgagactgaaatcaattggctccccttccggcggccaggcaaacctgcctcgcctctggatctgcttctagacccgctcccggggcttg

SEQ ID NO: 29863 - DNA, 322 bp, Homo sapiens
  misc_feature 1..322: note = chr5:122431064-122431386
  misc_feature 1..322: note = hyper
  source 1..322: mol_type = genomic DNA
atctagcctatagctcgagaaggcagtggggggaccgcaggctggagccccgggggcgtgaaccccacgcgagaagttcgggcccggatgctctgcctgcccgccctctgcccggctccccagcccccacgcccctccccgcctagggcgcacgcggcactgccagcaggcggcactcccgggtcctagtcgccgggctgggatcgatgggcgccggcccctcgggtctcggcctgcgagactgagggccgcgaccttggcggcggtaggggaggatttacagccggggtggatagtggcgcccaggcggggaagcaggctt

SEQ ID NO: 29864 - DNA, 75 bp, Homo sapiens
  misc_feature 1..75: note = chr5:122434453-122434528
  misc_feature 1..75: note = hyper
  source 1..75: mol_type = genomic DNA
gctattcctttcttccggcgtctagggagagcgtgcacaccaaaccctccagaacagcaccccggtcccccaccc

SEQ ID NO: 29865 - DNA, 112 bp, Homo sapiens
  misc_feature 1..112: note = chr5:122434605-122434717
  misc_feature 1..112: note = hyper
  source 1..112: mol_type = genomic DNA
cgcccttggagtcctggggctgcggctcctgctctaccgggctgcaggcttgctctgccccgtcccgtggcgtttgggaggcagtcgaggaagcctccgagtctctgggtcg

SEQ ID NO: 29866 - DNA, 401 bp, Homo sapiens
  misc_feature 1..401: note = chr5:124083481-124083882
  misc_feature 1..401: note = hyper
  source 1..401: mol_type = genomic DNA
ttatctccaatttgtcggctttcccaaggggccagggacggggacgcctgggggagggagaagggtatctccgagctacttggattttagggacccccacttcatgtattaaacaaagaaaaaccttttgcttgctccccagcctggtcctgtaataaatacaccattgttactatttgtgggtttgtttgggttgggtggggcttttattttttctcttaatggtatttttgttgcttgcttttttaaggagatggcgaatggtaattataaccattacatgtaatgagtgactattcccttgtttaatattaaattatcgggcactgggatctgacaggagacagaaatcggcttgttctgcccttgcccccattttcctggatcgctttgggaggggg

SEQ ID NO: 29867 - DNA, 59 bp, Homo sapiens
  misc_feature 1..59: note = chr5:124084195-124084254
  misc_feature 1..59: note = hyper
  source 1..59: mol_type = genomic DNA
tatagagacacaccacgcaaccgtacttacggtctgtattggatcgagttgaccttttc

SEQ ID NO: 29868 - DNA, 112 bp, Homo sapiens
  misc_feature 1..112: note = chr5:124084771-124084883
  misc_feature 1..112: note = hyper
  source 1..112: mol_type = genomic DNA
ggcaaaaaaatggtgcgcccctttcaattactacatcattcacataaaacacttatttattaaaacaaatctcaaacaggctgcgaggagaggatgtcggtaaatacaagtt

SEQ ID NO: 29869 - DNA, 334 bp, Homo sapiens
  misc_feature 1..334: note = chr5:125930586-125930920
  misc_feature 1..334: note = hyper
  source 1..334: mol_type = genomic DNA
ctcccatgctactaccgcatccagcgccagcggggagtcggtaggtcagtgcccgcccggcctcctcgagcgagccccggcggctgcagagatttcttgagcgcccgcgtacctctccccggcctccccagcttccattatacacgccctcgttttcctcgcggagccccagctctttcagccacgcatactggggctgattgatgaggagagtggacatgaaggcggcaggcctgctccaaggtccagagagcttgctggtctttgcagcgtgcacacacagcgcgcgaggaaggcgccacatactgagcccgggactcgggatgagcccaag

SEQ ID NO: 29870 - DNA, 97 bp, Homo sapiens
  misc_feature 1..97: note = chr5:126366983-126367080
  misc_feature 1..97: note = hyper
  source 1..97: mol_type = genomic DNA
cggaacctgtgagaccgtcgctctgggcgggctgccgtgcggggtggcatcctctgcggtgacttctgctgtcttttgggtccgccaggattccaaa

SEQ ID NO: 29871 - DNA, 96 bp, Homo sapiens; identical to SEQ ID NO: 8019
  misc_feature 1..96: note = chr5:126626514-126626610
  misc_feature 1..96: note = hyper
  source 1..96: mol_type = genomic DNA

SEQ ID NO: 29872 - DNA, 30 bp, Homo sapiens
  misc_feature 1..30: note = chr5:127537200-127537230
  misc_feature 1..30: note = hyper
  source 1..30: mol_type = genomic DNA
ggcccgcggctcccccgtgtggcctgagta

SEQ ID NO: 29873 - DNA, 311 bp, Homo sapiens
  misc_feature 1..311: note = chr5:127872869-127873180
  misc_feature 1..311: note = hyper
  source 1..311: mol_type = genomic DNA
gaaggaaaagggggacgcgctcctgggggtctttggatattctggcaaagggggctgcagctctaggctccagctaaagggtctgggacggagtgggccagaaagccgccaaactgaggattcccccctcccccaagccggagccctaggtgcggagccgcttgcccacttaccctcggagcacgtcctgctgtcctcgccggcggacgcggctggccactgcggcaccctcctcgcgatactcgggcgctagaaacccgccttcagagcctgctgtagcggaccgaacctgttgcggcggcggctggggc

SEQ ID NO: 29874 - DNA, 254 bp, Homo sapiens
  misc_feature 1..254: note = chr5:127873552-127873806
  misc_feature 1..254: note = hyper
  source 1..254: mol_type = genomic DNA
gagcggtacacgttgcataaccggcctaaagccccgagcgactccaggaccgtcagcgggcgggggaggaaattacaaaagccctggcgtaaaatttcaaaaaatgtgaacctcaaaagaaaaaagggcctgcacgcagagctcggcggattcccgtgcgctccgaagacggatattggaaagctgcaaaagtcaccagaaagaaacaggcaagcaaacaaaagtcgcccccagaagaagaggagggttccctc

SEQ ID NO: 29875 - DNA, 497 bp, Homo sapiens
  misc_feature 1..497: note = chr5:127873981-127874478
  misc_feature 1..497: note = hyper
  source 1..497: mol_type = genomic DNA
cggggcgggccggcgggcggcggctgtcagtgggggcgcggccgtccacacgtggggctcaacccggactgagaggccggcgcagagtgggcggggacagagtaagggagagatcgggactgaggaacgaggggaaccagggttgggtgaggggaagaggaaggaagggggggagggcgaagggagggaagaggacggagattggggagaaggggggcgaacccgagaggaaggccgggctggaagagggacttggaaagagggattggcgagcccgggtgcgagaggaaatgagcgggggatgggggcgaagttagggcaaagagagaagtgggaaaggagagggagggccaaggtccgggcgccgagaggaggggcccggggggccggctggagggggcgaggcgctaggcggctttgcttcccgtccccgtcaattggccgctagctctgttttgactgcctgtacaaagcgagtagacggcgggggatggggc

SEQ ID NO: 29876 - DNA, 253 bp, Homo sapiens
  misc_feature 1..253: note = chr5:127874705-127874958
  misc_feature 1..253: note = hyper
  source 1..253: mol_type = genomic DNA
cgcagtcagccaggaatagaggctcacggggctgttggttgcagcctcaatccaagaaggaggagacctcccctttgccctcctacccccaccgccccaccgggagcggcgtcagtctgcgggaccaaattaggggctgggagtttccagattgaaatgcgccctccaccaccaagagggagctcacgcggccgcggggggccgaggcagccagccggcgccgcggtcctggggagtccgtgcaggggtgtgc

SEQ ID NO: 29877 - DNA, 40 bp, Homo sapiens; identical to SEQ ID NO: 8024
  misc_feature 1..40: note = chr5:128300655-128300695
  misc_feature 1..40: note = hyper
  source 1..40: mol_type = genomic DNA

SEQ ID NO: 29878 - DNA, 82 bp, Homo sapiens; identical to SEQ ID NO: 8025
  misc_feature 1..82: note = chr5:128300712-128300794
  misc_feature 1..82: note = hyper
  source 1..82: mol_type = genomic DNA

SEQ ID NO: 29879 - DNA, 246 bp, Homo sapiens
  misc_feature 1..246: note = chr5:128301033-128301279
  misc_feature 1..246: note = hyper
  source 1..246: mol_type = genomic DNA
tcggagtgcgagctgcggctggggtaggggcacccctttccagcgggcgcgtgggtcaccaaggagcagttctccgggacccgttgcgtcagagggactgggcggggctgggcggggcaggacgggggcggcgctcaggaaccctggaacccgctggccctgaggccacggaccgagacgtggtgctgagcccctgcgcggtttctggtgcgtagagactgtaaatcgctgcgcttctcagtcatc

SEQ ID NO: 29880 - DNA, 408 bp, Homo sapiens
  misc_feature 1..408: note = chr5:128795689-128796097
  misc_feature 1..408: note = hyper
  source 1..408: mol_type = genomic DNA
cagaggcagcactcccggctctcggctggctgtgggtctgtcttgtggggctccagcactagcctgctcggcctcggaaactcctgcagcgtccagaacacagaaaatagactcatctcctaattcgccagggagctcgagggctgcggggccgcggggctgcctcccccgctcctcccccaacccgaccccaccccacccccgccagggcttcggcggcctcccggagtcacacagcctacccccccaccccaacaccccctcccccggcagacaaagggcctgggcaaattcgccgcccggcctcctagcgctccggggaggccgctgcgccccggagtggatcgcgctggaggcgtgcgccgggcgagaagccgcggccgcgggagcgcagtatggggaagaacc

SEQ ID NO: 29881 - DNA, 423 bp, Homo sapiens
  misc_feature 1..423: note = chr5:128796098-128796521
  misc_feature 1..423: note = hyper
  source 1..423: mol_type = genomic DNA
cgagatgcgcctgactcacatctgctgctgctgcctcctttaccagctggggttcctgtcgaatgggatcgtttcaggtaagttcttccgtgactttctcgcttcctttccagccatcccagcggagaccgcgaacgtacgggtcggcagggctggtgcaaccggtgcgtggagagcagggctcagtgggtagcaataaaaatgagcttgaggtgcaggttaaggggtcaagttcggaaatgaagcacacttctgccggcctcgttttaaccgtatgtggaatagtttccttctaattagagcaataatatttgcaaaggtacgtttacagcacctggaggaaaattagaacgtacctaagttgatagcaacgctctgctctagcatacacttcagaaatcgtttactcgtgctggagtcttt

SEQ ID NO: 29882 - DNA, 734 bp, Homo sapiens
  misc_feature 1..734: note = chr5:128796736-128797470
  misc_feature 1..734: note = hyper
  source 1..734: mol_type = genomic DNA
ttgtgctactggaaccgcggcactttaagccccgcacttctgtctgccccgcccgcagagctgcagttcgcccccgaccgcgaggagtgggaagtcgtgtttcctgcgctctggcgccgggagccggtggacccggctggcggcagcgggggcagcgcggacccgggctgggtgcgcggcgttgggggcggcggaagcgcccgggcgcaggctgccggcagctcacgcgaggtgcgctctgtggctccggtgcctttggaggagcccgtggagggccgatcagagtcccggctccggcccccgccgccgtcggagggtgaggaggacgaggagctcgagtcgcaggagctgccgcggggatccagcggggctgccgccttgtccccgggcgccccggcctcgtggcagccgccgcctcccccgcagccgcccccgtccccgcccccggcccagcatgccgagccggatggcgacgaagtgttgctgcggatcccggccttctctcgggacctgtacctgctgctccggagagacggccgcttcctggcgccgcgcttcgcagtggaacagcggccaaatcccggccccggccccacgggggcagcatccgccccgcaacctcccgcgccaccagacgcaggctgcttctacaccggagctgtgctgcggcaccctggctcgctggcttctttcagcacctgtggaggtggcctggtaagcgccttctttcccta

SEQ ID NO: 29883 - DNA, 137 bp, Homo sapiens
  misc_feature 1..137: note = chr5:129240373-129240510
  misc_feature 1..137: note = hyper
  source 1..137: mol_type = genomic DNA
gcttcgacctccagccggtgtcggcgcctaggcggccggctgcggccgcggctgggggcgcaaaggcggaggaggggcgggtgtgagccggggaaaccgcgtgccgcgccgcgacagcccagcgagcgtccgcgccc

SEQ ID NO: 29884 - DNA, 65 bp, Homo sapiens
  misc_feature 1..65: note = chr5:129240766-129240831
  misc_feature 1..65: note = hyper
  source 1..65: mol_type = genomic DNA
atctccaggggccaccgctgcccgaggcagcacccgggatcaccagttttcgaagcagcccctgg

SEQ ID NO: 29885 - DNA, 81 bp, Homo sapiens
  misc_feature 1..81: note = chr5:129241413-129241494
  misc_feature 1..81: note = hyper
  source 1..81: mol_type = genomic DNA
gcttctctgccagcacgtgcttcgggctcccacaggccctggcccgccctccccaccccttgcatccgcccacaattcgta

SEQ ID NO: 29886 - DNA, 30 bp, Homo sapiens
  misc_feature 1..30: note = chr5:129241724-129241754
  misc_feature 1..30: note = hyper
  source 1..30: mol_type = genomic DNA
ttcaggaagggaagacggaggatgctagct

SEQ ID NO: 29887 - DNA, 360 bp, Homo sapiens
  misc_feature 1..360: note = chr5:131346877-131347237
  misc_feature 1..360: note = hyper
  source 1..360: mol_type = genomic DNA
gggcctaatctgatccgcggatggtccttgccatcagggaagggggacgcaagaactcggcgggggtttgtggtggggtcgcagagagcaagccctatatctccctccgcagacccaggtgctccccaaacccggcccggagcccgcgagaactgggggcggagggtgtacttaggcggccctggggaccttgacgggacagctcagcagcaggggatgggggctcggcggccgcggagatgtaacacctccacctcgggcgaagacctcatagcctgcgggagatgggagtccgggacgcggacaggacgggcacttacctacgaatagccagagggagccccccgacacgaggaagaa

SEQ ID NO: 29888 - DNA, 39 bp, Homo sapiens
  misc_feature 1..39: note = chr5:131347702-131347741
  misc_feature 1..39: note = hyper
  source 1..39: mol_type = genomic DNA
acgcgaccctgcccccgcgcgactcgcagcctgggtttt

SEQ ID NO: 29889 - DNA, 123 bp, Homo sapiens
  misc_feature 1..123: note = chr5:131593289-131593412
  misc_feature 1..123: note = hyper
  source 1..123: mol_type = genomic DNA
gggcgggggctgggccgagtggggacaggggcgggcgggccgggggcgggcgcggcgtccaggcggcggcggcggctgcggcggcggcggctcctcctcagagtccggctcaggctccggctg

SEQ ID NO: 29890 - DNA, 15 bp, Homo sapiens
  misc_feature 1..15: note = chr5:131593472-131593487
  misc_feature 1..15: note = hyper
  source 1..15: mol_type = genomic DNA
cgcctggtgggcggc

SEQ ID NO: 29891 - DNA, 263 bp, Homo sapiens
  misc_feature 1..263: note = chr5:131992030-131992293
  misc_feature 1..263: note = hyper
  source 1..263: mol_type = genomic DNA
agcttccagactggccggtctgcgcgcccacccctgcctcccggaccggccaccgccggaggccgcggaggagggcccggccgcgcagatcccgcttatcgggcccatctcccgttacataaggccacccccctatctccgcgggccatcgccgccgcaaccgccgcgccagcgccttctcccacgcgcgggggcgcccctgcccaccgctcccggcagggcttttggtggccatgggggataaggggcgttgactcacccgg

SEQ ID NO: 29892 - DNA, 246 bp, Homo sapiens
  misc_feature 1..246: note = chr5:132083083-132083329
  misc_feature 1..246: note = hyper
  source 1..246: mol_type = genomic DNA
cctccccacctcccccggcggcgccccaggctgcagtgttccgggagctgggttataaaatgccgggttaagcggcaactcagactcaggatcccgctcacgacatggcctcgggcgctcagctcccgccgcagccgtcgagctcagaggtcagcgccgtccagagcccaggcgggcgtcccggcgccggtctggaggaaacagccctgggcgttcctctcccgccgtctccgggggaggcccctc

SEQ ID NO: 29893 - DNA, 90 bp, Homo sapiens
  misc_feature 1..90: note = chr5:132947087-132947177
  misc_feature 1..90: note = hyper
  source 1..90: mol_type = genomic DNA
agccccaaagactagcgtcagctcgtccccaaactcgaggcgacaggcgccgaaagcagagtgctgtgcctgcctcgtccaggtccctcc

SEQ ID NO: 29894 - DNA, 1064 bp, Homo sapiens
  misc_feature 1..1064: note = chr5:132947465-132948529
  misc_feature 1..1064: note = hyper
  source 1..1064: mol_type = genomic DNA
ccctttgggctgcagcgaggagacgcaagtttccccgcaaagccgcggggaggaggtgctgagaatgcctgcccggcgccccaacccggagccaagggcaccgggcccgggccgaggggccgcgctcgcctggctccgccggggccgctcggggtcctgaacccaagaacggcgcctgcaggatttcggagccgggcgcgagctgcgggctcggcccgagcgcttctgcgtggcgccccgcgtgccaaccgggtcactccggtccccaccgtagaccccggccacgagcctcggcgtcccagcctctcctcgagtcctggccttggccggggtagccctgccgagccctggcccagcggtcccttccccgcgggcaaacttggctttcccggcgcgggcagtaaggacaagcaagcgcccgcgccgggccctgcagcaagatgcggggccgcgggcgccaggaccccagtggggtgcagcgggaccggctggtggcggcgccagcgacatggcaccctccccgcgcccgctgggagctgcgcccgcgtacctgagacggccggggccgaggggaagaccaggtggccggacttgggcgggagggagggagcaccccgtggcggcggcggcgaccccgccccgcgtccttcggctggtttctcgggctgtcggcgggtcccgggctcgctggaggctgttgaggctccagctccctgagccgccgctgcccgctgctgtgccaccgccgccgcggctgccctatttctgccgccgggaccggagcccgtgacgtcaccctctgggccccgcctgcccaatcgccgccacctgtgcgcgccgcccgcccgccagccggtcagacccgcgcggcggccacggcaggtgcgcggagcaggcgggcgcgcacgcggggcgcgatgactccggagcgctggggccatctagggcccggagggaggagggccagcgtagcgctcctgcctctggctagcgtggagctcggcaagtgacagcccctcttcacctctgctctcctccaggctcctttccgggccaggttcccc

SEQ ID NO: 29895 - DNA, 155 bp, Homo sapiens
  misc_feature 1..155: note = chr5:133449703-133449858
  misc_feature 1..155: note = hyper
  source 1..155: mol_type = genomic DNA
gctcttggctgtgttcgcggctcggagccgtcgcctgactgaggggcccgtcacagatgtgtgatgtataagctctgcacgcaacaggagctcaataaatgtgcgaaggggggtatacttatgttcgcactgtatgcaggcggcctagaaggaag

SEQ ID NO: 29896 - DNA, 127 bp, Homo sapiens
  misc_feature 1..127: note = chr5:134367108-134367235
  misc_feature 1..127: note = hyper
  source 1..127: mol_type = genomic DNA
tcttcttggctgggtcgtctgcgccgccgcagcccgtgcctcccgcaccactgtcctcgggccccttgggttccccgccgcgctccttctctgcagtaggcaggacggggagcgggtcacctgggct

SEQ ID NO: 29897 - DNA, 1060 bp, Homo sapiens
  misc_feature 1..1060: note = chr5:134374791-134375851
  misc_feature 1..1060: note = hyper
  source 1..1060: mol_type = genomic DNA
cgaagccacggctgaagtcccgggccacgcagaggggccagcaattccatgggtggtggggccctccatccctggacgcagcggggagcagcgggcggccctctctcctgcccacttctcctgggggtgggggagccctgtgtcacccgacgctgcgaggggctgccacgggcttctcaggttgtgcccttcgcggggccgtggcccgtgcccccgaggctgctaccctcttgaggtgcccggagccaaagcagagggttgatcccgccggttgggtgaggtagcacccggtgacggcggctatgactgtgccctgggcgcaggaacgagctcctcgcgctgcctcgaaggctcctgaccttccgcgccttgcgctgtcccgcgccgccgggtggacccacacacgccaggagcaaactgcgcaggactcggccgccacctccctgcgcccctccaccgcggagaccctgcgcccctagcccagcgtctcttaccccacctgggcagcgctgcgtctgcggctcgtgggctccgggctcgcccgccgcggactctggctcaggtttcggctccggctggggccccggatccagctctggctctggcactgcacggttcttcggcccctgctggttcgctacatcccagcgcgcgaggccggggcttcctcggctcggcccgctcctcccgccgccgccgcccgtcgcccgcggggaaggcggggacactggccgggaggcgggaagggtggggggaggggaagctaggtgttcgccgggacctgcggggagaggggcggcgcgcagtcccgccggctaggggtcctggcctccctcggggcgtaggctggggtccgcgcggctggcggccgggcctcgaggccggggagcgcgccctgggacctccgtggaggggccctgccgcatgcggacgaagccagagcgggtcccagcctggccctggggcactttctctccctgggcccagtttcccacctgactcgtgaggggctggccctacttccgtttagacgggggctggtggtcgagtttggggtttt

SEQ ID NO: 29898 - DNA, 38 bp, Homo sapiens
  misc_feature 1..38: note = chr5:134376287-134376325
  misc_feature 1..38: note = hyper
  source 1..38: mol_type = genomic DNA
cacagggctccccagcgttgcctcgtggccagataacc

SEQ ID NO: 29899 - DNA, 30 bp, Homo sapiens
  misc_feature 1..30: note = chr5:134376833-134376863
  misc_feature 1..30: note = hyper
  source 1..30: mol_type = genomic DNA
cctcctctcaaccctcgacagcaggaaccc

SEQ ID NO: 29900 - DNA, 255 bp, Homo sapiens
  misc_feature 1..255: note = chr5:134385913-134386168
  misc_feature 1..255: note = hyper
  source 1..255: mol_type = genomic DNA
ggaagggcaggagggcgaggggctagggcgatggaagggggagatcaagagtggcgcggcagggggagagcgccctgagcctcgctggagcccatcccggcatggctgctgggaccgacaggccgatcgcgggccgcgagcacatctcacagagcctgggcacagagggcccgaactgtgcccagcgaggaggacgcgtgtgggttttgcctgcaagggttctgaccacttggggacagcgagggcgcgtagagg

SEQ ID NO: 29901 - DNA, 43 bp, Homo sapiens
  misc_feature 1..43: note = chr5:134386184-134386227
  misc_feature 1..43: note = hyper
  source 1..43: mol_type = genomic DNA
cgccgcctcactcttccgcgcgaggtgccgggtggcccagcag

SEQ ID NO: 29902 - DNA, 97 bp, Homo sapiens
  misc_feature 1..97: note = chr5:134801812-134801909
  misc_feature 1..97: note = hyper
  source 1..97: mol_type = genomic DNA
ctcttctcaagtaggcggcaaagtttactggtgattgcgaagtgattgcagagcggttggagagtgaatggatccggagcagcgtagcaaacagcgc

SEQ ID NO: 29903 - DNA, 93 bp, Homo sapiens
  misc_feature 1..93: note = chr5:134802273-134802366
  misc_feature 1..93: note = hyper
  source 1..93: mol_type = genomic DNA
agatttctaaacttgcgcctcctgggaagaaggctagagttagcgttgccgcagggctgtgcctcagacgaccaggcacgaccaagcacacag

SEQ ID NO: 29904 - DNA, 68 bp, Homo sapiens
  misc_feature 1..68: note = chr5:134825450-134825518
  misc_feature 1..68: note = hyper
  source 1..68: mol_type = genomic DNA
tccgagcccgtggagcgctgcacaaaatcgtctagcgcggagcagggcggggacggggagagacacaa

SEQ ID NO: 29905 - DNA, 130 bp, Homo sapiens
  misc_feature 1..130: note = chr5:134825912-134826042
  misc_feature 1..130: note = hyper
  source 1..130: mol_type = genomic DNA
ggagaggcccccgggacctttcaggcccacaaacgccgcgctaaatagccacgcgcacaatagcatgaaagggctcactcggaccttactgcaacacagtagattcacacccctccgaggggactaataa

SEQ ID NO: 29906 - DNA, 19 bp, Homo sapiens
  misc_feature 1..19: note = chr5:134826479-134826498
  misc_feature 1..19: note = hyper
  source 1..19: mol_type = genomic DNA
cgtgcgctgagggcccgga

SEQ ID NO: 29907 - DNA, 481 bp, Homo sapiens
  misc_feature 1..481: note = chr5:134870446-134870927
  misc_feature 1..481: note = hyper
  source 1..481: mol_type = genomic DNA
ggcgggcaggaggggcgctgggctgagggccggagaaacagaccaagagacatccgccgcgagggtgcggcgacctaacaagcggctcaggtatccccgactgctttaaagctcccgcttcctccctccgcctggagagggggtcccgaggcggcagctggggccccatctattgcctgctgactaggggagggggaaagtaacagtgtctacaaagggcctagtggtaaggaatgaaacagggcgttgtgtggagcaagtctttgggcaggcttgggaaggagaaaacagggtcgccggggcggtaggtgaagtcttcggaggcggctgggctactggggtcagagagcggggaggcggcggcggcacctgagccccaggactccgcgtcgctggcggggcttgggggaccgggcaggcaggggacgcactgcggcggcaggaggcgctcccgggcaccgcctccgggcagcccttgatc

SEQ ID NO: 29908 - DNA, 626 bp, Homo sapiens
  misc_feature 1..626: note = chr5:134871417-134872043
  misc_feature 1..626: note = hyper
  source 1..626: mol_type = genomic DNA
cgctcagagcgctgcagcccggactgagggcagagccgccagggcgcacttacgttcccaacagcctggggttgttactctgtgccagttgcgggtgcgagagcctggaagggtgcaggggcgcacggagaacttggcctggcctcctcgcctcgcctgcaggggccacgcgcccggccggtctcctgagtgatgtcgccggcgatcagatcagctcgtgtgagcaccgagtgtggcacacgactggcctcaggaccccttaagtacccggcgcaacaatgggcgcccccctcccttgccacctccgcccccgcggcagcccgggtgaatggagcgaggcggcaggtcatccccgtgcagcgcccgggtatttgcataatttatgctcgcgggaggccgccatcgcccctcccccaacccggagtgtgcccgtaattaccgccggccaatcggcggcgtcgcgcggccccgggagtcggctcgggctaagctggccagggcgtctccaggcagtgaaacagaggcggggtcggcgggcgattagcggccgaggcacgctcctcttggggcgggctgggcgcccctcgctggggtgggacggggaggcggggcgcgagcgcgaaagt

SEQ ID NO: 29909 - DNA, 523 bp, Homo sapiens
  misc_feature 1..523: note = chr5:134879428-134879951
  misc_feature 1..523: note = hyper
  source 1..523: mol_type = genomic DNA
caagtcttgagcaaacgaccctagcgccgtggctcttcctacggcgggggcctcggagaacccggcggggcgcgcggggggacgcgtgggcactgccgcgtgggcgccctgaccccgcgcccgcgtggagcgagagccgggactctgggccagcaagttccagttccccgatggggccggctcgcccggagccgcgtgaggggattagggccgcacgagaggcgaccgcgccgcggcctccagccacgtgagcacagacacggcttcaaacgtccccaacgcactaatccttgttatccggcaggataaccgcggccgcgccagcacccggcctgcctcctccgtctggctgcgggcggggagtgcgcctggctcccgagcccctgacacggatttggggcctgcaatgacgatctaccccacaccatccacattcctgggaccctcggggcaaggtcctacagtccttggtgaccaccacgcctgcaaaaagcggtgggaaagttgttacgcttagaaaact

SEQ ID NO: 29910 - DNA, 501 bp, Homo sapiens
  misc_feature 1..501: note = chr5:134914251-134914752
  misc_feature 1..501: note = hyper
  source 1..501: mol_type = genomic DNA
ggcttagttgctaggcggtctcctgcccctcgaccaccttggtgcccacccagaccaccccccgcgggatcccaggatgcctagaaattggcgcttgggttccccaggacaggacaagacgagacggcgacaaggggagctccccgcactcaccgtccacacgcgcggtgtacagcgccagcagcagcaggagcagcgcggccgccaggagcctcatgctgaccggaggggcgcggcgtgggagcagggacatggggagggcgctggcccgtcggagcggcggcccggagacgccacccagctctgctcggctttctctgcccggggcgcgccttccggctctgctggctccggctgcgccgtcggtggatgcccagggctgtctgtggccgtgcgctgcgctctgcgcttgtctccgcgctctctccacagcctccctccgcccgccctggcctcttttaaatccgctcctgccctcgcagcgagcgagctcattaatat

SEQ ID NO: 29911 - DNA, 290 bp, Homo sapiens
  misc_feature 1..290: note = chr5:135170256-135170546
  misc_feature 1..290: note = hyper
  source 1..290: mol_type = genomic DNA
gtgtctgggatgagccgcgcggagcgcacccttatccacccagagtgctgtgcctttaaggtccactgggggcgtgatgtcagccgccctccggcacttggagaggtgagcgcggcagcccgcgcagccggtgactgggggactgggtttggagtaggacctgcggcgtgctcgagactccgacttcggtcttgcggcgcgctcgcgcccgcgggccatgccccactgactctaagtgggcactgccccggctccgggagggcgagaccgagcgccggccatgggaagct

SEQ ID NO: 29912 - DNA, 172 bp, Homo sapiens
  misc_feature 1..172: note = chr5:135170997-135171169
  misc_feature 1..172: note = hyper
  source 1..172: mol_type = genomic DNA
gtgggagccaggcttcgagattaggccggcccaacggggcgtcccgactggagggagcagagctctcacagcagggagcggagcgccggctgcaggtgcccattgccaggctgcgaggagcacttattgccttcagccgccgccaaccgtcagccatcgcctacctccaagg

SEQ ID NO: 29913 - DNA, 159 bp, Homo sapiens
  misc_feature 1..159: note = chr5:135265701-135265860
  misc_feature 1..159: note = hyper
  source 1..159: mol_type = genomic DNA
gcattgataaaggggcgcccttcatcgggagtaagtcccagaaaccacaagcgttggctcatgcctgtgtggagtcacaggcaggtggccacggggaattagctgaagaccagcaggcaggaagcctcccacatgccacctaaggggcgctcccggaac

SEQ ID NO: 29914 - DNA, 12 bp, Homo sapiens
  misc_feature 1..12: note = chr5:135265919-135265931
  misc_feature 1..12: note = hyper
  source 1..12: mol_type = genomic DNA
cgccaggtgggc

SEQ ID NO: 29915 - DNA, 197 bp, Homo sapiens; identical to SEQ ID NO: 485
  misc_feature 1..197: note = chr5:135265932-135266129
  misc_feature 1..197: note = hyper
  source 1..197: mol_type = genomic DNA

SEQ ID NO: 29916 - DNA, 128 bp, Homo sapiens
  misc_feature 1..128: note = chr5:135266577-135266705
  misc_feature 1..128: note = hyper
  source 1..128: mol_type = genomic DNA
ggagtttatagttgccacaaatgtcaaaaagtagccttctggcgagctgaaagcgctcacctgtgcgctttaaggtgtaccgtctttgtctttggcgagtgtgccttttaagacgcttccaagataaa

SEQ ID NO: 29917 - DNA, 62 bp, Homo sapiens
  misc_feature 1..62: note = chr5:135527945-135528007
  misc_feature 1..62: note = hyper
  source 1..62: mol_type = genomic DNA
gcggtcgtggggcagcgcggcgaaggccgaatggcgcagctggcaaccgatgaagaggacga

SEQ ID NO: 29918 - DNA, 657 bp, Homo sapiens
  misc_feature 1..657: note = chr5:135528223-135528880
  misc_feature 1..657: note = hyper
  source 1..657: mol_type = genomic DNA
cccgccgaccccagccggaccgcttcacttggcctggagcatactggcgcgacccggcgcctccatggcgcgcccctcccgccctgccgcgcccaactgaccgagagtcggtgccttggggccggcggggactgcaaagaccccgggacgcgtccgctcactcgcctccgcgctcagctgctttccccgccggctggcggaccccagttctcggagctggacagttctgtgcccgcgcccctcgggctcactgtttctctccgtcgccaccaggacagaggtcccagtcactgactcgcctttcggctttacaacagcccgctcagctcggaccctcagctccagtgagctccaggtgctgggcgcctctgggctgcggcggcggggagaggcactcagcaagtgcagccgcagcccggggtctctgctgagcgcccggtggcagagcgcacggagggcgggtggccagggagtcctccgcgtcctccggcgccgccgccaccgcagcgtctcggaacagtcctgcaggctctggtccctgtcgagacgcccagtgttcagcgagcttgtccccactccctccggctgctgcgctcctgttttgagcaggagactgagctttctggcggctctgagcgcgctcgtgtcccgggcggg

SEQ ID NO: 29919 - DNA, 25 bp, Homo sapiens
  misc_feature 1..25: note = chr5:136834026-136834051
  misc_feature 1..25: note = hyper
  source 1..25: mol_type = genomic DNA
cgcgccccccagggccgggtggcgc

SEQ ID NO: 29920 - DNA, 203 bp, Homo sapiens
  misc_feature 1..203: note = chr5:136834289-136834492
  misc_feature 1..203: note = hyper
  source 1..203: mol_type = genomic DNA
cggccgcgagccccgggcacccaggcgtcccagcgccccagcccggaggcggggaccccgcggcgggcacgggcagcgctcgcgcacctggggcgcctgtcgcgcctctagacccagggacccctctcacgaatgggggactcatctacgaacgaggaggctgcgtcacgaatccgaggctgccgtccaactacaggggaccc

SEQ ID NO: 29921 - DNA, 171 bp, Homo sapiens
  misc_feature 1..171: note = chr5:136834493-136834664
  misc_feature 1..171: note = hyper
  source 1..171: mol_type = genomic DNA
tctcgtctattctccgagtgccccacagatgccgccctcctatcaggggcttggtacccctccccagaagcggggagcccgggtccgcacgccgcactcccacagacggtgcggtgcacacggctttggggcaggagaggggagaacagggctccagcagcacccgagctc

SEQ ID NO: 29922 - DNA, 175 bp, Homo sapiens
  misc_feature 1..175: note = chr5:136834706-136834881
  misc_feature 1..175: note = hyper
  source 1..175: mol_type = genomic DNA
cgacagctaagggaaaggtctcccttgagcgccctgaggtctcgggggtaagaaaggcgcgcggaggtaaccccaggccctgaccctgccagccccctaggcggccgcggggaggtcccaactactccaagttggggcgcggggttcctctgggcacgtaccttgggggccggcc

SEQ ID NO: 29923 - DNA, 107 bp, Homo sapiens
  misc_feature 1..107: note = chr5:136834912-136835019
  misc_feature 1..107: note = hyper
  source 1..107: mol_type = genomic DNA
cgcggcacggtcgccgggaaggctgatcgccggctcgcgcccctgcgctcctgccacacgccgccgccgagcgtctggccgctttgtgagcccgcagcgatgtgctc

SEQ ID NO: 29924 - DNA, 62 bp, Homo sapiens
  misc_feature 1..62: note = chr5:137225091-137225153
  misc_feature 1..62: note = hyper
  source 1..62: mol_type = genomic DNA
cgtcagagccgggcagcgcgcgccgcaagactagcgcgcaagcgccgcggcctcaggcgaac

SEQ ID NO: 29925 - DNA, 364 bp, Homo sapiens
  misc_feature 1..364: note = chr5:137577620-137577984
  misc_feature 1..364: note = hyper
  source 1..364: mol_type = genomic DNA
ccaggcaggggcgcccgtccggcaccggactcccgccctgggcccagctccggcgctcggccagccccgtgccccgggcggccgctgatagtcggctaatgcgtatcgaatttttgtggagttcggcccgcgcagagtgcgcgcggaggcgctgcccgagcctcttaattccctttgcatcgatcctgccgttaatgacataaccttctcccctaattaactgacaactgcattaggcggcgcgcctccgccgcacgccgcccacagcttcccccacgcagttccgcccgcgccggtgcggggctggggcgcagcggctccgcctggactcaactcagggtccggctgccgtggtggaggggag

SEQ ID NO: 29926 - DNA, 265 bp, Homo sapiens
  misc_feature 1..265: note = chr5:139047957-139048222
  misc_feature 1..265: note = hyper
  source 1..265: mol_type = genomic DNA
acgcggacgtgcctgcgcggctctggcggccgcgtctgccgccccggcgcccgcccgggtcccaggccgactaattaggcccggctacctcccgcgccgcccactgcccgctccaggcccgctgcccgctccaggcccgaggtgatggcggctgttcctgccgttctggggcctgtgccccagagctggccgcgtttctcggggcgggagccagctctgctcgcctggcttaacccagacgagcccaggacgccctatccctgaa

SEQ ID NO: 29927 - DNA, 49 bp, Homo sapiens
  misc_feature 1..49: note = chr5:139175487-139175536
  misc_feature 1..49: note = hyper
  source 1..49: mol_type = genomic DNA
gcgggacaggcagcccggcggcctccgatggccccgccgtgagaggccg

SEQ ID NO: 29928 - DNA, 62 bp, Homo sapiens
  misc_feature 1..62: note = chr5:139175815-139175877
  misc_feature 1..62: note = hyper
  source 1..62: mol_type = genomic DNA
cgccgcgggaaagcccgagcccagcctgagggacggtgggggctgccgggccgattgtctcc

SEQ ID NO: 29929 - DNA, 58 bp, Homo sapiens
  misc_feature 1..58: note = chr5:139175929-139175987
  misc_feature 1..58: note = hyper
  source 1..58: mol_type = genomic DNA
cgtgtgcgtggggggtgccagtggcagcctggtggtcggggatcggggcattgggtac

SEQ ID NO: 29930 - DNA, 196 bp, Homo sapiens
  misc_feature 1..196: note = chr5:139227725-139227921
  misc_feature 1..196: note = hyper
  source 1..196: mol_type = genomic DNA
acgccgaggctgagccgccgcccgagccgctgctcagcgacagcgagtccctcgccgcccgtgcgcgctgcgccgccagcccgttgaggcgcgagcggcgccagcgccggggccccgccgacgtcctgcgggacgcaccgcgcgcgcgcggccgcggcggcggcgggggcgcgcactcctgcgtggtctcgtactc

SEQ ID NO: 29931 - DNA, 36 bp, Homo sapiens
  misc_feature 1..36: note = chr5:139283710-139283746
  misc_feature 1..36: note = hyper
  source 1..36: mol_type = genomic DNA
agccccttgctctcccggccgcgacgacccgctcgc

SEQ ID NO: 29932 - DNA, 490 bp, Homo sapiens
  misc_feature 1..490: note = chr5:139283973-139284463
  misc_feature 1..490: note = hyper
  source 1..490: mol_type = genomic DNA
ctccgacattctgcacggggtcccaggcggtgggacggcctcagctctccgctgccgcgctgcgcccccgccgcctgcagcctcagtgcccgagcgcggcgcctttcttataggcggtcacaccctccgggggaggggagcagcgagccttaactcttcccctcccgcgccctccaccctcgccccccctccaccggctcgggccgcgggggcgtgtgggcggccggtctgggccctaggccccctccctgggcccaccgaggtaggcaagaccggcgcctaaacagggcgccacagacctcctcgccgaagagggggcttgagctgggctgggggcctgagcatgattggggagggcggagtagagatcccccagcgagggccaggctaaggacagcatgggggtggggagacagcgaggaaagggcccaggaagggaccaaaatgaagcccgctagccagcccagcggggtagcgagcacccttggct

SEQ ID NO: 29933 - DNA, 335 bp, Homo sapiens; identical to SEQ ID NO: 8065
  misc_feature 1..335: note = chr5:139525423-139525758
  misc_feature 1..335: note = hyper
  source 1..335: mol_type = genomic DNA

SEQ ID NO: 29934 - DNA, 128 bp, Homo sapiens
  misc_feature 1..128: note = chr5:140012165-140012293
  misc_feature 1..128: note = hyper
  source 1..128: mol_type = genomic DNA
gcggaggcatggtgccggttatctttaggtcctcgagcgtcagttccttgaggcgggagtacgctagcacacgcagggcgcctaccagtagctgagcaggaacctgtgcggctcccactgtgagccgc

SEQ ID NO: 29935 - DNA, 35 bp, Homo sapiens
  misc_feature 1..35: note = chr5:140012364-140012399
  misc_feature 1..35: note = hyper
  source 1..35: mol_type = genomic DNA
cggctctaggttgagaccgccggcatggatctcca

SEQ ID NO: 29936 - DNA, 107 bp, Homo sapiens
  misc_feature 1..107: note = chr5:140174733-140174840
  misc_feature 1..107: note = hyper
  source 1..107: mol_type = genomic DNA
gcctgttccgggtggcgtccaaaagacacggggaccttctggaggtaaatctgcagaatggcattttgtttgtgaattctcggatcgaccgggaggagctgtgcggg

SEQ ID NO: 29937 - DNA, 63 bp, Homo sapiens
  misc_feature 1..63: note = chr5:140187083-140187146
  misc_feature 1..63: note = hyper
  source 1..63: mol_type = genomic DNA
ccacctggaggtgatcgtagacaggccgctgcaggttttccatgtggacgtggaggtgaggga

SEQ ID NO: 29938 - DNA, 32 bp, Homo sapiens
  misc_feature 1..32: note = chr5:140214378-140214410
  misc_feature 1..32: note = hyper
  source 1..32: mol_type = genomic DNA
aaggaatctgttcatcgcggaatccaggccgc

SEQ ID NO: 29939 - DNA, 60 bp, Homo sapiens
  misc_feature 1..60: note = chr5:140248774-140248834
  misc_feature 1..60: note = hyper
  source 1..60: mol_type = genomic DNA
ccagctccactactccgtctcggaggaggccaaacacggcaccttcgtgggccgcatcgc

SEQ ID NO: 29940 - DNA, 111 bp, Homo sapiens
  misc_feature 1..111: note = chr5:140261900-140262011
  misc_feature 1..111: note = hyper
  source 1..111: mol_type = genomic DNA
ctggcttctgatcctcgcagcctgggagacgggtagtggccagctccactactccgtccccgaggaagcaaaacacggcaccttcgtgggccgcatcgctcaggacctggg

SEQ ID NO: 29941 - DNA, 367 bp, Homo sapiens
  misc_feature 1..367: note = chr5:140305805-140306172
  misc_feature 1..367: note = hyper
  source 1..367: mol_type = genomic DNA
cctagaaggtgtggtcgctcacgttcaccgtcccgcctctcgccgcctccgctcggcagctccacgctgagtcccgccctctccgccggagaggtgcgccggggtcagagcgccgggacccgacgcgcggctcccaaagggcggcaggaagagcccagctgggctcagccacagttatcagcaatctgcgggcagaggatgtggaggttaagatctgggcagcctcagggcgttgtcctagaaaacaccgtttaaggagagaagtgttagtgtctcggggcgtctcccaggctccgccctgcgcccgcagccagcgtggtggtcgagaccccagcccgctgctactggagacagcacctctcgcgcc

SEQ ID NO: 29942 - DNA, 176 bp, Homo sapiens; identical to SEQ ID NO: 8069
  misc_feature 1..176: note = chr5:140306444-140306620
  misc_feature 1..176: note = hyper
  source 1..176: mol_type = genomic DNA

SEQ ID NO: 29943 - DNA, 113 bp, Homo sapiens
  misc_feature 1..113: note = chr5:140306674-140306787
  misc_feature 1..113: note = hyper
  source 1..113: mol_type = genomic DNA
cggggtggatctacccagcggcaatttggtggtcagagagccggcggaccgcgaacagctgtgcagggccaaagctgcctgcgtcttgacctacgacctggtgctcgaggacc

SEQ ID NO: 29944 - DNA, 30 bp, Homo sapiens; identical to SEQ ID NO: 8071
  misc_feature 1..30: note = chr5:140345497-140345527
  misc_feature 1..30: note = hyper
  source 1..30: mol_type = genomic DNA

SEQ ID NO: 29945 - DNA, 30 bp, Homo sapiens
  misc_feature 1..30: note = chr5:140345821-140345851
  misc_feature 1..30: note = hyper
  source 1..30: mol_type = genomic DNA
taagcaggggagagacggtggagactggat

SEQ ID NO: 29946 - DNA, 40 bp, Homo sapiens
  misc_feature 1..40: note = chr5:140346709-140346749
  misc_feature 1..40: note = hyper
  source 1..40: mol_type = genomic DNA
gcttggaagtgctggcgcacaaccccgtggcggtgagcgc

SEQ ID NO: 29947 - DNA, 199 bp, Homo sapiens
  misc_feature 1..199: note = chr5:140514751-140514950
  misc_feature 1..199: note = hyper
  source 1..199: mol_type = genomic DNA
aatagtaaattaggacgcctggtggcgctgcaggctaagagtgtggatagtgggctctgcggataactcagacgccattaagctggggaatccaaactctaaaagaaggacgcattttaggtaagatctagtggctagatcttcagggtgggcttcgttcttgtggaaatcagtcaagaaagatcggattcgcggttat

SEQ ID NO: 29948 - DNA, 182 bp, Homo sapiens
  misc_feature 1..182: note = chr5:140593316-140593498
  misc_feature 1..182: note = hyper
  source 1..182: mol_type = genomic DNA
ctgctcactaaagtccggcgatattaacggtggtgttgtaaccttacatagtctcggggtgcatacaggcagagttgggaatattacatccattatcattccacaaaatgtaagatcctgtgaggacgcgtggtggcgctgcaggataagaaggcacaaaccagaaccgcagctgcagctcc

SEQ ID NO: 29949 - DNA, 75 bp, Homo sapiens
  misc_feature 1..75: note = chr5:140604438-140604513
  misc_feature 1..75: note = hyper
  source 1..75: mol_type = genomic DNA
ctcctacaccctgttcgtccgcgagaacaacagccccgccctgcacatcggcagcgtcagcgccacagacagaga

SEQ ID NO: 29950 - DNA, 161 bp, Homo sapiens
  misc_feature 1..161: note = chr5:140613853-140614014
  misc_feature 1..161: note = hyper
  source 1..161: mol_type = genomic DNA
agagtcgcatggtggcgctgcaggataagacggtgaaatttttgtaaccgcagatgctctggttttccttaaccatgggaactgaaagcgctggaataccaggagaaaatagtctttcaaaaggtagggcaccatcaacaccttcgcgacaggattaagag

SEQ ID NO: 29951 - DNA, 15 bp, Homo sapiens
  misc_feature 1..15: note = chr5:140614314-140614329
  misc_feature 1..15: note = hyper
  source 1..15: mol_type = genomic DNA
cagagtcatctttga

SEQ ID NO: 29952 - DNA, 28 bp, Homo sapiens
  misc_feature 1..28: note = chr5:140614383-140614411
  misc_feature 1..28: note = hyper
  source 1..28: mol_type = genomic DNA
cgagcagctggaccgggaggcactttgt

SEQ ID NO: 29953 - DNA, 120 bp, Homo sapiens
  misc_feature 1..120: note = chr5:140713985-140714105
  misc_feature 1..120: note = hyper
  source 1..120: mol_type = genomic DNA
agttcaagaccagccggacagggcggcctgcgactgtagtcccagctacgcggggcggggaggggcggggcggggcggggcaggagctgacgtgggaggatcccttgagcccaggaagtc

SEQ ID NO: 29954 - DNA, 45 bp, Homo sapiens
  misc_feature 1..45: note = chr5:140767211-140767256
  misc_feature 1..45: note = hyper
  source 1..45: mol_type = genomic DNA
aagtggagagcttggcgctccagatctcctcgcgcagccgcagcg

SEQ ID NO: 29955 - DNA, 197 bp, Homo sapiens; identical to SEQ ID NO: 8077
  misc_feature 1..197: note = chr5:140777472-140777669
  misc_feature 1..197: note = hyper
  source 1..197: mol_type = genomic DNA

SEQ ID NO: 29956 - DNA, 85 bp, Homo sapiens
  misc_feature 1..85: note = chr5:140787848-140787933
  misc_feature 1..85: note = hyper
  source 1..85: mol_type = genomic DNA
ccaccctgagtgagccgatccgctactcgattccggaggagctggccaagggctcggtggtggggaacctcgctaaggatctagg

SEQ ID NO: 29957 - DNA, 203 bp, Homo sapiens
  misc_feature 1..203: note = chr5:140797076-140797279
  misc_feature 1..203: note = hyper
  source 1..203: mol_type = genomic DNA
ttttggctgtcaactcgtagtttaaaaaaaattccttgaaagaggtagagaaaagtcaagttgcagtcccacacagagcctctgggcgccgccgtcggccagtgcagagcaagcgctgacgccggggatccctcagcctctagcctgggattccctgcgcagccaacaacagaaaagaaaaccagctcccacacagaggctcc

SEQ ID NO: 29958 - DNA, 305 bp, Homo sapiens
  misc_feature 1..305: note = chr5:140797327-140797632
  misc_feature 1..305: note = hyper
  source 1..305: mol_type = genomic DNA
cgggactcctcctgtcctgggccgaatgctcttttagcgcggtagagtgcactttctccaactggaaaagcggggacccagcgagaacccgagcgaacgatgggagggagctgcgcgcagaggcgccgggccggcccgcggcaggtactatttcctttgctgctgcctttgttctaccccacgctgtgtgagccgatccgctactcgattccggaggagctggccaagggctcggtggtggggaacctcgctaaggatctagggcttagtgtcctggatgtgtcggctcgcgagctgcgagtgag

SEQ ID NO: 29959 - DNA, 507 bp, Homo sapiens
  misc_feature 1..507: note = chr5:140800458-140800965
  misc_feature 1..507: note = hyper
  source 1..507: mol_type = genomic DNA
taagctctacaaatacgtgtgattcacaaaggtgagcgtaatcatttcttctggaatttcttagtcgttgcaataataagaatgggctctaggcgccgctgctcaccaatcagggaatgggaagctgcgcgccattgagtccctccctcccccgcctctaccacacaaagcggaatgagatggatactcacagatcctgacactggagacttagaagtattttccttcgctttctgatatattttggatgtagtcggcctaggacttcatagatacataagccgattcacaaccaaccagctcgagaaaccgcggaatatcggcttagagcctgccatggcgaatcggctacagcgcggggaccgcagtcggctgctgctgctgctgtgcattttcctggggacgctgcgggggttccgggccaggcagatccgatattcggtgccagaagagaccgaaaagggctccttcgtgggcaatatctccaaggacctggggctggagccc

SEQ ID NO: 29960 - DNA, 228 bp, Homo sapiens; identical to SEQ ID NO: 487
  misc_feature 1..228: note = chr5:140801034-140801262
  misc_feature 1..228: note = hyper
  source 1..228: mol_type = genomic DNA

SEQ ID NO: 29961 - DNA, 861 bp, Homo sapiens; identical to SEQ ID NO: 488
  misc_feature 1..861: note = chr5:140855598-140856459
  misc_feature 1..861: note = hyper
  source 1..861: mol_type = genomic DNA

SEQ ID NO: 29962 - DNA, 87 bp, Homo sapiens; identical to SEQ ID NO: 489
  misc_feature 1..87: note = chr5:140856546-140856633
  misc_feature 1..87: note = hyper
  source 1..87: mol_type = genomic DNA

SEQ ID NO: 29963 - DNA, 89 bp, Homo sapiens
  misc_feature 1..89: note = chr5:140864611-140864700
  misc_feature 1..89: note = hyper
  source 1..89: mol_type = genomic DNA
cgccggccgaaccgcgccagagctggcgcggggaaagggagataggtgtctccagctgctgtggctgtttggggcgggtcggcttcatc

SEQ ID NO: 29964 - DNA, 38 bp, Homo sapiens
  misc_feature 1..38: note = chr5:141030807-141030845
  misc_feature 1..38: note = hyper
  source 1..38: mol_type = genomic DNA
gggtctgaccccttccgacttcccgtctcctaccacaa

SEQ ID NO: 29965 - DNA, 425 bp, Homo sapiens
  misc_feature 1..425: note = chr5:141262718-141263143
  misc_feature 1..425: note = hyper
  source 1..425: mol_type = genomic DNA
aattcctttcttccccgaagagctccccactctccctgaccagagtctccttgatctggaggctgggcagcccccggggacccggtggccgccgctgaccccgtggcatgcggctctcaaaggccccattcatctctgggggctgaaggcgccattgtccccagcggggggtggtgtggggagtgaaggggtctggactcagaaggaaggaatgcgtctggagaagttgcccccggggctccagtctcaaggtccccaccagatctccatcgggaccctttcacgaccccgagccctttccccaggagctcccagcaaccttcgcgcttctccggagggtggggtctgccgcggcgcgggggcagcctcaccccacctcactgctggactccggagaaccatttctgggaccgggagctgtccag

SEQ ID NO: 29966 - DNA, 288 bp, Homo sapiens
  misc_feature 1..288: note = chr5:141293747-141294035
  misc_feature 1..288: note = hyper
  source 1..288: mol_type = genomic DNA
caaggctggagggaacgtgatgcaggcagtggagctgcgggctcggccccgggatcgtggggagagagagccccctgccgagcgcggaggggcgccctccctcccaggccccgggccaccgtctggggtcggttccctccagatttcacagccgcggcagcagcaggagcgcgcacacgcccgcgcccactgcactgcggcggtgctccgcagctcagcctcggggccatcacgtgggtgcggcctgaccccgggcgattctggggccgtctccgcaggcagttgagc

SEQ ID NO: 29967 - DNA, 25 bp, Homo sapiens
  misc_feature 1..25: note = chr5:141931330-141931355
  misc_feature 1..25: note = hyper
  source 1..25: mol_type = genomic DNA
ctcacttctccttctcgcccttaat

SEQ ID NO: 29968 - DNA, 79 bp, Homo sapiens
  misc_feature 1..79: note = chr5:141931424-141931503
  misc_feature 1..79: note = hyper
  source 1..79: mol_type = genomic DNA
cgccggcgccccgggtgggctcccggagcgcgcgggcctgtgacccggaggtcagagatgcctccgtcctgtttgatgt

SEQ ID NO: 29969 - DNA, 155 bp, Homo sapiens
  misc_feature 1..155: note = chr5:142781720-142781875
  misc_feature 1..155: note = hyper
  source 1..155: mol_type = genomic DNA
cccgtttatctgaggcgataacgatctctaaacacgaggtatcgaatggagcccaatgaatttccatgccgcttttttgacagctgccttcaaacccgaaaccaaaacaatatttcctaaaacgaaaacgctccctcaagcgacattatccccca

SEQ ID NO: 29970 - DNA, 434 bp, Homo sapiens
  misc_feature 1..434: note = chr5:142784781-142785215
  misc_feature 1..434: note = hyper
  source 1..434: mol_type = genomic DNA
gggaggtaacttttgcgcccccacaggtgacatcgcttgccagctcctgacacgggcgggggctgccgcagctccacctaatcctgctcgggcgctcggccacagccactctctcacctcccgccgcgctcagactgacggcggctccccctgctctgacatcttgaagacgattggggaagcgcgtcccggaagccgcccgccgccatcttggtagggtacagtgtcgccagcccgtccccgcggccaccatcttggcaaaggttcgcgatcgcgggtagcctaagccgtccttccttggttctcaagggtaaacggttccctgtgcattgtctgatgtgaaaggaaagaagtaggctttcagcaagcctcttgtccggagacgatctacgggggccgcctccagaggattctggagccgccatcttggcaaa

SEQ ID NO: 29971 - DNA, 287 bp, Homo sapiens
  misc_feature 1..287: note = chr5:143584834-143585121
  misc_feature 1..287: note = hyper
  source 1..287: mol_type = genomic DNA
tgtcaccgaggaggacgtgactcggagctgcctccgctttctccaagccatattcctttaagatgatgtaatagtcatttccctggatggtttcttgcctgcactgctgaaacaacagcatccgaactgcactgggaactgtggaaccacccagctccgccgccagagaagccggagccccgggccccccgccggcatctctgcgctgcgttggcctctggctcgcaccggctcccacctggctgggaacatgggagtccgtttgcccttgccggcaggtggggtgg

SEQ ID NO: 29972 - DNA, 182 bp, Homo sapiens
  misc_feature 1..182: note = chr5:145214963-145215145
  misc_feature 1..182: note = hyper
  source 1..182: mol_type = genomic DNA
ggccactcggagaaacgcgcagtcggccacgcccacgcccctactgccagagtccggggcctggggttacagagcgcgggaggcgctggagcgctcccagagcacccggggccccgcggtctccacgctggcggcgccagagcggccctggtgccctcccgcggccgcgcctgccgagaaaa

SEQ ID NO: 29973 - DNA, 50 bp, Homo sapiens
  misc_feature 1..50: note = chr5:145316176-145316226
  misc_feature 1..50: note = hyper
  source 1..50: mol_type = genomic DNA
aagccggttggagggcgcagcgcacccctgctgcgcggaggagggggctg

SEQ ID NO: 29974 - DNA, 255 bp, Homo sapiens
  misc_feature 1..255: note = chr5:145713641-145713896
  misc_feature 1..255: note = hyper
  source 1..255: mol_type = genomic DNA
cgtgccgagccctcacggacgctcggcctctggcccctgaatccctctgggcgtctcggatcctctgagccactttgcagacaatgcaaggcagcggccaacagacgagtcccgcagcagctgcgcaggcggcgagtacatgtgagaagtttgtgaaaggcgaccagagaaagggagaggaaggcaagtcaggcggctgcgaacacctggccaggcagccccgccagctgcctcgctgcgcgatggcatcttgag

SEQ ID NO: 29975 - DNA, 218 bp, Homo sapiens
  misc_feature 1..218: note = chr5:145716979-145717197
  misc_feature 1..218: note = hyper
  source 1..218: mol_type = genomic DNA
cagggcgggaaccagcggagggggctggctcggatggggagaaaagcaactggagggcgccgaggggaagagggagcccggatctgtcagggcgtcctcttggactaagggatgttcccctaaaccacaccaccccacctcgttcagattctgggaaacccggcacgcacataccctgcacaataacaggcagggtgaggtctctaagccccgaagat

SEQ ID NO: 29976 - DNA, 172 bp, Homo sapiens
  misc_feature 1..172: note = chr5:145717248-145717420
  misc_feature 1..172: note = hyper
  source 1..172: mol_type = genomic DNA
cggggtttctctccgaaccggagtgcagcgtagtcgaggtccaggattccccatccattattcacgatgtttactagagcggggcaagggagaggaaagaagagggaagtagagagaaaaagaggctaggggaggtggaggcgggcagtgctaacctcgagagccctcaagt

SEQ ID NO: 29977 - DNA, 265 bp, Homo sapiens
  misc_feature 1..265: note = chr5:145717780-145718045
  misc_feature 1..265: note = hyper
  source 1..265: mol_type = genomic DNA
acaagcttccttagacgggagggttggaggaagagtgggccaagttacatccctcaaatgaaagaaagaaaggcaagcgtggggaggaagccaccccggactgagaaggcagttactgcccctacctctaccccggagcgcggttgagggaggtggggcaggggtcacctgggcctcgttctggcagcccctcaccctctccagggcccgtctgggcgcttggaggcgcctcctcgctgcgccgcgggaccggactctggtggac

SEQ ID NO: 29978 - DNA, 36 bp, Homo sapiens
  misc_feature 1..36: note = chr5:145718465-145718501
  misc_feature 1..36: note = hyper
  source 1..36: mol_type = genomic DNA
cccggcgcgtgagcacgcctgcgcgcgcccgggccc

SEQ ID NO: 29979 - DNA, 144 bp, Homo sapiens
  misc_feature 1..144: note = chr5:145718802-145718946
  misc_feature 1..144: note = hyper
  source 1..144: mol_type = genomic DNA
gtggagcataattaccgctctaaggcacattttttgacaggcactagcttcatgtttttttcatgtcgcccagaacaatcgccgctgtctgaacccctctccttgtctcccccgcgttctctcccggcgcgctctctctctcat

SEQ ID NO: 29980 - DNA, 477 bp, Homo sapiens
  misc_feature 1..477: note = chr5:145719156-145719633
  misc_feature 1..477: note = hyper
  source 1..477: mol_type = genomic DNA
gcgccgaagctctggcggcggtggatatcgtctcccacggcaagaaccatccgttcaagcccgacgccacctaccataccatgagcagcgtgccctgcacgtccacttcgtccaccgtgcccatctcccacccagctgcgctcacctcacaccctcaccacgccgtgcaccagggcctcgaaggcgacctgctggagcacatctcgcccacgctgagtgtgagcggcctgggcgctccggaacactcggtgatgcccgcacagatccatccacaccacctgggcgccatgggccacctgcaccaggccatgggcatgagtcacccgcacaccgtggcccctcatagcgccatgcctgcatgcctcagcgacgtggagtcagacccgcgcgagctggaagccttcgccgagcgcttcaagcagcggcgcatcaagctgggggtgacccaggcggacgtgggcgcggctctggctaatc

SEQ ID NO: 29981 - DNA, 51 bp, Homo sapiens
  misc_feature 1..51: note = chr5:145719886-145719937
  misc_feature 1..51: note = hyper
  source 1..51: mol_type = genomic DNA
ttcatctgagaagatcgcggccatcgctgagaaactggaccttaaaaagaa

SEQ ID NO: 29982 - DNA, 280 bp, Homo sapiens; identical to SEQ ID NO: 2659
  misc_feature 1..280: note = chr5:145720018-145720298
  misc_feature 1..280: note = hyper
  source 1..280: mol_type = genomic DNA

SEQ ID NO: 29983 - DNA, 30 bp, Homo sapiens
  misc_feature 1..30: note = chr5:145720837-145720867
  misc_feature 1..30: note = hyper
  source 1..30: mol_type = genomic DNA
tctctgaccccagctcgctgctcttgccag

SEQ ID NO: 29984 - DNA, 161 bp, Homo sapiens
  misc_feature 1..161: note = chr5:145722306-145722467
  misc_feature 1..161: note = hyper
  source 1..161: mol_type = genomic DNA
cacctccctctccatcgggtgtcctttaataataaatgcccttatgccattacattatattgtgggttttgaaaatttaaaatacggctgatgcaatattaattgcctatagtggtataaaacacagggcaggagcccagccgggctgcagaggagacaac

SEQ ID NO: 29985 - DNA, 467 bp, Homo sapiens; identical to SEQ ID NO: 491
  misc_feature 1..467: note = chr5:145722560-145723027
  misc_feature 1..467: note = hyper
  source 1..467: mol_type = genomic DNA

SEQ ID NO: 29986 - DNA, 169 bp, Homo sapiens
  misc_feature 1..169: note = chr5:145723301-145723470
  misc_feature 1..169: note = hyper
  source 1..169: mol_type = genomic DNA
catggaaacctgcatcgggcctccggagggtgggactttgagaactacctggctggaacaggggcttcatctagaatgagctaggcatacacattccagcatgactaaagccctggtaggcagaacttggtggcaggagtcctgggctcctgaacggtgttatctctgg

SEQ ID NO: 29987 - DNA, 228 bp, Homo sapiens
  misc_feature 1..228: note = chr5:145724336-145724564
  misc_feature 1..228: note = hyper
  source 1..228: mol_type = genomic DNA
gctttgcacactgtgcgtcccagctacgcaaggaacgaagtattctctccctgggagtgcctggtgcgaatacatagctcccactgagaagcttggccccggtcagcggctccaggagcccggaacctcctccctggcggaatcccgggcaccattcagccttttcgaaggctccagacttcgcgctgctcctcctcccgaggaggggcggggcgccagagggcaaag

SEQ ID NO: 29988 - DNA, 45 bp, Homo sapiens
  misc_feature 1..45: note = chr5:145724793-145724838
  misc_feature 1..45: note = hyper
  source 1..45: mol_type = genomic DNA
gctcttctccaatcacgttatcacaccgcccgttttatttctttc

SEQ ID NO: 29989 - DNA, 234 bp, Homo sapiens
  misc_feature 1..234: note = chr5:145725693-145725927
  misc_feature 1..234: note = hyper
  source 1..234: mol_type = genomic DNA
cgcgactcccagggctccccggctgggtcagggttcgcccgctcctcccggcgcctccggataggggcttcccttcggctgcgtcccggcctgaggagtcccctggaccgcgggaggggcgattgccgggtccgcgcggctcagaatcctccccacgcgttgcttatacctttctttgtaaactgtcagatttctgccccctccctcagttcagccctgcgcagccttgcctgc

SEQ ID NO: 29990 - DNA, 30 bp, Homo sapiens
  misc_feature 1..30: note = chr5:146256927-146256957
  misc_feature 1..30: note = hyper
  source 1..30: mol_type = genomic DNA
ttttaaaggccccaccgatcgcgttgctca

SEQ ID NO: 29991 - DNA, 35 bp, Homo sapiens
  misc_feature 1..35: note = chr5:146257159-146257194
  misc_feature 1..35: note = hyper
  source 1..35: mol_type = genomic DNA
tgagagacataacatcgtttcgctcagggaggggg

SEQ ID NO: 29992 - DNA, 36 bp, Homo sapiens
  misc_feature 1..36: note = chr5:146257448-146257484
  misc_feature 1..36: note = hyper
  source 1..36: mol_type = genomic DNA
cccagccctagggcccggaggagtctccgccactac

SEQ ID NO: 29993 - DNA, 915 bp, Homo sapiens
  misc_feature 1..915: note = chr5:146257485-146258400
  misc_feature 1..915: note = hyper
  source 1..915: mol_type = genomic DNA
cgcccagctgcccaggaagcacagtgatccgcaacttgcgcccggccccaacggcggaatgcggcggggctggcgttaccttcggtcgcatagctgtggtcgcgcaggaaactgttgttgattttgcgggtatcaatgtcctcctccattgacagcaggcttacttgcgtgggaaccagaagccggcagacaagtatccatgatccctccccgcagccagtctcacaggagaggggggcaggggagccagtgggactgcaccatggtccgagcctgaggaggagacggggaggcggagagaaaaaaaataaaaacccggcaatggagctgtcacctcctccactcgggttctgcgaggctgcggcggctcctcccgcgcggtgcgctcactccagctccagttcccagcgaggatgctgcgcctgcctccgctgcctccgggtgccaagatacgccgtgccccgaggggtctggtcccgcccgcccgccccggaggcgctcacaagcgggtctggggagatgcccaacaggttcccctccttggcagccgctccaaaatgcaaaaaagatccctcctccccctgggagagcgggcagccgcgacaaaatggtgcctttctggacccgagctgcagtggcgagatggcagggacaggattcaggcttgcctggccggaatgagggtgctggtcccacgggagggcggctccggcaggcgggggtagggaagctggcggggagctgggcagggcgctgcagccggcgccagcgcactcaccctcacacccacacgcgcgcactcgcagctgctgctgctgctgctgctgctgctgctgcaggaggctggaggcggctggtgcattaaaggcgaggctcctcccaaccgcgtcagcagccccacgactctttcccagc

SEQ ID NO: 29994 - DNA, 35 bp, Homo sapiens
  misc_feature 1..35: note = chr5:146614297-146614332
  misc_feature 1..35: note = hyper
  source 1..35: mol_type = genomic DNA
cggacccggcccaagcgcggcgggacctccatccg

SEQ ID NO: 29995 - DNA, 35 bp, Homo sapiens
  misc_feature 1..35: note = chr5:146614703-146614738
  misc_feature 1..35: note = hyper
  source 1..35: mol_type = genomic DNA
cctggatgaaagcatcgctccgagcctcatgggag

SEQ ID NO: 29996 - DNA, 36 bp, Homo sapiens
  misc_feature 1..36: note = chr5:146832654-146832690
  misc_feature 1..36: note = hyper
  source 1..36: mol_type = genomic DNA
gagctgggagaggggcgcggtcgggctgccaagtac

SEQ ID NO: 29997 - DNA, 362 bp, Homo sapiens
  misc_feature 1..362: note = chr5:146888821-146889183
  misc_feature 1..362: note = hyper
  source 1..362: mol_type = genomic DNA
ccttccgcgcttgcacgaagatgctgcaagtggcgacacgcgcgaatccagggtctgggctaggaagtcgcgctacgctcagtggaggatgaccctttcctcctccttgtcccccagccccgtgcaaagtgagctggagaaagttgtgcccgggccatggcggccagggctggagaaaggaacgaaggcaaggagggaagtgacccggggcccccttaccttgtccttggggccgaggttctgcaacacctctttgccggtggcgctccggatctctaccccggcgggggcgggggaggcgggcgcgggctccctgctctcttcccggccttggcccctgcgcggggtgtccccctcgatcc

SEQ ID NO: 29998 - DNA, 207 bp, Homo sapiens; identical to SEQ ID NO: 8108
  misc_feature 1..207: note = chr5:146889331-146889538
  misc_feature 1..207: note = hyper
  source 1..207: mol_type = genomic DNA

SEQ ID NO: 29999 - DNA, 275 bp, Homo sapiens
  misc_feature 1..275: note = chr5:146889539-146889814
  misc_feature 1..275: note = hyper
  source 1..275: mol_type = genomic DNA
ccagaggcggcagtgctgctccgattcctgcttgtccctagcgagccagcgagccacacagccagctagcgcgcggagcaggggcccagagtagcgccgcgcttggctcactcgctggacctctcgcccggccgcacctcctcacgcacccccaaccctaacgtggcctcccgggctgacgcagcgtcggtgcccatcacaatcacaaaccaaacttggcgcgcgcgcacacgcacacacaggcgcacactgcccgctcgcgcaacagccttgcc

SEQ ID NO: 30000 - DNA, 38 bp, Homo sapiens
  misc_feature 1..38: note = chr5:148033734-148033772
  misc_feature 1..38: note = hyper
  source 1..38: mol_type = genomic DNA
ctgcgccctccctgccgccccctcgggtgcgggctcca

SEQ ID NO: 30001 - DNA, 160 bp, Homo sapiens; identical to SEQ ID NO: 8110
  misc_feature 1..160: note = chr5:148206272-148206432
  misc_feature 1..160: note = hyper
  source 1..160: mol_type = genomic DNA

SEQ ID NO: 30002 - DNA, 272 bp, Homo sapiens
  misc_feature 1..272: note = chr5:148521059-148521331
  misc_feature 1..272: note = hyper
  source 1..272: mol_type = genomic DNA
cctgcgctgccaacccgcgagcccgcatcatggatgtcgagctcccctatttcgcattgctagccctggaattcgagaccccagacgaggaccaggattcatgaaatcagtcgcaggggccggggcaggggcctctggctcccgacactggccgagaggtgggttccggggcgggtcgctgctccttgaagccgggcggggacgcgctgcccccgccctgcctccctgtggtccacaccccctttgggctccggagccgctgggcaggaata

SEQ ID NO: 30003 - DNA, 184 bp, Homo sapiens
  misc_feature 1..184: note = chr5:148651223-148651407
  misc_feature 1..184: note = hyper
  source 1..184: mol_type = genomic DNA
aagcccaagtgggagcgccgcggagggcgagcgagcggcagggcgcggcggggcgtgtgcggcaccacgggacagcgggctgcggcccagggggcgaggcgtgctcgggtctattccgggagcggctctgaggggcgggcgcgggcgcgggcggggcgggggctgccggcgagcatcctgtctg

SEQ ID NO: 30004 - DNA, 484 bp, Homo sapiens
  misc_feature 1..484: note = chr5:148651703-148652187
  misc_feature 1..484: note = hyper
  source 1..484: mol_type = genomic DNA
ggtgccttcggctgccgggacaacccggtgcgtgtcaacgcccgtgtcctggggccaactcgcctctcgtgtgtgaaatcagagttttcataggctaacgatttgtaacttcataaaagatccccctctagtttccggaggacagcgagctcctcccacctcattccactctaaaggggaaaacaaggtgtacaggttcaactcccgaaacacccgctgtgggcagcccctagggagaagctctaggggaccgaagtttgcagctgcctagggcattgcgagaaggaggagcgccgtgagcaggcgcgcgtgtgcatgcatgtgtgcgccagggagggaggaggcgggggtggttctatcccgcaccagctgtgtcctcggcccagcccttctctctggaccagcgacaaagttggactagatggtctccaaggcaccttgccgacccttttccagtgtatttggtagacgtttcacagaagtg

SEQ ID NO: 30005 - DNA, 22 bp, Homo sapiens
  misc_feature 1..22: note = chr5:149546581-149546603
  misc_feature 1..22: note = hyper
  source 1..22: mol_type = genomic DNA
actctcacgtggagccggcccc

SEQ ID NO: 30006 - DNA, 363 bp, Homo sapiens
  misc_feature 1..363: note = chr5:149569485-149569848
  misc_feature 1..363: note = hyper
  source 1..363: mol_type = genomic DNA
ccagagagggcaggtcgcttgcccaaggtcacgcagaaagccgagggtttccgtcgcgaacccccctccccactcgctcagggctctccaatccgcagctctgcgtgcgggggcgcgcgcatccccccgccgtccgtccgtcagctgtctgtctgggtgtctatgcgggcgcagcagtgcacccttccccagcctcgggcgctgcgcagggacagacaaggcattcgcagcgccctgcccgcgctccacgcccgcagccgccagacggcagcgcctgcgtccgtgcccgccccagccggtgcgcgggagccgcgggggcaaaggcgcagtggccagcggaccatctctcgtgccctcgctctc

SEQ ID NO: 30007 - DNA, 135 bp, Homo sapiens
  misc_feature 1..135: note = chr5:149682031-149682166
  misc_feature 1..135: note = hyper
  source 1..135: mol_type = genomic DNA
tgcgagggagttcagcgccccccggggacggtccagtgtctggtccgggactggctgccggacggctgggccggatctgctcggccgcagcggggcgctctggggaggtcaggcccgcgccgagctgcctcccgc

SEQ ID NO: 30008 - DNA, 734 bp, Homo sapiens
  misc_feature 1..734: note = chr5:150051058-150051792
  misc_feature 1..734: note = hyper
  source 1..734: mol_type = genomic DNA
attcttgcctccccccgacctttttttttggtggagggagaaccctggtcccctgccccgctgagcttctctgcggtttattctaccccctcgttcccagatgctggccggaagcgccaggaggaaggtgactggaacagcggagtcggggacggtgagcgtggaggggagctccctggaagggaagctgggggaaggggagcgcggctgggggcgggaggtcgtcggtggcctctgagaacccgcccctgtgcccaggttgccaatgccaatggccctgaggggccgaactaccgctcggagctccacatcttcccggcctcacccggggcctcactcgggggtcccgagggcgcccaccctgcagccgcccctgctgggtgcgtccccagccccagcgccctggcgccaggtgagtggcctcctcgggtcccgggaccagggctggggggcctgaagcatgggtgtgctccccatggggcaggaagagcacccagaaggctagtccgcccccttccccaacacacacgcgcacgcgcgcactcccctcgccagaccacgagccggaggggcgccgcgccccaggtcacacagcgagtcagccaaggccaagaccaacccgcgctgcgaactcgtggcttcctcactgcagtcctccgtgtttcctgggatggggaggggtctcctgtgctggagcaactgtggcttcccattcccgccgtcctctcccctaa

SEQ ID NO: 30009 - DNA, 30 bp, Homo sapiens
  misc_feature 1..30: note = chr5:150052081-150052111
  misc_feature 1..30: note = hyper
  source 1..30: mol_type = genomic DNA
gcccgggggacagaccgggaggggcgggaa

SEQ ID NO: 30010 - DNA, 487 bp, Homo sapiens
  misc_feature 1..487: note = chr5:150399922-150400409
  misc_feature 1..487: note = hyper
  source 1..487: mol_type = genomic DNA
aaaagaggaagggaccgcctcccacgtccacagggacctgacttccacctctctgcccagatttgcttatgtcactgtcgccccgggacggggaggtggggagctgagggcaagtcgcgcccgcccctgaaatcccagccgcctagcgattggctgcaagggtctcggcttggccgcggattggtcacacccgagggcttgaaaggtggctgggagcgccggacacctcagacggacggtggccagggatcaggcagcggctcaggcgaccctgagtgtgcccccaccccgccatggcccggctgctgcaggcgtcctgcctgctttccctgctcctggccggcttcgtctcgcagagccggggacaagagaagtcgaaggtgagtgagcctccgggccgggggccgggagaaaaaacctagcccctcggtgtccagcgctcagtgcaatgcaccccttttcccaggctccccgccagatgggcaat

SEQ ID NO: 30011 - DNA, 200 bp, Homo sapiens
  misc_feature 1..200: note = chr5:151066300-151066500
  misc_feature 1..200: note = hyper
  source 1..200: mol_type = genomic DNA
agccgggaggagaggcgcatcctcagcagagcttccctcccttgcacacgagctgacggcgtgaacgggggtgtcggggttggtgcaactatagaagggaaaggctgggcgggggtcacacatacctcagtggcaggcaggcaggcggcaggcagagcgcgctctccgggcagtctgaaggaccgcgggaatgtggaggg

SEQ ID NO: 30012 - DNA, 415 bp, Homo sapiens; identical to SEQ ID NO: 8117
  misc_feature 1..415: note = chr5:151304224-151304639
  misc_feature 1..415: note = hyper
  source 1..415: mol_type = genomic DNA

SEQ ID NO: 30013 - DNA, 33 bp, Homo sapiens; identical to SEQ ID NO: 8118
  misc_feature 1..33: note = chr5:151304708-151304741
  misc_feature 1..33: note = hyper
  source 1..33: mol_type = genomic DNA

SEQ ID NO: 30014 - DNA, 126 bp, Homo sapiens
  misc_feature 1..126: note = chr5:152870193-152870319
  misc_feature 1..126: note = hyper
  source 1..126: mol_type = genomic DNA
cagctagcatgaggacgggcttcttttcccgtgctcagttaatctggctgtcagttggtgttaacgctgcagtttaagtgttcggattccaagggaaacagacaaacctcacgaaaggaaggaagc

SEQ ID NO: 30015 - DNA, 879 bp, Homo sapiens
  misc_feature 1..879: note = chr5:153852425-153853304
  misc_feature 1..879: note = hyper
  source 1..879: mol_type = genomic DNA
gcttttccagctgtgcggtgggagctggggatgtggcgtgggcgtgggaggccgctggagtcaggcgtggggagagtgggggactatccagtgaccctctcaatgggcgccggctccgtctcggctcccgggttcagggactgcacgtttctgagaccgagtttagggctccaaggctctcttcccaaagagggtttggggccagcaggattgggttttctgaagaggcctggttatgccagacttggctttggcggccgctggcgggtctccctcagcaccccctcttctttccccggctataagaaagctagaccagggtgcgcattcttcccgtgcctaggatacttcacggtgctaaaaatagtcctgggagctgggacctgtgtatagccagaggtttgtgtgtgagcgaagttggagtcctgggttcgaatctagataagcttccctccgtgctgtggggcttagatcacctccctccctgagtctgtttctccatgcgcgccggaatttctaaacggactcccagaaagaaacggaaagaaagaaggtaaagaaaagaaaaacaaaacaacaagaaagaaactttgatttttctctctgctcctccccaagggccctggggcctcgggccgggtactgaggccgaggaaggggtgcgtcggacaggctcattaccgccaagtgttgccctagttaaatcgcgggcctgtttgatctggcggcgggtggcgagagggaaaaaagaaaaaagtaggggggcgagagtagagagagaagctcacacctcccccactgtttcctagcgcccataaaacaccttttattaactccttcgcgtccggaaaggcccgcgtggcctctcggcccctgcta

SEQ ID NO: 30016 - DNA, 133 bp, Homo sapiens; identical to SEQ ID NO: 2667
  misc_feature 1..133: note = chr5:153853386-153853519
  misc_feature 1..133: note = hyper
  source 1..133: mol_type = genomic DNA

SEQ ID NO: 30017 - DNA, 232 bp, Homo sapiens
  misc_feature 1..232: note = chr5:153855179-153855411
  misc_feature 1..232: note = hyper
  source 1..232: mol_type = genomic DNA
aggacattgcacgtgcgatccaagtgtgtggttgcagccgacgacctgccggcgctcagcagaagctccgcgggatgcgtagcaccagtcgccggagcccagagcctggcgttcgccgctgccttcctctcctcccggggcttcaggagtggctggcctggccaggtcctcggcgcgggcctcggctcactggtttaactccagcgcccagacttgctgcggccagccggtg

SEQ ID NO: 30018 - DNA, 270 bp, Homo sapiens
  misc_feature 1..270: note = chr5:153855657-153855927
  misc_feature 1..270: note = hyper
  source 1..270: mol_type = genomic DNA
cgcggagttcctgggacccgggatgggctgggcagcttcgggaggtttggtaaggaaaatgttctgcgtctggtgaaactgacgcgcgttgatttggctttaggacacctaagggagatcccaggatattggaagggaggggtggaaatccacggttctcccgctctcgctgcaccccacacacttccgccagcctcccaacctggtttaaacatcagggcttggatgcaggcttggggccccctaagccggagctgggagcctcagata

SEQ ID NO: 30019 - DNA, 512 bp, Homo sapiens
  misc_feature 1..512: note = chr5:153856148-153856660
  misc_feature 1..512: note = hyper
  source 1..512: mol_type = genomic DNA
cgtccctggatgagctttcgtcagtttaccacaggcccccgcaggttggataaaccaggtggggcgcttcagctggctccactccgctacggccttaagccccccaacctagagaaactgattggccagcctgaaaacccagcgctcagaagcccccagccccggacagccagaccgagtgccaggaagtgtcaccctaaccggagaggatcaagaaggccaagacgagactgcgctctccaaagctaaaagaagtggctcttatttacatgcaaagccactgaagtcgtcctcagaaccagtccatggggagaaccagaactggccctggactgagtagaagacccgatctgttttacctcacctccaccctggactcctcagataggtgcttttcctgccccgacccactctgggccctcagtttccctatttatacaatgatggaagtagactagccggtccagcaaaggccctttgaaaacaggaaccgagcccgggcacataaattc

SEQ ID NO: 30020 - DNA, 336 bp, Homo sapiens
  misc_feature 1..336: note = chr5:153856862-153857198
  misc_feature 1..336: note = hyper
  source 1..336: mol_type = genomic DNA
ctccatgcacaggatcgcacgctgtgaccaaccatctcagaactcttcccaacctttccaaatcggacacaggacaacacagcctccttcgactacctgcatggcctgaggctgctcaccgctcctgcacccttggctggagcatgcaagccccaggactcaccagctcccttttccgcttgctctcacggccgccatccgccttcttgagttcagccttgaaggcctcgggatcgccagactgtgcatccttggccagcacgtccatcaggtaggcgatgtagctggtggctaggcgcagagtcttgatcttggagagcttggtgtcggccggca

SEQ ID NO: 30021 - DNA, 597 bp, Homo sapiens
  misc_feature 1..597: note = chr5:153857284-153857881
  misc_feature 1..597: note = hyper
  source 1..597: mol_type = genomic DNA
cgccggccaagacggccgccaagcgcctccagccgcccggggctctgcccaggcctggcgtcaggaccataggcggtggcggctgcagcggccgcgggcggcggcccgcccgcagggaagtccggggcagcgtcagccgggctcagcagccagctctggaagtagggcctttcctgatgacagcgcgaggccggaccgaagaggaagggttcgtggagcatggggtgcgcagggtgcgggtggtgatggtggtgatggtgtgcgtagctgcccacgaggttcatgttggagcggctactggcctgcgccgccagccctattaacgccgctccatgcgccccagagactgccgggggccacctgtgggctctggagccactactgggcgccggctttgggagagtccgggcaaggctgaaaatgagacgcgcagcccactgtcttcttaccggtttctgccgcgggcgaggtcgccgaagcccaaagacctgtttaacccttctgcggactcccctgcggatctggcttatataagaccgcggctttgatgtcaacctctcccgggagccaatggcaggggggcggggataaggaaaa

SEQ ID NO: 30022 - DNA, 576 bp, Homo sapiens
  misc_feature 1..576: note = chr5:153858319-153858895
  misc_feature 1..576: note = hyper
  source 1..576: mol_type = genomic DNA
gaagacaggataggccgctaacgttcttccctaacaccttccagccctccgcccccacccccaccccttagtcatcggccctttctggagagactgggagccgcttgtgcacggggtcgttaccagcccgccaattctgacccagcctcaggcagacgggcacgcagctactgaccagcgaagaagcctttcggaggcaggggtaggggtggggcgggaaggaggaggcggactccaggcccacgggcatcgacgggtttgttcccggcttgagggtctgagatccactccggcctcccgggtgcctgatccattccgaaggccagcccggctggcgcagagacagtctggcgtccgccttgggcccggggcatctggccagcaggtctcctctggtctgtccgcaggactcgcaccgagacctgggagcgcggctacgtcgggccgctctacccagatcatcactccttaagaatctttggttctttaaagacaccggccccgaagctcacacctcgagacaccagcattcggcgttagacacacgcagaggggaccaagactgcacagcatccg

SEQ ID NO: 30023 - DNA, 22 bp, Homo sapiens
  misc_feature 1..22: note = chr5:153858916-153858938
  misc_feature 1..22: note = hyper
  source 1..22: mol_type = genomic DNA
cgacgtccggcatctctcacgc

SEQ ID NO: 30024 - DNA, 328 bp, Homo sapiens
  misc_feature 1..328: note = chr5:153859386-153859714
  misc_feature 1..328: note = hyper
  source 1..328: mol_type = genomic DNA
tgaacagatatggaacgtgaagcccagagaagaagagcgattttctcgaggtccggtagggagtggatgagtggaattccactcctggacaagagagtgaatgaagggtggggggttacatacaggagtgacggagacaaaagcctgggcctgctggttccacctgtgggagctcagcagggctgtgggccctggaggtgcatgggggggtggtgcagggaggtcctggtttcctgcccgaggcgggctggaaaccccccgctctccccggcgcctggcgccagcagcgctggggtagggcagagcgcggagccggaggcacgcgggg

SEQ ID NO: 30025 - DNA, 143 bp, Homo sapiens; identical to SEQ ID NO: 8132
  misc_feature 1..143: note = chr5:153862037-153862180
  misc_feature 1..143: note = hyper
  source 1..143: mol_type = genomic DNA

SEQ ID NO: 30026 - DNA, 246 bp, Homo sapiens; identical to SEQ ID NO: 8133
  misc_feature 1..246: note = chr5:153862218-153862464
  misc_feature 1..246: note = hyper
  source 1..246: mol_type = genomic DNA

SEQ ID NO: 30027 - DNA, 44 bp, Homo sapiens
  misc_feature 1..44: note = chr5:153863373-153863417
  misc_feature 1..44: note = hyper
  source 1..44: mol_type = genomic DNA
cctctgtgtattttccgcacagagagatgtctgcttcgggacgc

SEQ ID NO: 30028 - DNA, 33 bp, Homo sapiens
  misc_feature 1..33: note = chr5:153863418-153863451
  misc_feature 1..33: note = hyper
  source 1..33: mol_type = genomic DNA
ttcaacctaaacagaacccggtctgattggaaa

SEQ ID NO: 30029 - DNA, 30 bp, Homo sapiens
  misc_feature 1..30: note = chr5:153863972-153864002
  misc_feature 1..30: note = hyper
  source 1..30: mol_type = genomic DNA
ctcggctcattgtcacgaaggtcattctca

SEQ ID NO: 30030 - DNA, 304 bp, Homo sapiens
  misc_feature 1..304: note = chr5:153990970-153991274
  misc_feature 1..304: note = hyper
  source 1..304: mol_type = genomic DNA
gacgggccacacacccgcgtgtacacacagtccgagaacgcacacacgtacacacacacatgcgcaaggcacggcctggccttcaggcacagagagcccatccggtttcccactcagctcccacaacttcccccacactttggtactaagggctcagctgggtccttttgaagccaccaagggagggagttgggaagggccccagtgacaaacagtggggagcaagaattttacgaacttaagggctgtaaatttcggccagcaaatccccgcccctgtccgtccgccccgccttccttctcac

SEQ ID NO: 30031 - DNA, 491 bp, Homo sapiens
  misc_feature 1..491: note = chr5:155107388-155107879
  misc_feature 1..491: note = hyper
  source 1..491: mol_type = genomic DNA
gccggaacaagctctcgctgggaatccgcacactccttctcccggtgtttcttaacccctttcttctcccgggagtggagagggggctcaaggatactagaaacctgtccccttggcggagacacgtagtcgcctctggccgccgcggccgactgatcttgcggagtggagctccccccaccccgcccgcgtttcgctggggctccctccgctctgcaaagggagcggggagctgggggagccttgcacaccagtcttcctggagctgcagacgaggagccccgcgccttcgggagcctctcggcggcttcccctctaacgcgcgactgtgcagcctctccccgccgcccccacccgcggctcgccctcgctccctccctccagccccgccagccggagcgcgcacaccgggactccggcacgtgggcgcgcgggaggtggcggccgctgctgccgctgctgccgctgccggagcccgaacccaagcccca

SEQ ID NO: 30032 - DNA, 96 bp, Homo sapiens
  misc_feature 1..96: note = chr5:155108172-155108268
  misc_feature 1..96: note = hyper
  source 1..96: mol_type = genomic DNA
gaggctttccgcagccgcttggccggcgccggcccctattccgttggcaagtcccttgtctatcccggagggcgcacccggacgctcgagccggag

SEQ ID NO: 30033 - DNA, 494 bp, Homo sapiens
  misc_feature 1..494: note = chr5:155108355-155108849
  misc_feature 1..494: note = hyper
  source 1..494: mol_type = genomic DNA
cgatgcgcccccacccgggcggcgcgccctctgccaactcgccacccatgggatcgactgccctcagctgcccggcttggagtgcgtagccttcgccgcgtggcccaggagaggagcgagacaccaaggcgtttcgcggactccgcgcgcaccagtcggcttggtggccctgcgggatagcgtttatacccaggggtgagtaggccgctaatggaggccccctttacccccagctagcggcttgcatggacggcaaagagacgggagaaagttgggtctccttgcgcttaatctggcattggcagaggaatgcaacactgtttcctccaactcgattgccgcgggggtttccccagttccctccatctctaagccaaggagggagtccccttccgcttcctaaggagaaaaggggctccctagagcagatcgctgacttcctcaccaacgtgccatttggggcttttcagccgcccgcgcgttaagctagctcc

SEQ ID NO: 30034 - DNA, 255 bp, Homo sapiens
  misc_feature 1..255: note = chr5:155109192-155109447
  misc_feature 1..255: note = hyper
  source 1..255: mol_type = genomic DNA
catcctgtggctaggcgcgggggaggggaacggctccctccccgagccccgggctgcctctgctgcttctaggggtgcatctgaacatggataaggaaatgcgctccctgctctcaggccctatttggggtgagtgtgtgaggcatccaaatgcctcctgtcggaaaacagcggcctcattgtgtgcccgattgaggtttcaacttgcaggcaactgagaggccattcagctgggcagcacggagttggctggtc

SEQ ID NO: 30035 - DNA, 455 bp, Homo sapiens
  misc_feature 1..455: note = chr5:156887049-156887504
  misc_feature 1..455: note = hyper
  source 1..455: mol_type = genomic DNA
ctgggagcctggcagcgtcctcaccccaggaaggcatgcgcccctctgcgggcggccccagccctgggccccctgcccccggaattgcccaagatgccgggtgactcctccccggggactctcccactctgggacgcgtcactctccccacccctgggtccggaccccggcggcttctcgcgcgcgagccacgcgggggacaagtcgcggccacctgctccggagctggggagcccgggcgccgtccgcccgcgcgtcggttcgtgtgccccgggccccatggagctgcgggtcagcaacaccagctgcgagaacggtgcgtacggcagggctggggaccaggcgggctccgcgcttcgcgccctcccctccttgccaccgctctccctcgcatcctctcctcccaggggggccaaagctggggaggggcagggccagcacgaggtggctcccac

SEQ ID NO: 30036 - DNA, 45 bp, Homo sapiens; identical to SEQ ID NO: 8142
  misc_feature 1..45: note = chr5:157001813-157001858
  misc_feature 1..45: note = hyper
  source 1..45: mol_type = genomic DNA

SEQ ID NO: 30037 - DNA, 30 bp, Homo sapiens
  misc_feature 1..30: note = chr5:157002174-157002204
  misc_feature 1..30: note = hyper
  source 1..30: mol_type = genomic DNA
cgctcccaggccacacgggcagggcgctcg

SEQ ID NO: 30038 - DNA, 332 bp, Homo sapiens
  misc_feature 1..332: note = chr5:157002447-157002779
  misc_feature 1..332: note = hyper
  source 1..332: mol_type = genomic DNA
cgtgggaacaaagcccgggctcccaggctggggacggcgggggcgcaggccccgcggagttgcgggaggcgcaggggtcgcggtcccagcgctccggacccgcaaggctactcccaggtctccgggccacccagcctccatccccccgcgcctggccacttacttgtccatccaggctcccgcgccgcccgcggccggaggggctgcagggcaaacgccagcaagcagagccgggcggcgcctgcgccccctggcatggtggcggcggcccttagcgctcggcgctcacacgccctcagccatacctgcccactgcccggcggtggaggcgc

SEQ ID NO: 30039 - DNA, 439 bp, Homo sapiens
  misc_feature 1..439: note = chr5:157098271-157098710
  misc_feature 1..439: note = hyper
  source 1..439: mol_type = genomic DNA
gccccgccagcaggccggggtcactgcagtccccacgtcgaagcggaaaaggtctgctcagctcaccgcaccccacttcttccagacccgtccgtcttcacagcaacgcgccgggtctcaccacggcggatgccgagggacaatattaccgcgtccgtggccgccggactctgcacgcatgtccaacagcccccgtccccttccccgcagccaatatgtgtctcccaggcaacgcgccgcgctcggttcagggctccgcccagggactcactccgcgtcagcgcgcgcccacctaggtgggctggcaaccagccaccagtttccaactctttctccaacagggaagccgcaatgacacagccgactaggccctcggtcacctgtgaccagggatcctccacgatcggcgggaccgccgcccaggcgaccaccagttcca

SEQ ID NO: 30040 - DNA, 25 bp, Homo sapiens
  misc_feature 1..25: note = chr5:158478441-158478466
  misc_feature 1..25: note = hyper
  source 1..25: mol_type = genomic DNA
cccacccccccaccccgccgcccgg

SEQ ID NO: 30041 - DNA, 303 bp, Homo sapiens
  misc_feature 1..303: note = chr5:158478512-158478815
  misc_feature 1..303: note = hyper
  source 1..303: mol_type = genomic DNA
cgctggcgacaaactggagccggggcctttccgcttaggaggaactcgctacgtgtcgctaacaacaacacaaacaccgccggcccggctcggtgctccgctgcccacagtgcgctcggcaccagggctggatttatagcaaggagccccgactgtaagaagtaattcatgagtccccacaatgccactactgagaggcattcagaagggggggcaagacacggggtgttcctgctccgtggcctccatcccagccgatcccgctttgcagttgtgcacaatcacaatcgcagccagcagttt

SEQ ID NO: 30042 - DNA, 36 bp, Homo sapiens
  misc_feature 1..36: note = chr5:158524686-158524722
  misc_feature 1..36: note = hyper
  source 1..36: mol_type = genomic DNA
atgtggagaagggtccgagggcggggctcagaactg

SEQ ID NO: 30043 - DNA, 289 bp, Homo sapiens
  misc_feature 1..289: note = chr5:158526129-158526418
  misc_feature 1..289: note = hyper
  source 1..289: mol_type = genomic DNA
aaagcgtgggctcctcgcagacagctccaggtcctccggccgcaggcgacgaaggcagagcggctggagagcgcggagccccggcggagagcggagcgcagcggctgcggactcaccccgccgcccggccccgcggcagcagctgccgctgccgctgccgcctccgcctcccggctctcccgctcgcggctcacctcggccgcggtccccgcgcagtacccacctctgcgccgccgtgttggcgtccagcaccccggcgccctgcatccacgtccgcaccgcgttcatg

SEQ ID NO: 30044 - DNA, 406 bp, Homo sapiens
  misc_feature 1..406: note = chr5:158527411-158527817
  misc_feature 1..406: note = hyper
  source 1..406: mol_type = genomic DNA
ataacgtcatctttccgcccaccgcagccaatcgcggcccgggagccggctcgctggcggcgccaggccacgctctctcattaacatcccgctcccggtggcgcaggggagccggccaaagttcctcgcaaagtggcgagcgaaggagcgctgagcactgacgtctgggctggggaggagcgggtccgagcgaggacggagaggggacagagggaaagggaggcgggtgtcttcctcaggaatttgagctggggatctgcatcctggccattgcagtcctttagcatcctcgccgcgccctgagcgcgctggaggctcgcaggctgcgccctcccagggctgatgccgcgtcctgctccgccgttctgggacgtcggggacaaaagtggaggagacgggagagccc

SEQ ID NO: 30045 - DNA, 296 bp, Homo sapiens
  misc_feature 1..296: note = chr5:158527818-158528114
  misc_feature 1..296: note = hyper
  source 1..296: mol_type = genomic DNA
ggcagaaaaagcaggacgcgcgtcccaggtgcccacctcttcgctttgaggcgggggcggtgggatggaatatgggtgcgcgaggtcggggctggtaactctcggaggggcacggcctccacgctgggagggatgaatggacgctgggccccggcaaatgaggcgctgtgggtccccaggaagtggggtaccaggctctactcccaccccggcctctgaaacgcttctctctcggccgctagcctagaggctgccagggttgggcactgttctcactcacacgctcacctctctcg

SEQ ID NO: 30046 - DNA, 155 bp, Homo sapiens
  misc_feature 1..155: note = chr5:158533542-158533697
  misc_feature 1..155: note = hyper
  source 1..155: mol_type = genomic DNA
ggtctaggcagggtgcggaccgagggcccaagggcaggcgtgcagaccgctacgactttggctttagggagacgccttcggggcgcagggcccgcccgaagacgcgggttagcatacagctcagctccaggcaggcgatgcgggttcccaatgcg

SEQ ID NO: 30047 - DNA, 96 bp, Homo sapiens
  misc_feature 1..96: note = chr5:159200128-159200224
  misc_feature 1..96: note = hyper
  source 1..96: mol_type = genomic DNA
agcctgaatggctaacggtagagcaggtgactgaatgaggggtggacggacgcccagatgcctgcttcctggcttttctcccgctctgtcttcaca

SEQ ID NO: 30048 - DNA, 145 bp, Homo sapiens
  misc_feature 1..145: note = chr5:159343442-159343587
  misc_feature 1..145: note = hyper
  source 1..145: mol_type = genomic DNA
gcggagtcagggcgccgggctcccccgcctgatgtcaccgccgtgcagtcagcccagaagcggctcattgaaagcagaccctcttcggcgctcgctgggcggaggacgcgccgcggtccgcagacccgagcgagctgggcaccgc

SEQ ID NO: 30049 - DNA, 28 bp, Homo sapiens
  misc_feature 1..28: note = chr5:159399072-159399100
  misc_feature 1..28: note = hyper
  source 1..28: mol_type = genomic DNA
tcgcctgggcggctgcgcctacacctac

SEQ ID NO: 30050 - DNA, 188 bp, Homo sapiens
  misc_feature 1..188: note = chr5:159399509-159399697
  misc_feature 1..188: note = hyper
  source 1..188: mol_type = genomic DNA
cgcagctttctttccctggggaggaaaacatcgtgggggggaggggagggcggggcggaggggggaggggagcgtccacgccgggtagacgcgcgccccaaggggaaccggggggagggccggggagaggggcagctgcttttctggcaggggcatgggtgccaggtaccacgcggaaagccgggccg

SEQ ID NO: 30051 - DNA, 86 bp, Homo sapiens
  misc_feature 1..86: note = chr5:159615222-159615308
  misc_feature 1..86: note = hyper
  source 1..86: mol_type = genomic DNA
ccaggaatgccctcccggcctctcctcccgattccttatcagctacaagctcgagtttcctcagccacacgcgatcaaatgctgct

SEQ ID NO: 30052 - DNA, 30 bp, Homo sapiens
  misc_feature 1..30: note = chr5:159738710-159738740
  misc_feature 1..30: note = hyper
  source 1..30: mol_type = genomic DNA
tccgctcagacactccgggagaaggtaaag

SEQ ID NO: 30053 - DNA, 30 bp, Homo sapiens
  misc_feature 1..30: note = chr5:159739156-159739186
  misc_feature 1..30: note = hyper
  source 1..30: mol_type = genomic DNA
tcgccggacacggggcgatatggagctgtg

SEQ ID NO: 30054 - DNA, 61 bp, Homo sapiens
  misc_feature 1..61: note = chr5:159739813-159739874
  misc_feature 1..61: note = hyper
  source 1..61: mol_type = genomic DNA
ccgcggcgccacctgcgcgcaccacgcgtgaaacgtgcggacaggacgcccccagaaagtt

SEQ ID NO: 30055 - DNA, 336 bp, Homo sapiens
  misc_feature 1..336: note = chr5:160973454-160973790
  misc_feature 1..336: note = hyper
  source 1..336: mol_type = genomic DNA
aggaagcaggcatagcgttttcagcatcggatccctactacatttccctgctcacagaggtatgcagacagaacccttcaaagtgagaacggaaaagagaaacgctgggcacacttacctctgcgcacagacagcggcgattattaaggggaaggaccaaatcccaaagtagccccttttccgcactctccacatccctttagtttttgatggaattgagggtttcactgaagagaggagatccaacttagtctgcccagtgcagtaattctaatgtgaggcgcatgcgcacggcgtaccaaaacatcaaaggggaagcggcggctgccggggacc

SEQ ID NO: 30056 - DNA, 249 bp, Homo sapiens
  misc_feature 1..249: note = chr5:160974612-160974861
  misc_feature 1..249: note = hyper
  source 1..249: mol_type = genomic DNA
tgtctctccaggtttcggtctgattctgcagtgggaattattagtgggcagggtggggtttgcatgagggggagatgggacgtggaggcgtgagggatgcgggtgacgggcgccctagcgcaggtgcgggggactggagggcgtgggcgaccgcacagagcaggaagggcaggtggccgggtgggacgcgccccggccggtcccccagcgccccctccgctgcgcgcacccgcgcgcacacacgtgcag

SEQ ID NO: 30057 - DNA, 257 bp, Homo sapiens
  misc_feature 1..257: note = chr5:160975090-160975347
  misc_feature 1..257: note = hyper
  source 1..257: mol_type = genomic DNA
gtctccgcgccacctcgtcctcttcttcccttccccgcgcccaggggactcgcacacccagaggctgcctcttcccttcctcctgaagctcaggccgcctcgccgtggccgccgggacccggaggaggcagcaagcttggggtggggaaattgggggagggagatactcaattcacaaaagaagtcttccctccgctccagggaaagagaggagccacgggcggcgtgaggtgctacgagtctggggacacaaggcc

SEQ ID NO: 30058 - DNA, 100 bp, Homo sapiens; identical to SEQ ID NO: 8154
  misc_feature 1..100: note = chr5:160975348-160975448
  misc_feature 1..100: note = hyper
  source 1..100: mol_type = genomic DNA

SEQ ID NO: 30059 - DNA, 210 bp, Homo sapiens; identical to SEQ ID NO: 2672
  misc_feature 1..210: note = chr5:160975724-160975934
  misc_feature 1..210: note = hyper
  source 1..210: mol_type = genomic DNA

SEQ ID NO: 30060 - DNA, 15 bp, Homo sapiens
  misc_feature 1..15: note = chr5:160975955-160975970
  misc_feature 1..15: note = hyper
  source 1..15: mol_type = genomic DNA
cggaagtagctccac

SEQ ID NO: 30061 - DNA, 30 bp, Homo sapiens; identical to SEQ ID NO: 8157
  misc_feature 1..30: note = chr5:161274605-161274635
  misc_feature 1..30: note = hyper
  source 1..30: mol_type = genomic DNA

SEQ ID NO: 30062 - DNA, 110 bp, Homo sapiens
  misc_feature 1..110: note = chr5:161275376-161275486
  misc_feature 1..110: note = hyper
  source 1..110: mol_type = genomic DNA
tcccagacttttccccggtcttaagagatcctgtgtccagagggggccttaggtaagtgcgactttggaccacgatacacagacagagctttgaacgtggcttttcctag

SEQ ID NO: 30063 - DNA, 55 bp, Homo sapiens
  misc_feature 1..55: note = chr5:161275816-161275871
  misc_feature 1..55: note = hyper
  source 1..55: mol_type = genomic DNA
gttggggaggggcgtcgggggccatcatctaaagttaagacgctgggacggaaaa

SEQ ID NO: 30064 - DNA, 30 bp, Homo sapiens
  misc_feature 1..30: note = chr5:161495166-161495196
  misc_feature 1..30: note = hyper
  source 1..30: mol_type = genomic DNA
tggggaggggtaactcgggagaccacccag

SEQ ID NO: 30065 - DNA, 69 bp, Homo sapiens
  misc_feature 1..69: note = chr5:162931214-162931283
  misc_feature 1..69: note = hyper
  source 1..69: mol_type = genomic DNA
ccccggccctcttcccgccctcttctttgttgtcccctgattatgcttgtttagcgctggggcagtcct

SEQ ID NO: 30066 - DNA, 191 bp, Homo sapiens
  misc_feature 1..191: note = chr5:162931522-162931713
  misc_feature 1..191: note = hyper
  source 1..191: mol_type = genomic DNA
aaaaggtttaggagtcggggaaaggccctaggaaaatccagacagtggtcacgtttgtggacgacgtttagagcttgctatcctgggcacacaagaacccttggactgttcggtgcaaagttggcaaatcctacacggcctgtgccagggtttactttctgcatcaatttcacaggcgtccagcctggctg

SEQ ID NO: 30067 - DNA, 100 bp, Homo sapiens
  misc_feature 1..100: note = chr5:166405747-166405847
  misc_feature 1..100: note = hyper
  source 1..100: mol_type = genomic DNA
tgcacgtgtccctagcgcccctctttctcagccgtgagcccctccctggctgcgtaccccgcagccacagcagctgcagccccagcgccaccacccaacc

SEQ ID NO: 30068 - DNA, 42 bp, Homo sapiens
  misc_feature 1..42: note = chr5:166406152-166406194
  misc_feature 1..42: note = hyper
  source 1..42: mol_type = genomic DNA
cgtcctcctcctaatcgtttccgaagtagcagcagcagcacc

SEQ ID NO: 30069 - DNA, 222 bp, Homo sapiens
  misc_feature 1..222: note = chr5:166406254-166406476
  misc_feature 1..222: note = hyper
  source 1..222: mol_type = genomic DNA
atcgagctcagcggcacagcaggcagaactgtgcagaagcgagcaccgtttggggagtccggggggcgggtaagagggaggagggggaaagcctgtcttggtctttgggattattttttttccccttctttccctctctctctctttcttgagggtgtgtgttgccccctcgaagtgaaggaattttgctccaaagcgagctgggaccgaagactctaggct

SEQ ID NO: 30070 - DNA, 50 bp, Homo sapiens
  misc_feature 1..50: note = chr5:167001021-167001071
  misc_feature 1..50: note = hyper
  source 1..50: mol_type = genomic DNA
gctgaggcaggtaagcgccgatcggagggtttgaccgagtggcttagtta

SEQ ID NO: 30071 - DNA, 177 bp, Homo sapiens; identical to SEQ ID NO: 2674
  misc_feature 1..177: note = chr5:167956090-167956267
  misc_feature 1..177: note = hyper
  source 1..177: mol_type = genomic DNA

SEQ ID NO: 30072 - DNA, 65 bp, Homo sapiens
  misc_feature 1..65: note = chr5:167956413-167956478
  misc_feature 1..65: note = hyper
  source 1..65: mol_type = genomic DNA
cggacaaccgccgggacgaccacccagagccaccagagccccctgacacccgccccgaggcaccg

SEQ ID NO: 30073 - DNA, 129 bp, Homo sapiens
  misc_feature 1..129: note = chr5:167956694-167956823
  misc_feature 1..129: note = hyper
  source 1..129: mol_type = genomic DNA
gggccgggggcgcggcggcggcgacggcaaggatcgcggcggcggtggacagcggcggggcggcgtggccaagagcaagagccgccgcaggaagggcgccatggtggtgtcggtggagccgcaccggca

SEQ ID NO: 30074 - DNA, 136 bp, Homo sapiens
  misc_feature 1..136: note = chr5:167956844-167956980
  misc_feature 1..136: note = hyper
  source 1..136: mol_type = genomic DNA
cggggcggaggacgcgctggtcacgctgaacatggtgccgggccagtctgtgtacggcgagaggcgcgtcacggtgaccgagggcggcgtgaagcaggagtaccgcacgtggaacccgttccgctctaagctggcc

SEQ ID NO: 30075 - DNA, 452 bp, Homo sapiens
  misc_feature 1..452: note = chr5:168727476-168727928
  misc_feature 1..452: note = hyper
  source 1..452: mol_type = genomic DNA
caggtgggtggcccgcgtggggtggggcaggggtactcacaggcgctcagcgttgcgggggatgccccgaggaaccgcgcggaggcccagcccgtggcagtccacgctggcagcggagcaggtacacttggtggggcaggcgacggctggaggcccactcaggacgctcgccagcgccaaggccagcgccaggcgggcgcgcacggcggcgccgacccctgcccacccgggggccatggtgtgcagggccccgctcctggaggaggctgcctctgcggggcaagacgcgtggagcccgaggaggcgcgcggggagcgcgggcggcctggggagcgggcggcggagttagcgcggaggaggggcgagctcggtgctcaggcgcacggggcgcgggcggagcggggcgctccgggcggcggcggcggcagcaacagcagctccatcggcggggc

SEQ ID NO: 30076 - DNA, 82 bp, Homo sapiens; identical to SEQ ID NO: 8166
  misc_feature 1..82: note = chr5:168727994-168728076
  misc_feature 1..82: note = hyper
  source 1..82: mol_type = genomic DNA

SEQ ID NO: 30077 - DNA, 276 bp, Homo sapiens
  misc_feature 1..276: note = chr5:168728077-168728353
  misc_feature 1..276: note = hyper
  source 1..276: mol_type = genomic DNA
cggcggctgcggctggggcacggggcggccgggtgagctggccggcgctcgctctctccattcagtgagcacggcagacaccggagacgcggggcccacccctccggcccccccccgaccaagaaacgccaactccgcctcccattggctgcgccgcgcgtcatgtcgactaagttgggaactttgctggagcgaccgagagcctggagggaggaggcagtagaggagggagagagaaggaaccagggaaggaaaggggctcggccagcagggccc

SEQ ID NO: 30078 - DNA, 30 bp, Homo sapiens
  misc_feature 1..30: note = chr5:168728570-168728600
  misc_feature 1..30: note = hyper
  source 1..30: mol_type = genomic DNA
tgtcgcccacgaagccgcttccctaccgca

SEQ ID NO: 30079 - DNA, 508 bp, Homo sapiens
  misc_feature 1..508: note = chr5:169064022-169064530
  misc_feature 1..508: note = hyper
  source 1..508: mol_type = genomic DNA
gcggtggtggtctggcgagccccaggtggggactggcctctgctccctcgcctggggaggagacaaagtgggagtggtccccaagttttgcgtgaagtggggtggggtggcgtgtcttagcctacggggcaccagccttctagtgtgcccctgcccaacgggagggaggagggagcggggagccccggcgagggaggagagggcgggccctgagaggagtttgaaaagaggaaggaagtggggccctgcggcgcccagccaccccctgacggcttccccacgggaggacgcgaggccccggcccagccatggccccctggcgcaaagctgacaaggagcggcacggcgtgggtaggtgcgggccccagggcgcggcagggagcgggacaggtggcgggagagccgcgagcaggaggatgctgcggggccggcggcgcggggtgggcagggcgcgctgcctgcaggtcagagggcgcagcctgcggcggggcctcggggcgggaaagcc

SEQ ID NO: 30080 - DNA, 274 bp, Homo sapiens; identical to SEQ ID NO: 2677
  misc_feature 1..274: note = chr5:169064531-169064805
  misc_feature 1..274: note = hyper
  source 1..274: mol_type = genomic DNA

SEQ ID NO: 30081 - DNA, 30 bp, Homo sapiens
  misc_feature 1..30: note = chr5:169930863-169930893
  misc_feature 1..30: note = hyper
  source 1..30: mol_type = genomic DNA
tgctcccggggctcccgcacataccccggc

SEQ ID NO: 30082 - DNA, 104 bp, Homo sapiens
  misc_feature 1..104: note = chr5:169931223-169931327
  misc_feature 1..104: note = hyper
  source 1..104: mol_type = genomic DNA
cggcagcctcggccgggcggccgctctggccccgtgtccagtgccaggcaggcttcagggcaccgtcctcggccctgggcgagggaaccgccgggccgggtcct

SEQ ID NO: 30083 - DNA, 131 bp, Homo sapiens
  misc_feature 1..131: note = chr5:169931353-169931484
  misc_feature 1..131: note = hyper
  source 1..131: mol_type = genomic DNA
cgcggggagcggctagccctgagtccctgcatgtgcggggctgaagaaggaagccagaagcctcctagcctcgcctccacgcttgctgaataccaagctgcaggcgagctgccgggcgcttttctctcctc

SEQ ID NO: 30084 - DNA, 483 bp, Homo sapiens
  misc_feature 1..483: note = chr5:170107959-170108442
  misc_feature 1..483: note = hyper
  source 1..483: mol_type = genomic DNA
tggtggaaaataaaccgtgcactttagaacagcaggaagggaggcttggaagcctggttttctggctttgaatgaccgcctagcgcttgccggtgcgccagggtgctgtgaggatgtgggcagagggcgagtccgaagggctccagacactgggaatagtggtggtcgtgtgctcctccctgaaacttttgcactacctcggactgattgacttgtcagacggtaagcgaaccctggagcttccccgttttctgtgaatgtgtttttgtggcttcggttgctgtgacagtcgtttcgaaaatgcacggaaatgagggcggagacccgagagatttgaaaaagccgggctgaaacagcgtggtattggtccccgcctccccagtcgcgccccagtgctgcgctgtccgtcgtgctgaaatgtggtgcgcctggggagtgcgggagccaggaagttagggtctcctgctccggccctatgagcat

SEQ ID NO: 30085 - DNA, 209 bp, Homo sapiens
  misc_feature 1..209: note = chr5:170735112-170735321
  misc_feature 1..209: note = hyper
  source 1..209: mol_type = genomic DNA
aacgattttagaattcgctggaagaaaatgattccgcttgtctccccaaagctgcagcggaaggtgactacttcgtgtgcggtcctgtccacggtgccctgggccgggtagacagtcactgaggcgcgagcagaacggggagtggttccagcgcccaaagtggactggagccgggaagggctcaccagtcgcgtttcccaaagaaatcc

SEQ ID NO: 30086 - DNA, 21 bp, Homo sapiens
  misc_feature 1..21: note = chr5:170735730-170735751
  misc_feature 1..21: note = hyper
  source 1..21: mol_type = genomic DNA
cggtagcgtccaaggggcttc

SEQ ID NO: 30087 - DNA, 48 bp, Homo sapiens
  misc_feature 1..48: note = chr5:170736116-170736164
  misc_feature 1..48: note = hyper
  source 1..48: mol_type = genomic DNA
gcctttattgaaagccgggagccaatgagaggagagaggcttgttgat

SEQ ID NO: 30088 - DNA, 116 bp, Homo sapiens; identical to SEQ ID NO: 496
  misc_feature 1..116: note = chr5:170736715-170736831
  misc_feature 1..116: note = hyper
  source 1..116: mol_type = genomic DNA

SEQ ID NO: 30089 - DNA, 417 bp, Homo sapiens
  misc_feature 1..417: note = chr5:170737281-170737698
  misc_feature 1..417: note = hyper
  source 1..417: mol_type = genomic DNA
cgcttccatcgccagaagtacctggcctctgccgagagggcggcgctcgccaagtccctcaaaatgacggacgcgcaggtcaagacctggttccaaaaccggaggaccaagtggcggtgagagaggcctgacccggcccaccttacacctgcccttcacctgtcccgccccgagccgcagcctcgcactagccctattttaaggctatccactacccccgcccccctctgcctcccccaaacacacccccaccccgccttcgcagattgtacctcttcctttcacccttctcgctggcctgtgcttctctctccatcgtggtctcccacgccttggtttctcctccatccccatccccatctttcgtgagcccctccaactctctccccgtgttttgtacggtctcctgcgttcact

SEQ ID NO: 30090 - DNA, 106 bp, Homo sapiens
  misc_feature 1..106: note = chr5:170737758-170737864
  misc_feature 1..106: note = hyper
  source 1..106: mol_type = genomic DNA
cgcacacacacgggcctctcgcactctccttctcctccttcttccagcccgccctctcggattttcaacaatcctcgtggacgccggtttcctctccccccatctc

SEQ ID NO: 30091 - DNA, 755 bp, Homo sapiens; identical to SEQ ID NO: 499
  misc_feature 1..755: note = chr5:170737935-170738690
  misc_feature 1..755: note = hyper
  source 1..755: mol_type = genomic DNA

SEQ ID NO: 30092 - DNA, 1116 bp, Homo sapiens; identical to SEQ ID NO: 500
  misc_feature 1..1116: note = chr5:170738823-170739939
  misc_feature 1..1116: note = hyper
  source 1..1116: mol_type = genomic DNA

SEQ ID NO: 30093 - DNA, 23 bp, Homo sapiens
  misc_feature 1..23: note = chr5:170740455-170740478
  misc_feature 1..23: note = hyper
  source 1..23: mol_type = genomic DNA
aaggcaaaacactttcggggccg

SEQ ID NO: 30094 - DNA, 99 bp, Homo sapiens; identical to SEQ ID NO: 2686
  misc_feature 1..99: note = chr5:170740574-170740673
  misc_feature 1..99: note = hyper
  source 1..99: mol_type = genomic DNA

SEQ ID NO: 30095 - DNA, 331 bp, Homo sapiens
  misc_feature 1..331: note = chr5:170740674-170741005
  misc_feature 1..331: note = hyper
  source 1..331: mol_type = genomic DNA
ctcccgccgtcacctccacctccaagcccagctagcctgggatctgcgcctttcaggacataaagacacccagggagggactagggtgactcagaacttcgggtctcttccgtgagtgttttcctgaaatgcttttattttctccaataaaaagcctgatgaacgccgtcatcgggttgggaaaggttggcccttcggctgaggactagagggacccttgactttgctggcggagaagcgctttcctcagagacgggtgtcgcggtccagctcccttccgttccgttttattctgttgctccataataaggcctagcggggttttttttct

SEQ ID NO: 30096 - DNA, 807 bp, Homo sapiens
  misc_feature 1..807: note = chr5:170741469-170742276
  misc_feature 1..807: note = hyper
  source 1..807: mol_type = genomic DNA
gggattacaggcgtgagcccccgcccccggcccaacgtatcattcttataaggcctagtatttttgtttttcaaaattacttctgttgttttgccagggtgacactcaattctttgggcctctttggagacacacgcacgttgtttttttttctttctgttgggcgcctcgctttgcgcagaaggcctctggcccggaggcccgtccggggtaggcgtccaggcaggccgggggtggggggccggtctggcttcggccctcggggggcgcctggctttcccgcacctagtgccttcgcggcgtttggcgtcttccagcgctttgccctcacccagccttgcccagccagagacgggctacgggtcttttcctgttacagagctgagcccactcatgtggtgccaagtagcgactatctctcggccacctccacccagagcaatgtgggcgcccccagcgggtgggagcgattgccgagcggcgcaagggcgtttaacgcctaaccccctcctcctgggttgccaagccgctaggtcgccgtttccaacgtggctgcgcgggactgaagtccgacgactcctcgtcctcagtaggagacacacctcccactgcccccagccacgcgagctatgggcagaatcggggcaacggtaatatctggatggggcaggctcccctgaggctgtgcttaagaaaaaaggaatctggagtagcctgaggggccccacgagggggcctcctttgcgatcgtctcccagccttaggccaaggctacggaggcaggcggccgagtgttggcgcccagcc

SEQ ID NO: 30097 - DNA, 214 bp, Homo sapiens
  misc_feature 1..214: note = chr5:170742386-170742600
  misc_feature 1..214: note = hyper
  source 1..214: mol_type = genomic DNA
cgcccattttacagatgcagggcagggagacaagaggcatctccgggggccgagtagaatgatggcgcgggttctcccggcgccctgatttcgaggctgcgcccggggccctacatgcaggcggggaggcctgggccgaaggcgtctgcaaggaggggcgagtctgcccggtccgggcagggagtgaggccacagtcagttctccctaggaggc

SEQ ID NO: 30098 - DNA, 177 bp, Homo sapiens
  misc_feature 1..177: note = chr5:170742672-170742849
  misc_feature 1..177: note = hyper
  source 1..177: mol_type = genomic DNA
cgccgaaaactctggggccggccgctcgcttcccgctagtgggaatggtttccggtcatccgttcccagtccagccccgggtagggagctctgatttgcaatgcacagcacttgcgaggttcgaatgcccccgcaatttgcagatggaaatactaagcctaggccgggcgtggtggc

SEQ ID NO: 30099 - DNA, 331 bp, Homo sapiens
  misc_feature 1..331: note = chr5:170743149-170743480
  misc_feature 1..331: note = hyper
  source 1..331: mol_type = genomic DNA
tcaaagaagctctgataatagttctgggtcgtgcagcggtggcggccccgcgctctcgcccctaaagcaagcgctctttgtactgggtggaggagctttgagtagtgagggtggagatgcagcttcggggtggcgcagccaccctgacactaggcccggggtcgcagtgggacagaagagtctgccgctctgacttgggctctgagttccaagggcgcccggcacttctagcctcccaggcttgcgcgctggcgcctttgccatccgtgccgaagtggggagacctagccgcgaccaccacgagcgcagcggtgacacccagaggtcccac

SEQ ID NO: 30100 - DNA, 482 bp, Homo sapiens; identical to SEQ ID NO: 504
  misc_feature 1..482: note = chr5:170743646-170744128
  misc_feature 1..482: note = hyper
  source 1..482: mol_type = genomic DNA

SEQ ID NO: 30101 - DNA, 66 bp, Homo sapiens; identical to SEQ ID NO: 8189
  misc_feature 1..66: note = chr5:170744496-170744562
  misc_feature 1..66: note = hyper
  source 1..66: mol_type = genomic DNA

SEQ ID NO: 30102 - DNA, 116 bp, Homo sapiens
  misc_feature 1..116: note = chr5:170745303-170745419
  misc_feature 1..116: note = hyper
  source 1..116: mol_type = genomic DNA
gttgagctcaggggccgatggtgattatccagcatgcgaagctgccttgcatttgcatccactgttcaggtgctacagctggggcacttttgttcctgggacgtagtgagactaag

SEQ ID NO: 30103 - DNA, 102 bp, Homo sapiens
  misc_feature 1..102: note = chr5:172386993-172387095
  misc_feature 1..102: note = hyper
  source 1..102: mol_type = genomic DNA
cagaagtacaatgtccgctccatgcccatccgcaaggacgacgaggtccaggtacgtctccctccggcgctagtggcgctcggacaccgttgcctaagaacg

SEQ ID NO: 30104 - DNA, 736 bp, Homo sapiens
  misc_feature 1..736: note = chr5:172655825-172656561
  misc_feature 1..736: note = hyper
  source 1..736: mol_type = genomic DNA
caaggctgttgcctgcggcgtagaagcgctgggcctgagctcggaatgcttcccggaggatgcgaggggcgggcgctgcggggaagacggtgctactcccgcgcgggaccgcgtgatgtttccgagtcagcggtgaaacctgcggcttccgcgcgtcctttaaaaatacaggtatttagatacacaccgtggcgtcgacttaaggtgaaatctaaacaaaatgaaaggacgggagctattctgatttggccgaacctgtgcctgcgggctgggaatgacccaaggaaacgaagggacggcggagccagtgcggcgggggccgggtgggaggcggtggcctcgtgctggggacccccagccccggctcgcctttgccgggaaccaccaagctaatttttttccctttcttttttaaataaacctaccttccttcccccattttttccttttaatatcgctgtttatctccattttttttaactgcggcgtgttcttgttcgattttaaaaaatactaaaaataaaatgagtcccctaggtgcctccctggcgccctaggcatggagagctcatgcctgcgccaccctcatctccgctggctttgccacctcggaggcgccccacacttctcctttgttttgcttttctctgagccggttgagttttcttaccctgaatgcgtcgtttatacaattagcaactgaacacagaacaaatatcaccgatataattggggt

SEQ ID NO: 30105 - DNA, 482 bp, Homo sapiens
  misc_feature 1..482: note = chr5:172659544-172660026
  misc_feature 1..482: note = hyper
  source 1..482: mol_type = genomic DNA
cagggtcgcgccacgcgggtcccttccctaccaggctcggataccatgcagcgtggacactcccgagttgctctgcggaatcccggggctctgaaccgcattcaagtccccgacgccgaagttcacgaagttgttgttggcggcggcagtggccggctgcgctggggaaggcccggcggggtaagcggcagtgcagctgtagccagggctgcaggccgcgccgccgtaacccggataggcggggtaggcgttataaccgtagggattgaggcccacgccgtaggcaggcgcgtagggcgccgagtcccctaggcatggcttgccatcgcgcaccagcactggcaccgcgatcctgcgggcaggcggcggcggcggcgggggcagccccaccagctccagagtctggtcctgccgctgccgcttgcacttgtagcgccggttctggaaccagatcttgacctgcgtggacgtgagtttcagca

SEQ ID NO: 30106 - DNA, 113 bp, Homo sapiens
  misc_feature 1..113: note = chr5:172660141-172660254
  misc_feature 1..113: note = hyper
  source 1..113: mol_type = genomic DNA
cgcccggggccgctccgcgttgtccgcctctgtcttctccagctccaccgccttctgcagcgcgcacagctctgagggggaacagagaggcagagagacgcttggtaagagcg

SEQ ID NO: 30107 - DNA, 133 bp, Homo sapiens
  misc_feature 1..133: note = chr5:172660868-172661001
  misc_feature 1..133: note = hyper
  source 1..133: mol_type = genomic DNA
ctatgaattctctcccggctggcagcggcccttcgcccagcgcttcgcccagcgcctgcggcctcccgggaatcgcccgggctcctgccttgggctggggggtctcccagaaggcccctttctgcagcggggc

SEQ ID NO: 30108 - DNA, 20 bp, Homo sapiens
  misc_feature 1..20: note = chr5:172661126-172661146
  misc_feature 1..20: note = hyper
  source 1..20: mol_type = genomic DNA
cgcgccggcaagttgtgctg

SEQ ID NO: 30109 - DNA, 856 bp, Homo sapiens
  misc_feature 1..856: note = chr5:172661471-172662327
  misc_feature 1..856: note = hyper
  source 1..856: mol_type = genomic DNA
acccaggagcagagccgaagccgcccggggctttgttaggccggggggaaacgttttttggtctcttgcttctgatcctttcaatccggcatttcctctgaacctccgattggacgcggggcgcgggagcctggcgacaacaccaggcatcttacattctgaaccccccgccgcagcccagccctcggcccaagggcgcgtgtctcctcctcctggccctgagtttcttggggacgaaagcgacccaggaggggagaagggggcctgtgtttcctcctcacctttcttttcggctctagggtccttggctgggtcggggtcgctgtaggcacgtggatagaaggcgggggcggcgggaaaggcagacgcacacttggccggtgaaggcgcgcggcccagctctgcgcgcagctctgggaggcccggcgcagccgcctcgggcccagcgtaggcctctggcttgaaggcggccagcatgcaggaggagggcgccagggtcgcctccaggcgggcagagagctctccggcggcagccaggctgcgctgctgctgttccaggtttaggatgtctttgactgagaagggcgtgggcgtgagagcagggctggggaacatggtggcagcgccagtctcacagcgccaggtgggcggcagaaagcggcgctgcccacggcccctggcagcttccctgcatggtgccgccgcccgcccgcgcacccgtcggccagctctggatgtgtccgggcagcaggtagcgctgagcacaaggggcaggagaggcgggaccaggccagaggagggggactcagcctgccattgggccaggggcctcgatgacaggagcgatgagcagttt

SEQ ID NO: 30110 - DNA, 387 bp, Homo sapiens
  misc_feature 1..387: note = chr5:172664210-172664597
  misc_feature 1..387: note = hyper
  source 1..387: mol_type = genomic DNA
caaattctccttggacggagctgcatgtcagcggccttgcggcccttcctcgcctggacttttggccacgttaccgttatggctgtaaattaacctagcttgggggcccgccttgcctttgaagattgttttcgagcgcgggcgggggggggtgtcgttggagaggatgcctatcgccgaggcggtgacgtctggcaaacgagccacatccgattcaattaaatgtctcgctgaaaagagctcggaacgagggtcctgggagcgctgttaagtgaatctgctggccaggcggctcgcgatgacagtttgaaagattagtgtgagcggacgcctgaaatattaccgtttaatgggggacatcgaggctacatccgggatccctgtttt

SEQ ID NO: 30111 - DNA, 417 bp, Homo sapiens
  misc_feature 1..417: note = chr5:172665448-172665865
  misc_feature 1..417: note = hyper
  source 1..417: mol_type = genomic DNA
ggaatgtcattaatgcgctggggagacgtccattggagacaggcggcgttatccgcggctttatcttcaacaacgcctcgctctcggcccgcgcgggggaaacagatgggagtttctgtctgggacgctcgccccatgtttatattttgggaagaatcgcaactcgtgggagtccccggctggccccctgataaatgaacattagcactttttcggactactgtatcaacaaaggggctgcggcgctgcaataattggcgagaaagcaaacagagggccgagagcgcgactctgctcttcgtccggctgatggatgagcagctccggctgcgcgccggactcccggcctcggcctccgcctccgcctccgcctccgcctccgcgctgggcccctccgccgcccggcttccttcctgg

SEQ ID NO: 30112 - DNA, 277 bp, Homo sapiens
  misc_feature 1..277: note = chr5:172670821-172671098
  misc_feature 1..277: note = hyper
  source 1..277: mol_type = genomic DNA
gtttgcctcggattccgaggatccgagggagtcgctttcagacttccggtgtcctttcgcgttaatttcgtcctcttttcttctctgggctggggctggtggctgccacatcccaccccttctgccccgacggctgcaaaccgcttcagccaaaacgggcggagaggcggagagaatcgagacgctggaatcagttcctcggagtcccgtcgctggaggtcacagctgggaaaatcaggtgacattcgagtcagatggacaacgactcagatacagt

SEQ ID NO: 30113 - DNA, 137 bp, Homo sapiens
  misc_feature 1..137: note = chr5:172671345-172671482
  misc_feature 1..137: note = hyper
  source 1..137: mol_type = genomic DNA
ctccgcggctctggccgaaaccccggctggccgcagctccgggagcccccagccctgtgctgctgcggccggctcagtgctgaattgatgctggaaacggctggccagcgggcctagggtcgccgcctttccctcct

SEQ ID NO: 30114 - DNA, 160 bp, Homo sapiens
  misc_feature 1..160: note = chr5:172671639-172671799
  misc_feature 1..160: note = hyper
  source 1..160: mol_type = genomic DNA
cgcaagcggtgtctgtggagagcctcccgggggcatggcacgggggacccggaggccaacaagctgcgcgataccggagcaaagtcgggatcagcagccgcctttcgcggagggcgttctgcgctccaagcaaattggcgaaatgcggggattcagacac

SEQ ID NO: 30115 - DNA, 146 bp, Homo sapiens
  misc_feature 1..146: note = chr5:172672747-172672893
  misc_feature 1..146: note = hyper
  source 1..146: mol_type = genomic DNA
gctgttgtccccaaacgccgcctgtcaaaggagacgccacccgcattaggacctagactggggcccttccgctcggggtcaggcgcagcgccctcggcttgggccccgccgcccctttaggggtccgggagggtggagagaagggg

SEQ ID NO: 30116 - DNA, 97 bp, Homo sapiens
  misc_feature 1..97: note = chr5:172672960-172673057
  misc_feature 1..97: note = hyper
  source 1..97: mol_type = genomic DNA
cgctgaaaccggcccatctgggagaaatattagggcgcatgtctctcccggagggcttccttttttttttttttcctaaccacgaaaatagggaatc

SEQ ID NO: 30117 - DNA, 109 bp, Homo sapiens
  misc_feature 1..109: note = chr5:172710849-172710958
  misc_feature 1..109: note = hyper
  source 1..109: mol_type = genomic DNA
gagcactctcagccacgcccccgccaccccagcggcgctgcaggaaccagcccgccgccagcgcgaaggtgagaccgggcgccacgtgcttacccggcggcctccggaa

SEQ ID NO: 30118 - DNA, 576 bp, Homo sapiens
  misc_feature 1..576: note = chr5:172754355-172754931
  misc_feature 1..576: note = hyper
  source 1..576: mol_type = genomic DNA
tgctttgcagcttgccggtgagccaagagccggtagagcagaggaggcgcacggttcgggtcgtgtcaccatttcttggcttgctgacctggccaggagctggggatggcggcagcaccgcggaggtacgctttgcgctgccctcacgctcccttccgaaagcagtgcccccagggggaaagttcgcaatgccatttgtctcgccggcaaagttctgggatgtcgggcatcttttgaggagggggaagacgcggcacccttactgaggccggcaggccaggaagagaagttctccgggcgcagggcgcagcccagctccggggaccctctgggcctcccgcgtgccggccgggatgaagcgcgctttgcaccggacccgggattcgggggcgggggctggcgctggcagcgtcagacgctgcttcatttcccctcgaccctggggaggacagcaacaagtcctgccccagccatttcatcaccctgctagcacgtgcagattccgggccctcggagcccggcgcggacctcgccttgcctcgcgcttccctttgcacgtcccgtgccatcccaaga

SEQ ID NO: 30119 - DNA, 62 bp, Homo sapiens
  misc_feature 1..62: note = chr5:172755316-172755378
  misc_feature 1..62: note = hyper
  source 1..62: mol_type = genomic DNA
tttccctcctcctcgcggccgcggctcggatagaggttacccagcgccctcccgtagctctc

SEQ ID NO: 30120 - DNA, 143 bp, Homo sapiens
  misc_feature 1..143: note = chr5:172755420-172755563
  misc_feature 1..143: note = hyper
  source 1..143: mol_type = genomic DNA
cggcaatggcagggatggtgcctcaaatatccctggaagctctggtgtcacttgaatgaaggagtcgagcaggtgttgtcccggcggctggaccaatccgagaccccggcccttttgacaacacggccgggaggcggggcctg

SEQ ID NO: 30121 - DNA, 69 bp, Homo sapiens; identical to SEQ ID NO: 8207
  misc_feature 1..69: note = chr5:172755594-172755663
  misc_feature 1..69: note = hyper
  source 1..69: mol_type = genomic DNA

SEQ ID NO: 30122 - DNA, 845 bp, Homo sapiens
  misc_feature 1..845: note = chr5:172756377-172757222
  misc_feature 1..845: note = hyper
  source 1..845: mol_type = genomic DNA
caaaaaagctaaatccggggaagttatctccatctcctcccttttcttgttcggccccctccccaagaaccgccgggtcgggatagcccccggctactttctcacccggcccgtggagggaaggagaaagttgggcgccgcttggagcgcctcttcccctgctgtgtgtgtacgtgtgcacgctcacgtctcccccgcgccggggccggggacaggaactgctctcggtcccgtcaccccacggcgcagctcggggggctcgcagggctgggggagggcggggacacgagcgccgcgcccaagcgccccagggcacgcacccggcgttggcgcgcactcgcccctccccccgtccccaccctcctcctggagaacaggtgagccccggtaccagctctcgatcccccacccccgccccgcgccccgcccgcgccctctgcggtaatgcgcctgggaagtttcatcacccactgcccaggcgacgcggccctgggtctccgcggcggggcgcactgcccgcctggttggggccgccatgtgacacggctgggggagggggcgaggagacacgcgggcaggtcatcttttggccggcgcttgacttccaaagctttcctttcccgtgtcccggctgcacgcgggagtggggaaggcggaggcggggggccaggatggccacggctggccgcagctatccggcgtgtcgagctctcctgagtcggaaggaaggagaggagggggtggggagggcgtcttcagagtgggcttcccctgcgctggagcgccagggagcatccataaattgtcactttgaaggtccgaacctgcggcggtagggaccatgc

SEQ ID NO: 30123 - DNA, 400 bp, Homo sapiens
  misc_feature 1..400: note = chr5:173738828-173739228
  misc_feature 1..400: note = hyper
  source 1..400: mol_type = genomic DNA
actttcaccgcagagcgggggctgctggaggggcgggtgggctgcggcccggcggcggcggatgcctgtctctgccgaagccgaaggaaggctgcgtgggcagatcttccagctaggcccagagggacggccgacattcaacccgccagtcaaaggagggaagggctggcggcaggagcagctcaggaggcagacccgggcgcgcgggggcgcgggggctcgggggcctgtgagggatccccggacgggcagctgcggggtgcgggccgggctgcaccgcgacaaaggcggcccagcggcggcatcggaggacgcacgctgccccctggtggccaggccgctccccgcaaacgcgagctcctttgttttgcggtcccggcttctgcggcccaggcttgct

SEQ ID NO: 30124 - DNA, 201 bp, Homo sapiens
  misc_feature 1..201: note = chr5:174115388-174115589
  misc_feature 1..201: note = hyper
  source 1..201: mol_type = genomic DNA
aaatgtgatcactctcggcaccgtagtctctgatgagaacatttaatcaattagcattgccgttgccaaaacttgcttcccaccgagcccaaaagccgccggcggcacatcccagcggcctccctcctcccgggctgggattcgcctctgcaagaaacgtcatgttttctctcccagacatcgttccgggagccccagatg

SEQ ID NO: 30125 - DNA, 55 bp, Homo sapiens; identical to SEQ ID NO: 8210
  misc_feature 1..55: note = chr5:174119987-174120042
  misc_feature 1..55: note = hyper
  source 1..55: mol_type = genomic DNA

SEQ ID NO: 30126 - DNA, 176 bp, Homo sapiens
  misc_feature 1..176: note = chr5:174147420-174147596
  misc_feature 1..176: note = hyper
  source 1..176: mol_type = genomic DNA
cctctcccctctctgcgcctggacgacttcatctgtggaatggggagaaagctcaggctttagggggccttcagtaatctgcatcgtgcttttggcaaaagctccttctctccagccccggctcaaacccgggctcggtcctgactccggaccttagggggcgggaacaggagaac

SEQ ID NO: 30127 - DNA, 37 bp, Homo sapiens
  misc_feature 1..37: note = chr5:174150431-174150468
  misc_feature 1..37: note = hyper
  source 1..37: mol_type = genomic DNA
gaggcctctaatcctcgaagctcgctctccccttccc

SEQ ID NO: 30128 - DNA, 72 bp, Homo sapiens
  misc_feature 1..72: note = chr5:174151125-174151197
  misc_feature 1..72: note = hyper
  source 1..72: mol_type = genomic DNA
gtaagccaattttgacgcatagtaggggcttcgtaaatgtttctgcaatgctgtttgcgaatcttgaactta

SEQ ID NO: 30129 - DNA, 306 bp, Homo sapiens
  misc_feature 1..306: note = chr5:174151463-174151769
  misc_feature 1..306: note = hyper
  source 1..306: mol_type = genomic DNA
agagccaatcaggggcgagcgtctctggcgtcagcgccaggcccggcgcggattggcggcgcgcgtctcccacttcccctcggaggaaaggctcagctcccagcgcgcccctcccgtctccgcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcgga

SEQ ID NO: 30130 - DNA, 294 bp, Homo sapiens
  misc_feature 1..294: note = chr5:174159299-174159593
  misc_feature 1..294: note = hyper
  source 1..294: mol_type = genomic DNA
ggagaaaagggctgcatcttgcgtggctggcgggttagactggaatccgtctggggaactgcgcaccatccccatcgctccagacgccgaaacaaaacctgaggctcggagaggggaaaaagagttgttcaggctcgaacatacgcatcccagcctcataggtggatggggttaccgagctgagaaccaagccggaggtccgcgaagccgggccgcccccttgctctgggcctcccttcaagcctgcagtctggggatgggttccgagtcaccgcggtccgggcctcggtcagg

SEQ ID NO: 30131 - DNA, 30 bp, Homo sapiens
  misc_feature 1..30: note = chr5:174162217-174162247
  misc_feature 1..30: note = hyper
  source 1..30: mol_type = genomic DNA
cctctcttcccccaccgccttctttgcctg

SEQ ID NO: 30132 - DNA, 37 bp, Homo sapiens; identical to SEQ ID NO: 8213
  misc_feature 1..37: note = chr5:174162509-174162546
  misc_feature 1..37: note = hyper
  source 1..37: mol_type = genomic DNA

SEQ ID NO: 30133 - DNA, 86 bp, Homo sapiens
  misc_feature 1..86: note = chr5:174162770-174162856
  misc_feature 1..86: note = hyper
  source 1..86: mol_type = genomic DNA
tgccatcaataaatacgcactgacaccggcccggcccgctccaccggcacggaagatcgcagccgaccaggcgccctcctccctgc

SEQ ID NO: 30134 - DNA, 41 bp, Homo sapiens
  misc_feature 1..41: note = chr5:174178168-174178209
  misc_feature 1..41: note = hyper
  source 1..41: mol_type = genomic DNA
gggctcccccgaccccgccctggcagcgccccccgccgcga

SEQ ID NO: 30135 - DNA, 126 bp, Homo sapiens
  misc_feature 1..126: note = chr5:174178667-174178793
  misc_feature 1..126: note = hyper
  source 1..126: mol_type = genomic DNA
agggagaagaggggccgcggccgcgcgccccgccatcagctgcgcgcacagagggagagttcactccggggacaagggcggcgcgaccggcccggggctcttgggcggccgcgtttcccctcccac

SEQ ID NO: 30136 - DNA, 86 bp, Homo sapiens
  misc_feature 1..86: note = chr5:174220856-174220942
  misc_feature 1..86: note = hyper
  source 1..86: mol_type = genomic DNA
cgacgcgccacatggctggcaccggcgcgcccccgcgcggccgcctgcgagaagctcactctccgcggaggcgaaatctggttttg

SEQ ID NO: 30137 - DNA, 1179 bp, Homo sapiens
  misc_feature 1..1179: note = chr5:174870699-174871878
  misc_feature 1..1179: note = hyper
  source 1..1179: mol_type = genomic DNA
accttgccttggggtcgtctctctcaaagcccctggagcttggaatgtggacttcgctgggggcagcggctccgaaacgttgaggaagcgcgcctgagcccagccagctgcgcgcagcaggggttcggctcccggtgcgcaaaaatcgccggggtgcgtttggggaaaggatcccaggccaggtcccaagagaggcggcggcagcccacttccttgaagagctggagattgttcaaagggcactagaccccggctaagggctcctgggcgctcggagcttccttgggagagagcactcccaggactggtcacctgggcagcttcttttcttggcttcctttcgagagcccagagccttggcgaacctcgggcggccttcagccctacagagcagggccccgcgcctccccgcaggcactgcccgcgacctctcaggagcctgtggcaatgcgaggcagcgagccgagctggcaccagcaagcgcacaggccggcggggttcccgcggggcacagcccaccccgcccgcgcgtcccctcccctgccctgggggcggtcctcgcttgacaggcagagttgcgggcgacagccgcacgtggtccccctggatggttctgcgggcgaggtgggcggaggacgccccggtgagtgcttgccctccctggttacctcgccagtctccggatccccgcgcagcacgcgcagggcccgcgaggcaaatccaatgtcagaacctcaagtaagcttgagtcccctgaaagcaaagctcagccccgacatccagcgcctcttggggtcaacccctagccggacccaaagccctaagcgagcgggagcaccccccattccccgcacaccaactcctagaacggccggcggacgtccgacctgcgttgtctccaagtgtcccctaactagggttggagatgcccgtgggcgcctgtactcaccgctcgcagggagggcgcggcgcagctgggatccgggccagcgcgcgccgctgcgccccgaggggactcactccttccccgcccaggtggcgggcgcgtcccggctgcggtcaacgccggactccagccggtgccccgcacctcccgagcgccccaaccccagcgccgcgcgctccgtgtgcccggggcgccctctgccggcggctgcgacttcccgagcgcccgctgtg

SEQ ID NO: 30138 - DNA, 265 bp, Homo sapiens
  misc_feature 1..265: note = chr5:175085050-175085315
  misc_feature 1..265: note = hyper
  source 1..265: mol_type = genomic DNA
aggccgtgcgcgcgccgcccgctgcatccctgcccggagcgcagccggcgcgggcgcgggaccgaggcgaaccgggtgcggagccaatacccgcggcagcagcaccaggtaacgcggccgccgcctccccgcggggcctcggctcggggtggggtcccaggcgggcttggggacccggcgtgggctggcggagccgcccgaggggctgctcgggatccccggcggccgtcgtggccccgaacccgggttcgagcctcggccccac

SEQ ID NO: 30139 - DNA, 220 bp, Homo sapiens
  misc_feature 1..220: note = chr5:175085524-175085744
  misc_feature 1..220: note = hyper
  source 1..220: mol_type = genomic DNA
cgaaacagtccccgttttgtctccgggtctgggtggtggcattttctcgcggcgatgtgtctgtcggagcatggagcaactttctgctaaagggaagccagcggagagcgggggctgctggggaggaggcttctatgtctcaggaaaccagaacgacctgccttcatcccgctgggctgccgcccgctgccggatgaccgatgaccggagccacaacagg

SEQ ID NO: 30140 - DNA, 30 bp, Homo sapiens
  misc_feature 1..30: note = chr5:175223481-175223511
  misc_feature 1..30: note = hyper
  source 1..30: mol_type = genomic DNA
tgccacctctgctggcgtcctctctcatct

SEQ ID NO: 30141 - DNA, 70 bp, Homo sapiens
  misc_feature 1..70: note = chr5:175223880-175223950
  misc_feature 1..70: note = hyper
  source 1..70: mol_type = genomic DNA
agagcttcctagaggcggcttcctccggcctctccccctccctggagctctcagccgccggcggctcttc

SEQ ID NO: 30142 - DNA, 321 bp, Homo sapiens
  misc_feature 1..321: note = chr5:175224441-175224762
  misc_feature 1..321: note = hyper
  source 1..321: mol_type = genomic DNA
gggctgggcctaggctgaggtcccggcggggaggaaggagtgcgccgccccgtcttccctccagacccccaccccatcccagctcagaatcgcggacttccaagagccctgcacagaagcccgcggctggcagctgcaatcactgactccggctgtccccggaacatccctagaaagtgtgaggctgagtttccgtagggggagggggctgagaagccgcggggaagcctcacgaacgggacagctccaggctccctctctccctcactccccgggttccgcccccacctccagagaaatcccagacggcagagaaggcag

SEQ ID NO: 30143 - DNA, 35 bp, Homo sapiens; identical to SEQ ID NO: 8221
  misc_feature 1..35: note = chr5:175298647-175298682
  misc_feature 1..35: note = hyper
  source 1..35: mol_type = genomic DNA

SEQ ID NO: 30144 - DNA, 40 bp, Homo sapiens; identical to SEQ ID NO: 8222
  misc_feature 1..40: note = chr5:175298910-175298950
  misc_feature 1..40: note = hyper
  source 1..40: mol_type = genomic DNA

SEQ ID NO: 30145 - DNA, 192 bp, Homo sapiens
  misc_feature 1..192: note = chr5:175299156-175299348
  misc_feature 1..192: note = hyper
  source 1..192: mol_type = genomic DNA
cccggaggagggagtcgcccccaggggtacagtgcgcactcccggagtgagtcagagggcggcggcaggggggcggacagaccgcaggtggaggggaggagaacgtagacattgacaggggatgggggaccaaggggactatttgtccctttccgggaggagccgccgcttggacagcgcacgcccgccgcc

SEQ ID NO: 30146 - DNA, 550 bp, Homo sapiens
  misc_feature 1..550: note = chr5:175299591-175300141
  misc_feature 1..550: note = hyper
  source 1..550: mol_type = genomic DNA
acccccggccacttccgcttttcagccggagtcggctccctacctcctcccatcctccgctgcccctcccctcccccatgcgtctcccatcccgggccacggggtggggacggggcggggggagggggtggagtgacatcccctgtctctgccactgcctttggcgtagtcccctgccagaagcaaatgagtgttgaattgagttgcggtgaatatagcccagacttgaatcataaaaacagaaaaacggccataaggacaaccactgcaggttacccgagtcagcctgtcagatggcggggcccagtcccgaaaacctctaggggctcagatggtcgagcctgagtcggtgcttgggctgggacgggctcggagggagtcggagaggggaaggaagctgaaggcgcgccctgggtccccggcgcactgaaggtacggaaacctggtgctacgacggcatccctcgccgcccccggcctcccctcccccagcgcagcatcccccacccacccccactcccacccacccccaccctcaccccccttcccgc

SEQ ID NO: 30147 - DNA, 29 bp, Homo sapiens
  misc_feature 1..29: note = chr5:175300142-175300171
  misc_feature 1..29: note = hyper
  source 1..29: mol_type = genomic DNA
cagggatagaccaaggcttcccgcagaat

SEQ ID NO: 30148 - DNA, 196 bp, Homo sapiens; identical to SEQ ID NO: 8226
  misc_feature 1..196: note = chr5:175300216-175300412
  misc_feature 1..196: note = hyper
  source 1..196: mol_type = genomic DNA

SEQ ID NO: 30149 - DNA, 54 bp, Homo sapiens
  misc_feature 1..54: note = chr5:175488184-175488238
  misc_feature 1..54: note = hyper
  source 1..54: mol_type = genomic DNA
agccaggagaacccgcgagcccagcggcgcctgcacctgcggcttccgggagcc

SEQ ID NO: 30150 - DNA, 308 bp, Homo sapiens
  misc_feature 1..308: note = chr5:175560514-175560822
  misc_feature 1..308: note = hyper
  source 1..308: mol_type = genomic DNA
agtagcctgggtccccgtacctctgcaggcgcagccgctcttttcacctggtgcgccagcttgcaagtcgtgcatttacctcttttggctgcacagagggcagggaagcctcgcgggtatgcaagatcgggaatggctgggggtgcgaccaaggggacttggagaaccgccccgcctccccaggttcccctggtagagcgcaccaccccccacccccgcgagttttcagaggcccaggccctgtggagctgggtctctgcggaaggggtggggaccgggcagaggcaggaggacggaaagagctgggc

SEQ ID NO: 30151 - DNA, 163 bp, Homo sapiens
  misc_feature 1..163: note = chr5:175621342-175621505
  misc_feature 1..163: note = hyper
  source 1..163: mol_type = genomic DNA
gccggcgcctgctcccgcagacctgccatgccaatgctctccaagctgaggccgggtggcctgcgacgctcagcccgctgcccatcacaagaagaaaagcgcttatcagggcgctgtgcgcacggggccaccttcgcgctggcccgtgcgggcaccctcagcc

SEQ ID NO: 30152 - DNA, 83 bp, Homo sapiens
  misc_feature 1..83: note = chr5:175626566-175626649
  misc_feature 1..83: note = hyper
  source 1..83: mol_type = genomic DNA
cgcgtaggagcggggcgcgggcaggtacagaacgcgggcaggagcaggacgcggaggggagcggggcgcgggctggcagaggt

SEQ ID NO: 30153 - DNA, 108 bp, Homo sapiens
  misc_feature 1..108: note = chr5:175792208-175792316
  misc_feature 1..108: note = hyper
  source 1..108: mol_type = genomic DNA
cggttttcccttctgcgtggtatcattgtaaggggtaacggagaaaagccgtgagctaacccctggtggatgctagcaagcaccgccgtctcccgtcctccccaggca

SEQ ID NO: 30154 - DNA, 392 bp, Homo sapiens
  misc_feature 1..392: note = chr5:175792540-175792932
  misc_feature 1..392: note = hyper
  source 1..392: mol_type = genomic DNA
cgcacctgcgtccctcgcccggcccgatggcgccgcggccgctgggccccttggtgctggcgctgggcggcgccgcggcggtgctgggctcggtgctcttcatcctctggaagacctacttcggccgcggccgagagcggcgctgggaccggggagaggcctggtggggcgcggaggctgcccgcctccccgagtgggacgagtgggacgtgagtgccgggccgaggcctgcggaagggcgggcaggctgggctgcgactccgcgcatgtggccaaggggtgtgaccacggaacggccctgctggtgccgggagcttggggggtcgagggcttggcagccgcagcgcacaggccccgcgcgggtgggcggtcagagcccgggaaccgaggaa

SEQ ID NO: 30155 - DNA, 221 bp, Homo sapiens
  misc_feature 1..221: note = chr5:175792997-175793218
  misc_feature 1..221: note = hyper
  source 1..221: mol_type = genomic DNA
cgggtgttccagcgggggccggagtttggagggcgcggctcgggagcatcccggggcccagccgggtcggctcgcgcccctccggcgcctgcgcagtgcaccccgcccgggggtggggatgtcgggagaaaccccatcccctcccgcctgcggtcgggactccgagaccggtggaggaagcggggcgcgcgagcgtttaaggaattcgccaagggtttgga

SEQ ID NO: 30156 - DNA, 204 bp, Homo sapiens; identical to SEQ ID NO: 8233
  misc_feature 1..204: note = chr5:176024005-176024209
  misc_feature 1..204: note = hyper
  source 1..204: mol_type = genomic DNA

SEQ ID NO: 30157 - DNA, 71 bp, Homo sapiens
  misc_feature 1..71: note = chr5:176038550-176038621
  misc_feature 1..71: note = hyper
  source 1..71: mol_type = genomic DNA
gcttcctcacatttccggtcctgaaaattgctcattcactgcccacaaggccatttcgcttcagagcttac

SEQ ID NO: 30158 - DNA, 313 bp, Homo sapiens
  misc_feature 1..313: note = chr5:176046289-176046602
  misc_feature 1..313: note = hyper
  source 1..313: mol_type = genomic DNA
gcctcggtgcaagcgcggagagagggcctctgcggcaagagggcaggggcggggcctcgcgcagggactgcctatgccaataaaggcagcgcatggggggcggtgcctctgcgcggagccagcagtatctccgcccccatctttctcactctgaggcggtgttgggggccccctagtgctgatcctgatccgctcaaggctcccgggcggcatcccagacctctgcgggccctcgcccacctcaaactttcggcctcaaacattccggcgccttcgtgggggtgggagggtggagcaccggaggccagggctc

SEQ ID NO: 30159 - DNA, 659 bp, Homo sapiens
  misc_feature 1..659: note = chr5:176056505-176057164
  misc_feature 1..659: note = hyper
  source 1..659: mol_type = genomic DNA
cagccccagaaaccccgccccttacccaccgacgtagaggacgccctccttggtcttctccgccgcctcggtgaccccctgcttggttttctccgcggctgccacaacgccctccttggccatggacaggcccttcatgaacacgtccatcctggcggcctggggagggcgatacacgggcaccggtgcactggccccgcactctcaccccagcccctcccgcgggacgcagatgcccccctactcccgagaccgcggcgcccttctggaccctgagccccctcccgctttccccccatcccaccccactccccagtgcgaagcctcagggccgcggagagtcctagcgtccttgaaacctggggacgcgggaggggccactgcctcggttatccgggccctgcaaactgcagccccgtcgaaccggagtgctgggttcggcgcgaatatccaggacccgcctgtacacgcacggcacagtcacacggtcatgcacacaaacatacaccacggacaagctcacgtgcacacacaggacacgcagacgctccaacgcgcacgaataccccgacccacatgggcgcggacacacgtccccacagccgcccgggcagctgcaaacaccggagcatactcacatactccggggtgcacactga

SEQ ID NO: 30160 - DNA, 141 bp, Homo sapiens
  misc_feature 1..141: note = chr5:176057373-176057514
  misc_feature 1..141: note = hyper
  source 1..141: mol_type = genomic DNA
gaggggggatagggccgggatcaggcgctcgggtcgcgggtcctgagcaggagcgcagcagtgcccgggtctcgggtgcgtagccagccaccgctcgttcctcgcgccctgcgagctcgcgcgctccggctccggctccgg

SEQ ID NO: 30161 - DNA, 30 bp, Homo sapiens
  misc_feature 1..30: note = chr5:176057751-176057781
  misc_feature 1..30: note = hyper
  source 1..30: mol_type = genomic DNA
gagttctgctgggctcgaatctcagctgtg

SEQ ID NO: 30162 - DNA, 405 bp, Homo sapiens
  misc_feature 1..405: note = chr5:176107080-176107485
  misc_feature 1..405: note = hyper
  source 1..405: mol_type = genomic DNA
gccttagcgcctccccgcagctcagaggatgggactggggtccagctccctgcccgccccgcaccccgtaccccgcagcctgtccgtccatccgccccgcttcacttcgctgtcccctgtcggggttcgagtcgcagcctccagcctcaacccgcacctcccgccctgcagctcaactctcgcctccgctgcaatttattactggaggccgcagaaccagcggcgtggagtgcgcctcccgggagccgccgctgtcggagaaaggcacccacccgcctgggccggctcccgggcgcggggcggtgtctcagggaggcgtctcagccgagctgcagggcgaggggagcgagccgggtcccgggggaaggcatccggtcagggcctcgcccacccggatggctcctg

SEQ ID NO: 30163 - DNA, 69 bp, Homo sapiens; identical to SEQ ID NO: 2710
  misc_feature 1..69: note = chr5:176107517-176107586
  misc_feature 1..69: note = hyper
  source 1..69: mol_type = genomic DNA

SEQ ID NO: 30164 - DNA, 30 bp, Homo sapiens
  misc_feature 1..30: note = chr5:176170309-176170339
  misc_feature 1..30: note = hyper
  source 1..30: mol_type = genomic DNA
ccgggggtgcgggtgcgccgagccctcggg

SEQ ID NO: 30165 - DNA, 277 bp, Homo sapiens
  misc_feature 1..277: note = chr5:176236721-176236998
  misc_feature 1..277: note = hyper
  source 1..277: mol_type = genomic DNA
tgccaaagcccagctcgttcctttacacccacgtcgcgggcgccgtgcgctctcggggctcaaacaccgcgcgcccagtcgggtgtgctgcgcctgaaggttgttttccttcggcgaacggcgccgaggggttagggaaaccttgggtcatggtgtgaggcgcgcccctggaatccaccagcctgcgaggctgggactgcgggtgtccccgagtctggcctgccagctctggtggccagggcacctctgcgcgcgggccagggccccggggctctcc

SEQ ID NO: 30166 - DNA, 17 bp, Homo sapiens
  misc_feature 1..17: note = chr5:176237148-176237165
  misc_feature 1..17: note = hyper
  source 1..17: mol_type = genomic DNA
cgcgccggggtcgccgc

SEQ ID NO: 30167 - DNA, 95 bp, Homo sapiens; identical to SEQ ID NO: 8241
  misc_feature 1..95: note = chr5:176264805-176264900
  misc_feature 1..95: note = hyper
  source 1..95: mol_type = genomic DNA

SEQ ID NO: 30168 - DNA, 95 bp, Homo sapiens; identical to SEQ ID NO: 2711
  misc_feature 1..95: note = chr5:177411327-177411422
  misc_feature 1..95: note = hyper
  source 1..95: mol_type = genomic DNA

SEQ ID NO: 30169 - DNA, 702 bp, Homo sapiens
  misc_feature 1..702: note = chr5:177411507-177412209
  misc_feature 1..702: note = hyper
  source 1..702: mol_type = genomic DNA
cgcggagatgggccagagtccggccatccagaagtgcctggagcgcacagcaaggccctgccctcggctccgtgaaggtgagggggtaaagtcggcccggagtccccgggggtgcaggaggggccccgcgggttccagcagaccctcgacggaacgttccaggcaggcgagatctcgcacagaatctgcccttttaaaggctcggctttgtcctcgttaaacttgcgtctggcaacgcgaccgctgcggctcccgagcaagattagagggtttccgctcgcaggggcgcgcccggggaccgcgcctccccgcctggtctcggcgccccggcccaggggtcttcagtggtgaggggcgcccagatcgctgcatcccctggagctctgcgcccggccgagccactcagagctcccgccccgcacacccacttcgagctccaagtccttccttttctatactccaagttggatcctgctgggaaggaagggcccttcctgagagaccagggattgcgatttcccagcacaaagtcgaattcatgacttcagcttcaacggggctgcattctccccttggcaggaatgggatggagcgagggtgaagctgctggaaagacactcgttttatttttttaatcgtaaacggggcaacttccaactctgccagttttaagcttctagagtatctcctcggcggagcgcg

SEQ ID NO: 30170 - DNA, 90 bp, Homo sapiens
  misc_feature 1..90: note = chr5:177412560-177412650
  misc_feature 1..90: note = hyper
  source 1..90: mol_type = genomic DNA
gctgggttgctggggcgccagtctgcggtgttcaggcccaaagcctgcagcctgttcagtccagggcaccgcaggcgccagaactctggc

SEQ ID NO: 30171 - DNA, 30 bp, Homo sapiens
  misc_feature 1..30: note = chr5:177666777-177666807
  misc_feature 1..30: note = hyper
  source 1..30: mol_type = genomic DNA
ggtcctgccgagagccgtgtggcttcctgc

SEQ ID NO: 30172 - DNA, 87 bp, Homo sapiens
  misc_feature 1..87: note = chr5:178004287-178004374
  misc_feature 1..87: note = hyper
  source 1..87: mol_type = genomic DNA
cgtctcccctcttctcgggacaccagccctgttggatcagggcccccccacaacgacctgtgccacctcatccgcctctttaaagac

SEQ ID NO: 30173 - DNA, 303 bp, Homo sapiens; identical to SEQ ID NO: 509
  misc_feature 1..303: note = chr5:178016681-178016984
  misc_feature 1..303: note = hyper
  source 1..303: mol_type = genomic DNA

SEQ ID NO: 30174 - DNA, 52 bp, Homo sapiens; identical to SEQ ID NO: 510
  misc_feature 1..52: note = chr5:178017519-178017571
  misc_feature 1..52: note = hyper
  source 1..52: mol_type = genomic DNA

SEQ ID NO: 30175 - DNA, 344 bp, Homo sapiens
  misc_feature 1..344: note = chr5:178017572-178017916
  misc_feature 1..344: note = hyper
  source 1..344: mol_type = genomic DNA
ggcgccggcacccgcccccgcacgcacctctgaggcttccccagcccaagcccgcactgtggaccccagaggtcggaggggagcccggcgacaccgcgccccttctgcagcccacccctggctggagcacccaccactcgtgccttagcacattcctctaaacttgtgaattacctttctgacacttgtaaaagttcaaaacttcaaatcctgcaaaaaactgagtgggtctgtcctcggtggtggattagcgccgcttcgtggcggaaagcgacctctgcgcactcacatttagagaggcagggtcgagattgcgccaaacagaaatacgccccttagaatct

SEQ ID NO: 30176 - DNA, 43 bp, Homo sapiens
  misc_feature 1..43: note = chr5:178422264-178422307
  misc_feature 1..43: note = hyper
  source 1..43: mol_type = genomic DNA
caagccagtcacctgcgccagccgctgtcggttcaggacaagt

SEQ ID NO: 30177 - DNA, 217 bp, Homo sapiens
  misc_feature 1..217: note = chr5:178450901-178451118
  misc_feature 1..217: note = hyper
  source 1..217: mol_type = genomic DNA
ccaggtacaggctgccggtgagggcgggcccggggcgtgcggctgccgcggcgggaccaggacgagggctggcctctgcgcgtgtctgccgagtccccggctccgggcgtccgagccggggcggcctcggcaggtgaacccggccccggagggggcgtggcctgggaagggcctggcggaggccgggagggcgcttcgacgccgctggactcctggg

SEQ ID NO: 30178 - DNA, 46 bp, Homo sapiens; identical to SEQ ID NO: 8250
  misc_feature 1..46: note = chr5:178487258-178487304
  misc_feature 1..46: note = hyper
  source 1..46: mol_type = genomic DNA

SEQ ID NO: 30179 - DNA, 403 bp, Homo sapiens
  misc_feature 1..403: note = chr5:178487341-178487744
  misc_feature 1..403: note = hyper
  source 1..403: mol_type = genomic DNA
cggcgtggggccggaggcatgccgggagtggtagttctcccgcggttggcggggtttcggggacagctcgcggcctttcgggggttctcctggcttgggccatccaggcttggctaggattgccggcctggggttgaggcgctcgcagtggtctcttccgggccggggtggatccgggcctctccagcgagtgggcggcgtgcagcctcgtctgggcttctgggaccagccctacgcggctcgggccccttggccactgggtcccggggcgccgtccgcgagcggcctggactgccggagacccgcgggagggagcgcctcgccaggtgagctgggtgcgccgggccgctggggtggggatgccagccttttgtcgttgttcattctgcgattttcttctgtg

SEQ ID NO: 30180 - DNA, 338 bp, Homo sapiens
  misc_feature 1..338: note = chr5:178594123-178594461
  misc_feature 1..338: note = hyper
  source 1..338: mol_type = genomic DNA
cgacacctcgcttccacttcattttcctaccttccggatgacgaactgcgtctcagacaactgaaaggactcgcctgagtcccacagccggaaagaggtcggggtgctgccccccgcgcggggcgggcagaggaagggccgggcccgagcggccaccaggtggcgctgctgccgcgagaacagcggcccgggccggggacgcacccggcgcccagactccgcggccgcacccgggctcccggggccccagcggccccaagacagcctctgggcctcaccctaaatacatcaattatgacctgagcaaaaagttctgttccaatcgttgctctccgaca

SEQ ID NO: 30181 - DNA, 145 bp, Homo sapiens
  misc_feature 1..145: note = chr5:178770760-178770905
  misc_feature 1..145: note = hyper
  source 1..145: mol_type = genomic DNA
tactcaccagcccatcgcagttgctgagcgccacagaggaggcttcggctaggccggccacgtctccgacgtagagacagctcccgagcaggggctccacgcgggtggtgcccttctcgccctgccactccatagtggccccggg

SEQ ID NO: 30182 - DNA, 433 bp, Homo sapiens; identical to SEQ ID NO: 2717
  misc_feature 1..433: note = chr5:178771198-178771631
  misc_feature 1..433: note = hyper
  source 1..433: mol_type = genomic DNA

SEQ ID NO: 30183 - DNA, 58 bp, Homo sapiens; identical to SEQ ID NO: 2718
  misc_feature 1..58: note = chr5:178771723-178771781
  misc_feature 1..58: note = hyper
  source 1..58: mol_type = genomic DNA

SEQ ID NO: 30184 - DNA, 78 bp, Homo sapiens; identical to SEQ ID NO: 2719
  misc_feature 1..78: note = chr5:178771782-178771860
  misc_feature 1..78: note = hyper
  source 1..78: mol_type = genomic DNA

SEQ ID NO: 30185 - DNA, 15 bp, Homo sapiens
  misc_feature 1..15: note = chr5:178771967-178771982
  misc_feature 1..15: note = hyper
  source 1..15: mol_type = genomic DNA
cgccagtgctccgag

SEQ ID NO: 30186 - DNA, 546 bp, Homo sapiens; identical to SEQ ID NO: 2721
  misc_feature 1..546: note = chr5:178772184-178772730
  misc_feature 1..546: note = hyper
  source 1..546: mol_type = genomic DNA

SEQ ID NO: 30187 - DNA, 58 bp, Homo sapiens; identical to SEQ ID NO: 2722
  misc_feature 1..58: note = chr5:178772778-178772836
  misc_feature 1..58: note = hyper
  source 1..58: mol_type = genomic DNA

SEQ ID NO: 30188 - DNA, 349 bp, Homo sapiens
  misc_feature 1..349: note = chr5:178957597-178957946
  misc_feature 1..349: note = hyper
  source 1..349: mol_type = genomic DNA
cgagggtgatctgagatccaaagtcaggagtcttctgcatcctgccctttgtcagcgctggtcctcatttcacctgcccagggccttcaggaggggcgacactctccggctgcgggcggcccagcgctcgcccccctcggccccacgtactcttcctgcctcgcccccatcgccctcctccggcttcccgcgcctcccggggctctgcgcttgcgtccagggcgccctctccggggacaatgggcgggtgcttcgcaggctgcagtcagggccgacttcacccggcgaggacagggcgaggcgctgggcccagaggtatgtttgaaacgattcgcgtatgtgaatctac

SEQ ID NO: 30189 - DNA, 31 bp, Homo sapiens
  misc_feature 1..31: note = chr5:179243847-179243878
  misc_feature 1..31: note = hyper
  source 1..31: mol_type = genomic DNA
ccccagcagtgcccccgggtctccggccacc

SEQ ID NO: 30190 - DNA, 22 bp, Homo sapiens
  misc_feature 1..22: note = chr5:179244320-179244342
  misc_feature 1..22: note = hyper
  source 1..22: mol_type = genomic DNA
gggcgttcgtcctccatccctc

SEQ ID NO: 30191 - DNA, 34 bp, Homo sapiens
  misc_feature 1..34: note = chr5:179498329-179498363
  misc_feature 1..34: note = hyper
  source 1..34: mol_type = genomic DNA
cctggctggggctgtcggccgggcagcgcgggag

SEQ ID NO: 30192 - DNA, 30 bp, Homo sapiens
  misc_feature 1..30: note = chr5:179498867-179498897
  misc_feature 1..30: note = hyper
  source 1..30: mol_type = genomic DNA
ctcacgtccactgcccgcctgtggggacgc

SEQ ID NO: 30193 - DNA, 55 bp, Homo sapiens
  misc_feature 1..55: note = chr5:179635756-179635811
  misc_feature 1..55: note = hyper
  source 1..55: mol_type = genomic DNA
cccagcaggggctggcggcgcgcggcagagctgggtctcccgccaggtggccggg

SEQ ID NO: 30194 - DNA, 39 bp, Homo sapiens
  misc_feature 1..39: note = chr5:179636267-179636306
  misc_feature 1..39: note = hyper
  source 1..39: mol_type = genomic DNA
ggagctgcgggagcccgcgggcggcgctgcacaccaggg

SEQ ID NO: 30195 - DNA, 135 bp, Homo sapiens; identical to SEQ ID NO: 8263
  misc_feature 1..135: note = chr5:179779648-179779783
  misc_feature 1..135: note = hyper
  source 1..135: mol_type = genomic DNA

SEQ ID NO: 30196 - DNA, 173 bp, Homo sapiens; identical to SEQ ID NO: 8264
  misc_feature 1..173: note = chr5:179779840-179780013
  misc_feature 1..173: note = hyper
  source 1..173: mol_type = genomic DNA

SEQ ID NO: 30197 - DNA, 1257 bp, Homo sapiens
  misc_feature 1..1257: note = chr5:179780035-179781292
  misc_feature 1..1257: note = hyper
  source 1..1257: mol_type = genomic DNA
cgggtgaggggcagccaggcccggccgacgacagcccctcggtaggggcccggggcagatcggcgcccccagccaggtcctcggcgcctgcttgcgggcggaggcgcggagaggctgcggcgccgggacccgcggacggcgtggaggaggcggctcgggcgggcgcggcactcaccgcacatcgtggctgcttctcgggctccttcgcggctcgagggggtctgcccgttcggacgctggggctcctccgtgggctcctccgtgggctccgtgggctccgtgggctccgcgggctccagctcccgtccgctcggcctccagcccttataacccggagccctccgagagggcggggaagggggcggggaaggggcggggcttcccccgcccgcctgctcccattggcccccggttgtcgtgacaacgacgggacccggcccccaggagccagggaggggggccgaggggcggctcccaggcgcgggtcgggcgtgtaaggctggggcgccgggcgccagatcccggagcggggcttagggcaaccaacggcccgagttcagaccccgactcaaccagagtaggcgtggaagccgggcagggcccgatcgcgctgtgcctccgctttcccgtctgtgaaacggggctacccagggaagctccctcccacggggtgctgagaagtcagacgggccgcgtaaggggcagagcgaggggtccggcatcactcgcgcgctccggaaacccgcgtgagccgctgttcctgccgcgctcccatctgagtgacaggcttgtttcagagctccgcagacctctaagcctggccctcaccctgcgtggagagaacgcccgggcttggcggagagacgagaaaaccgaggctcccggaggcagacaaggactctgccaaaaccggacgccgcggcggtggcagaattcgaccctgggatttgccgcggagcccgagcttgaaggcgagggttccgcaggttgtgaacgaagctggaggcgccccaggaagccccgaccccacccgcgccgagctgccccctccccagatctgcctcgcgctgcaggcccgcgagggacccgggggttcctacgcctggggtcggaatccgaccccccagtgaggcaccaaggcccgcgtttctccgccctggttcccggccgtccctcccgttccccctgcactctgggcccctcgtctcccgaggaaggtcacgagaaccggcccaacgtttgcgcactttgaagttt

SEQ ID NO: 30198 - DNA, 62 bp, Homo sapiens
  misc_feature 1..62: note = chr5:179867486-179867548
  misc_feature 1..62: note = hyper
  source 1..62: mol_type = genomic DNA
aaggggatggagggtcgcattaaacaacacctcaaggcagcccagatcgggagggagggtcc

SEQ ID NO: 30199 - DNA, 544 bp, Homo sapiens
  misc_feature 1..544: note = chr5:180017145-180017689
  misc_feature 1..544: note = hyper
  source 1..544: mol_type = genomic DNA
atggacggtcctccccgcggcggggttttcagccctcgcgggtgggcagcgtcttgtcctcaggtgtagatgctccagtctcggctcagccaaacactgtcagggccccctggaaagcagaagccgagcttgagtgcccccagccctgccaccaagaactcaggcgggggcgcggcagcggccggctctgtggggagcgggagcggggcggttccgctggcgtctccgggggacgcgcacccgcgcggggccatctccgccttccccgcccctgcagctcggatgcgccccacccagttcccacccggagacccgggcttctcccagggacagggcttggaggggcaggacgggaaacagccctgacgtagggccgggacacctctggtgcagttttgaggctggccgggaagggatgcccgcgcaggaagggcacccggggtgcccactttaccagcagggccttcagggccttcacggcccccacggcctggggacccagctcagccacacacttctgggagccctctatgaggtggttcac

SEQ ID NO: 30200 - DNA, 442 bp, Homo sapiens; identical to SEQ ID NO: 2726
  misc_feature 1..442: note = chr5:180017690-180018132
  misc_feature 1..442: note = hyper
  source 1..442: mol_type = genomic DNA

SEQ ID NO: 30201 - DNA, 195 bp, Homo sapiens
  misc_feature 1..195: note = chr5:180018484-180018679
  misc_feature 1..195: note = hyper
  source 1..195: mol_type = genomic DNA
ggggaacctgcggctgcccgggcaaggccacgaggcttcttatacccggtcctcgcccctccagcgccggcctcgcccgcgctcctgagaaagccctgcccgctccgctcacggccgtgccctggccaacttcctgctgcggccggcgggccctgggaagcccgtgcccccttccctgcccgggcctcgaggact

SEQ ID NO: 30202 - DNA, 67 bp, Homo sapiens
  misc_feature 1..67: note = chr5:180075791-180075858
  misc_feature 1..67: note = hyper
  source 1..67: mol_type = genomic DNA
tcctcagctggccttcgaggcccctgtcccctcaaatccggggacccctggccttccgccccttctg

SEQ ID NO: 30203 - DNA, 405 bp, Homo sapiens; identical to SEQ ID NO: 513
  misc_feature 1..405: note = chr5:180076053-180076458
  misc_feature 1..405: note = hyper
  source 1..405: mol_type = genomic DNA

SEQ ID NO: 30204 - DNA, 552 bp, Homo sapiens
  misc_feature 1..552: note = chr5:180076532-180077084
  misc_feature 1..552: note = hyper
  source 1..552: mol_type = genomic DNA
cgccccgctgcatctccggccgctgcgcgtgggtccgacccgagcggccgcggctcggggctgaaagtgtccgcgcgggcgccggctggcctggggcggggcggggcggggcgggggccggaggcgggcccgggattcaggccgctccccgcgcccccctccccccgtccctcccagcccgccgcggggcgtccggtgcacccgagcagtgcgcgctccgcaccacagggtccgggccccctcctgggcggctccgggcgcggggacgcgggtaacgcagacggtctcgcgatgcgctccggaggtgatggagcctggtgggcaaaggggagcaaaatgcggcacgcgctcttttccgtcctttctttccatcggtaaaatctagactaaacaagaaagcaatccttgtaaaaatagtatgttacatctttgaaaatagtggcaccagccggcgtaacatagggagacccagtctcaaaaataaacaagcaaataaataaaataatacgccgagcttggttgtgcgcgcctgtaatcccagcttctcggggg

SEQ ID NO: 30205 - DNA, 258 bp, Homo sapiens
  misc_feature 1..258: note = chr5:180100616-180100874
  misc_feature 1..258: note = hyper
  source 1..258: mol_type = genomic DNA
cgtttttgtcgcttccagctcggtttcccctgtggtcagttggagccagggtggggaatctgcagcttgcagaggggaccactgcgcctcctgcctgaggcgggctggggggtcgttgtcctcgcagcgttaaggcgagtctgggacaggaccccggcaccccctccggatctgtggcatcctccaggactccggcgcaggacgcgctccaggagccgctccttcagggcctccggtgcgcgcagtccgggcgccgga

SEQ ID NO: 30206 - DNA, 153 bp, Homo sapiens; identical to SEQ ID NO: 2731
  misc_feature 1..153: note = chr5:180101015-180101168
  misc_feature 1..153: note = hyper
  source 1..153: mol_type = genomic DNA

SEQ ID NO: 30207 - DNA, 346 bp, Homo sapiens
  misc_feature 1..346: note = chr5:180527353-180527699
  misc_feature 1..346: note = hyper
  source 1..346: mol_type = genomic DNA
atctcccacccttgccgccctctggatccagcgtccaccgagcactttttccagttccttcattctgcgcgcgagtcagcttgctgtgtagggacagaagatgacgaagtgaattcctgcagcccgccgagctgttgctgtcgccctgggagcagggcacgctcttgaccatccactcgcagatctgcgacagcgcgagccgcttctccgccgagctctcgtcggccctggtgctgaggtcggcgtgggacaggctgcgcgacgcggtgcgacgggacgagctgcccctgcgctgctgcccggcggaggcggggtcccgggtgggtgctgcggcgcggcgtcccgg

SEQ ID NO: 30208 - DNA, 46 bp, Homo sapiens
  misc_feature 1..46: note = chr5:180527793-180527839
  misc_feature 1..46: note = hyper
  source 1..46: mol_type = genomic DNA
cgactggaaatccgggtgcacctccgccccccggggcgcttcggcc

SEQ ID NO: 30209 - DNA, 29 bp, Homo sapiens
  misc_feature 1..29: note = chr5:180530748-180530777
  misc_feature 1..29: note = hyper
  source 1..29: mol_type = genomic DNA
gctgggattacaggcgtgagcccccgcgc

SEQ ID NO: 30210 - DNA, 139 bp, Homo sapiens
  misc_feature 1..139: note = chr5:180531166-180531305
  misc_feature 1..139: note = hyper
  source 1..139: mol_type = genomic DNA
gctgccacaccctctcgtccggtctcccatgcccccttatgctaccgcgtcgggcatgaaaacttccttttctttcttctccttctttccttccttttgagacagggtcttgctctgtctccgccgctggagtgcagtc

SEQ ID NO: 30211 - DNA, 284 bp, Homo sapiens
  misc_feature 1..284: note = chr5:180600774-180601058
  misc_feature 1..284: note = hyper
  source 1..284: mol_type = genomic DNA
cctacaacactccaccgctatctccacctggttaaggaaaaaaggctatcaagggtatttatacctttgcctttccgcctcaaccattggaacctgggacgaactgaacccacttcacttgctgtggacaccagcgccgacgaacttcgcacaaagcccgtccactggacagctgcgcgctgccaaatggaatccagatcccgagcaagggtgcggcccagggagagttccaaggaactgggggacaaaatgggcaaaccacaacaagctggcagcggtgggat

SEQ ID NO: 30212 - DNA, 284 bp, Homo sapiens
  misc_feature 1..284: note = chr5:180601118-180601402
  misc_feature 1..284: note = hyper
  source 1..284: mol_type = genomic DNA
cgctaccttcctccgggggttcacctgcatcttttccttccttataaaacatccccagggttcccgggccaacaaggcgttggggcgaatccacagggcatcgcagaaccaccgccttccagcaggattcgcgggccagaggcaccagctgggaaacggctccaccagcgccccagcagagaagattcgcgacgcgcaggcctcggaatttgctttgggggccactcagaaagtcagaaagtcacccacattggccctctttggggaggcggcgtgagaggagg

SEQ ID NO: 30213 - DNA, 243 bp, Homo sapiens
  misc_feature 1..243: note = chr5:180632859-180633102
  misc_feature 1..243: note = hyper
  source 1..243: mol_type = genomic DNA
cacaccctctctcctcgctcactctggaggccacttggatcaagctttcgcccgcaccctcctcagaaaccgcccttgccaatgtcaccgggaacttcagcaattctcacccaaaggcgaagacctcgcctcacctcatctgcccccggatgctccctccttcccgacttcccttctcagggccttccaggacccagtgtccccgatcttcttgctgttcctgaaccccgtggcctctgcgct

SEQ ID NO: 30214 - DNA, 553 bp, Homo sapiens
  misc_feature 1..553: note = chr6:391190-391743
  misc_feature 1..553: note = hyper
  source 1..553: mol_type = genomic DNA
atgttctctaaacaccgcggagaggcagggttcccggtgatggccttgccgagggtgctcccgcaacctccacctccagttctctttggaccattcctccgtcttccgttacacgctctgcaaagcgaagtccccttcgcaccagattcccgctactacacgccccccatttcccgccctggccacatcgctgcagtttagtgattgactggcctcctgaggtcctggcgcaaaggcgagattcgcatttcgcacctcgcccttcgcgggaaacggccccagtgacagtccccgaagcggcgcgcgcccggctggaggtgcgctctccgggcgcggcgcgcggagggtcgccaagggcgcgggaaccccaccccggccgcggcagcccccagccttcacgccggccctgaggctcgcccgcccggccggccccggctctcggcttgcaaagtccctctccccagtccaacccccggcccccacaggcctcggcgccccgccccgccccaggccccgccccagagagttctataaagttcctctttcccacctc

SEQ ID NO: 30215 - DNA, 20 bp, Homo sapiens
  misc_feature 1..20: note = chr6:391744-391764
  misc_feature 1..20: note = hyper
  source 1..20: mol_type = genomic DNA
cactctcagtttcaccgctc

SEQ ID NO: 30216 - DNA, 135 bp, Homo sapiens; identical to SEQ ID NO: 517
  misc_feature 1..135: note = chr6:391765-391900
  misc_feature 1..135: note = hyper
  source 1..135: mol_type = genomic DNA

SEQ ID NO: 30217 - DNA, 25 bp, Homo sapiens
  misc_feature 1..25: note = chr6:392409-392434
  misc_feature 1..25: note = hyper
  source 1..25: mol_type = genomic DNA
gctctcccgggcctgctccggggtc

SEQ ID NO: 30218 - DNA, 372 bp, Homo sapiens; identical to SEQ ID NO: 519
  misc_feature 1..372: note = chr6:392587-392959
  misc_feature 1..372: note = hyper
  source 1..372: mol_type = genomic DNA

SEQ ID NO: 30219 - DNA, 115 bp, Homo sapiens; identical to SEQ ID NO: 520
  misc_feature 1..115: note = chr6:393124-393239
  misc_feature 1..115: note = hyper
  source 1..115: mol_type = genomic DNA

SEQ ID NO: 30220 - DNA, 233 bp, Homo sapiens; identical to SEQ ID NO: 521
  misc_feature 1..233: note = chr6:393240-393473
  misc_feature 1..233: note = hyper
  source 1..233: mol_type = genomic DNA

SEQ ID NO: 30221 - DNA, 196 bp, Homo sapiens
  misc_feature 1..196: note = chr6:711053-711249
  misc_feature 1..196: note = hyper
  source 1..196: mol_type = genomic DNA
tccagtggcatttcccgtcttacacgatgagcttcatccacgttctccataaccccctccccgccacgggaagcgtcagccacctggaacagccctattctgctcggttgtaaaaagcgtcaggcgcttttgatttgaaaagcgttaggcctgggaatcgctgttgctccctcggtgggcacgccctgctgacacg

SEQ ID NO: 30222 - DNA, 189 bp, Homo sapiens
  misc_feature 1..189: note = chr6:1311809-1311998
  misc_feature 1..189: note = hyper
  source 1..189: mol_type = genomic DNA
ctacagaagcacatacgccgcgtgcagcttaggcccgagcaaagtccctgctcccctagacccagtcccttcaggtgtccccctaggggaactgtggcgtgtccccccaaccaggcgcactcgcctaaactgcgtccccgaactccagggcgcagggagccctcgcgggctgcccggggctggggccca

SEQ ID NO: 30223 - DNA, 30 bp, Homo sapiens
  misc_feature 1..30: note = chr6:1312754-1312784
  misc_feature 1..30: note = hyper
  source 1..30: mol_type = genomic DNA
agagaaaaagcccagcggaagaggactccg

SEQ ID NO: 30224 - DNA, 62 bp, Homo sapiens
  misc_feature 1..62: note = chr6:1314000-1314062
  misc_feature 1..62: note = hyper
  source 1..62: mol_type = genomic DNA
ggcggcggcccccgccaagccactccgaggcccggcggccggcggcgcgcacctgtactgcc

SEQ ID NO: 30225 - DNA, 277 bp, Homo sapiens; identical to SEQ ID NO: 2742
  misc_feature 1..277: note = chr6:1378199-1378476
  misc_feature 1..277: note = hyper
  source 1..277: mol_type = genomic DNA

SEQ ID NO: 30226 - DNA, 210 bp, Homo sapiens
  misc_feature 1..210: note = chr6:1379267-1379477
  misc_feature 1..210: note = hyper
  source 1..210: mol_type = genomic DNA
cgaaaccaccccggggaaagccgtaggggcgcgccggcccacgcgggaccgagttcagaggactctgcaccgtcagtttcagggccgacgtttatagagcgcttcccacgtgccgcacgcggttctaagagcttggcttgtattaattcgtttaatcctcccagcaacactgttaggcattataatgatcccaatcgtagaagtcaaaaa

SEQ ID NO: 30227 - DNA, 253 bp, Homo sapiens
  misc_feature 1..253: note = chr6:1379699-1379952
  misc_feature 1..253: note = hyper
  source 1..253: mol_type = genomic DNA
cggggggaagacagtcgccggccgccgggctcctgccacgctgtggcgcgcgtggaaggtgagggtcctccgctgtcccgccgcctcccacagggcggcccagagcctgcatcttttgcaaagggaacataggatggagagaaagaaagtcccgcctgaaataagcaaacgcggtggcggctttgcggtcggccacgtccgctaggaacccgcgaggcgcccttgcgagctgcgcagtcgagttttctttcca

SEQ ID NO: 30228 - DNA, 191 bp, Homo sapiens
  misc_feature 1..191: note = chr6:1381893-1382084
  misc_feature 1..191: note = hyper
  source 1..191: mol_type = genomic DNA
cagagaaccaaataacggaactgaatgatcgtttcttcagcaaagcctaaagacgcttgcgtcccgcggagaggtgcccacgcgcgactcggctgccccctcttcttgcgggtccgggtagggtagggcgggaacgcgggacgtgccctaagcgggccagccgagcgcgagacaggcgatgctgcagaagc

SEQ ID NO: 30229 - DNA, 186 bp, Homo sapiens
  misc_feature 1..186: note = chr6:1382452-1382638
  misc_feature 1..186: note = hyper
  source 1..186: mol_type = genomic DNA
cacccacgaggataccgcgaccaagccaccaaagcactctctggccaggccgagaccccttttcccccgggccccaagagaaaaaagcactttctcctaaaacacgaactccccgcggaggggcccggggctgcctggcacggggcagggtgtgcggctgccgtgcgggcgcgggccagagtcacg

SEQ ID NO: 30230 - DNA, 448 bp, Homo sapiens
  misc_feature 1..448: note = chr6:1382993-1383441
  misc_feature 1..448: note = hyper
  source 1..448: mol_type = genomic DNA
gtgtggggcacagggcgtgaggggaggatgagctccccctgagcagatggagatttctccttgcctgggccgtttgacccccaaagccttgcagactggccgcgtgggtgccatggggcgatttcttgggaaaggagggcagcagaaaggcccgtgggctctcagcgccttggagtcaggggagcaggaaggggagtggaggtgcggacacgcctccagccaccgtgctcccctaggaggatctcccttcagcccctgtagaaccctgcatctcaaccaccctcgtgcatgtggtttaccttggcatagatttccaagccgctacagaaaacctgtccacctcccccaaggtggaggcgggagttgggaggcaggggtgctggaaagggtcacctggctcaagccgaccccaggtctgacgggcggagagcctcgagggccacgcccc

SEQ ID NO: 30231 - DNA, 32 bp, Homo sapiens
  misc_feature 1..32: note = chr6:1383677-1383709
  misc_feature 1..32: note = hyper
  source 1..32: mol_type = genomic DNA
caaactcatctagggcgcgcccggagcttccc

SEQ ID NO: 30232 - DNA, 41 bp, Homo sapiens
  misc_feature 1..41: note = chr6:1383859-1383900
  misc_feature 1..41: note = hyper
  source 1..41: mol_type = genomic DNA
ggggcccggggcctttggccaggctgcggggaggggtgggg

SEQ ID NO: 30233 - DNA, 72 bp, Homo sapiens
  misc_feature 1..72: note = chr6:1384108-1384180
  misc_feature 1..72: note = hyper
  source 1..72: mol_type = genomic DNA
gctcggcggggaggacgagaggggagttttgatgcgccaggaagttcatctatcgcccaggcgctcaggacc

SEQ ID NO: 30234 - DNA, 19 bp, Homo sapiens
  misc_feature 1..19: note = chr6:1384625-1384644
  misc_feature 1..19: note = hyper
  source 1..19: mol_type = genomic DNA
cgagcgttgccacagccgg

SEQ ID NO: 30235 - DNA, 325 bp, Homo sapiens
  misc_feature 1..325: note = chr6:1384971-1385296
  misc_feature 1..325: note = hyper
  source 1..325: mol_type = genomic DNA
tctccactcactccccgcaaccccgcaactcgccacccctaaacgcagcgggctgtaggcgaagtcgaagaggtgctccgcctggtaccgcggcctgcgcactgggatcggggcctgcaggccgctgggctggctcctgggatcatcccaaggttttggtctcgcaaccgaggggacccgcgcccggcaatttgggaagtgcggaaatggggtgaggccggtcttcgcttgagggtctcgtagattggacccctttttcccccttcaagcaccctcagacctggccagtgggtcatcgagtcgtgcccaccgcccaggccaggag

SEQ ID NO: 30236 - DNA, 33 bp, Homo sapiens
  misc_feature 1..33: note = chr6:1385653-1385686
  misc_feature 1..33: note = hyper
  source 1..33: mol_type = genomic DNA
ccagcactgagttctcgccgtccacatttagaa

SEQ ID NO: 30237 - DNA, 35 bp, Homo sapiens
  misc_feature 1..35: note = chr6:1386121-1386156
  misc_feature 1..35: note = hyper
  source 1..35: mol_type = genomic DNA
ggagagaggacccatcgcggcggaggctgcatagt

SEQ ID NO: 30238 - DNA, 269 bp, Homo sapiens
  misc_feature 1..269: note = chr6:1389006-1389275
  misc_feature 1..269: note = hyper
  source 1..269: mol_type = genomic DNA
acactaactggggtgcgggggtggggggaagaagtggaagcaaatgcaaccctaagtcccatgagatccaggtttccagagtctttgaaacttggcctaggtttctcagtgtaaatccctctgctcaaagttccgaaaacgtccacgatcgccagcggcccgcaaccctgcggcggcccccagtcgccctaacaattgtcggggagcctgcaggccctgccagaaagagagaggattggcacgttacctttgggcgtctggcaccccgg

SEQ ID NO: 30239 - DNA, 411 bp, Homo sapiens
  misc_feature 1..411: note = chr6:1389950-1390361
  misc_feature 1..411: note = hyper
  source 1..411: mol_type = genomic DNA
gctcggggagggatgcgccgggcgttgcctcccgcccgccgccgccgccgccgccagaagccccagaggagctgagggaggcgacgccgaagcgctggcccggagtggccacggctgcagcccgggcggcgggctagggcgctcgcagggcttctgggccgaccccgctccggcgcctccgcttcccgcccggggcccgccctcgcggcccggcctcgctcccgggtcccagatgaccaccgagggcgggccgccgccggccccgctccgccgcgcgtgcagcccggtccccggcgcgctccaggccgccctgatgagcccgccgcccgccgccgccgccgccgccgccgccgccccggagaccacctcctcctcctcgtcgtcgtcctccgcctcctgcgcctcgtcctc

SEQ ID NO: 30240 - DNA, 44 bp, Homo sapiens
  misc_feature 1..44: note = chr6:1390362-1390406
  misc_feature 1..44: note = hyper
  source 1..44: mol_type = genomic DNA
tcctcctccaattcggccagcgccccctcggctgcctgcaagag

SEQ ID NO: 30241 - DNA, 145 bp, Homo sapiens
  misc_feature 1..145: note = chr6:1390423-1390568
  misc_feature 1..145: note = hyper
  source 1..145: mol_type = genomic DNA
cgggcgccgggagcgggggcgccaagaaggcgagctcggggctgcggcggcccgagaagccgccctactcgtacatcgcgctcatcgtcatggccatccagagctcgcccagcaagcgcctgacgctcagcgagatctaccagtt

SEQ ID NO: 30242 - DNA, 451 bp, Homo sapiens; identical to SEQ ID NO: 8299
  misc_feature 1..451: note = chr6:1390955-1391406
  misc_feature 1..451: note = hyper
  source 1..451: mol_type = genomic DNA

SEQ ID NO: 30243 - DNA, 210 bp, Homo sapiens
  misc_feature 1..210: note = chr6:1605301-1605511
  misc_feature 1..210: note = hyper
  source 1..210: mol_type = genomic DNA
aaggaaggctggctgcggccccggcgcctgggtccgctgcggcgccgggccggagacctgggaacagccagccacctgcaaggttgcagcccacctcaccccgccggcggctccggggctgtctgtgggtctgtctcacggggcaaagcctttcttcccacacccacagccaaggcgcgtccgtgcaggggcacacgccttctgctccag

SEQ ID NO: 30244 - DNA, 370 bp, Homo sapiens
  misc_feature 1..370: note = chr6:1611389-1611759
  misc_feature 1..370: note = hyper
  source 1..370: mol_type = genomic DNA
cccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccct

SEQ ID NO: 30245 - DNA, 10 bp, Homo sapiens
  misc_feature 1..10: note = chr6:1614190-1614200
  misc_feature 1..10: note = hyper
  source 1..10: mol_type = genomic DNA
ccgggaagat

SEQ ID NO: 30246 - DNA, 49 bp, Homo sapiens
  misc_feature 1..49: note = chr6:1614286-1614335
  misc_feature 1..49: note = hyper
  source 1..49: mol_type = genomic DNA
cggcgctaggtcccggggctgcctccagcttcctcgggttacagcctct

SEQ ID NO: 30247 - DNA, 39 bp, Homo sapiens
  misc_feature 1..39: note = chr6:1619896-1619935
  misc_feature 1..39: note = hyper
  source 1..39: mol_type = genomic DNA
cagccccgcgttccccgcgcccggcgctgccggggaaaa

SEQ ID NO: 30248 - DNA, 471 bp, Homo sapiens
  misc_feature 1..471: note = chr6:1625220-1625691
  misc_feature 1..471: note = hyper
  source 1..471: mol_type = genomic DNA
tgccgcagggctggccgcgccaagcgcgcgtcctacccaaagccaccagccccgcggggaagggactcgggctgtggggcgcgaggccccaggactcggggacccctctacctcggcggcagcgtgcgaccctctttctaacgcggccgtggatgtttcttcccgggccgcagccaagcgcggttcttcctgggcggtggctttgggcttttcgtacccacagtcaagtcagttcacgtcgcctcccgcacacacgcgttcataaaacgaaactggagtttcacgaagcaattcttaggcttagcgtccaggaacgctgtagacggtctattctattctacccctattctactcggttcgattctgttcctaagaaaatgccgatctcgacccacttgtacttccacgagcggagctgcagccagcagctctgcaggaccccgcactgcccgccaccgtcccctctggcag

SEQ ID NO: 30249 - DNA, 500 bp, Homo sapiens
  misc_feature 1..500: note = chr6:2903017-2903517
  misc_feature 1..500: note = hyper
  source 1..500: mol_type = genomic DNA
ctgggattacaggcgtgagccactgcgcccggccgagactggtgactgtaaaggacagtgaagaagcaggacagacgtcatcctgcggatcccagagcagagaagagcagtgagaacacagggccggcaggtggggaggaggctgcaggggagggcttcggccagggaagggcagcgaggagacatccgggagggaggcgtccgcggtggctgtgggccgccaaggcggagaccggctgccgctcccaggcaccccccagagaccgttgctgaccccaccgagaaggcaccgcctccccggggctcttggctgagcgacctctcctgtcctccggtcccatcactcggtggcagccggtggacctgaagctcgccactcccgtcccctaccccagccgtgcgcggggacgccctcacctgccacctagtccagcgctgccgccgtctccgtgccgcgctccgagcctggacgccgacccccgaggcgcaggacccggccc

SEQ ID NO: 30250 - DNA, 92 bp, Homo sapiens
  misc_feature 1..92: note = chr6:3228298-3228390
  misc_feature 1..92: note = hyper
  source 1..92: mol_type = genomic DNA
caggtgctccagtgccggcaggtgggagggctgaggtggcacaggctgctccgccacctcggactgcggctcctactcggccactggccaga

SEQ ID NO: 30251 - DNA, 90 bp, Homo sapiens
  misc_feature 1..90: note = chr6:3228984-3229074
  misc_feature 1..90: note = hyper
  source 1..90: mol_type = genomic DNA
agggtggcccaagcccgagtaacaaactttcttatcttccatcgcggcgacctggaggtccgaggcttcgtgctgcggttgaagggtggg

SEQ ID NO: 30252 - DNA, 66 bp, Homo sapiens
  misc_feature 1..66: note = chr6:3229387-3229453
  misc_feature 1..66: note = hyper
  source 1..66: mol_type = genomic DNA
acacttcggaagggccgttggcgaggtgacgtgacctctttcatcccctggcgagaaaggccgaat

SEQ ID NO: 30253 - DNA, 358 bp, Homo sapiens
  misc_feature 1..358: note = chr6:3231580-3231938
  misc_feature 1..358: note = hyper
  source 1..358: mol_type = genomic DNA
aggccttccctcctccgcctgggaagccagcggccccggcggagctgcccggcactgtttagtcgcaggggctgcggggtggcagcctcagagccctgtccttccgcagccgtgggccccgcagggaccagccaagcagggcaaccaaaagctggaaccagcagcgaaaaccccgagcccacgaacgcagcgcagtgcgggaacacttgccctttgttcctcagtaaggccgggtgttttcgcatccccggaggttgtgaatttgagttataatggcctcggtcgggactgagagagccgagcttccacgagagagctttgcctgctttgtcctacaaatcggcggagggagtagcat

SEQ ID NO: 30254 - DNA, 37 bp, Homo sapiens
  misc_feature 1..37: note = chr6:4135160-4135197
  misc_feature 1..37: note = hyper
  source 1..37: mol_type = genomic DNA
cttcaaggccaccaccgtgtttcggttttgttcccta

SEQ ID NO: 30255 - DNA, 41 bp, Homo sapiens; identical to SEQ ID NO: 8306
  misc_feature 1..41: note = chr6:4775411-4775452
  misc_feature 1..41: note = hyper
  source 1..41: mol_type = genomic DNA

SEQ ID NO: 30256 - DNA, 137 bp, Homo sapiens
  misc_feature 1..137: note = chr6:5026605-5026742
  misc_feature 1..137: note = hyper
  source 1..137: mol_type = genomic DNA
gacagcttagcctcccgcctcccagagcctctcctgaggctcccacccagcgcctttctttccttcctcccttcgtttatttctgggacccctccccacaaactttctttaaagcctggtcacgtgaggtctcctct

SEQ ID NO: 30257 - DNA, 591 bp, Homo sapiens
  misc_feature 1..591: note = chr6:5085738-5086329
  misc_feature 1..591: note = hyper
  source 1..591: mol_type = genomic DNA
ggctaagtttggaggcgccgggaccagcgcccttccgagaggccccgccggccgaggagctgcccgccccggtggtcccctgtgtgcagggtggcggcgacggcggtggcgcttcggagaccccgagtcctgacgctcagctaggggataggcccctgtccccgaaggaagaggccgccccccaggagcaggaggagctgctggaatgccgccgccgctgccgcgcgcgctccttttccttgcccgccgaccccatcttgcaggcggccaagttcctgcagcagcagcagcaacaggcggtggcactgggcggcgagggggcggaggacgcacagctcggcccgggcggctgctgcgccaagtgcaagaagcgggtgcagttcgcggacacgctggggctaagcctggccagcgtgaagcacttcagcgaggcggaggagccgcaggtgccgcccgccgtgctctcgcgcctgcgaagcttccctatgcgtgccgaggacctggagcagctcggggggctgctggccgcggcggcagtggccgcgcccctttcagcgccgccttcccggctccggccgctcttccagctcc

SEQ ID NO: 30258 - DNA, 30 bp, Homo sapiens
  misc_feature 1..30: note = chr6:5851459-5851489
  misc_feature 1..30: note = hyper
  source 1..30: mol_type = genomic DNA
cgctgcacctcggggcgtgttctcccaccc

SEQ ID NO: 30259 - DNA, 114 bp, Homo sapiens
  misc_feature 1..114: note = chr6:5851703-5851817
  misc_feature 1..114: note = hyper
  source 1..114: mol_type = genomic DNA
ggtgcccacgcgtcccgggcttcaggggagcacctgggaagcgctgggggtcgcgtgcccttggccggaggcctggtcacccgcaggccctgccatcctcggcttggccgctgc

SEQ ID NO: 30260 - DNA, 683 bp, Homo sapiens
  misc_feature 1..683: note = chr6:5996021-5996704
  misc_feature 1..683: note = hyper
  source 1..683: mol_type = genomic DNA
gcctgaagcccactccgtcccactcccaatactcccaccatctcatcagtggggcatgctcgccctggttaatgtcatctccctgaactgccaacgaggctagcagctttgctgcttaaaaccggtaacatcaaccaacatatggagatgtcatcatgattaaacggcaaattatagccgaagacggcgcgataataatctaaacaatcaccacaagaagaaacgttctctaacgctccagttgcggaagcctgcgtttccaagactcgcggccctgcgttcccagggatatctccgtgctcacgtgagcgtggtcctcggcttgggacagacaagggagccccagacaggacgataaggtttggagattcccagggcgatctgggactccgtggcgtgggggcttggaagcgcgtggaggggctgagagaggggagagggcgcccttcctctagggcggccccgtctgggaagcagttggaacagcagtaggagccaggggttcctagagaagaaccctgttaggagagcagaccagcccgcgctcccagtccccgccccctcgccccttctgccccgcccttagcctgcctcttcctagatcttccaggacattgatttccgagtaggaagcccgcgctgctaggggaggggcgtcctctgtgggtcgtgggggggtttcc

SEQ ID NO: 30261 - DNA, 291 bp, Homo sapiens
  misc_feature 1..291: note = chr6:5996952-5997243
  misc_feature 1..291: note = hyper
  source 1..291: mol_type = genomic DNA
atcatcctatttatacgcagaccgaaaataaccattgaaacgaaaccaacaaaatgcaactattttccaaaaccccgagcgtttgctggtgggtgaccaccccgcgcaggtagcgcggatctgctttggttttgactgagaacccgggttttgactgagacctccgtcgggaggaggggactgggtgggagttagcgggcgaaacgattccccggagtggccccgagcggcgcgtgcgtgaacgcgcggccgtaatatatgctgccattaagaatccgtgcagcttccagc

SEQ ID NO: 30262 - DNA, 248 bp, Homo sapiens
  misc_feature 1..248: note = chr6:5997557-5997805
  misc_feature 1..248: note = hyper
  source 1..248: mol_type = genomic DNA
cagttctttctcccccgcctactccaggcctgcagtccccggacccgggtcgcctctgcccatttactccggaatgtttacttctctttaaggccatgcggggcctataaataggagaggtggaatcagccccactgccagatcaatagggcccgtctcctcgccatttcagctgagctgtcttattaattatgaaaggattcacctgatccctgccagggaacacagcctctcggcccctctgctgg

SEQ ID NO: 30263 - DNA, 260 bp, Homo sapiens; identical to SEQ ID NO: 525
  misc_feature 1..260: note = chr6:6003269-6003529
  misc_feature 1..260: note = hyper
  source 1..260: mol_type = genomic DNA

SEQ ID NO: 30264 - DNA, 395 bp, Homo sapiens; identical to SEQ ID NO: 526
  misc_feature 1..395: note = chr6:6004349-6004744
  misc_feature 1..395: note = hyper
  source 1..395: mol_type = genomic DNA

SEQ ID NO: 30265 - DNA, 492 bp, Homo sapiens
  misc_feature 1..492: note = chr6:6004836-6005328
  misc_feature 1..492: note = hyper
  source 1..492: mol_type = genomic DNA
cgtgaacatttctgtcttttaaaactgtgactccttggactctagccttctctgggaggccgggaggctgcgcgcgggacggattttgcaggcgcacgcgtcccagcaggtcgcagcccgtgggtccctcgctgtccttcctgaaccccgcttaggcgagactctagcgggtgaccctggctccttccctgtcctctctgccgtccccttcttgtgcggtttccatccgttcattcattcgttcgacctctcattcattccgaacttcctcctgctgcgtcttctttcgtgttcaccacactcttctacctccccgcccctcccaacccccacttttcttgccaaatgtcaatgatttgggacagctcccagccgtgaattaataaagaccgaggttctgttgcaggaaagggcagacattagggaacaaatacgttcaatttcaattccacagtcaacaaatagtcatttttggaccgaggttaatgtgtt

SEQ ID NO: 30266 - DNA, 54 bp, Homo sapiens
  misc_feature 1..54: note = chr6:6006358-6006412
  misc_feature 1..54: note = hyper
  source 1..54: mol_type = genomic DNA
gttccctatcactctcgatttgcccaccagccgggtctgcggtgcccgtgcaaa

SEQ ID NO: 30267 - DNA, 278 bp, Homo sapiens
  misc_feature 1..278: note = chr6:6006674-6006952
  misc_feature 1..278: note = hyper
  source 1..278: mol_type = genomic DNA
aagggggaaaaaaaccgtgtccagaaaatgtccggccgcacacatttcctggcgaacatttggaatctatagctttaggaaaaaccgatctgggacgcgctagtccccaggaactgatgcccccaccctcgggggattgccggcttctccgcaccctggggcggccgcggacccgctagtccccctccgcgcctcgggccggggcaggctgcctcccgcctccagcctccagccgggctgagcggccacttacctatttgcaccgcgaggatcagtga

SEQ ID NO: 30268 - DNA, 421 bp, Homo sapiens
  misc_feature 1..421: note = chr6:6007249-6007670
  misc_feature 1..421: note = hyper
  source 1..421: mol_type = genomic DNA
acagcctcacgcccacgagcaggcctgacgtgggggatgacacggaatgattttttttttaatatagacaccttggtagagaatcgccatttatagtcatcagaagctggaattaatcagatatctccaattaatgtgcgatctgaacgaaattttgcctcccgggggtgagcactttcctattctagcggtcacccctgcctcttcctcgttccgggggccccccagccccgccgcctccctgcgcagaacaggggctccccctcccttccccgccaggagctggggagtcctggcgcgcccactcgattgtttcaacctgctccccctcctccatcagcaccacagagaatccagcccgctctctacgatgcaggggggtttaaaggagcgggagagggaaaaacagctaagctagctc

SEQ ID NO: 30269 - DNA, 778 bp, Homo sapiens
  misc_feature 1..778: note = chr6:6007671-6008449
  misc_feature 1..778: note = hyper
  source 1..778: mol_type = genomic DNA
attaattcgaaagcgctcctcggccgcccgccccctgcgcttgcctaccctctttttctccaacccagcagctgagctctgggcgcagcctggagcgcgtgagcacgcagcccggccccccgcacgagcacacacacacacacacacacacacacacacaaacgcgcgcgcgcacgcccgccagccgcgccgagcgcccccatgcccgcccgcacacaaggcacgcgagcgcgcgcacacgcccaggccccgggggtttggtttgcacacgtggggccccagaaataaacaccgaatgtcctctgaattttacccacctgcgatgccccagcgggccaaaggccgcttcaagggacacagcgacacctgttttagggggcgagtagggcaccggggaaggagcctctgataagacagttttcggatactagtgatttaccaaccaactctcagcgctttaggaaatttccaaggcaagcgctggtgtgcggacttctttctaatcttgatgcgcctcttgggcttatttgttgggctacacacacacgtacccacacgcacacacgtacatcacgtacgcacacgcacacccggacccacacacacctgcactgtcttttgatgctcaggcacagaccctgtgtaggtgtagcctaccctgcaacaaaatacttctgcagctggctttgtgctaggtgcaagctgctatcgacgacagcttgagtcaaaaccgaaaaactaacagggctatttcctttctaaacgcctttaagctctg

SEQ ID NO: 30270 - DNA, 294 bp, Homo sapiens
  misc_feature 1..294: note = chr6:6009258-6009552
  misc_feature 1..294: note = hyper
  source 1..294: mol_type = genomic DNA
ccaggccaccagctgcgggcccccaacctcgctcagactcgtgcagagcccaggcttgggagtggcttaaggttttttgccctcaacgtccttgccttcctcctgcttatccacctgggatcttcacagcatcattttctgggatcctctccaacccctcccctgtaactctgagcgtggggcgctggggatgtggagtaggcagggctgagggcctcaatgaagcgggtgaacccacgcgcgtgcgcacagccgcccgcgccgcgccccgggccgatccggttcttgcccttg

SEQ ID NO: 30271 - DNA, 676 bp, Homo sapiens
  misc_feature 1..676: note = chr6:6546546-6547222
  misc_feature 1..676: note = hyper
  source 1..676: mol_type = genomic DNA
caccgcaaccgcagccgcagccgcggaggggaggccgtgcacccgcccgccgggagagccgcgcgcctgagccgggcgcacgtgggaagtgggccacgagactggagtccaccgagatggaggccccggcactcgggctcaggcctttgtgcttagcacgtactgttggaatccagcacgccctgctccggcgggcgcctccgatcctgaagcgcgcacctgggaactcacgcaccgcccagccgcgaggggcttggcctggctgaaagccacattattctcgaaaacaaccgtgggaagcacacgctgagctcccggggcccctagagtatgcaaagaggccggccctgcgagactaaataagtctctccccctaggacctagtcccttgccaccggctcccgcggccaccgcgcagccagagtgcaccgtccctagggctttggcggtggccagagccagcaagtgcggcggcctggagctggggtggtgagggcggatggcaggttggagaaatgcagccgagccgcaggtttctagaggcctctacagcccctgccatctgggcactgcacagacagacgctgcgtgagacctggagctcgccacctccatgcggcgctgccagccactccgctgcgggtgcaggagcgttccatgtcggggactgagggac

SEQ ID NO: 30272 - DNA, 40 bp, Homo sapiens
  misc_feature 1..40: note = chr6:7051798-7051838
  misc_feature 1..40: note = hyper
  source 1..40: mol_type = genomic DNA
cccgggacggcctagcgcggccctctccttatttatccac

SEQ ID NO: 30273 - skipped

SEQ ID NO: 30274 - DNA, 82 bp, Homo sapiens
  misc_feature 1..82: note = chr6:7726308-7726390
  misc_feature 1..82: note = hyper
  source 1..82: mol_type = genomic DNA
ggtacctgagccgggcgcgcagcagaaagcccacgttggccgctgcggggagcgcggcgtggagaggcgggagaccgaattc

SEQ ID NO: 30275 - DNA, 1069 bp, Homo sapiens
  misc_feature 1..1069: note = chr6:7726700-7727769
  misc_feature 1..1069: note = hyper
  source 1..1069: mol_type = genomic DNA
gaggggcgtgcgccacggtgatgccgggcatctcccgcagctcgtgagcggccccgctccccgctgccccgggtcccactcagtcgccagggagagcgcggggcagcgcacgtgtgcggccagcgaggcccagagtgaccgcgccgcgactcgcaggagccagggcgcaggctgcagtgcagcccggactcagacgcacctggcctggaccgcgcgcctctagagacctgcgcgaggctgtgaggctccccttcctcccctccaagcggttctcctggtgatcgccccttcgccacctctctagcctgggcaactgggggcgccccggacgaccatgagagataaggactgagggccaggaaggggaagcgagcccgccgagaggtggcggggactgctcacgccaagggccacagcggccgcgctccggcctcgctccgccgctccacgcctcgcgggatccgcgggggcagcccggccgggcggggatgccggggctggggcggagggcgcagtggctgtgctggtggtgggggctgctgtgcagctgctgcgggcccccgccgctgcggccgcccttgcccgctgccgcggccgccgccgccggggggcagctgctgggggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcag

SEQ ID NO: 30276 - DNA, 1035 bp, Homo sapiens
  misc_feature 1..1035: note = chr6:7728086-7729121
  misc_feature 1..1035: note = hyper
  source 1..1035: mol_type = genomic DNA
cggccgggccgcggggctccgggagcgctgtccccagcgggcgtgtatttgcggactccctgagcacgttccgcgctttttttcacttctgcccagctctggccaggttaactcaactgcagcaggagagtccagcccgagtgtggccatcctgggaagagggctcttcagtacgattttcccctctaaactgccgccttttgccccctaacttggagtgcagttttcccaccgagacttttagggaatccgacagcggctgggaactttgaaaacttggcatgagtatgtttagaggtatccacggcactaggggaggttgcagagggaagtcccaaaaggaccgcggaaggcgctcggatcccggccgggcggggctcgcttctgtttggggcgggatgaaagctcaactggggtaatccatcctgtgccccggctcacatgcccttggccattgtccccaaaggctgaacctttgatcaatgcagcccaagctgcacgggcagagaaagggtgcggggtaggggccggggttgggcgctgagctcctctgaaccggttgccaggcaacagaatggaaattcacgggcggctaaatggagctccgccacaaatgttctgtggcaaacccggacccagtcacatcgccctttctcccccctcccaccccactgagttttctcatctgtaaatgagaagggtgcagagaagactcttttcttcggagtcagtgcctccggtttgcactgcttttcattcataagctgacttagtttagcgcagacataggatggagggacgcgctgtcagcggacagatcatgggtgcactggctacgcccgggatggttgcagctgcgcggcggggtggggcttcacgggcctccttcccatgtgagacggtggttgtgcccaggccctgaagtgggtgagcagacactcgccaaaggagcacacgggtctcccagccacgtcaaagacgctcatcttttaacggcattacttactggaatgattcccgcgtagactatctggg

SEQ ID NO: 30277 - DNA, 15 bp, Homo sapiens
  misc_feature 1..15: note = chr6:10113574-10113589
  misc_feature 1..15: note = hyper
  source 1..15: mol_type = genomic DNA
gccgactggggagcc

SEQ ID NO: 30278 - DNA, 55 bp, Homo sapiens
  misc_feature 1..55: note = chr6:10113619-10113674
  misc_feature 1..55: note = hyper
  source 1..55: mol_type = genomic DNA
cgggtgcgcaggcctggcccagcgggggcgccgggagagccggcccaattatgat

SEQ ID NO: 30279 - DNA, 86 bp, Homo sapiens; identical to SEQ ID NO: 529
  misc_feature 1..86: note = chr6:10381507-10381593
  misc_feature 1..86: note = hyper
  source 1..86: mol_type = genomic DNA

SEQ ID NO: 30280 - DNA, 275 bp, Homo sapiens
  misc_feature 1..275: note = chr6:10381694-10381969
  misc_feature 1..275: note = hyper
  source 1..275: mol_type = genomic DNA
cgccggctaagggcagcctgcggcaggtccccgagcctgagcactcctcctatctggggcctgagaggacgctctgggctttttcccaggcccagggtgcgcggcctgctagcgcctttcgaggcacagtcccaagataggctcttgtccttcgacgcccccttggcacaagcgcactggcgccctccgctcaacccaccttgcctttggggcgggcttcaaccctgggaagacaggcctgggggaagcgagaggagaggcccgaatagaggttc

SEQ ID NO: 30281 - DNA, 46 bp, Homo sapiens
  misc_feature 1..46: note = chr6:10382321-10382367
  misc_feature 1..46: note = hyper
  source 1..46: mol_type = genomic DNA
cgaggggcctaggttagggacacgctcttctcgctgggtcccaagc

SEQ ID NO: 30282 - DNA, 272 bp, Homo sapiens
  misc_feature 1..272: note = chr6:10382722-10382994
  misc_feature 1..272: note = hyper
  source 1..272: mol_type = genomic DNA
tattaagggagacttcgaaggcctgttagcaggtgactgcggcaggggcaggggcgcatcagctgtccggcttggaccggcgtgggcgtgggctgggggcttttccgatttgctgagtcagccgcgggcgccgcgggctttggtgtttccagcccaagcgactgtgcttcgctgactggtgtgtcaacttggtagtgtaattattgttttgttttctaatatgtaattactctttgtcgttgctattatgaatccaccgagcttgactcttg

SEQ ID NO: 30283 - DNA, 237 bp, Homo sapiens
  misc_feature 1..237: note = chr6:10383837-10384074
  misc_feature 1..237: note = hyper
  source 1..237: mol_type = genomic DNA
cacccaggccctgcccgccgccctctgcagcctaggcggggtgtgtggcgtcgcggtcagccttaccgagggacacgccgccccgggccgggacggggtggggctgtgggggatcctgggccgaggaaagcgatccattttctctaaccgtttgctccagagctgtcaggttagcgtggcctcctcggccgcccagagaagaatgtgttaaaattctttgcacgggagcctttccca

SEQ ID NO: 30284 - DNA, 65 bp, Homo sapiens
  misc_feature 1..65: note = chr6:10384438-10384503
  misc_feature 1..65: note = hyper
  source 1..65: mol_type = genomic DNA
tgcccctgcgggtcccgattacagatgaatttttattccgaggtggggcacgtaatggaacggaa

SEQ ID NO: 30285 - DNA, 25 bp, Homo sapiens
  misc_feature 1..25: note = chr6:10384950-10384975
  misc_feature 1..25: note = hyper
  source 1..25: mol_type = genomic DNA
ggaaggagggggagccgtggcgggc

SEQ ID NO: 30286 - DNA, 994 bp, Homo sapiens
  misc_feature 1..994: note = chr6:10385279-10386273
  misc_feature 1..994: note = hyper
  source 1..994: mol_type = genomic DNA
gtgaaaatttgcgattcagggcaaatgattctccgacagacgctgggctccacatcccacccctcccagcccgcgccccctccggtcctcgcgctccccggccgccacgtcccgggcagttcaggaaagcttgctaggtttccacgccggaaagcccaaggagaaggagccagcaggcctctgagcgtgtgagcgcgtgtgcgtgtcagcgcgtacatgggggtgttttcctcttcgggaagtgttatcaaacagtaatagctaccctcgactccgaatcacagcattccccccagaattcctgatcagtaaaacccaaatcgttttcaagacaaaggagcatcaatcagcgacaaagacagatttaacgtattaaatctttattaaagtgaagtcattcttattgaaatgatgtattgggtgtgcagaaagattggatttttttttttttttttttttgacaatgtgtaaaatggagatggtggcggagagcttgcgccgcgtcttgccctgattgttctgggctgggattggattactgggactgcccagggtcccgcgccaggaaacaccaccttggactacagggaagagactgatctccctcctcctgccggcccccacgttgatttcccgagaaacaagcgtgtcccaggtcttctcaaaaacttccctccttggtctccgcattagggaaactgaggtactgctggcatggctgtccatacgtttgctaaatcagctactccagaggcctagagaagggagggaacgccctgggttttccagaacaagacacagatctctccgtagcctaaagaaagtccttgcgccccaggtctgaaagccaaggggagcctgtgtttgctcccagcggggtcgccggccgtctccacaacccttgcttcctacaggcagaattgaatgcaggagctggctgtcttcccgcctggggtgggctctcaattcaactggacctcgggtcctgtcaagg

SEQ ID NO: 30287 - DNA, 1307 bp, Homo sapiens
  misc_feature 1..1307: note = chr6:10389909-10391216
  misc_feature 1..1307: note = hyper
  source 1..1307: mol_type = genomic DNA
ctccacataagcagtcgatttctgtggtttcaaagaaaaaaaaaaaaaagatgaaacatgtcttctctttgagggtgacctttgacctttctttccaatacacctgacacaaagggcttagaaaagacccgtttcgggtgcggggtgctgatgctgcttttttgttgttcgtttgcgctcgcgctcgctctcgctctctctctgcatccccctcaccccctttctcggagactgaactaagtgaaaagttgtttcaataatcgcagctctctgctccgccagggccgagggaggcgggcggaacacggagggtgttttgttaaatgctcccgtcgttcgcaggggctgggacttgataaaaggagacagttttctgaaaagatttgattgaaatggcgtgtgccagggctgatgggagccagcgagggacaaagcgccgagaatccatggacactcgagcaattatgcctccacgctgaaggtggattagcgcgctggaaagaagcatatgtttggcccggggcgacacttccccccggctgagcttagagaatgggagcgcggagagcggctggacccggaatatcaactatctgcgaagcccccccttctagcccaactccgccagcctccccgcccccgccggggaaaagtcggagtgcatttttacaaagatgagaggagaagagagggctaggggaggagcgggcagggaggggagtaggtgcctagaggtgcaaatggccctgggatcccccaggagcggccctccaggctctcctctctggcgatcccgagggcgcgtccgtccttgggtgtggaaacccagagggggtcaaataaatgctcccctatggaatttcccactgctaaggtagttcggtccaggatgcccgctcaacgcgtattggaaggtcagccgaattgttgcaatgaaacaaggttttaatgactaaagatgcaagtgcctaaaaggttgcgttgggcaggaggcgcttggagggcagcgcgggttcccagccattccttgggtccaggtcgaggaaggcctcgggagacgagtcccacagtgagatatttgatgaaatgggtcggggctggaaagctcggacaggccgcatgggagagaaagggtgcgggtgcggcagtcggatccccacgcagctctatctgcttagacacccgggcgagggatgctttgggagtttggagccagaaagtttcccagaccctgcctccagtcattaattaaagcgcccttcccgtggaaaaaaaaaaggcccttaaaactctgacctggagcctcc

SEQ ID NO: 30288 - DNA, 132 bp, Homo sapiens
  misc_feature 1..132: note = chr6:10391324-10391456
  misc_feature 1..132: note = hyper
  source 1..132: mol_type = genomic DNA
cgcgagtgccggtggccgctgcccaggccgtccacatttccctccctggctgtccttcgagcccctaccagtccttcctctccctgccgcccaagcccaggcaagactcgaaccgcccgtcccacacaatct

SEQ ID NO: 30289 - DNA, 430 bp, Homo sapiens
  misc_feature 1..430: note = chr6:10410518-10410948
  misc_feature 1..430: note = hyper
  source 1..430: mol_type = genomic DNA
cccagctggggcaaccgtgccgtcccgttgctggtgccgtcgtgacggtcctagaagagagcgagaggaaaggtaaagaacaaggaatcaggcgtcgagctacaactatccacacaaaatccacttgacaagtctgcgtgggaaatcgcccgttcccgttggctggccgccgggaaaaaatcagctctaagttcttttcaggaaataccctcaagtgaaacagaccgaacaacgcagagaaactgtatatggagggggcacaagagactatttaggggtttctttcaaagagaggaaaagatagaaaagggtctcctggaacacagcccattaaactgcagcgtgaaatctctcttaagcaaaattaaaattcctcctaaatactaaacagcagaagcggccttttcttttcccccgatttgaacctgtc

SEQ ID NO: 30290 - DNA, 293 bp, Homo sapiens
  misc_feature 1..293: note = chr6:10411253-10411546
  misc_feature 1..293: note = hyper
  source 1..293: mol_type = genomic DNA
gagagaggtgcaccccggggctgtggccccccccccccgccccttccaccccagccccaaagggcagaagaaacgcctgactttaggtttctctattgcaattcccttgcaaaacaagcgaagagagttgattccagagaccgcgaaccctcggcggttcggccgcaggtcccgagggtagggggcacaccgcgctgcacttttcctgcagacagtttaagcatcaaatgttgagaacatctcggggacaagtgaagactcaaggaaatcaagatgaacgtggggagaaacac

SEQ ID NO: 30291 - DNA, 90 bp, Homo sapiens
  misc_feature 1..90: note = chr6:10411946-10412036
  misc_feature 1..90: note = hyper
  source 1..90: mol_type = genomic DNA
ccaggactccagtcacggcgccgacgctccccggagcgcgggagcccggctcggatccatccgaacttgaaccaccgattcgcgcggcgc

SEQ ID NO: 30292 - DNA, 310 bp, Homo sapiens
  misc_feature 1..310: note = chr6:10414201-10414511
  misc_feature 1..310: note = hyper
  source 1..310: mol_type = genomic DNA
agtgttggttgtaaccgttcccagcgcctcctgcgggtggacaggtcgcgctagggtctcccttgctgcctcaagaaggcgagctcaggggactctgcgttttaaaatgggttccaaagcggcgcgctctgtcggcccagcgggcttgcggcaccagaggtggtctgcagccgcgcaaggattcccacggtcgttctgggctggtgcagaagctggtgctcccgcacccagcggccagcaggctcggcgcagcacatctccccaccccacccccacacacccccgtggggtgcgtcgatcctgtagctca

SEQ ID NO: 30293 - DNA, 268 bp, Homo sapiens
  misc_feature 1..268: note = chr6:10414978-10415246
  misc_feature 1..268: note = hyper
  source 1..268: mol_type = genomic DNA
agaagggagcatccacgtcctctctctgcagcttctcccccgcgttcttcgggcgaatccgagggacgggcgctgcgctggggaaagtttgtcccacccgcgtttcgcagctggttgcaaggagaggaggaggagagggagggtcaagctcggagcctgtgaccgcacggatgatcgagccggcgtcgcgcttacctcgcagtcctcgtacttgatattatccgtcaatttccaaagcattttcatggatcggcgtgaacggatatgc

SEQ ID NO: 30294 - DNA, 193 bp, Homo sapiens
  misc_feature 1..193: note = chr6:10415559-10415752
  misc_feature 1..193: note = hyper
  source 1..193: mol_type = genomic DNA
aatagtccaattgctcgccagtaccacaatctgccgccggccgctccgacacaggtataaaggcctctctacgccgcgaacttgcttctagagcgcactccagcctgcgaactgataaaaccttcctcgagctccgccgcgaggccctgccccaacaccccctctcttaccccaattccgccacattcccctt

SEQ ID NO: 30295 - DNA, 30 bp, Homo sapiens; identical to SEQ ID NO: 8339
  misc_feature 1..30: note = chr6:10416118-10416148
  misc_feature 1..30: note = hyper
  source 1..30: mol_type = genomic DNA

SEQ ID NO: 30296 - DNA, 372 bp, Homo sapiens
  misc_feature 1..372: note = chr6:10417158-10417530
  misc_feature 1..372: note = hyper
  source 1..372: mol_type = genomic DNA
ctgagcacaattcctcggctgaaccgggctggaggcttggcgccgccctccgtccagaaaatggtcgactttccagggctagaccctgcagggctgtcccagcctgtcgccagtgcagtggtttgaagtcaggatctgggctgccaggagcaccgacaccctcccagcagcggccatagcctgagcaggccaaaccctaggcctgagagcatgggtttttacactccgtagacgtcgccgcggtgtgcttaagggaactccaagtttcgctttcttgccctctgcgggcttggaaaggccgccctccatcctctgccaccccatttcaacccccgtttccacctccccgctgccccgcgcccaacagatctc

SEQ ID NO: 30297 - DNA, 363 bp, Homo sapiens; identical to SEQ ID NO: 533
  misc_feature 1..363: note = chr6:10419077-10419440
  misc_feature 1..363: note = hyper
  source 1..363: mol_type = genomic DNA

SEQ ID NO: 30298 - DNA, 56 bp, Homo sapiens; identical to SEQ ID NO: 534
  misc_feature 1..56: note = chr6:10419476-10419532
  misc_feature 1..56: note = hyper
  source 1..56: mol_type = genomic DNA

SEQ ID NO: 30299 - DNA, 258 bp, Homo sapiens
  misc_feature 1..258: note = chr6:10419744-10420002
  misc_feature 1..258: note = hyper
  source 1..258: mol_type = genomic DNA
ccagctccctggaatcgcttaggcaaatcctccttttttacctgctcaccaacatctcacctggtcataaagagctgggttgctacctgccgacgcatgcgcgctggcccaggaattcactccgccagctgcagtcccagcgccgcacagagctgacctgggaagtgatggatttatagccgcggcaatcttgccatcagctccagcttttcccaacagccccaacccgctttcccggtcagtccctggcccgggaac

SEQ ID NO: 30300 - DNA, 150 bp, Homo sapiens
  misc_feature 1..150: note = chr6:10420118-10420268
  misc_feature 1..150: note = hyper
  source 1..150: mol_type = genomic DNA
cgaactgggggagtctccactcccgggtgggggtcgggggttggggaagggctagactgctagaagcgtccagaccccatgatccccgcgcacctggacacagtggggacaggtcgccgtccccgcctccccacccgcccacgaggtgca

SEQ ID NO: 30301 - DNA, 37 bp, Homo sapiens
  misc_feature 1..37: note = chr6:10420718-10420755
  misc_feature 1..37: note = hyper
  source 1..37: mol_type = genomic DNA
ctttaaaagaagccacgggatttggggctcccggagc

SEQ ID NO: 30302 - DNA, 207 bp, Homo sapiens
  misc_feature 1..207: note = chr6:10420876-10421083
  misc_feature 1..207: note = hyper
  source 1..207: mol_type = genomic DNA
cgcctgggccaggcccagttaccctcccgggctgctgtcgccgggacttggagacgaacaaagaaccagttttaaatcgtcttctctgacatgtcaggcaaatatgtgtaaaaggtcagctccacgctgtggagcagagacctgtcccccaggcaccaaaacctcccctttctaaccgtgcccgagagcctccgacccctgggccct

SEQ ID NO: 30303 - DNA, 96 bp, Homo sapiens; identical to SEQ ID NO: 535
  misc_feature 1..96: note = chr6:10421356-10421452
  misc_feature 1..96: note = hyper
  source 1..96: mol_type = genomic DNA

SEQ ID NO: 30304 - DNA, 1113 bp, Homo sapiens
  misc_feature 1..1113: note = chr6:10421548-10422661
  misc_feature 1..1113: note = hyper
  source 1..1113: mol_type = genomic DNA
cgggcccagccggacgggccgggccgagcctaggaggggctggcagacgtgtcccagggccagggtggggcgtagggagcgccgtctccaccctcagtacttttggggtgggggacctgagcgtgcggagagcgggaggcagagctgagagcggggttaagcgcgaagctaaggcgccgcatagggttgggtgggaatggacagggtgagctggaagcgaagcaccccagccaggccttaggagagaggaccgtcggcatctgtgcacatcctagcgggcggatgatgtgggagagaggcggagggaggtgaaatgcgggagctagaatttagctttgcagtgaggtcacttggggtctgcattcagctccgatatatacatgtaggggctgtgtgatcctggggaagttaccgaccttgtctgaactcctgtttcctggtttgtaaagtggctaattggtgggaattcaataggagaatgtgcgcaaaacgcttagcacagcgcctggccaacaatgcgctctcaagaaaggctgctgagccttgtccaggacggtctacaccgccccacgtccaagatgagttcacagcgcccaagacctgttcaatttaagatgatgtaaactgcattgcccttcttagacacgcagcagccaggagctggtcatctgcacctcccgcgatttcctcctcagaaccccagtcctgccagatttgcgtccttccctggctcctcaaacacctgctgcaccgctcagagcctttccccaccccgacctcctccgcagctccgcaccagcgagactgcgccccgtggcacctcgggggtgccacgattggcgggggatgggggatgcctcccagcttcatccgctctccgggttccagacaaccattccggagagccagctgctctcagtgcgggcaggcccaaggccactaactgcacttggcgacccacctccgttcccaagaggcctcggaaagtgcggcctcgggtctcttttgaaacagagacccgcggcaccccgcttctccccctgggataggagagggagagccgcgggagttccgcagccactcctggcgctgccaccacgaagcaggttcact

SEQ ID NO: 30305 - DNA, 155 bp, Homo sapiens
  misc_feature 1..155: note = chr6:10423932-10424087
  misc_feature 1..155: note = hyper
  source 1..155: mol_type = genomic DNA
gcgtggtgtcccaaccggcctggaaagaccgagagtaccatgagctgtgaagctggggtgtgacagggatgcccgtccagggctggcaagagtgcagaatggctctcttggatctttggaataggcacatctgcagaccccgctccaatgtttac

SEQ ID NO: 30306 - DNA, 15 bp, Homo sapiens
  misc_feature 1..15: note = chr6:10425463-10425478
  misc_feature 1..15: note = hyper
  source 1..15: mol_type = genomic DNA
aaaaacttgagaccc

SEQ ID NO: 30307 - DNA, 161 bp, Homo sapiens; identical to SEQ ID NO: 2765
  misc_feature 1..161: note = chr6:10425629-10425790
  misc_feature 1..161: note = hyper
  source 1..161: mol_type = genomic DNA

SEQ ID NO: 30308 - DNA, 972 bp, Homo sapiens
  misc_feature 1..972: note = chr6:10425838-10426810
  misc_feature 1..972: note = hyper
  source 1..972: mol_type = genomic DNA
cgctactttaacgtctcagtctcgttcgctaagcccatgcgcctgggacttgttctttgaatctcaagtccgaaaagccaggaatcctcgatcatggacttcctcctgctaaattagagggagtgaaatttcgctctcctctccatcctacttccccatcccaaactcgctagattaagttcgctgaccaggcgcgcacccaatggcagcaccctctccaacattttccccaccagagaggcaagtgtcctacatttgtacgtaaaggtccctgagtggctaggtggagaggctcggatgtcttttcctggagcgggcctcggggagctgcagcagccccagcctcaggcaccacagccaagcgagcgcgccttgggctcgctgctctgcacgcagctggaggtctgggccgctgaccctctggccacgtagtcaacccgaggatgtgtgccccggggctcggccttgcctcgggtgagaaggctagtcaccattcagggtgcaggtgtcatggcctggaaatggcaatatctgagcaaacaggtgggcgtcgcttcccggcggtgcggtggccgctggctcgcagcgcgctccagctttcggcgccgccgccgcccctttgctctgcggactcagccagttcccgggtggcccagctgggtggctccgaggcctgcccccttgggctgcggcgggaggcggggactgcagtgccgagtgtagggcgccccagccgggctggcggttcacgctgcgctcgggcctctgccgggagggcgccctggcgccaaacccgggcgggcaggggggtggagagccgattgagtttattcccattcagaatttagaggctggtggagacagagagtctcctaaatggatgcaagtctcctgaaagtctgggccggaagcctcgaaactttctgccacgcaaagccccagctagtctccagggctcggtcctggttccct

SEQ ID NO: 30309 - DNA, 386 bp, Homo sapiens
  misc_feature 1..386: note = chr6:10881854-10882240
  misc_feature 1..386: note = hyper
  source 1..386: mol_type = genomic DNA
gactcttcaagaactcgaatgccattctccctccttcggatggacagcgccccgcgtgcccgcacacacccggttcacttacctgaggcatctgcggatcgttgatgtcccagctgagctgcatcccgtaggagcacacgccgaccgcttcctgcaccgcggccgccggcatctgcccaactcgctcgcgctttccgcccagggttctgaaaaatagaagaaaaaaggacaggtgcgccaggtgggttttttttcttctctttaaagaagaaagtggggtgtgtgaaggggaggtgcagagagagagaaagagagagaggctgtttagatatctggaagctggggacaatggttatggacccgggcggggccttgtccttggccgc

SEQ ID NO: 30310 - DNA, 47 bp, Homo sapiens
  misc_feature 1..47: note = chr6:10882241-10882288
  misc_feature 1..47: note = hyper
  source 1..47: mol_type = genomic DNA
gtgctgaacgttctccacccgaacggcagcatcgacctctggcagct

SEQ ID NO: 30311 - DNA, 15 bp, Homo sapiens
  misc_feature 1..15: note = chr6:10883008-10883023
  misc_feature 1..15: note = hyper
  source 1..15: mol_type = genomic DNA
ttgggcctccactgc

SEQ ID NO: 30312 - DNA, 72 bp, Homo sapiens
  misc_feature 1..72: note = chr6:10883114-10883186
  misc_feature 1..72: note = hyper
  source 1..72: mol_type = genomic DNA
cgagcccaggcgccttcacgctcccggggacttcggagggacctggccctgcaggaacggagtcctacaaag

SEQ ID NO: 30313 - DNA, 268 bp, Homo sapiens
  misc_feature 1..268: note = chr6:10886917-10887185
  misc_feature 1..268: note = hyper
  source 1..268: mol_type = genomic DNA
attacaggcgtgagccaccgcgcctggccgcccctctggctttttaaggcggggcaaaaacttggaacagctaccacaaagcgaacgcctatctgtttggaatttcgcaaataaggaacgtttaaatgacgtagttcacatcctttgagtgctggctttctcttaaagggtgagtgcgtgcgcccaggtggtttggcctgtgtgcgctagttacttgcacgcgcttcttgagtctcaaaacacagagctctagtaaacttcagggggc

SEQ ID NO: 30314 - DNA, 530 bp, Homo sapiens
  misc_feature 1..530: note = chr6:10887186-10887716
  misc_feature 1..530: note = hyper
  source 1..530: mol_type = genomic DNA
gattcgtcaattacagttgcggaagaagactcgactcgaagagcggtccgccaccagggctctttcggcagcgcccccagcgggcggggctcttgggcggggaagcaggagagggccgaccgagcgcaacaaagctgagcggcgcgtcgcttcaggaacgaagaagcctcgttatgcaagcggtgagtgacccccgaagggcccggaccttctgtccacagtgctagggcgcgcgagggcgcggggtccctggggctcaggttctgccgccttgaggtgttcgctcagagaccgggtgctgggcatagtcccccgccacctccttgggtttgctcggagtgtattggcagcctgcggggagaccaggcagaatagaaacctcggatccctagctaaatagcgctcagggaaaggggaaccggagaattcgtgttcggaaagcaatgagatagttcttttctagttgctttgcgtattttcctagccggttttccagccctctttccaccttgctgcgtagaaagtgcaga

SEQ ID NO: 30315 - DNA, 416 bp, Homo sapiens
  misc_feature 1..416: note = chr6:11043690-11044106
  misc_feature 1..416: note = hyper
  source 1..416: mol_type = genomic DNA
acacgggtgaacacacacacacacacacacagcttactgccgaggagaaagaagcgttactaatccagagtggaggactggcctgggaaatcgggcagagagaggagttgtcggaaagaacacaccagaagcccctccgagcccagacactgatagaaacccagccgcttcccaagccaatctgcaaacccaggaggcacccacgagtgcacagacacacccccggggtgcaggcgcggtgaagggaggagaggggcaagagcttgaccgttagggcccgaaccccagaactcccgaggcagggtgtgtgccgcgcgcgggaaacgccgttctccgctccaggcgtcggcgggcggtggcgagagcaggttcgggggtccggagggtcggagggtgggctgcgcgcgggaatggcc

SEQ ID NO: 30316 - DNA, 434 bp, Homo sapiens
  misc_feature 1..434: note = chr6:11044107-11044541
  misc_feature 1..434: note = hyper
  source 1..434: mol_type = genomic DNA
ccgcgaaggaggggcggcttcctcgggcatcccgggcgcccggccccgtgcatgcaacaggggactgggcgcgagcgggcgcctcgaggtgccggggcgggaccggggagaggggaccgagacaaagttcccgagacccgcgggcctcgggccgacccgcgcgcccccggcccaaacgctcagctcccgctccccaggcccgcgcggacccggcccctccgagggtagcgggttccagcggcgaacccgcagcgcccgcgccggcgcccgctcggccctttcccgcccggtgcgtgggtccaggagagaaagaaagcgcggcggtgtcggtggcggcgcgcggccccactcaccatgatccgcagcggctgtggcgcggcgacccgggcgggcggcgatgcgctgtccagggtagccgggtccctctgcccggc

SEQ ID NO: 30317 - DNA, 366 bp, Homo sapiens
  misc_feature 1..366: note = chr6:11044542-11044908
  misc_feature 1..366: note = hyper
  source 1..366: mol_type = genomic DNA
ctatctcggcgcccgcgccggttacccccacccacacccacgcccggcgcgcgcacacccgcccgcgcctccccgccccctcgggctcgcgccgccgccgcgcggcgctccgagcctcggggccgtttcgtccccgccccctctcccacaggggcctcgccggccgccgcgccaggagggcgcgcgggggaggggcgcagggcaagtgaggcggcgccccccgcccctgcggcctcgcgcgccccctcctgggcgaccgacctcgccctcgcgtccgcggcgtcccctgccggccgggcggcgatttgcaggtccagccggcgccggtttcgcgcggcggctcaacgtccacggagccccaggaat

SEQ ID NO: 30318 - DNA, 121 bp, Homo sapiens
  misc_feature 1..121: note = chr6:12749820-12749941
  misc_feature 1..121: note = hyper
  source 1..121: mol_type = genomic DNA
ccctcctcccccttccgcctctctccctctccctccgtctccttctccctctcagctcgccgggcgaccctgctcctgcctcccacattaatggcggcatcctcggaggatgatatagacc

SEQ ID NO: 30319 - DNA, 100 bp, Homo sapiens
  misc_feature 1..100: note = chr6:12750364-12750464
  misc_feature 1..100: note = hyper
  source 1..100: mol_type = genomic DNA
gggcgaggttggctggcgcggctactacggggtggaacttgttggtgacattcagactctgttggctttgacgggttgacgccgccgctgcggtgttgga

SEQ ID NO: 30320 - DNA, 506 bp, Homo sapiens
  misc_feature 1..506: note = chr6:13013570-13014076
  misc_feature 1..506: note = hyper
  source 1..506: mol_type = genomic DNA
gaaagtcaagggctacgggttggacccgccggagagggtaatttgctgtggccctggaggggagcttgcacccgaggtttcccagtgcagcgctttccgtgtgaaacattttgctttcattcggcagctttaggcgtgaagaaaagggggagggggttggcgttccgccctggagctcttgagagtgaaggtagcttcaaacccagcaggctctcagtagctggtgctgagatttccggaggggtggggctgccagaggaggatgtgcacgtgagaccccgagagaggtgggagtggagcttctcaggtaggacccaggagcgccctgcctaccccctcctccggcttcgggatccggattggctggggcagcgaggtcggcgaggtcaagaccctttcggcgccctccccgacccgccccgccgcggcggtgcttatatagagcggccggcgcgggcggggcgggggcatgctggcgaggccgaggggcgcgagtggcagcgcgc

SEQ ID NO: 30321 - DNA, 176 bp, Homo sapiens
  misc_feature 1..176: note = chr6:13488419-13488595
  misc_feature 1..176: note = hyper
  source 1..176: mol_type = genomic DNA
taagcaacaggcctgcgattggaatccaggccccagagtctgggcacggaaccgcagacttctacggtctccttccaagctagcctgctccaatcgcgcgcccccgctccggccgcgcacgcacggttcagccgccttcttccaagacagtccagtcttggcgggctcccatctgc

SEQ ID NO: 30322 - DNA, 699 bp, Homo sapiens
  misc_feature 1..699: note = chr6:13924890-13925589
  misc_feature 1..699: note = hyper
  source 1..699: mol_type = genomic DNA
gtgcctactaggatgcgaataccacttggccctgggctcgctccgctttagccttcccctctcgctggggagaaacaggcggtttgtgagggagactgagagaggggcgtgtttgtggtggtggcggcccatcgggggtccttgtcctctccgaatacccggactgctgaggggaagggccgggggggccccggcggttgccatggtgacgcagggtcggcggctcagcgccgtagagacaaagccgcccgcccgccagcccgctagctcctcgcgcgagctcctcctccacgggaacctccctcccctcccaggcgccgccgcagccggagcggctcccgggccctgggccgccgccggccaggtaaggcgatcgcgcccgcggccggggaggggtcggcgggacgccgggcctccccaacgctggggcagcagccagccccgcagtcctggacggcgccgggccgcccaagcgcgccgaggagagggggcggcaaacttcgggccgagcggcgccggggcccgcgcgcggagtctccctccgggcaccacgggggccgccgtcctggcaccaacttgaggggctgtgcggcggagggcggctgcggagcgcccgcgcgggctgcacctgctcagggagctgcccctctgttgttgttgttattttccttcttggcgtgccatcgaggcttttggggg

SEQ ID NO: 30323 - DNA, 30 bp, Homo sapiens
  misc_feature 1..30: note = chr6:17102273-17102303
  misc_feature 1..30: note = hyper
  source 1..30: mol_type = genomic DNA
ggcaaccattcctggcgactgcccagaaac

SEQ ID NO: 30324 - DNA, 37 bp, Homo sapiens
  misc_feature 1..37: note = chr6:17281225-17281262
  misc_feature 1..37: note = hyper
  source 1..37: mol_type = genomic DNA
gtggagagctgtcctcggcactcgtcttccagatccc

SEQ ID NO: 30325 - DNA, 386 bp, Homo sapiens
  misc_feature 1..386: note = chr6:18122677-18123063
  misc_feature 1..386: note = hyper
  source 1..386: mol_type = genomic DNA
aggccaggcagaccacgtggccgcaggacaggttgcgcgggcgccgctgctgccggtggccaaacttctcaaagcacaccttgcactcgagcaggctgatctccgcctcgcgcatgagctcatgcagcgctggcccgctctccgaggcttcggccgccatggcgcgtcctgtgcactcccgccgcgccgcctggccgtgccccagcgacgctctcggtcacggtcacagtcatggtcacggggtgggacgtgcgccctgacgtcgagcgccgcgggcctctgcactgcgatctgctgccccttggtgggcacgcgcggcactgtttcctgagggcctgatggtggacgtttgcaagacaaatccacatgcgcgttgtgtagacctg

SEQ ID NO: 30326 - DNA, 430 bp, Homo sapiens
  misc_feature 1..430: note = chr6:18277531-18277961
  misc_feature 1..430: note = hyper
  source 1..430: mol_type = genomic DNA
gagaggctctgagggcgcccgcggggcggaggggagcggggcagagggccgccggggcgagggccgaggaggggtccgagacgcgccaaggggctggtagctaggcgacctgaatgtcttccatacctgaacccgcagcctgaagaagctgatagcggaccccgagcgcgcgcgcgccttggcgggagccctgcgcctcccggggtctccctgctccttacttggacctcgggcgcaaggtaaggaggggcacggggtgcagcgttcgccctcgagctgcctggagcctctgcgaggggccagttcggcctccccgaggctgtcaccgcctccccttctgctccttccctttctccgtccccaggtcccctccgcgcagagctgaagccgcggcgggcggcccacgggggatcagaccctcgggcatccg

SEQ ID NO: 30327 - DNA, 64 bp, Homo sapiens
  misc_feature 1..64: note = chr6:18277979-18278043
  misc_feature 1..64: note = hyper
  source 1..64: mol_type = genomic DNA
cgccggacccccacctcttctccaagctccactcccgacttttcttccccgcccccgggaagct

SEQ ID NO: 30328 - DNA, 186 bp, Homo sapiens
  misc_feature 1..186: note = chr6:19691811-19691997
  misc_feature 1..186: note = hyper
  source 1..186: mol_type = genomic DNA
atgctaaccttggagcgcaacctctccatttgcatttgaaggagctaaatattaggcaggaaagaaagtgctctttttgaaagcctgagaaaatgtccccgctcggggctgctccgccatctgggccgcgggctgggcgcgcggctcccgcccccagctccttggcagaggcgccggaggaagggg

SEQ ID NO: 30329 - DNA, 78 bp, Homo sapiens
  misc_feature 1..78: note = chr6:19692142-19692220
  misc_feature 1..78: note = hyper
  source 1..78: mol_type = genomic DNA
cgtcccgagggctctcccttttcccagagcgcataccaaaggcagactcctttgcaggctccacgagccccattcgcg

SEQ ID NO: 30330 - DNA, 246 bp, Homo sapiens
  misc_feature 1..246: note = chr6:21664923-21665169
  misc_feature 1..246: note = hyper
  source 1..246: mol_type = genomic DNA
gggcatctctggtcccgggatgcgattgtcccggtttctccttctggcccactcgccgcgcgcacgaactctaggggaagttggttgtaaagtttccgagagcggcgtgggctggtgcgagtgaagcgcggggcgggggaggcgaggacagaagctctcctcgcggcgtctttgttctgctctggaggagagaccttggcaaggagtcgccgggcgggtgcagggacctaccgccaccacattccg

SEQ ID NO: 30331 - DNA, 141 bp, Homo sapiens
  misc_feature 1..141: note = chr6:21665754-21665895
  misc_feature 1..141: note = hyper
  source 1..141: mol_type = genomic DNA
ggcggcctgggaccccgagtcagatctttggggtgagcacgaggacgtggtgtagggaagaggacgagtgagcagcgcctggctgtagggtcagagggcgcctggtcatcctgagagccttgccttcgcagtttgagatta

SEQ ID NO: 30332 - DNA, 42 bp, Homo sapiens
  misc_feature 1..42: note = chr6:21666457-21666499
  misc_feature 1..42: note = hyper
  source 1..42: mol_type = genomic DNA
agggctggcatctcccggggaaagtttcgagcctggcagtgg

SEQ ID NO: 30333 - DNA, 175 bp, Homo sapiens
  misc_feature 1..175: note = chr6:24126308-24126483
  misc_feature 1..175: note = hyper
  source 1..175: mol_type = genomic DNA
gcgcgccagacagctcggccccgcccactcgccgctctcggaaagctggaaccctgcccctttggagggggaggcggcggcggcggcggcggctgcgcgggcctcgggtgcgcgggcacgcgggactcccagctgtcaatcaggcgcgggctgagctctacgaggcggagcggcg

SEQ ID NO: 30334 - DNA, 208 bp, Homo sapiens
  misc_feature 1..208: note = chr6:24494664-24494872
  misc_feature 1..208: note = hyper
  source 1..208: mol_type = genomic DNA
cgcggggtcacacttcgacccctcagagaacgatcgctcccaatcaatactacgtgctcaggagctacaactgaagaagcgtgatcacggccttggcatttagggcaggcaccagcgcatctatggaccgcgcacaaattccggggatgccgaatttgggggatgctaaggggagagagtgggtctctagcagcgattgggggctcag

SEQ ID NO: 30335 - DNA, 94 bp, Homo sapiens
  misc_feature 1..94: note = chr6:25652379-25652473
  misc_feature 1..94: note = hyper
  source 1..94: mol_type = genomic DNA
gcgcgcagggcggggcggggacaggcgcgccaggagcggggcgggcttccagccgctggttttgctgagggctgagggacggctcagcgacgcc

SEQ ID NO: 30336 - DNA, 229 bp, Homo sapiens
  misc_feature 1..229: note = chr6:26020909-26021138
  misc_feature 1..229: note = hyper
  source 1..229: mol_type = genomic DNA
aaactacctttccagcgcctggtgcgcgagattgcgcaggactttaaaacagacctgcgtttccagagctccgctgtgatggctctgcaggaggcgtgcgaggcctacttggtagggctatttgaggacactaacctgtgcgccatccacgccaagcgcgtcactatcatgcccaaggacatccagctcgcccgccgcatccgcggagagagggcgtgattactgtggt

SEQ ID NO: 30337 - DNA, 30 bp, Homo sapiens
  misc_feature 1..30: note = chr6:26034014-26034044
  misc_feature 1..30: note = hyper
  source 1..30: mol_type = genomic DNA
ggcttgacgagccttcgacttgaatactaa

SEQ ID NO: 30338 - DNA, 90 bp, Homo sapiens
  misc_feature 1..90: note = chr6:26087615-26087705
  misc_feature 1..90: note = hyper
  source 1..90: mol_type = genomic DNA
gccccccaaaagaagcggagatttaacggggacgtgcggccagagctggggaaatgggcccgcgagccaggccggcgcttctcctcctga

SEQ ID NO: 30339 - DNA, 88 bp, Homo sapiens
  misc_feature 1..88: note = chr6:26088186-26088274
  misc_feature 1..88: note = hyper
  source 1..88: mol_type = genomic DNA
acccacagcaggatccgcacggggtttccacctcagaacgaatgcgttgggcggtgggggcgcgaaagagtggcgttggggatctgaa

SEQ ID NO: 30340 - DNA, 152 bp, Homo sapiens
  misc_feature 1..152: note = chr6:26172018-26172170
  misc_feature 1..152: note = hyper
  source 1..152: mol_type = genomic DNA
cctgaaaaataacagcggtcatcctactcccggtgcggctatgcggccatgaaaaggagtcttggggccggtcgtgcccctccacgcaggctccctcatagggtcatcccatcaaccctcgccaaaaacgccggccccctcatagggccgtc

SEQ ID NO: 30341 - DNA, 97 bp, Homo sapiens
  misc_feature 1..97: note = chr6:26184021-26184118
  misc_feature 1..97: note = hyper
  source 1..97: mol_type = genomic DNA
gcatgcctgagccagcgaaatccgctcccgccccgaagaagggctccaagaaggccgtgaccaaggcgcagaagaaggacggcaagaagcgcaagcg

SEQ ID NO: 30342 - DNA, 477 bp, Homo sapiens
  misc_feature 1..477: note = chr6:26188757-26189234
  misc_feature 1..477: note = hyper
  source 1..477: mol_type = genomic DNA
attgattactccagcatgggcgacacagcaagagtgaaaataaactttaatacactatcctcaccggccagtaagatatgaagccaaggcgtaataagaccatttaacttgaaaaccggagctactaaacacgtgaaactacacttttagcagtgactactactctttctcctgagtggataggtggccctgaaaagggccgttggttttgcggtagtgtactgtagaggtaagctcagccgccgaagccataaagagtgcgtccctggcgcttgagcgcgtacaccacgtccatggctgtgactgtcttgcgtttggcgtgttccgtgtaggtgacagcatcgcggattacattttccaggaaaactttcagcactccgcgagtttcctcataaatgaggccagaaatacgcttgacgccgccgcggcgagccaggcggcggatagcgggcttggtgattccttggatattgtcac

SEQ ID NO: 30343 - DNA, 158 bp, Homo sapiens
  misc_feature 1..158: note = chr6:26189235-26189393
  misc_feature 1..158: note = hyper
  source 1..158: mol_type = genomic DNA
caataccttacggtgacgcttggcgccacccttacctagaccctttccgcccttaccgcggccagacatcttgaaaccacagctgttaaatctgtaacgcaatacgtctggcagagccacgcagcacttttataatagcatgacggacctgtttgaaa

SEQ ID NO: 30344 - DNA, 195 bp, Homo sapiens
  misc_feature 1..195: note = chr6:26197272-26197467
  misc_feature 1..195: note = hyper
  source 1..195: mol_type = genomic DNA
tggaatggcagtttgcgaatcagcagctcggtcgacttctggtagcggcggatctcgcgcagagccaccgtgccgggccggtaacggtggggcttcttcacgccgccggtggctggagcgctctttcgagcagccttggtggccagctgcttgcgtggcgctttcccacccgtggacttgcgagcagtctgcttg

SEQ ID NO: 30345 - DNA, 25 bp, Homo sapiens
  misc_feature 1..25: note = chr6:26198574-26198599
  misc_feature 1..25: note = hyper
  source 1..25: mol_type = genomic DNA
gttttgagacagtctcgctctgtcg

SEQ ID NO: 30346 - DNA, 85 bp, Homo sapiens
  misc_feature 1..85: note = chr6:26198839-26198924
  misc_feature 1..85: note = hyper
  source 1..85: mol_type = genomic DNA
gtaaggaaccgcgccccgccaatttgcttatgtatttttatggcatctttaaaatggacggttagtttcacgattcagtgttaag

SEQ ID NO: 30347 - DNA, 450 bp, Homo sapiens
  misc_feature 1..450: note = chr6:26199182-26199632
  misc_feature 1..450: note = hyper
  source 1..450: mol_type = genomic DNA
acttgtttagctcctcgtcgttgcggatggccagctgcaggtgtcgggggatgatgcgggtcttcttgttgtcgcgggcggcgttgcccgccagctccaggatctcggcggtcaggtactccaacaccgccgccagatacactggcgcgccggccccgactcgctcggagtagttgcccttgcggagcaagcggtgtacgcggcccacagggaactggagtccggcccgcgaagagcgggtcttagccttagctcgggcctttccgccttgcttgccgcgtccggacattttgaattcttaaaaacgatgttaagcaatgaagacaaaaatgtaaaagtgaattttgttagcaagtgagaaactattatacttggaggtcgaattgtaaataacgctatttgattggctagaacaaccaaccaattgcaaagaaacgctagaatcaccta

SEQ ID NO: 30348 - DNA, 40 bp, Homo sapiens
  misc_feature 1..40: note = chr6:26199835-26199875
  misc_feature 1..40: note = hyper
  source 1..40: mol_type = genomic DNA
aggcggtgaccaaggcgcagaagaaggatggtaagaagcg

SEQ ID NO: 30349 - DNA, 39 bp, Homo sapiens
  misc_feature 1..39: note = chr6:26200115-26200154
  misc_feature 1..39: note = hyper
  source 1..39: mol_type = genomic DNA
cgccgtgtcagagggcaccaaggccgtcaccaagtacac

SEQ ID NO: 30350 - DNA, 613 bp, Homo sapiens
  misc_feature 1..613: note = chr6:26204685-26205298
  misc_feature 1..613: note = hyper
  source 1..613: mol_type = genomic DNA
ggcgggaactggagtcgttggtgacgtcatcccagtctgatctgtgaagggtagggccagcaggcagcaccaaagttcccgtatgcgcgttttcagtcttcatttaggtccgaattcccggcatataagaatactaccgtcgcttgtttttcagatttttgcggctattttcgttggtgtgttggtcatgtctggtcgcggcaaaggcggaaagggactgggtaaaggaggcgctaagcgtcaccgtaaggtcctgcgagataacatccagggcattaccaagcctgccatccggcgccttgctcgtcgcgggggtgtcaagcgcatttctggtctcatctacgaggagactcgcggggttctgaaggtgtttctggaaaacgtgattcgtgatgctgtgacttacacggagcacgccaaacgcaagacagtgacagcgatggatgtggtctacgcgctgaagagacagggacgcactctttacggcttcggcggctaatgctaccgcttaaacgactcagcatctcgacttcccaaatcaaaggcccttttcagggccgcccacagttttccgcaaaagagctcatgacttgttagacgattggttggtctc

SEQ ID NO: 30351 - DNA, 210 bp, Homo sapiens
  misc_feature 1..210: note = chr6:26205502-26205712
  misc_feature 1..210: note = hyper
  source 1..210: mol_type = genomic DNA
aaaatgcatggttttcgacataagtgggaaaaccgcaagacactgcgtaaccgctcaaaatggcggagagcgaagaacaaagccggtgcctggcaatgggccggacccgcgaattagcgcaaccaatcatcttcctggaaaggagtgtgggccttaaattctagcggcctgttttctattacttaacctaacgaccgagtttaggtgtgt

SEQ ID NO: 30352 - DNA, 24 bp, Homo sapiens
  misc_feature 1..24: note = chr6:26216371-26216395
  misc_feature 1..24: note = hyper
  source 1..24: mol_type = genomic DNA
ttacaaaatcggaaaaattattcc

SEQ ID NO: 30353 - DNA, 99 bp, Homo sapiens
  misc_feature 1..99: note = chr6:26216596-26216695
  misc_feature 1..99: note = hyper
  source 1..99: mol_type = genomic DNA
gaggtaatggtcgagcgcttgttgtagtgggccagacgggaagcctcgcctgcgatgcgttcgaagatgtcgttaacgaaggaattcatgatgcccatg

SEQ ID NO: 30354 - DNA, 98 bp, Homo sapiens
  misc_feature 1..98: note = chr6:26216755-26216853
  misc_feature 1..98: note = hyper
  source 1..98: mol_type = genomic DNA
gagtagctctccttacgactgcgcttgcgcttcttgccatccttcttctgcgccttggtcacagccttcttggaacccttcttcggagcaggagctga

SEQ ID NO: 30355 - DNA, 30 bp, Homo sapiens
  misc_feature 1..30: note = chr6:26217548-26217578
  misc_feature 1..30: note = hyper
  source 1..30: mol_type = genomic DNA
tgctgcctaagaagacggagagccaccata

SEQ ID NO: 30356 - DNA, 754 bp, Homo sapiens
  misc_feature 1..754: note = chr6:26233978-26234732
  misc_feature 1..754: note = hyper
  source 1..754: mol_type = genomic DNA
gttggccattctcaacgaccagctgcacaagatcgtgggccggaagcaccttgggcatgccacgtactgctcacaaccaggacgggatgtgctcaggaagtcacctcaacgctaaagtaaactaaagcatttacaccacatccctgtgtcagaaataaaattttttcagggccacttttaagcgccgcgctttaacagaaatcggccggccaatcacacaccaccgcgggaatttgaagaaaaagtaggacctggtggctcaagtagccttagctatccggtgactgtggctgagactgagacggaaggatccttgcgcccaggctgctgggagctgttaataactgacccccaaccagcacgactaggatagaccgtggccgcacaacaccgcagcacccgcacccctctccaccccactcccccctccaaaaagcttcagctcttttgactgagacctgtgggtggctctgaaaagagccgtttaaaattttcaaaggggaacgtcccgccagtttcactttttcttcggagctgccttctttgcctttgtaaccttcggcttccccgacttaggcttggccgccttgggcttaggggctttggccttagctggactcttggcagctttttttggctgaggtgttttcacctttttcgcactcttggccactttcttggtcccagcagcggttgctggcttctttaccttcttaggagtctttttgatgcttttcttcggggtagcggcgcc

SEQ ID NO: 30357 - DNA, 191 bp, Homo sapiens
  misc_feature 1..191: note = chr6:26234942-26235133
  misc_feature 1..191: note = hyper
  source 1..191: mol_type = genomic DNA
atcgtagccagcagccgcaagcgctttcttaagcgcggccagagaaacgccgctgcgctccttagaagctgccactgccttggtgataagctcagatactgggggtccggatgctttgcgtttcccagcagttgcgcctgccttcttcgcctttttcttcacaggtgttttttctgcgggtgcaggaatgg

SEQ ID NO: 30358 - DNA, 587 bp, Homo sapiens
  misc_feature 1..587: note = chr6:26240682-26241269
  misc_feature 1..587: note = hyper
  source 1..587: mol_type = genomic DNA
tttaggaaagggaggcgccaagcgccatcgcaaagtgctgcgtgacaacatacagggcatcacgaagcccgccatccgtcgcttggcccgacgcggcggcgtgaaacgcatttcgggcctcatttatgaggagacccgcggtgttcttaaggtgttcctggagaatgtgatacgggacgccgtaacctacacggagcacgccaagcgtaagacagtcactgcaatggatgttgtctacgcgctcaagcgccagggacgcactctgtacggctttggtggctgagcctcaccccggctttttatttaacagctcacccataaaaggcccttttcagggccacctccttcgtcacacgaagggctgtaactgatgacgacttgggtttcgttttgtaaatttgggattctaactgagttaaaccgagccgtttttagcgatcttcctaagatggcggatgtgctaaggagaaagggaaggcgaaacattagaaacttgttcaggtatttcgatcgcaaacattcacaggaaaagatggtggaaatggtttgggaataccagcagccttttatgacgtatgtgatgtgtt

SEQ ID NO: 30359 - DNA, 41 bp, Homo sapiens
  misc_feature 1..41: note = chr6:26249960-26250001
  misc_feature 1..41: note = hyper
  source 1..41: mol_type = genomic DNA
ggaggagtggagtggcgcgatctcggcttacttcaacggct

SEQ ID NO: 30360 - DNA, 504 bp, Homo sapiens
  misc_feature 1..504: note = chr6:26250181-26250685
  misc_feature 1..504: note = hyper
  source 1..504: mol_type = genomic DNA
cgggctcccacagtactgggattacaaggcgtgagccgccactatcggccattttgaagacaatggccaagacacaaaagcctagtttagaagagccaccggccctgcccccatcccctaaccctccaccctccttgttttaggagacattactccctagtgctacggcgctttcaactgaaattgttggtggctctgaaaagagcctttggtttaagttggcgcacaccctcagtacaacttatgccctctctccgcgaatgcggcgagcgagctggatgtccttgggcatgatagtcactcgcttggcgtggatagcacacaggttggtgtcctcaaagagccccaccaggtaagcctcgcaggcctcctgcagcgccatcacagccgagctctggaagcgcaggtcggtcttgaagtcctgcgcgatctcacgtaccagacgctggaatggtagcttgcgaatcagtagctcagtcgatttctgatagcggcggatttcac

SEQ ID NO: 30361 - DNA, 496 bp, Homo sapiens
  misc_feature 1..496: note = chr6:26250686-26251182
  misc_feature 1..496: note = hyper
  source 1..496: mol_type = genomic DNA
gagggcgacagtaccaggcctgtagcggtggggcttcttcacgccaccggtggctggcgcgcttttgcgagccgccttagtggccagctgcttgcgcggggctttgccgccagtggacttacgagctgtttgcttcgtgcgtgccataggaatgggtttcaagcaatggtcacaactgaacaaacagttgttcttactcctatttataaaggcaaagtccttctgattggtccgaatcttccagtttcgcgccctgaattatgtagtgtgataggacttgtgatcagctactaggtctcattttagaaaatcttaacctatctaaatgcttttttcccctagttccttacattttattatgttttatgtgcctacctgtattacgtaccttcattgattttattttaatcagtttgtttgggattatgtttgacagacggaaatgaacgttctgcagttccggagcgattcaaaaataccgcgtttgagagtgatt

SEQ ID NO: 30362 - DNA, 400 bp, Homo sapiens
  misc_feature 1..400: note = chr6:26251540-26251940
  misc_feature 1..400: note = hyper
  source 1..400: mol_type = genomic DNA
tagaaacataatatccgtctttgtttctgtttaaattctcacctaaggagacagaacttataggtagatgttactggcaaggcattagtttttctaatgttttgaatgaaaaactacgttttttcccccgggaggtgtagaaaaggatttagggtaggtttcgcataaatatccaatcaaaaagtagacttgaatttaacttttttattggctgatttggtccaatcagggattgagaatgattaagcacctatttgcataaaagacctacaaaaacggccagctgtgctgttgagccttcactttggggtgtattcttactcctttatcttgttgcaatgcctgatccagctaagtccgctcccgccccgaagaagggctccaagaaggcggtgaccaa

SEQ ID NO: 30363 - DNA, 39 bp, Homo sapiens
  misc_feature 1..39: note = chr6:26252060-26252099
  misc_feature 1..39: note = hyper
  source 1..39: mol_type = genomic DNA
gatcatgaattcctttgtcaacgatatcttcgagcgcat

SEQ ID NO: 30364 - DNA, 40 bp, Homo sapiens
  misc_feature 1..40: note = chr6:26252140-26252180
  misc_feature 1..40: note = hyper
  source 1..40: mol_type = genomic DNA
cgaccatcacctccagggagatccagacagccgtgcgcct

SEQ ID NO: 30365 - DNA, 39 bp, Homo sapiens
  misc_feature 1..39: note = chr6:26252240-26252279
  misc_feature 1..39: note = hyper
  source 1..39: mol_type = genomic DNA
gtacaccagctccaaataaatggacgcatgttcaaaccc

SEQ ID NO: 30366 - DNA, 445 bp, Homo sapiens
  misc_feature 1..445: note = chr6:26271371-26271816
  misc_feature 1..445: note = hyper
  source 1..445: mol_type = genomic DNA
tcttgaagtcctgagcgatttctcgcaccaggcgttggaaaggcaacttgcggatcagcagctcagtcgacttctgatagcggcgaatctcgcgcagagccacggtgccgggacggtagcgatgaggtttcttcacgccgccggtggccggcgcgcttttccgagccgccttagtggccagctgcttgcgcggcgctttgccaccggtggacttgcgtgcagtctgcttggtgcgggccatctcagactacctgaaagaaaaactcagccacttggcagagtggaaactgcccttatatatactcagaaacattctaattggccttgttgattttcaaaagacccgcgcaacaaaaccattggctgaagagtccaacgatgtgattggtgaattactggaaaatctgattggatgaatcacttcatttttgaatcctctcttctc

SEQ ID NO: 30367 - DNA, 24 bp, Homo sapiens
  misc_feature 1..24: note = chr6:26271817-26271841
  misc_feature 1..24: note = hyper
  source 1..24: mol_type = genomic DNA
gttagtctgcgatccaagaacgtt

SEQ ID NO: 30368 - DNA, 46 bp, Homo sapiens
  misc_feature 1..46: note = chr6:26272059-26272105
  misc_feature 1..46: note = hyper
  source 1..46: mol_type = genomic DNA
gtacctgggaaatcacgagccaagaagtcaccgacatacaacagtg

SEQ ID NO: 30369 - DNA, 422 bp, Homo sapiens
  misc_feature 1..422: note = chr6:26272431-26272853
  misc_feature 1..422: note = hyper
  source 1..422: mol_type = genomic DNA
gacagggcaacagcacggcctgaatattgggcaggacaccgccctgcgcgatagtaactttgcccaacagcttgttgagcttctcgtcgtggatggcgagctgcaggcgtcggggggtgacgcgggtcttcttgtctcgggccgcgttgcccgccaactccaggatcttggcggtcaggtactccagcaccgcctccaggtacaccggcgcaccggcccggacccgcttggcgtagttgcccttgcggaggaggcggtgcactcggcccacagaaaactggagaccagccctggaagagtgcgttttagccttggcgcgagctttgctgccctgcattccacatccagacgcagtgaagtatttaaatacttgtttagaagaaggaaagtgattgattctagtaaaacgcaagagctaaact

SEQ ID NO: 30370 - DNA, 159 bp, Homo sapiens; identical to SEQ ID NO: 8394
  misc_feature 1..159: note = chr6:26273111-26273270
  misc_feature 1..159: note = hyper
  source 1..159: mol_type = genomic DNA

SEQ ID NO: 30371 - DNA, 180 bp, Homo sapiens; identical to SEQ ID NO: 8395
  misc_feature 1..180: note = chr6:26273570-26273750
  misc_feature 1..180: note = hyper
  source 1..180: mol_type = genomic DNA

SEQ ID NO: 30372 - DNA, 120 bp, Homo sapiens
  misc_feature 1..120: note = chr6:26322568-26322688
  misc_feature 1..120: note = hyper
  source 1..120: mol_type = genomic DNA
ggcgagcgagaggcggcgctgggctggcgttggagagcgacggcaggacggctgcggctacgaacacaattgcagtattttttttttttgacagagtctcgcactgtagccccggctgga

SEQ ID NO: 30373 - DNA, 157 bp, Homo sapiens; identical to SEQ ID NO: 537
  misc_feature 1..157: note = chr6:26327825-26327982
  misc_feature 1..157: note = hyper
  source 1..157: mol_type = genomic DNA

SEQ ID NO: 30374 - DNA, 106 bp, Homo sapiens
  misc_feature 1..106: note = chr6:26328310-26328416
  misc_feature 1..106: note = hyper
  source 1..106: mol_type = genomic DNA
gcggtaatcccaaaacgtttttttctataggtataacgcctgtcttcgttcgtcagagggccagtggcgcaatggataacgcgtctgactacggatcagaagattc

SEQ ID NO: 30375 - DNA, 108 bp, Homo sapiens
  misc_feature 1..108: note = chr6:26331703-26331811
  misc_feature 1..108: note = hyper
  source 1..108: mol_type = genomic DNA
tgatctggagtcagacgcgctaccgttgcgccacgaggtctccgggacacctacgttttatttacctgtcaatctgattcatgaaaataatttcggtactggtgaaga

SEQ ID NO: 30376 - DNA, 132 bp, Homo sapiens
  misc_feature 1..132: note = chr6:26332134-26332266
  misc_feature 1..132: note = hyper
  source 1..132: mol_type = genomic DNA
ggtgagttttaaattcgtttccaaagttcactgcaggtcacaaccagtgtttccgttaacgaattcacgcgggggctggcaggttgtttgtgctgcatcttttctgagagataacggcgcctccctgtagcc

SEQ ID NO: 30377 - DNA, 240 bp, Homo sapiens; identical to SEQ ID NO: 538
  misc_feature 1..240: note = chr6:26501949-26502189
  misc_feature 1..240: note = hyper
  source 1..240: mol_type = genomic DNA

SEQ ID NO: 30378 - DNA, 292 bp, Homo sapiens
  misc_feature 1..292: note = chr6:26550767-26551059
  misc_feature 1..292: note = hyper
  source 1..292: mol_type = genomic DNA
atggcctggaagagccgtactctggatacccgagggcgcggccccagcgccgcgacgccccgcccctctggctgctccgctctgggatgcacttccgacgccctctaggcttgggagttccgcgcctctcggtgtcgcctggggggcgtgctccggttggcgcactgattcccagttgggtaggggaggcttgactgagctcccacccggaatttcaccttagacctttaaagaccttgctccggcctcccgcgccagcgctaacacctagtcctctttagtggagttccgg

SEQ ID NO: 30379 - DNA, 46 bp, Homo sapiens
  misc_feature 1..46: note = chr6:26551083-26551129
  misc_feature 1..46: note = hyper
  source 1..46: mol_type = genomic DNA
cggtggtctcctcccagatggcgaatttccgcggcttcttcatctt

SEQ ID NO: 30380 - DNA, 304 bp, Homo sapiens
  misc_feature 1..304: note = chr6:26577131-26577435
  misc_feature 1..304: note = hyper
  source 1..304: mol_type = genomic DNA
tacacagaatacttccggtgtatgagaatactgctttaaagccgatcgtagtttaaaaaatgagcattaatataattaattaaaaccaaatctcctaaatggaacaagacttaaaaacccagaaacttccaggacgcacattattttggggattctagagaacgcagaactacgtgtctaaaaaggacagcgttccgtgtccttcgatagctcagttggtagagcggaggactgtaggctcattaagcaaggtatccttaggtcgctggttcgaatccggctcggaggacggtagttttgacct

SEQ ID NO: 30381 - DNA, 166 bp, Homo sapiens; identical to SEQ ID NO: 8404
  misc_feature 1..166: note = chr6:26577722-26577888
  misc_feature 1..166: note = hyper
  source 1..166: mol_type = genomic DNA

SEQ ID NO: 30382 - DNA, 213 bp, Homo sapiens
  misc_feature 1..213: note = chr6:27059686-27059899
  misc_feature 1..213: note = hyper
  source 1..213: mol_type = genomic DNA
aattgtctaagcaggcgagtactgaatccggacttcttctaagggcagacaccggaatgttgatgcggctgcagctgcgctctcccacctctgtctgtctcttctcaaaccccgaaaggaagaccgtgggcagctcgtgcgcgcgtgcgtgtgcgtgtttaaccgagtgctggaggggaaacgtgagttgcagtcaaccggttatcttcctct

SEQ ID NO: 30383 - DNA, 141 bp, Homo sapiens
  misc_feature 1..141: note = chr6:27064628-27064769
  misc_feature 1..141: note = hyper
  source 1..141: mol_type = genomic DNA
cgactccggtgtgaacggttttgggaacctcggtctcctgctggctcccaggtgcgctatccgacgcagcgagacgcggtgagcctacagaagggctgaccaggctcacctgacgccccaggtcgacagcaaaccccgtgc

SEQ ID NO: 30384 - DNA, 233 bp, Homo sapiens; identical to SEQ ID NO: 2787
  misc_feature 1..233: note = chr6:27064770-27065003
  misc_feature 1..233: note = hyper
  source 1..233: mol_type = genomic DNA

SEQ ID NO: 30385 - DNA, 264 bp, Homo sapiens; identical to SEQ ID NO: 2788
  misc_feature 1..264: note = chr6:27065004-27065268
  misc_feature 1..264: note = hyper
  source 1..264: mol_type = genomic DNA

SEQ ID NO: 30386 - DNA, 49 bp, Homo sapiens
  misc_feature 1..49: note = chr6:27094912-27094961
  misc_feature 1..49: note = hyper
  source 1..49: mol_type = genomic DNA
ctacattagcctatccgttattgccataagatggcgacagcccttctca

SEQ ID NO: 30387 - DNA, 84 bp, Homo sapiens
  misc_feature 1..84: note = chr6:27100309-27100393
  misc_feature 1..84: note = hyper
  source 1..84: mol_type = genomic DNA
tgcgctcgaaaatgtcgttcacaaacgaattcatgatgcccatggccttggacgaaatgccggtgtcagggtggacctgcttca

SEQ ID NO: 30388 - DNA, 600 bp, Homo sapiens
  misc_feature 1..600: note = chr6:27100453-27101053
  misc_feature 1..600: note = hyper
  source 1..600: mol_type = genomic DNA
ctttcttctgcgccttagtcaccgccttcttggagccctttttcggggcgggagcagacttcgctggctctggcatagcactgtgtagctataaagcgccaacgaaaaggaaaaacagcgtgagcagggtatgacaaggcgcttttatatagaatcgcttatgcaaataaggtgaagagttgaagtcttgtgtctgattggtagttattcagggtaacgtcagaggtcaggtctgcccaatcaggattcgcaaatccagaagacgcactactattggttgaaattaaactgcagccctaaccaacaacacgtcttctttttcgcgcccaatagtgtttataaaaagcgccgcctttcccgttcactttgtggttgctcgtagtgagttgcgctcgctatgtctggacgtggcaagcagggaggcaaagcccgcgctaaggccaagactcgctcttctagggccggtctccagttccccgtgggccgagtgcaccgcctgctccgcaaaggcaactatgccgagcgggtcggggccggcgcgccggtgtatctggcagcggtgctggagtacctgaccgccgagatcctggaactggcggg

SEQ ID NO: 30389 - DNA, 24 bp, Homo sapiens
  misc_feature 1..24: note = chr6:27101113-27101137
  misc_feature 1..24: note = hyper
  source 1..24: mol_type = genomic DNA
ccgcaacgacgaggagctcaacaa

SEQ ID NO: 30390 - DNA, 39 bp, Homo sapiens
  misc_feature 1..39: note = chr6:27173508-27173547
  misc_feature 1..39: note = hyper
  source 1..39: mol_type = genomic DNA
aagagatgaattgcccggctaatgtcactgccggacgcc

SEQ ID NO: 30391 - DNA, 549 bp, Homo sapiens
  misc_feature 1..549: note = chr6:27173632-27174181
  misc_feature 1..549: note = hyper
  source 1..549: mol_type = genomic DNA
cgtggcccggttcctttctcttacactcttccaaggaccccttttagacctagaggaaaccccgcagaagtgacagggagagggggaaagctcttttacagtggcgaaaccacgtggctgcgagagcttctcagggagagctcctgttttcaaagtctggcaaatttatcagtttgatttttcttaaacatttatatttttatggagtagaaaatctaccaaacgagtaaagaatgtttccgcctggtttcaaaccggggacctttcgcgtgtgaggcgaacgtgataaccactccactacggaaacaactgtgggaaagggttacccacatcccccccgcccccatccccaccccgccgcttaactaagagggctttgcctgaagggcctggactgccttatacgtctgtttagaaaatgatcgttgtggtgcagttctctccttttactgttttcgaaaagaaaagcaattcataaccaagcttccccagggctccaattcccgcacaaatttcaaacatggaaagctagaacggaatgctacagaa

SEQ ID NO: 30392 - DNA, 121 bp, Homo sapiens
  misc_feature 1..121: note = chr6:27182869-27182990
  misc_feature 1..121: note = hyper
  source 1..121: mol_type = genomic DNA
aacaaaaacaaaaagcgggtacatcaatgatagataatcgacagacgcagactgagtggccagtagtcaaaagcgcaaccgagggccagtggcgcaatggataacgcgtctgactacggat

SEQ ID NO: 30393 - DNA, 97 bp, Homo sapiens
  misc_feature 1..97: note = chr6:27203207-27203304
  misc_feature 1..97: note = hyper
  source 1..97: mol_type = genomic DNA
aaagatataccctgacggaacggataaatttaaagttcattttaactaattcaaaactgaaaaacactctcactaagcgagtttccgtagtgtagtg

SEQ ID NO: 30394 - DNA, 505 bp, Homo sapiens
  misc_feature 1..505: note = chr6:27205332-27205837
  misc_feature 1..505: note = hyper
  source 1..505: mol_type = genomic DNA
gaaggtgagaaccctcgtggcccgtacggggatcgaacccgcgaccttggcgttattagcaccacgctctaaccaactgagctaaccggccacccggaaaacagttgttctttcaattttaaaaaagcaaaatgtttgttgtttttgtgtttctttaacactaaaggaaattcttttcctctcctcaaagggatgtcttttaaaataattttaattgcgactacgtaatattgtttcttcaaacttctgttggtgttttgcattttcccttcctgcactcccgcagggaagaaggaaaacaaaaacaaaaacaaggacaaggccaaaaactctacctccagcagaaaggaacttcgcctctcccgtgggaaatgagattttctcaaactcacctattccgcccggagaaaatactacagagaaccattcacgagaggggcttccttccttttgaccttgggaggggtccagagacccgggggacgatctgggagcagaagctggt

SEQ ID NO: 30395 - DNA, 344 bp, Homo sapiens
  misc_feature 1..344: note = chr6:27205913-27206257
  misc_feature 1..344: note = hyper
  source 1..344: mol_type = genomic DNA
cggcatgaggaatccgctccataatggaaggaagaaaatctccggcagctatgcctcgcgggttcataaggactggagagttactccttctctctggccccctcaaaacgcccggtggtatgtctgttgctccactacgcgttattataattaactgcttgtgttactctttgtgctgtcttgctcttcattctcctggtacctcgggtgcccgcacagcatggtaagctgctcaatagttcaatgaatggggaaaaggtgtgcagaggtcatttctgctgattatcaagacttcaattcttcgaagtggagcacgaggatcctctaggcggcaggcaaatgtc

SEQ ID NO: 30396 - DNA, 15 bp, Homo sapiens
  misc_feature 1..15: note = chr6:27228172-27228187
  misc_feature 1..15: note = hyper
  source 1..15: mol_type = genomic DNA
gaagagcccacctgc

SEQ ID NO: 30397 - DNA, 170 bp, Homo sapiens; identical to SEQ ID NO: 540
  misc_feature 1..170: note = chr6:27228289-27228459
  misc_feature 1..170: note = hyper
  source 1..170: mol_type = genomic DNA

SEQ ID NO: 30398 - DNA, 197 bp, Homo sapiens
  misc_feature 1..197: note = chr6:27242926-27243123
  misc_feature 1..197: note = hyper
  source 1..197: mol_type = genomic DNA
tcgctggctgaaaaccgacgagtttctgcagaactgccataaaaaactactggggaaaatacgtggccagtacggggatcgaacccgcgaccttggcgttattagcaccacgctctaaccaactgagctaaccagccgacgctgggtgcagctcttccccccccaccccccgcccttaatctcgacactcatccttt

SEQ ID NO: 30399 - DNA, 119 bp, Homo sapiens
  misc_feature 1..119: note = chr6:27247620-27247739
  misc_feature 1..119: note = hyper
  source 1..119: mol_type = genomic DNA
ctggcccagtgctcccggaaagggtggctttcggcaaagtctcggcctcgccttgaccctccaggaaaaatgttcctgagcggaaagatcgttcaagttgcctgcgaaccaagtccttg

SEQ ID NO: 30400 - DNA, 56 bp, Homo sapiens
  misc_feature 1..56: note = chr6:27248054-27248110
  misc_feature 1..56: note = hyper
  source 1..56: mol_type = genomic DNA
tgcccggtttcgaaccggggacctttcgcgtgtgaggcgaacgtgataaccactac

SEQ ID NO: 30401 - DNA, 505 bp, Homo sapiens
  misc_feature 1..505: note = chr6:27255942-27256447
  misc_feature 1..505: note = hyper
  source 1..505: mol_type = genomic DNA
tgctttccttcgccgcggttgcggccgcgaccctgttcttaccaccagcaattcctccagggacttggtcagcagcccaacttgatctgcgtctctctgctaaggtgtttccgcaacagggtcaactccaagtctcacctttctaggaatcccgggcgcagcgcgggggtcgggactccgacctgtatttccaggcggaggtttccctgggtcaggcggccactctctgccagagattgtcagttatccaactgtcaatagagccgccgctccagcgagtttaatttaggcacagaaaagtcctgcctgggttgaggtgggcttaggatgagtttacttgagtgtgtgatttagaaatagatctatgggacagacagacacgaaatcgggcattggggccctcgcaggcagggtatctagactggcagctgccggtgcaggatattgccaaggactcggcatccggctcagctcaaggtggggacgaagacgtcctggttgcaag

SEQ ID NO: 30402 - DNA, 320 bp, Homo sapiens
  misc_feature 1..320: note = chr6:27258104-27258424
  misc_feature 1..320: note = hyper
  source 1..320: mol_type = genomic DNA
aaacatcgacaacaacgaaatcacactcttctgaattcctgcctctgccccgtgaaaacaaaaaaaaaagaaaaaaaaatcaacgtccacagtaacaagcctcgcatctgaggggaaattttcttaaattctccagtcacgtctgaaaaaaaaaagttttaatggaggactttgtagtaaagaaaagcatggtaaccttgataatttactgaaaggaaaggccaatcaactcgatgttaccaaagctgaaacagaaaaatttaattctcccttaacgaaggaagccaacgcagcacacaggtttccgtggtgtagtggtt

SEQ ID NO: 30403 - DNA, 991 bp, Homo sapiens
  misc_feature 1..991: note = chr6:27279795-27280786
  misc_feature 1..991: note = hyper
  source 1..991: mol_type = genomic DNA
gtggggcagggtgggcgcggtggacgaactgaacccgatgaacttggtgaaggggctgaggtggccggcgtttcgtgggcctctcgggcaagtcggtgcgcacctgggctggggacgagggcgaaagttccagtttgctcaggaaactgcccatgaggagagatgaggcgcgggcagtgagttcaagcacggttttggcttccgaggtttcggacgtctgcagaatcggacagagtcgaagagcgcagtgttcggttgacggttgggattcacgcgctaggaaagcgcgagtctcagggtgcttagcactctccaggcccggcacccgcgggaacgggggacacgcgggacttcggcagtcccagtaacttgctttgctgttctgagacctcagcggggcggtcagacctctgctgtctccgcagcgagttgcagtacttggcgcggggagaggaactcgagaggaagctcactgcgcctcgcccctggcgtcggcagcggctgtctgggaccctgtggtccggattcaccaagtggcgcagagctggaatcgagtgggtgcacagtttccaggctccgactattactggcctcgaaggtacaggctcaggcggctcagggccccggcgcagatctgtcggcccgcgggatccccggagtctgagtggggagcactatccgcaccccgtagagtgagtgcgggcggctttcgcaggtgctcaggactggagatctggaccggtggctgtgccgcccggatggcatttgtggcactagcagtcgggaaagcagctgattgaggatttccgcgtttctctttttttgcagatcgtgacgccgccagtaggtgtcagtcatttgccgcacagccacctttgagatccacctgtgtctcccagcggccgaatccaggtttccttcctattcgcacttggagaactcatgcagattgccgtcaggagtggcctcagagatccggagtgggcgaatg

SEQ ID NO: 30404 - DNA, 328 bp, Homo sapiens
  misc_feature 1..328: note = chr6:27342701-27343029
  misc_feature 1..328: note = hyper
  source 1..328: mol_type = genomic DNA
gcaggatacactgcccgcccagtggcctggagggcgcgtcccgggctcccctacgccttttggaatcagcgacagacgcaggtataaaagagagcctccactcccacctctccagggctccccacccgctccttctggccgctttctcctgaaagagcaaggcacccctagaagcttcaggctcctccacaggcgagtgcctacccacctatcaggtaagacgtgcaactgacactcagcgcgcggaggagcccgctgagaaagggtttacctgtccgaagagaactgcgcttgcatggctctggctgtgggccggctggctcttgtc

SEQ ID NO: 30405 - DNA, 66 bp, Homo sapiens
  misc_feature 1..66: note = chr6:27356988-27357054
  misc_feature 1..66: note = hyper
  source 1..66: mol_type = genomic DNA
tcatgaagcccccagcgctcgtctcactggcgggccagcctagtccctctgcggcagtgacagcca

SEQ ID NO: 30406 - DNA, 538 bp, Homo sapiens
  misc_feature 1..538: note = chr6:27463133-27463671
  misc_feature 1..538: note = hyper
  source 1..538: mol_type = genomic DNA
ttccacataatttttcgctccctccacctaagacacaaatcagcggaagcgattccgtgcctggaatcccctacgaacaccgtcgttcaccgaggagctttgggctcctggaagtccgaacaccccggatcagaggagagttggccatgactccccgtcggtaccggctgggtttggtgccagctatggcgagtacagaagcctggccggtcccggggcaggcaggcgctcgctggatgttattcgactgactggatatttgctggaaacgttaatgcttgtgcgatgaggactctctctaattgcagggcgctcaattaccaaggatagcctgacttcctttcctagaattctcatttcaccttagcatttccaaaaaaactcaccaaagacagaagtttgcacacgtcacctgacacgtcatttcaccaatctatcaaagggtgaagttccacagctgtagtcgtggccgagtggttaaggcgatggactagaaatccattggggtctccccgcgcaggttcgaatcctgccgact

SEQ ID NO: 30407 - DNA, 33 bp, Homo sapiens; identical to SEQ ID NO: 8419
  misc_feature 1..33: note = chr6:27471362-27471395
  misc_feature 1..33: note = hyper
  source 1..33: mol_type = genomic DNA

SEQ ID NO: 30408 - DNA, 123 bp, Homo sapiens; identical to SEQ ID NO: 542
  misc_feature 1..123: note = chr6:27512761-27512884
  misc_feature 1..123: note = hyper
  source 1..123: mol_type = genomic DNA

SEQ ID NO: 30409 - DNA, 499 bp, Homo sapiens
  misc_feature 1..499: note = chr6:27512994-27513493
  misc_feature 1..499: note = hyper
  source 1..499: mol_type = genomic DNA
cgcccgctccagtccggttttagccgttccttcggaagagtaagtcagttgaatgtcatcgaagaagctcctgatttagattttaactgtacgtaaacgcagatgaccccccactctcgtgccttcatttaattcccgttgcttctcccatgggtattcagaggcttgaggttgcttggactctcaattcaatactccctttctgcgggttcgtgagaattaggtgtgaacgtggtgtccgcggatttcagcagctagcgggcaagctccagcgcccagaaactttgagtcgcttgtctaggagtcctgtgttgaattgcaacactatgcactatgttctggttattgatgtgctctgaatgagctctttcgttcgtgagcagaggccctgacgagactgaagaccaactatttccgagcgctccactcaaccattataagttcaccccagccgtcagcgatggcgtaggtaggtagtcgtggccgagtggttaaggcg

SEQ ID NO: 30410 - DNA, 555 bp, Homo sapiens
  misc_feature 1..555: note = chr6:27533822-27534377
  misc_feature 1..555: note = hyper
  source 1..555: mol_type = genomic DNA
ggcgctgtgaggcaacggtctcaagagtcctcgagagaaagagaggtgttgcccctccctggggacaacctgacactaggtgtggagccagtcgcggggatgggcgaccgccatggggccaggggcggaagtggggatagagcacagggtataaaagactcctgctacagctccccctctgctgtcgggtgcagacacgaggtagcctccaggtgacaacacgggtggtgagagccgccgcatgaatccacactgcggctgaaggtcaagaattggcggtagcccatcggtagcccagagacccaaactgtgtccgatgtgagtgaaggtcaccccagatcagtgcgtcagttccgttttggcggccaaatttctgacgatcccatgtaagaaatgccacacctgtcaataggagcgactcacgcgctgggtctctttctcggatcgggtcgccaccccagtgccgggactatgctaaagactagagtctcagacttggaatttcgaggaaggtgttccaaaacgctgcgctccctccggcgagggacaagagca

SEQ ID NO: 30411 - DNA, 32 bp, Homo sapiens
  misc_feature 1..32: note = chr6:27551251-27551283
  misc_feature 1..32: note = hyper
  source 1..32: mol_type = genomic DNA
cgaaccccggtctcccgcgtgacagacgggga

SEQ ID NO: 30412 - DNA, 128 bp, Homo sapiens
  misc_feature 1..128: note = chr6:27559865-27559993
  misc_feature 1..128: note = hyper
  source 1..128: mol_type = genomic DNA
aatgacgaagaaaatcgggctcagaatagagtgggaccccttcggtagtgaataatcccgcagctcattattgcgaacagcagcccttagagatcgtagctggctggtaaaggcggctttagagcgga

SEQ ID NO: 30413 - DNA, 732 bp, Homo sapiens
  misc_feature 1..732: note = chr6:27572883-27573615
  misc_feature 1..732: note = hyper
  source 1..732: mol_type = genomic DNA
gactgatcagttgaacggctaaggaaaagaactgggtgttaccgtcgttgctagagcggtgtgagtttacgacagttgctggtcagatcaatgtccgactcccctttcagagagacagacgatatacaggaatctggaacattcctacagggctctctgagaacggagacctttttctcgtgccttttttcttttcttttctttttttgtttgtttaatttttatgttagcggattcacagaccaatagatggaaatccgctgcttactttctcgcaggagaaaatgatctccaacagtgctgcgggactgcgtccaaatggcactgaaaatatcccaggattctgtaaatgtggggttttcctttgtcgattggtttgatgtaagagagatgcctctctctttgcgagaccctgtttggcgaacatcggttggggagggaaatcttggaggtagaaacggctgaactattgtggcattccttggcgaaactttcggtacaaatctggtagggaaaaacaaaagatcaggctgtgtcagaagtgggattcgaacccacgcctccatacggagaccagaagacccgaacacaggaagcagtaagcttgagtctggcgccttagaccactcggccatcctgacactgtgacaaaaatccttgaaactatacatgatgagtaatcacggcttacggctcgccttctggctgaatcccagccgcaaaagttctctc

SEQ ID NO: 30414 - DNA, 53 bp, Homo sapiens
  misc_feature 1..53: note = chr6:27585093-27585146
  misc_feature 1..53: note = hyper
  source 1..53: mol_type = genomic DNA
ttttcctattgtttgcgtttataccacttccggtcacacgggcattgttttgc

SEQ ID NO: 30415 - DNA, 188 bp, Homo sapiens; identical to SEQ ID NO: 8427
  misc_feature 1..188: note = chr6:27598672-27598860
  misc_feature 1..188: note = hyper
  source 1..188: mol_type = genomic DNA

SEQ ID NO: 30416 - DNA, 81 bp, Homo sapiens; identical to SEQ ID NO: 8428
  misc_feature 1..81: note = chr6:27599260-27599341
  misc_feature 1..81: note = hyper
  source 1..81: mol_type = genomic DNA

SEQ ID NO: 30417 - DNA, 218 bp, Homo sapiens
  misc_feature 1..218: note = chr6:27635245-27635463
  misc_feature 1..218: note = hyper
  source 1..218: mol_type = genomic DNA
aagaatgaaaaacatcgaagctcctggtggtacttcggtctttaaccgttgaatacattaagagtaacactggaattccaacacttcctcgcgccagcgtcagttttagaatcaacaaaatcgttacttgctgattcatttaactgctaatatattcgttaaaagtttattaggcgtcagtgatcttgaaagttccaaaaacacgaaggaaaccccag

SEQ ID NO: 30418 - DNA, 211 bp, Homo sapiens
  misc_feature 1..211: note = chr6:27635858-27636069
  misc_feature 1..211: note = hyper
  source 1..211: mol_type = genomic DNA
tccctcaaccccattcgccttcctttcggcggcgttgtcttgaaccaacctgaaaataataagtccttaagttacaagtcactaaagggaagtttgcaacttgcgatccagtacactgacatgactctaaaaagagaaggctgccgactctgggcgtactgcctttgaattagccatactccgcaaggagcagtgccgttcaaaaaaaaaa

SEQ ID NO: 30419 - DNA, 161 bp, Homo sapiens
  misc_feature 1..161: note = chr6:27636349-27636510
  misc_feature 1..161: note = hyper
  source 1..161: mol_type = genomic DNA
gcgcattcgtgtggccggttagctcagtcggctagagcgtggtgctaataacgccaaggtcgcgggttcgatccccgtacgggccactggatgccatagtggggcccttcacttacctgaagggaggccttttaatttaagcctgtcgaatcacaggtgct

SEQ ID NO: 30420 - DNA, 219 bp, Homo sapiens
  misc_feature 1..219: note = chr6:27647517-27647736
  misc_feature 1..219: note = hyper
  source 1..219: mol_type = genomic DNA
gtaggggttggcgatcgaccatcaggagagcccagtctttgccacttgcggggagtcacttattgcaggcagggtgttaactgagtttaacactaggagacaaaatgaggaaataatctctcagaatgtaggttaggaaagtagaaacgccctccgagtgtatgtctatcccagaagaaaacctgtcttaaagttcgcgatttttaccaaaataggcca

SEQ ID NO: 30421 - DNA, 357 bp, Homo sapiens
  misc_feature 1..357: note = chr6:27647890-27648247
  misc_feature 1..357: note = hyper
  source 1..357: mol_type = genomic DNA
cgaaccgagctgaacgctcattgctgagtcctgggagaaggtcgcgtttgtacagaaggctcctggcagcgagcaaggccgggagtgggcccagtgcgcacgaagtcgcgccccgaattcccactgggaggaacgcactggaattgaaatgtctgagatcaagccccgctgagaatcaagtcccagaggatcttctcggctggtggaaacgtggaggggaaaggcggtcacgaaaattgaagtctcctagtccaatacagattatccaggccgttgacggcaggaatatatttttatttattcctttacccttctctcctcacagctcttccttctcgtccacgcttgatgggtttt

SEQ ID NO: 30422 - DNA, 76 bp, Homo sapiens
  misc_feature 1..76: note = chr6:27648814-27648890
  misc_feature 1..76: note = hyper
  source 1..76: mol_type = genomic DNA
aaccgcaaactggttcgtgcgtaagaaggaatagaaactaagcagcaaccaagaatatcataagcctacctgtttc

SEQ ID NO: 30423 - DNA, 15 bp, Homo sapiens
  misc_feature 1..15: note = chr6:27648950-27648965
  misc_feature 1..15: note = hyper
  source 1..15: mol_type = genomic DNA
cggaaacaccctctt

SEQ ID NO: 30424 - DNA, 280 bp, Homo sapiens
  misc_feature 1..280: note = chr6:27661759-27662039
  misc_feature 1..280: note = hyper
  source 1..280: mol_type = genomic DNA
taaacgacagagacacggaaacctccgaggtttccagagcggacccggaaatgacgccaggggatgcaaacccttctgcccctttttgctacccctgaagcttactgttagtggtcgagtttttctggaagtgggcttccgcgatcgcggggaccaacgccctgagctcttgtgcccaaaggggatcgccaggttttttgatgcggatcgaaagggactggccccggagcctacaacctgacgcaggtgggacttggggaaatgtcgagaaacctaggtc

SEQ ID NO: 30425 - DNA, 331 bp, Homo sapiens
  misc_feature 1..331: note = chr6:27774914-27775245
  misc_feature 1..331: note = hyper
  source 1..331: mol_type = genomic DNA
tggagcctggcctggcggtgtcaaacgcattctggtctcatctttttagaaacccgtggatgctcaaggaatttccggataacgtgatcccggatgcgcttgactgacttacacggaacgagcaaagcgcaaagcagtccctgctaaggacttagtttatgccctcaagcgcaaaggtcggaccctctatggtgttggtagctatatgcacgtacctcatgtacatttcaccttaaatggctttcaaagagctagattaatttagtggatagatcaaaatgatttatgacccctcgccccccagtgataggaagagcgaaccagctcttct

SEQ ID NO: 30426 - DNA, 441 bp, Homo sapiens
  misc_feature 1..441: note = chr6:27777715-27778156
  misc_feature 1..441: note = hyper
  source 1..441: mol_type = genomic DNA
aaaatttgagtccttcgccaatccggttactgttgggtaggccttcagcatacttttgtccaatcagcttcagactctcactataaataagcggctagctttctctttctcctgaagtgaatctagctctgaaggcatggcgcgtacgaagcagactgctcgcaagtccaccggcggcaaggctccgcgcaagcagctggccaccaaggcggctcggaagagcgctccggccaccggcggtgtcaagaagccccatcgctatcggcctggtacagtggctctccgcgagattcgccgctaccagaagtccaccgagctgctgatcagaaagctgccttttcagcgtctggtgcgtgagatcgcgcaggacttcaagaccgacttgcgcttccagagctccgcggtgatggcgctgcaagaggcatgcgaggcctacctggt

SEQ ID NO: 30427 - DNA, 206 bp, Homo sapiens
  misc_feature 1..206: note = chr6:27782436-27782642
  misc_feature 1..206: note = hyper
  source 1..206: mol_type = genomic DNA
cgggaaactgaagcccggcccgagaagagcgggtcttggccttggcgcgagctttgcctccctgcttaccacgcccagacatggcaaaaggtctattacctttacggtcaagaaagactgaaatgaaattggaaaaacgtacattttatagcctctactgggcgcgaaaaggaagctgtgcgattggcttacgttttatttttatt

SEQ ID NO: 30428 - DNA, 213 bp, Homo sapiens
  misc_feature 1..213: note = chr6:27833079-27833292
  misc_feature 1..213: note = hyper
  source 1..213: mol_type = genomic DNA
ctggtgaacttctctcggctgttctcagttcctccatttatcgtttcttcgtcatgtcgggacgcggcaagcagggaggcaaagctcgcgccaaagccaagacccgctcttctcgtgccggtctccagttccccgtgggccgagtgcaccgactgctccgcaagggcaactatgctgagcgggtcggggccggcgcgccggtgtacctggcgg

SEQ ID NO: 30429 - DNA, 279 bp, Homo sapiens
  misc_feature 1..279: note = chr6:27834035-27834314
  misc_feature 1..279: note = hyper
  source 1..279: mol_type = genomic DNA
actgcacgccagcctgggtgacagcgagaacctgacttgaggaaaaaaaaataatccagtacagaatgacacggtcatatcaaattggcatgtaatagagaccccatcttgaaacttgctactatattgtcttgtgcgttgatagcatattatattaatgccgaacacattagtgacgccgaagtagctggtgcctaaatggcttaaacgcggaaaaaccacatacagatgatggaacaaaaactggccaatcagattatagagcgggctttttaaaat

SEQ ID NO: 30430 - DNA, 187 bp, Homo sapiens
  misc_feature 1..187: note = chr6:27834676-27834863
  misc_feature 1..187: note = hyper
  source 1..187: mol_type = genomic DNA
ctgctttgggcttagcggctttgggctttgccgccttcggcttaactgccttgggcttggcaggactcttggttgcctttttcggtttggcagcggccttggccttcttagggctcttcgccacctttttgacgccagccgccgcgggcttcttcgccttcttcggagtcttcttcactgccttttt

SEQ ID NO: 30431 - DNA, 193 bp, Homo sapiens
  misc_feature 1..193: note = chr6:27834904-27835097
  misc_feature 1..193: note = hyper
  source 1..193: mol_type = genomic DNA
cgggcttcttagctttagcggcgcctgccttcttggctttgggcttggcttccccggaggccgccttcttgttgagtttaaaggagccagaagcaccagtgcccttggtctgcaccagggtgcccttgctcaccaagctcttgaggcccagcttaatgcggctgttattcttctccacgtcgtagccaccggc

SEQ ID NO: 30432 - DNA, 40 bp, Homo sapiens
  misc_feature 1..40: note = chr6:27835377-27835417
  misc_feature 1..40: note = hyper
  source 1..40: mol_type = genomic DNA
cgggccccgggcttatataagccggcgctgccctgtgatt

SEQ ID NO: 30433 - DNA, 890 bp, Homo sapiens
  misc_feature 1..890: note = chr6:27839683-27840573
  misc_feature 1..890: note = hyper
  source 1..890: mol_type = genomic DNA
tatgccctctcccctcggatgcggcgcgcaagctggatgtctttaggcataatagtgacgcgtttggcgtgaatggcgcacaggttggtatcctcaaatagccccaccaggtaggcctcgcaagcctcctgcagcgccatcaccgccgagctctggaagcgcagatcggtcttaaagtcctgtgcgatctcccgtaccaagcgctgaaaaggtagcttccggattagcagctcggtcgacttctggtagcggcggatctcgcgcagggccacggtgccggggcggtagcggtggggcttcttgacgccaccggtggccggagcgctcttgcgagccgccttggtggccagctgcttgcgcggcgctttgccgccggtggacttgcgagctgtttgctttgttcgtgccatggctaagtagacgtacctactcaacacaaatgagagaaaaaaactgatcatcccggtatttatagctgccctcgcgttctgattggacagtagactgtgccatgccacgtctcacacacggaattggctcccagtttaatctgctagtgaaagggagacattccgcctctgttttgggtcaagaaacgtaaaatggttttgctagctaaagaaaaacaaaaacggaaacaaaaaaaaatcccccaaaagtctaggatttttcatgcatcaaaatcctgtttaaatataagcttgataaatctaaacttgccttgcactattttaattacgaggtgtcattactgatttgacaaaaagttaaagaacgtaaaggaaaagtgaaactagagtaaatttgtaaatggaggcattgaaggggatatgaaattcgagcgttgtggtatgccagtatttctcaaatttaaacgtacttaatgtttt

SEQ ID NO: 30434 - DNA, 107 bp, Homo sapiens
  misc_feature 1..107: note = chr6:27841143-27841250
  misc_feature 1..107: note = hyper
  source 1..107: mol_type = genomic DNA
ctgagatgcgcttaacgcctccacgccgtgccaggcgtcggatggcgggcttggtgatgccctgaatgttgtcgcgcagaactttgcggtggcgcttagcgcctcct

SEQ ID NO: 30435 - DNA, 400 bp, Homo sapiens
  misc_feature 1..400: note = chr6:27858304-27858704
  misc_feature 1..400: note = hyper
  source 1..400: mol_type = genomic DNA
gccgagctctggaaacgaaggtcggttttgaaatcctgcgcgatttctcgcaccaggcgctgaaatggcagtttgcggatgagcagctcagtcgacttctgataacggcggatctcacgcaaggccacggtgcctggcctgtagcggtggggcttcttcacaccgccagtcgctggagcgcttttgcgcgctgccttggtggccagctgcttccgcggtgccttgccgccggtagacttgcgagctgtctgcttcgtccgggccatagttgagaaagctatgctctgaaagcaagcagctgaatgagcagtggcttctaccagaatttataacgatgatctgatcctgattggtcagaactgttgtaggaaaaacctggttggttgttaatactatcttc

SEQ ID NO: 30436 - DNA, 96 bp, Homo sapiens
  misc_feature 1..96: note = chr6:28129482-28129578
  misc_feature 1..96: note = hyper
  source 1..96: mol_type = genomic DNA
ggcgcagccaggccccgcccagaaatttccgggacacgccccggaagtactgagagggacttccgccccgaggcgaggcctcggagctggttgctg

SEQ ID NO: 30437 - DNA, 1065 bp, Homo sapiens
  misc_feature 1..1065: note = chr6:28175217-28176282
  misc_feature 1..1065: note = hyper
  source 1..1065: mol_type = genomic DNA
acaaatgggaggactcgggcagctttcctgggatatcacaccatatagactgagaatttcagaaacgcaaagtgcgcgtcccagcagggcgagaatggcgttaactatgtcaccaccgcccaaattccctataatttaccacttatcgttcctggctttattctccgtgcgtgcagggacatgtaattctctaggagacggtggtccggacttggttcccgactccctcgtggctgcaaacaggggcagctgatttgggtggatgcagaggttgtggccaggggaagggccgcggggcagcgcgtagaactgattgtaaacccaacttcccgcctcggagcgagccgcggctcggagtagcgtcattcgaaagccaccggagatatcgagagagctccttaactgctcactgagcaaacttcgttttacagctttggggttgatatttgggaaactgggtcctaaaagtggcttctggtcttcagaaggctttgttctccgcttttgattttttgacaccacgggtttcacaccccaccccaccccccagtctcacacaaaccactcaaactcgattgcgtctccattgcgctttggggaaaaataatttaagattctcgcttctgaaatacagcgtgatggttaagagcatgggccgtggaaacagacccggggaaagcctcagctcggccactctttgccgcgtgaccctgggtggcaccttctaagggtgattctgggattctatgaattaatgcatggaaagcgcttgcgagagcgctagccggagtccgcgctatttaggtgtttgccaatattattgttgttgttaaggtgtgagggatcttggaagacagaagccaggaataaagtaaacctacagagacgtccctccccaaaccccggccgctacccctgcaagaccttgtggagcatgttaggtttcgtggcgtcgccaagttgtacctcctgcgcttcgccgcagataaagccccagcttagagcatggggtcgcaaccacccagagccttcagaccagtgagcactttccgcacaggtttgaat

SEQ ID NO: 30438 - DNA, 170 bp, Homo sapiens
  misc_feature 1..170: note = chr6:28249409-28249579
  misc_feature 1..170: note = hyper
  source 1..170: mol_type = genomic DNA
gggctctggggaaaccggcgctcccgacaggggagcaccgggcctctgagctccctcgggagcctttcacgaggtcagctacgtctttgttgtgcgcgttcctgaacttttggtccattaaccaacaattagacacgccggtattcagtgcctggcgcggtgctagatgc

SEQ ID NO: 30439 - DNA, 38 bp, Homo sapiens
  misc_feature 1..38: note = chr6:28303451-28303489
  misc_feature 1..38: note = hyper
  source 1..38: mol_type = genomic DNA
gccaggacagcccgcagactaagcgcattccctctcct

SEQ ID NO: 30440 - DNA, 30 bp, Homo sapiens
  misc_feature 1..30: note = chr6:28303931-28303961
  misc_feature 1..30: note = hyper
  source 1..30: mol_type = genomic DNA
cggaaatgcgtcagccgttctgagcccact

SEQ ID NO: 30441 - DNA, 30 bp, Homo sapiens
  misc_feature 1..30: note = chr6:28304271-28304301
  misc_feature 1..30: note = hyper
  source 1..30: mol_type = genomic DNA
ggctgagatcctgatcgcttacaagctgag

SEQ ID NO: 30442 - DNA, 225 bp, Homo sapiens; identical to SEQ ID NO: 544
  misc_feature 1..225: note = chr6:28367054-28367279
  misc_feature 1..225: note = hyper
  source 1..225: mol_type = genomic DNA

SEQ ID NO: 30443 - DNA, 67 bp, Homo sapiens; identical to SEQ ID NO: 545
  misc_feature 1..67: note = chr6:28367280-28367347
  misc_feature 1..67: note = hyper
  source 1..67: mol_type = genomic DNA

SEQ ID NO: 30444 - DNA, 81 bp, Homo sapiens; identical to SEQ ID NO: 546
  misc_feature 1..81: note = chr6:28367490-28367571
  misc_feature 1..81: note = hyper
  source 1..81: mol_type = genomic DNA

SEQ ID NO: 30445 - DNA, 306 bp, Homo sapiens
  misc_feature 1..306: note = chr6:28367572-28367878
  misc_feature 1..306: note = hyper
  source 1..306: mol_type = genomic DNA
cgcggggcgcacttccgcggccgctctaggaagggagcgaaaggggctttcaactcggtagtgtttccgcgcgtctacgtgagaggaaggttgatggctttcaggcccgctggtaaatggaacgggtttatcttctcctcttctttacccagccattgtccacacttcccccgacccgatgggtggtcgaggcttgtagaactgatcttaagacagggaaatcccttgcgtctccattcactttgggattctgtgtctctgaggttagagatgcctcaaagggatgttctccgggggaccttccca

SEQ ID NO: 30446 - DNA, 141 bp, Homo sapiens
  misc_feature 1..141: note = chr6:28410889-28411030
  misc_feature 1..141: note = hyper
  source 1..141: mol_type = genomic DNA
cctaagatgcagatacggagagttcagagtgccatcagtacagggcagagaggttgaagagctcaggaacagacatagggtgggggaaaggggtaggggcaacgacgctgacttttggttaacaaagcccttccaggctgc

SEQ ID NO: 30447 - DNA, 57 bp, Homo sapiens; identical to SEQ ID NO: 549
  misc_feature 1..57: note = chr6:28411031-28411088
  misc_feature 1..57: note = hyper
  source 1..57: mol_type = genomic DNA

SEQ ID NO: 30448 - DNA, 342 bp, Homo sapiens
  misc_feature 1..342: note = chr6:28411151-28411493
  misc_feature 1..342: note = hyper
  source 1..342: mol_type = genomic DNA
cggtagcccgactccgaagctcaccgaggcatccgtgagaggagatgccacctagcgcagatcacatctgctctgaatccttgacaaccgcagcccaaagaatgataaactacaaaggccggaaatgcgtcaccgcggcccgctctccgcgaaacagcggttccggctgtgttccttctaggaaggccggaggtttccacacctctgtggtcgtcactctgaatcccgtctgtagtcttaagtgagatactaggtgacacattgtcttccacgcggcaatataataacggccaacatagtgttttaacacgtattaattcattaccccgcataacaaccctg

SEQ ID NO: 30449 - DNA, 50 bp, Homo sapiens
  misc_feature 1..50: note = chr6:28414942-28414992
  misc_feature 1..50: note = hyper
  source 1..50: mol_type = genomic DNA
atccagcattgcagccgccgcggcggtctaagagctcaaaccctttcagg

SEQ ID NO: 30450 - DNA, 118 bp, Homo sapiens
  misc_feature 1..118: note = chr6:28415091-28415209
  misc_feature 1..118: note = hyper
  source 1..118: mol_type = genomic DNA
cgttcccctttatcggctctattgccagactactggacttggaggatcagcagtttcaggtcatgcctcagaccagattgaaaacatggtgcctgttaaggatcgaatcattaaaatt

SEQ ID NO: 30451 - DNA, 289 bp, Homo sapiens
  misc_feature 1..289: note = chr6:28457572-28457861
  misc_feature 1..289: note = hyper
  source 1..289: mol_type = genomic DNA
ttctcctctgtaacccgtccttccacgtcccggtggtgggggggggggtcccggttctcattctttcggggacctgcaaggagccccgcccgcaggctttgaaccgatttcggctccgcgtccaggagcaggccctacgtagggccgggggaattcaggtgcgtctgcggggcccagggcacccagggcaggcggggactgagacgactgagggttgagggacaaggaggttgggactggggaggggagacccgggacccgcccagaacgctttcgtggggttggagag

SEQ ID NO: 30452 - DNA, 64 bp, Homo sapiens
  misc_feature 1..64: note = chr6:28458128-28458192
  misc_feature 1..64: note = hyper
  source 1..64: mol_type = genomic DNA
ctgcctactcctaaacgcagccggcaaaaatgagacgtcaactaagcgccgtttcagtcccaga

SEQ ID NO: 30453 - DNA, 119 bp, Homo sapiens
  misc_feature 1..119: note = chr6:32632538-32632657
  misc_feature 1..119: note = hyper
  source 1..119: mol_type = genomic DNA
caagggtgggcctcacggaggggcgacgacgctcacctctcctctgcaagatcccgcggaacgccacctcgtagttgtgtctgcacaccgtgtccaactccgcccgggtcccctccagg

SEQ ID NO: 30454 - DNA, 128 bp, Homo sapiens
  misc_feature 1..128: note = chr6:34110456-34110584
  misc_feature 1..128: note = hyper
  source 1..128: mol_type = genomic DNA
agttccagtttcactcgatcgctcacccgctcgctctctcacctacctcgggctgcctgccgctgtgcaaggcgctccctctcagagaagtcacgcctccaacggaatgaagccgcccagacgcaggt

SEQ ID NO: 30455 - DNA, 87 bp, Homo sapiens
  misc_feature 1..87: note = chr6:34111685-34111772
  misc_feature 1..87: note = hyper
  source 1..87: mol_type = genomic DNA
ccctccctgtcacttcgggctttctgccagattgacacaggggcagccaccgctctgagagacacgtggcttcgggcacccagctag

SEQ ID NO: 30456 - DNA, 1141 bp, Homo sapiens
  misc_feature 1..1141: note = chr6:34112299-34113440
  misc_feature 1..1141: note = hyper
  source 1..1141: mol_type = genomic DNA
acccccacaacctgccgaggccacgggcaagcggttgccgggctccggccgctggcgaaggcggcgctggggcgggcacgggagctggacgcggtgcctgggaaaggagccgaggcgcgcgaggctgggtgccctcccgccgggagactgccgggaagaggtgcaaataatgccccgcgcccccgcctgtcccgcctctccgcagaccgggatgcgctaatgccgccgcccccacctgaaagctggcacgaccctccatccggtggaagcccctgtatacagagacagtactttccaccgggcccgcaaaaaagcctctgccccattccctccctcaggggcacccggaaagcctgccttagccccgaggggagaccctctagttcagatcccgcgccctccggcccctagggctccgggggcgccagctctcctcggagcactccaagcgcgggagctcgccggaggccacctccccgagccccgatgtccccgccgcagccctcgccccaggaggccggagggcacggtcccctctgtcggtccccctcgggccacaactcaccgcgcgccagcaaggtttaagccgcggcgaggggtcggctgcgtgccggcctgccccgggggcgcaggcagtcgacggccggaggcacggttctcgcggtgcccagagcccgggccgcggcgggcagcgctgacgctgcggacccagcgcgccgcggagccgcccggagtccgggacgcagcagggatgagctggcggccgcccggccggagccgccgccaagcgcgcggcgttcggctgctgctccggcaagcgagcaagcgagagggagatcggcggcaacccctgctcctgctgcggcggagcccggcgtccgagccggaaggagcgggagaggcggcaagaggagctgggtctggccgagagctccgggctgggaagggagcggagcgggagcgaccagcgagcgcagccggccgaggtacgggcgcctggcggcgccgcaacagcggcaacagcagcaggaaaaaaaatgagagcgagctagagagcgcgctggagagcgagcgagagagggagcgagagacgagagagcgaggaaggcgctgagaggggaggctgcgggagagggcggga

SEQ ID NO: 30457 - DNA, 80 bp, Homo sapiens
  misc_feature 1..80: note = chr6:34119186-34119266
  misc_feature 1..80: note = hyper
  source 1..80: mol_type = genomic DNA
ctctctccacatgtccgggggctgtcagccgtgagccaaatgtcattagcatggatgtcacaagccgggatgtcaaaata

SEQ ID NO: 30458 - DNA, 527 bp, Homo sapiens
  misc_feature 1..527: note = chr6:34433517-34434044
  misc_feature 1..527: note = hyper
  source 1..527: mol_type = genomic DNA
cagggagcaacatcccgggctccgagcgcgccagctgggagggctggggaggagggcgcaccggagggctcccggcacgcgcggggccgcgggcagcccccagaagagggagccaggcaagactgctggggcaggggtcggctgaagcagcggggagccggaccccacccgccacccgccacccgccacccccggcgcctgccaaactggttgctgcctccccggcagccgcggcgcgtccacctgcgcagccaccgcgccgccctgcccgcgctaccattggctcgctaaaaatgcctctctaatctgctctgctcggtgcacgcctcctcctcatccttcccccctctccgcctcagctctgaccttcctccttcccgcagccccggcgagatcccagagcgacgcggtggcggcggcagcgccagccccctcctcccccgggaagtcggccgggcttgaggccgggccccagacgtcccgcttcgccccgagtcgccgccgatggtccccggagctcctgcccc

SEQ ID NO: 30459 - DNA, 144 bp, Homo sapiens
  misc_feature 1..144: note = chr6:35181280-35181424
  misc_feature 1..144: note = hyper
  source 1..144: mol_type = genomic DNA
gagcgagcgcggggacgcaccctcgctccccgactctttcctaggggagcgaggacgagtcggagcccggtgctgtttggtctggagccgagcggagcttgcattgatccattgattgcgcgcggtctgcgcctgacctccctg

SEQ ID NO: 30460 - DNA, 58 bp, Homo sapiens
  misc_feature 1..58: note = chr6:35466126-35466184
  misc_feature 1..58: note = hyper
  source 1..58: mol_type = genomic DNA
cgaaactggagagggcgatggcgaaggcctgcagggcgcacagcgggtaccggtagtc

SEQ ID NO: 30461 - DNA, 49 bp, Homo sapiens
  misc_feature 1..49: note = chr6:35992409-35992458
  misc_feature 1..49: note = hyper
  source 1..49: mol_type = genomic DNA
gggcgggctgaggagatgagagtgggggaggggacgaggaagaggagca

SEQ ID NO: 30462 - DNA, 57 bp, Homo sapiens
  misc_feature 1..57: note = chr6:36088966-36089023
  misc_feature 1..57: note = hyper
  source 1..57: mol_type = genomic DNA
acaccttggaggatccgattagcaagaaaggcagggcctgtccggatgggggcaagc

SEQ ID NO: 30463 - DNA, 305 bp, Homo sapiens
  misc_feature 1..305: note = chr6:36252866-36253171
  misc_feature 1..305: note = hyper
  source 1..305: mol_type = genomic DNA
taacaattattattacgttggggtagggtattcaagatatacccacaggaaaatgcagattacaattcagtctgcaattagggaccagatagcagccaactctcaggtgatccatgcagggattctgagcattcgtcggcgcctccccaggggctgctgcgccccctgcttcccgcgcgcccaccacgcacgctgctctgggagcagggccggcggcgccgccgcctcgcagcgattggttgaaccggaggttgttgctaggctaccagtgcgccctgagcctggggccccgcagtcccatcctc

SEQ ID NO: 30464 - DNA, 165 bp, Homo sapiens
  misc_feature 1..165: note = chr6:36806918-36807083
  misc_feature 1..165: note = hyper
  source 1..165: mol_type = genomic DNA
gcagatcggcaggggcgcagtcctggagaccaggacactctgggaagggggcgcgcggaggtttaggatcgaagcggcaggggccgcggggctctgcgtccagggccggggcaaggggacccggccagcgggaggctcacctgcaggacacggtgatctccacct

SEQ ID NO: 30465 - DNA, 376 bp, Homo sapiens
  misc_feature 1..376: note = chr6:36808176-36808552
  misc_feature 1..376: note = hyper
  source 1..376: mol_type = genomic DNA
tctctgctgagtgtgcgccctactcgggggcgggtctcagttcagaaacagaccctacatctccttctggggaggtgtgtgggggcgaccccagtgccaggagggactacctcggtttcccagtggcccaggtggggtcggtgcatgggcgcctcccccatccgtggttcccgccagccgcggcctcgccaagtcggctgccgaaaccacgcgccagcgcccttccactcccccgcccgtcgtgaccacacgactgagccagcctccaggtctagaagctcctgccacccagtctggtggcaaccagactgggagatcggcccgagctccctgggcttctatgcagccagcaccgagtaggcgcgtgctgtgtgcc

SEQ ID NO: 30466 - DNA, 474 bp, Homo sapiens
  misc_feature 1..474: note = chr6:37663985-37664459
  misc_feature 1..474: note = hyper
  source 1..474: mol_type = genomic DNA
agggccaggggatgccggcatcctgatcagggtgtcaagccctgagtagaagaagcgaagccgcagcaacagcggggaaggcgagcccgccgcccggccttggtgctgacagccggctcgcccgcaagccgcgcggcaactccggctcatgcatcgcttggcttccactccggaggccgagccaggacgaggtttcggtgcaagtcgctgcaccagtcctagactgggtctgtccgggtctcccgagccgaccgggtgctctcaagggttcctaatcattcccacctctagcagggtgtgggaaagtgggtgcctcctcctgacatcccggcttcccaccagaccctacgaccggcccctgtgttccgaagcagctagctcggtctccacgcgccctggagagggcggggacgcgggcatccactccagagtccgagtcgaggtctccaccaaaccccggcagcgcgcactttg

SEQ ID NO: 30467 - DNA, 71 bp, Homo sapiens
  misc_feature 1..71: note = chr6:37664481-37664552
  misc_feature 1..71: note = hyper
  source 1..71: mol_type = genomic DNA
cgaggttaagccaaggtggagcgggacgcgggctcttaccgtagactccttgtccccggcagtggaagggg

SEQ ID NO: 30468 - DNA, 445 bp, Homo sapiens
  misc_feature 1..445: note = chr6:37673008-37673453
  misc_feature 1..445: note = hyper
  source 1..445: mol_type = genomic DNA
gcagccccagtggaacgcatcaagtttcgctgagctggtctttctaactttctccccggcagctccgcgggaagcaggatcaaatgttctccagcctgaaaagcccggctggggtgtgaggagaaaggagaaggggaggaggggcggccaatctgcggtattggaaggggaggggccggggccgggccccagggacaggcctcgtgactctccttgctccctttctgtttaaccctcccagccaattctttttcctttagccattagctctttttgatccacgtaaaagggggtggggggcgggaaatctggcgtggacttggaggcgttcagcacacccgcgaccgctgcgtggcataaactacagggggcgccattcacataggatacgacagacatggcgcccgccccctccgcccccccagtacaacgtgggggccctgct

SEQ ID NO: 30469 - DNA, 79 bp, Homo sapiens
  misc_feature 1..79: note = chr6:39016246-39016325
  misc_feature 1..79: note = hyper
  source 1..79: mol_type = genomic DNA
ctcagctgggagacccgggaggaggtccggggtgccagggtgggaggagggcctggcttgtcgctgaaagccggccagg

SEQ ID NO: 30470 - DNA, 240 bp, Homo sapiens
  misc_feature 1..240: note = chr6:39016390-39016630
  misc_feature 1..240: note = hyper
  source 1..240: mol_type = genomic DNA
cggagagcagtgcccgctatctcctggcccgggaccggcagaggggtgcggcggggcgggcccaggggtctctggcggccggaagaaccgggaccctgccaggcccctcccgcgggcagggcggcccctcgccggctcctcccccaccgcccgccaccagcccgggatcagtctccgcacgcggttccgcaggtggcagcgatggcccagtcctgaactccccgccatggccggcgcccc

SEQ ID NO: 30471 - DNA, 251 bp, Homo sapiens; identical to SEQ ID NO: 8461
  misc_feature 1..251: note = chr6:39016678-39016929
  misc_feature 1..251: note = hyper
  source 1..251: mol_type = genomic DNA

SEQ ID NO: 30472 - DNA, 190 bp, Homo sapiens
  misc_feature 1..190: note = chr6:39197136-39197326
  misc_feature 1..190: note = hyper
  source 1..190: mol_type = genomic DNA
gggcgccctggaccgcggatgcgtaaggagcgggaagaacacaggacttgactctgggcagacacgtgggccgcttctccacgcgtcgctcctccgcgcgccactagcagtatgcgccgcgcccgcctccgcacgcctctttaaccagcgcccggcgcgctctgcccccttgctccgggctccgaccggg

SEQ ID NO: 30473 - DNA, 218 bp, Homo sapiens; identical to SEQ ID NO: 8462
  misc_feature 1..218: note = chr6:39281088-39281306
  misc_feature 1..218: note = hyper
  source 1..218: mol_type = genomic DNA

SEQ ID NO: 30474 - DNA, 383 bp, Homo sapiens
  misc_feature 1..383: note = chr6:39281616-39281999
  misc_feature 1..383: note = hyper
  source 1..383: mol_type = genomic DNA
ctcagcccggcttctcgcagtcctctcgctagggcgagggtcttttcctccgaggtcccccaaccctctggtccccgcgcaggaacgcccacccccgttgtgcccgcgtctgcgttcccgacgtttccctgaacaggaaacacctgaccagggcctgaataggccccctcgccctcggcccgtacaccccgcggcccgctaccccatcccgccgcgcccaggccgacgccgctcgcccctgacccggatcagcgagtccagcgccgggcggtccagacacgtgaagttctgcaacagctcccacttgtcgcgctggaagctgcggctggagtcctgcgccgcgcggccctccagcgtccagaacacgccggtgcccagcgcca

SEQ ID NO: 30475 - DNA, 388 bp, Homo sapiens
  misc_feature 1..388: note = chr6:39759800-39760188
  misc_feature 1..388: note = hyper
  source 1..388: mol_type = genomic DNA
gcccagaggaggagccggggagaaacccgctgcccaggtggccacttttgcctctttgacccttccatgtttccaaaacagaaggggccctgagaacgctccctgccaaagtggggaacagctaccctcattgtacgcctcgccctgccggtggcgctctccccccgcctgcgttcggtctgaaagtgtgaaaattacaaatcccaagaaactgcaatcagaagtctacctagggaaaattcagagtaaccttgccataaatatcccgctccaagacgcctgacgtcagagcggggcgggcggacgggcgcgaggccgggcctggaggggcggcagccgcggcttcccggggatagcgcggagcacgcagcagcgagcggagcgcggg

SEQ ID NO: 30476 - DNA, 193 bp, Homo sapiens
  misc_feature 1..193: note = chr6:39902169-39902362
  misc_feature 1..193: note = hyper
  source 1..193: mol_type = genomic DNA
agcggaaccgcagcccgcttcgggagcacactggccgggcactcgcccccggggtcatcccagcaagggcggggaggggcagggggagggcgggacccgcgcagccaataggcgaggacgcagtcccgcgtggccttgtgggagctgtagtacgctccctgtgcccactttcctgggccggggtagcgctcta

SEQ ID NO: 30477 - DNA, 271 bp, Homo sapiens
  misc_feature 1..271: note = chr6:40554589-40554860
  misc_feature 1..271: note = hyper
  source 1..271: mol_type = genomic DNA
agttcccggttccctcgggtgcgttcagccccgcgccgagctcccgcggacacccgggatcgcaaagacgcagcgccggcgaccactcacctgggcgaggcagcatctacccccggctgggtggcaccgaggccggctccgcggggcgcccgggctccccggctcggccacgcatccttccccgcccgagacagactcgagctaaaccctccggcggctccggcgaatgcaggcagatggtggcctcggacgtccacgcggggaaagccct

SEQ ID NO: 30478 - DNA, 29 bp, Homo sapiens
  misc_feature 1..29: note = chr6:40555212-40555241
  misc_feature 1..29: note = hyper
  source 1..29: mol_type = genomic DNA
cccggtttctctctccgctccacacacac

SEQ ID NO: 30479 - DNA, 200 bp, Homo sapiens
  misc_feature 1..200: note = chr6:41337024-41337224
  misc_feature 1..200: note = hyper
  source 1..200: mol_type = genomic DNA
aggcaacaggtgggacggggagccagggagtggaaacgccggaggtcctcaggctggggatcccggagtcctcgctcagattccgattccggagaaggccaattccgggaccctatccatgtcccattccgggcaccttcctcaaaagtaggggtgggaggggcataagccggtcaagtatttcccgggccttccggagc

SEQ ID NO: 30480 - DNA, 334 bp, Homo sapiens
  misc_feature 1..334: note = chr6:41339225-41339559
  misc_feature 1..334: note = hyper
  source 1..334: mol_type = genomic DNA
tccccagagagcgatcgccccggacttgtgcctgtgttccggcctagggcagccggaacctcccgatatccccagaggagtctcaggacagcgcacagggaagtactggcttggagctgcgtgttccttgggcggccggcggagggcgaagagcaggaagagcccgggggacgacggtagcagagtgttggggaggccacagacgcggactgcgtggagaaagcacgcacccgggccgcagtagccgggcagggggacggcggaaagcagccctctctggaacattttattctgatccccgcaggactcccccgcgagccccggcttgagcagt

SEQ ID NO: 30481 - DNA, 405 bp, Homo sapiens
  misc_feature 1..405: note = chr6:41339601-41340006
  misc_feature 1..405: note = hyper
  source 1..405: mol_type = genomic DNA
cgtgggcacttacacgttcccggggaggctgggggcaggagcttcactgttcacacaaagagcgcttagaggaggaacatttaagtttgggggcaaagaaagaaaaaagagttaaaggtttaggagatgggggaggaggatggggcttaaggacgcggtgttgccgcggctcagccatcggggcgggaagctcggggagggagagcgcctgggcccgcttctcgcctattctacgcagaacttttctctcctccttcttccctcgctctgcctctctcggggcggtctccggggactgtctctcacatccattctcctctcctccttgatttatgctgcagagtggaacgaccttccctgacctcattttcatgtcggcgcgagcacacccggagccggctacgc

SEQ ID NO: 30482 - DNA, 186 bp, Homo sapiens
  misc_feature 1..186: note = chr6:41340902-41341088
  misc_feature 1..186: note = hyper
  source 1..186: mol_type = genomic DNA
gagaaatgcaaacagcggggtacggccggagtccgccccagcccccgcgccggagctgcgggtggcagggtcgggccgcggtaacccgagccgccgcgccggctccccgcgcgctgccctccgcctgccccttcgcccctgaccccgcagtcggcgcgctgggcctgcgcccgccatccccagcgc

SEQ ID NO: 30483 - DNA, 76 bp, Homo sapiens
  misc_feature 1..76: note = chr6:41341501-41341577
  misc_feature 1..76: note = hyper
  source 1..76: mol_type = genomic DNA
cctggacagaccaggcgagcctcgctcctggtgcgggagctagttttccctggatcttccgcggcagagaagcctg

SEQ ID NO: 30484 - DNA, 30 bp, Homo sapiens
  misc_feature 1..30: note = chr6:41342243-41342273
  misc_feature 1..30: note = hyper
  source 1..30: mol_type = genomic DNA
agctcccaattacttcgcgggattgggagc

SEQ ID NO: 30485 - DNA, 671 bp, Homo sapiens
  misc_feature 1..671: note = chr6:41342779-41343450
  misc_feature 1..671: note = hyper
  source 1..671: mol_type = genomic DNA
gggtccttcaaaaagcgccactttggagacggtgataaatctgcgctgcctgagtcgttcccctactcccaacccctcgctcctcatcactgcccctcctagaccctgctgtgtagacgggacctcaaggagttcccgagggaacagatttgaaagcccagctccgggttccatggacagtgtttgacaggtcagcccctcgctgtcctcctatccccctcctccaagtccggtccccctctttcaccccaacccccactctcgcgtgggactcagacactgatcccggagcgagaatgcggctgacagttaaattgcagtgtaggccgagggggggaaaagggaccatgtctctttaacgggccctgcagacaaagcgtctccccttggagcgagcggagccaggcgcagccgcgcgcagacctgtcagcgcgtctcacgcgcttgggagagagtttgcaaagtcataattatatctcttaacctgtcttgctctctgcagaagaaggtcccattatattgaaatgagattattagccatcaaatactttctttctcgggagttttttttttttttaattcaaataccttaacgacttggcaattgcattttgatcagatttagttggcgccccagcccggagcgggagccggggcgggaaggcagctgg

SEQ ID NO: 30486 - DNA, 52 bp, Homo sapiens
  misc_feature 1..52: note = chr6:41343650-41343702
  misc_feature 1..52: note = hyper
  source 1..52: mol_type = genomic DNA
tctttgaaaatggaacgcgactttcagacaaggcgaacgtggacgccgaggc

SEQ ID NO: 30487 - DNA, 278 bp, Homo sapiens
  misc_feature 1..278: note = chr6:41438225-41438503
  misc_feature 1..278: note = hyper
  source 1..278: mol_type = genomic DNA
agcgagctgctaagccggactggacggcgggagccatctgggccagcgcgggggccggggaagttcaaggcccgggcactgcgcagcgccgagggggatgacccgccgtctccggggcgccagcgccggctagttgctcaacctgctggattagtcactcggcgggacccgcgggaccgtcggaaaaacgcgaagggagcgctaacgcgcagtgggagggaaggagaggactgaagagagacgggggaggggagaggaggggtcggctgccaggccta

SEQ ID NO: 30488 - DNA, 56 bp, Homo sapiens
  misc_feature 1..56: note = chr6:41605896-41605952
  misc_feature 1..56: note = hyper
  source 1..56: mol_type = genomic DNA
acaggcaaaggaaaacgtgcagcccgcggatctccgggcctcagagagcagggagt

SEQ ID NO: 30489 - DNA, 320 bp, Homo sapiens; identical to SEQ ID NO: 2812
  misc_feature 1..320: note = chr6:41606037-41606357
  misc_feature 1..320: note = hyper
  source 1..320: mol_type = genomic DNA

SEQ ID NO: 30490 - DNA, 95 bp, Homo sapiens
  misc_feature 1..95: note = chr6:41606527-41606622
  misc_feature 1..95: note = hyper
  source 1..95: mol_type = genomic DNA
cgccctatggagcccccagcgcagccccgggcccaggtaggaccgggagtggcgagcgaagctggacaggggcgggtgggcggctgaaggggcca

SEQ ID NO: 30491 - DNA, 176 bp, Homo sapiens
  misc_feature 1..176: note = chr6:42879393-42879569
  misc_feature 1..176: note = hyper
  source 1..176: mol_type = genomic DNA
gggtcttcctccttccggttcttgggaagatcctgcaatctgaaagaggcaggagagctctttccccatctgtaatgtggtaaccgagcccgagccagctcctccctgggctggagggtgggagagtcgttagggacacctgccccgctccctccccctcccgggggggaacccac

SEQ ID NO: 30492 - DNA, 139 bp, Homo sapiens
  misc_feature 1..139: note = chr6:42879621-42879760
  misc_feature 1..139: note = hyper
  source 1..139: mol_type = genomic DNA
cggcctccaggcagccctgggaaagcaagggccgggagcgcagccctggaggcagagtgttccctcaggaccgtcaggagagcgccatccacaggattattaaaatagccatccagacggaaatcgagtgaggctggca

SEQ ID NO: 30493 - DNA, 200 bp, Homo sapiens
  misc_feature 1..200: note = chr6:43211262-43211462
  misc_feature 1..200: note = hyper
  source 1..200: mol_type = genomic DNA
aaggaggatcggggccgggccgggccgggatgatccgggtcggaaggccgccgccgccggagggagcgggtcacccaacgccgcactgagccgcccccgccccgccccggccccgggggatgcgccgccccgagctgctgcctccgccgccgccgcagccgcagccgcagcgggcacagagcaggtgaggcggggcgggg

SEQ ID NO: 30494 - DNA, 438 bp, Homo sapiens
  misc_feature 1..438: note = chr6:43237245-43237683
  misc_feature 1..438: note = hyper
  source 1..438: mol_type = genomic DNA
caccctgcctgaccccgcccacttgcccgggacgccggcgccgcaggggctgtgagcggtgggtggccccggagacggagctgtcgagtctgtgcctgacacctcttttccctccactttcttggtctctttcagttggaggaggacagactctcggggcactccctcccgcggtacagccccctgcgacgactggcgtcctccgtgttctcctcctccacgctggagacggagcattaccctcaccccggcggcggcggctcctcgggctcctccggttccctcattcagcgcagccgctcggctgagagcagccctgtgcgggcgccccaccggcgccacgcgcccctcgctgctggcaaccacagactcatgccctcggtgctccgcatctcgcggtcccagctgcagcaggtgtgggcccggttcacccacaag

SEQ ID NO: 30495 - DNA, 116 bp, Homo sapiens
  misc_feature 1..116: note = chr6:43242817-43242933
  misc_feature 1..116: note = hyper
  source 1..116: mol_type = genomic DNA
cacacactctccctccgtagctgcgcgcacttcgcccactctccggaccctgcactagcggccccggccgggagggcacgaggactgcgcagccggacccccgcaggtccccaagc

SEQ ID NO: 30496 - DNA, 42 bp, Homo sapiens
  misc_feature 1..42: note = chr6:43243433-43243475
  misc_feature 1..42: note = hyper
  source 1..42: mol_type = genomic DNA
ccccctttttgcccacgccccaatccgcgtcccctgccccac

SEQ ID NO: 30497 - DNA, 30 bp, Homo sapiens
  misc_feature 1..30: note = chr6:43244222-43244252
  misc_feature 1..30: note = hyper
  source 1..30: mol_type = genomic DNA
ggtgggacacggacacgcacccacgcgcac

SEQ ID NO: 30498 - DNA, 15 bp, Homo sapiens
  misc_feature 1..15: note = chr6:43612884-43612899
  misc_feature 1..15: note = hyper
  source 1..15: mol_type = genomic DNA
ggcagggcctcagcc

SEQ ID NO: 30499 - DNA, 180 bp, Homo sapiens
  misc_feature 1..180: note = chr6:43613052-43613232
  misc_feature 1..180: note = hyper
  source 1..180: mol_type = genomic DNA
cgctctataggtgaggaggcccccgggacgggctccccagagggtggctacctggaggcagggcggggtgggcgggtcgcagcaattgaaaggggcggggcccatggggccaagggaggtgtgggcgggatctgagatgagtggaatgggggagaccctggggggcgggcctggggacgg

SEQ ID NO: 30500 - DNA, 30 bp, Homo sapiens
  misc_feature 1..30: note = chr6:44264917-44264947
  misc_feature 1..30: note = hyper
  source 1..30: mol_type = genomic DNA
gtaacccagggaaaccggcagtgcagtggg

SEQ ID NO: 30501 - DNA, 66 bp, Homo sapiens
  misc_feature 1..66: note = chr6:44265201-44265267
  misc_feature 1..66: note = hyper
  source 1..66: mol_type = genomic DNA
gggcgtggggtctcccgtgggtacggaccggcgcttccccgccacggaaaacgcaacccaggcaat

SEQ ID NO: 30502 - DNA, 238 bp, Homo sapiens
  misc_feature 1..238: note = chr6:44265569-44265807
  misc_feature 1..238: note = hyper
  source 1..238: mol_type = genomic DNA
cagggtggccaggcccggcctcgggacggttccgtggaagcggccgctttgcgggtagtgggactgtggccttgcgctatgccctgtgcttccgtgggacgtgtctaggaacgggtgggctttctgcgggaggcgggggtcgggcagggctgctggtctggagtgcttgtgctctcttggtagcttttgtgtggcaatggatagggagctggtccaggaaaagcgtctgtggaagaag

SEQ ID NO: 30503 - DNA, 60 bp, Homo sapiens
  misc_feature 1..60: note = chr6:45387578-45387638
  misc_feature 1..60: note = hyper
  source 1..60: mol_type = genomic DNA
accaggtgtcatagccggtggcgcagaatcgcttctcggagtcaccgagggtggcagtgg

SEQ ID NO: 30504 - DNA, 260 bp, Homo sapiens
  misc_feature 1..260: note = chr6:45387838-45388098
  misc_feature 1..260: note = hyper
  source 1..260: mol_type = genomic DNA
cttacccctcgagagcgcacacctggctaccccgcacccccacctctgctcccgcggtctggcagaccctcagtcccccgcgcatctcttcagcggggcgatcccgagtcacgcaaccacagccccccaagctcatcttgtactcgaaagggctccagagtccgcgactggcaccaggcccccatcttccgtgcccctcatgctctcagagcccttccaggccccttctagggcgcagacccgggcgtgggctcagcgag

SEQ ID NO: 30505 - DNA, 38 bp, Homo sapiens
  misc_feature 1..38: note = chr6:45388359-45388397
  misc_feature 1..38: note = hyper
  source 1..38: mol_type = genomic DNA
actgatgatttttttcgcaaacacgttttcaagctttg

SEQ ID NO: 30506 - DNA, 30 bp, Homo sapiens
  misc_feature 1..30: note = chr6:45388792-45388822
  misc_feature 1..30: note = hyper
  source 1..30: mol_type = genomic DNA
ataaataaacagccacggaagcattttgaa

SEQ ID NO: 30507 - DNA, 408 bp, Homo sapiens
  misc_feature 1..408: note = chr6:45391133-45391541
  misc_feature 1..408: note = hyper
  source 1..408: mol_type = genomic DNA
acatcccggcctggccgcattgcgggctgcccgcgcagcctctctttggggctccgcgcgctctcacccgcttccctcacagccaaacgcctctcctcaggtctcggcgtccccttccccgacccgcagagttcagcggtcctggtccctcccgggctcccgtgccgggattcgtggggtgccggtgccgggcattagtgcccggggctgggcgtggggtgctgactgaggcgcgcgggctgcgctaccagtgcccgggagggtcctggacaaacctagggtctccagaggagggggtgtcagggcgggggcgtttgctctgttcgctgacccgcgccagatcccgttaccgggaggaaggcggggccgctggggcgtccgcaagccccgaagcgggggcgttcaggg

SEQ ID NO: 30508 - DNA, 178 bp, Homo sapiens
  misc_feature 1..178: note = chr6:45982792-45982970
  misc_feature 1..178: note = hyper
  source 1..178: mol_type = genomic DNA
tcattgtgtcaataacgtttctctcccattcctccccctcctcccgttttaaaggaaaggttcacgggtccagccaggtttctgccgcatcccgacacctggagacgtctttcaggaccagcctgaatcgcgtccgggctgggctctggactcggactcgcagcggtgacagcggagg

SEQ ID NO: 30509 - DNA, 30 bp, Homo sapiens
  misc_feature 1..30: note = chr6:45983617-45983647
  misc_feature 1..30: note = hyper
  source 1..30: mol_type = genomic DNA
gcccaaaatagccggcggctgcagggcggg

SEQ ID NO: 30510 - DNA, 105 bp, Homo sapiens
  misc_feature 1..105: note = chr6:46138639-46138744
  misc_feature 1..105: note = hyper
  source 1..105: mol_type = genomic DNA
gggtgactggaggaacgcccccggaacgcgcaggagctcacctgcgctcaactctggagcggagcacctgaccgcgccgcttccccgccccgcctcctggcttct

SEQ ID NO: 30511 - DNA, 931 bp, Homo sapiens; identical to SEQ ID NO: 8483
  misc_feature 1..931: note = chr6:46702594-46703525
  misc_feature 1..931: note = hyper
  source 1..931: mol_type = genomic DNA

SEQ ID NO: 30512 - DNA, 192 bp, Homo sapiens
  misc_feature 1..192: note = chr6:49518808-49519000
  misc_feature 1..192: note = hyper
  source 1..192: mol_type = genomic DNA
cgaggggaccctgcacgggaagaggtggccggtgcagaggaccttcctcatgcgggtggagaggaccacggcgaggagcccaactacccttctgtctttcaacgacaaaagcgaatttctggcaggcgtgtagccccgccgcgggacgcagcagacccacccaaatacgtgcttgtgcgggtggaggattat

SEQ ID NO: 30513 - DNA, 387 bp, Homo sapiens
  misc_feature 1..387: note = chr6:50674363-50674750
  misc_feature 1..387: note = hyper
  source 1..387: mol_type = genomic DNA
gttaccagggggtcccggggccagcgcggaattcgcggaattcaccaagccgcagctgcctgccgctgaatgcgaagagggcgcaggagactggcaggtacagctggtggtcccttcggcctgatttccctgctgagtgccacagcgtccgagatccacgactggccaggtggagccaccgactctgaagagaaccagaggcggaccagccaggggagagggcaaccctgggagcactgcacccttgtcggtcccctggaaagctagcggtaagatccgggaggctgaatttgaggccgcggtagtccaggcgacttcccctggaaggtgtgacgatgacttgtactgcaaaagaagcctagaccaggcctccgtctgggtgttttc

SEQ ID NO: 30514 - DNA, 460 bp, Homo sapiens; identical to SEQ ID NO: 2814
  misc_feature 1..460: note = chr6:50681604-50682064
  misc_feature 1..460: note = hyper
  source 1..460: mol_type = genomic DNA

SEQ ID NO: 30515 - DNA, 74 bp, Homo sapiens
  misc_feature 1..74: note = chr6:50682265-50682339
  misc_feature 1..74: note = hyper
  source 1..74: mol_type = genomic DNA
agggagcaagttgaacgatttgcacagactggattttttaaaatatatggacaatgattttgagcagcccgggc

SEQ ID NO: 30516 - DNA, 236 bp, Homo sapiens; identical to SEQ ID NO: 2816
  misc_feature 1..236: note = chr6:50682448-50682684
  misc_feature 1..236: note = hyper
  source 1..236: mol_type = genomic DNA

SEQ ID NO: 30517 - DNA, 230 bp, Homo sapiens; identical to SEQ ID NO: 2817
  misc_feature 1..230: note = chr6:50682711-50682941
  misc_feature 1..230: note = hyper
  source 1..230: mol_type = genomic DNA

SEQ ID NO: 30518 - DNA, 174 bp, Homo sapiens
  misc_feature 1..174: note = chr6:50682991-50683165
  misc_feature 1..174: note = hyper
  source 1..174: mol_type = genomic DNA
cgctccaccaccagtccttccattacgagtttcagcacagccacccggccgtcacccccgacgcctactctctgaactctctccaccactcgcaacagtactaccagcagatccaccacggggagcccaccgactttattaacctgcacaatgcgcgggcgctcaagtcgtcct

SEQ ID NO: 30519 - DNA, 118 bp, Homo sapiens
  misc_feature 1..118: note = chr6:50689899-50690017
  misc_feature 1..118: note = hyper
  source 1..118: mol_type = genomic DNA
ctgcgtgctgactctcggttaatggtgtacgcgattttgcccgcagctccggctctccaaccatcagaaccaataatctttactttaccctgtgctcgcgtatcgatagcttctttcg

SEQ ID NO: 30520 - DNA, 49 bp, Homo sapiens; identical to SEQ ID NO: 8491
  misc_feature 1..49: note = chr6:50690631-50690680
  misc_feature 1..49: note = hyper
  source 1..49: mol_type = genomic DNA

SEQ ID NO: 30521 - DNA, 424 bp, Homo sapiens
  misc_feature 1..424: note = chr6:50691789-50692213
  misc_feature 1..424: note = hyper
  source 1..424: mol_type = genomic DNA
attaatatctgctgccgtggggggagaggtaacatggggggaggggtaacatgggggaggagggttaggaagggtgagaggctagagaggaagcagcagagaataattctccccacccaactcacaggcgcacctcgcagaaatgcaaccgcagaacaaacagggacaggaaactcttgtaatcgcttacacatttttaatgtgtcagaaaaaaaagagcgatcactggagatgaagaaggggagaagaaaaatccctgccgtttgtatttctttcatttgaattgtaaacatctgtttggctgtaaggcgaacagatcatttattttgctctcaagatttggtctaattatgtcaacaccgacgctacgacgagtggggcggcgctgtggctttggagaggatgcgcgcaccggcccagcgcc

SEQ ID NO: 30522 - DNA, 213 bp, Homo sapiens; identical to SEQ ID NO: 553
  misc_feature 1..213: note = chr6:50692299-50692512
  misc_feature 1..213: note = hyper
  source 1..213: mol_type = genomic DNA

SEQ ID NO: 30523 - DNA, 661 bp, Homo sapiens
  misc_feature 1..661: note = chr6:50787216-50787877
  misc_feature 1..661: note = hyper
  source 1..661: mol_type = genomic DNA
gagcaaaatagaagtcgtagcagtttattagtttctgttttcttgtgttttgcttccttgagggtcactgcgtccgaacagaaatcgcagccgcctcctgtgtgggcatctttcacggaaatttctgcccacgttcaatgcgtacgggtctctagcactgaggctagctcaactcttcggggcaggagaagttgcgcccagccaggaggacgccagccgcctccggggcccggaccgcgctcgccaaagcccttttccggctcgggcgagggctgacgcggccagacggctccgctactcgcgggcgaggcggactaggcggacgaggcggccgaggcgggcgaggtgggagaggcgggcgaggtgggagaggcggccgaggcgggcgaggcgcggggcgcgcggcgggccaggctggggaccgggaagcccgcggagcctcgcttttaagcggaatggtctgggacagccccaggtggttgccaggggaagggaggaagggaaggttctgctgagacgtcgaggttggaaataaaaacttcggaaaggcgaagcggatttagaaaaggagggaagtcgaggcgggcgaagcgggccatggagattgctaagaggaaaagttggagagaaaaggaaggaagagaagcagactcccgggtgg

SEQ ID NO: 30524 - DNA, 452 bp, Homo sapiens
  misc_feature 1..452: note = chr6:50787949-50788401
  misc_feature 1..452: note = hyper
  source 1..452: mol_type = genomic DNA
cgacccctccggatcgggacagctcctgaaagcccggcgcagagccgcctcgaagatcctaagagtgggcgactcacaggcgcggccggcaagctcctgggggactcgggctcggacgagcgcccacaggcagcgcctggcgcccacacctcctgcccccccccgaatcctaatgttggggtgtgtgtatgtgtggaggtatgtaggagagaggaggaggagataagagaggagagggagaaaagcaggagagagcgcgagagagcagagaggagagagattggtcttgttgctgaatgatgcttggggttttccttttctctttgtggttgtgtatcgactgtaacgaagagccgcgcctacgcgcctggtggggattgtttcggttcggcctccttttctttccttaacaggcgggataatggtaaagtccaaggcgctagaactgtcct

SEQ ID NO: 30525 - DNA, 30 bp, Homo sapiens
  misc_feature 1..30: note = chr6:50789549-50789579
  misc_feature 1..30: note = hyper
  source 1..30: mol_type = genomic DNA
gtctgagcccagcttcgggtgaaagaggac

SEQ ID NO: 30526 - DNA, 360 bp, Homo sapiens
  misc_feature 1..360: note = chr6:50791135-50791495
  misc_feature 1..360: note = hyper
  source 1..360: mol_type = genomic DNA
tcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcatt

SEQ ID NO: 30527 - DNA, 36 bp, Homo sapiens; identical to SEQ ID NO: 555
  misc_feature 1..36: note = chr6:50791550-50791586
  misc_feature 1..36: note = hyper
  source 1..36: mol_type = genomic DNA

SEQ ID NO: 30528 - DNA, 316 bp, Homo sapiens
  misc_feature 1..316: note = chr6:50793335-50793651
  misc_feature 1..316: note = hyper
  source 1..316: mol_type = genomic DNA
atagtcttgtcaaagcgtcggaaaggatttagtgtttatgtgaacggagcacctcggggccaagttgttgctgtcgggaatacagaccacagaggtagagagctgaaaggagaaaagcagcaggcagcacaccggagccacttgcaggctctccactcacccaacccccaccctgttcctcccctgctttatctcatttcgtcacctgccgggaggcccacgggaccttcttgggacgacccctatagtgcaagggacacaccctgctcctgtccctagagggaaacagcaaagacagggacggtctctgcctccg

SEQ ID NO: 30529 - DNA, 132 bp, Homo sapiens
  misc_feature 1..132: note = chr6:50794608-50794740
  misc_feature 1..132: note = hyper
  source 1..132: mol_type = genomic DNA
tgagttgtttttctgcgcttccgcatgcagtcctaattaaatctttacgatcctccctgtgacgattaagcgccagcatgctgcgtgaatatcctgtacaaaaacccagcaggcggccgtaattagatagaa

SEQ ID NO: 30530 - DNA, 218 bp, Homo sapiens
  misc_feature 1..218: note = chr6:50798960-50799178
  misc_feature 1..218: note = hyper
  source 1..218: mol_type = genomic DNA
agtagagagagcaaacgagtggagtgaaggtagccagcgtgataaatggctctttcatttgaagatctccagagctcgtttacggctaattttctgtattggccccctttgagctattaatgcaatctgcagggaccgtggcccctctcctcttagctgccccattagagctcccattaagctgcctagtctcaactccatggcgggagtgggcgggg

SEQ ID NO: 30531 - DNA, 564 bp, Homo sapiens
  misc_feature 1..564: note = chr6:50803804-50804368
  misc_feature 1..564: note = hyper
  source 1..564: mol_type = genomic DNA
aatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaaggtaaccccaccacgaaaaacaaaaacaaaaacaaaaaaacaaacaaaaacccaccagtttttatttattggacagtgaggagaaggttccagcaaaacccaatctgcagtctgacgcagttgcctagcaaccgggtggccggagcattgctttcgcgcagcgcttgggaggatccgcggccgccacctgctcgcccacaaactctagtgtccttgcatccaggcctgcccgcgccgcgcaagtcctaccgcagattttgccgccctgggaacctttcactttcctggccctgcgcctggcgcctctcttcctgtcacccctaggacatctcagggggcattctccagcctgagtacaacgcggaactaacagccc

SEQ ID NO: 30532 - DNA, 30 bp, Homo sapiens
  misc_feature 1..30: note = chr6:50805801-50805831
  misc_feature 1..30: note = hyper
  source 1..30: mol_type = genomic DNA
ggaaggtaagcaagacgtgtggccatttca

SEQ ID NO: 30533 - DNA, 116 bp, Homo sapiens
  misc_feature 1..116: note = chr6:50808634-50808750
  misc_feature 1..116: note = hyper
  source 1..116: mol_type = genomic DNA
gcctgcagtgggcggcgctgcgtgcgcccgcacgtttctcttgcaggcgcggcccaaacagccgcgctcatttatttagtgttggaggacgcggtttgtcccgttgacagcgtaat

SEQ ID NO: 30534 - DNA, 163 bp, Homo sapiens
  misc_feature 1..163: note = chr6:50810551-50810714
  misc_feature 1..163: note = hyper
  source 1..163: mol_type = genomic DNA
gagaaaggctgaagtcgggggaaggcaaggctttggggtggaaggggtgcattacctccccacccccgctttcctttcagtcccagctgctcgagaagggagggcgctgggaaaggaaacagagcggaatcgcccacattagcctcgctcttcggtgacccgg

SEQ ID NO: 30535 - DNA, 30 bp, Homo sapiens
  misc_feature 1..30: note = chr6:50811458-50811488
  misc_feature 1..30: note = hyper
  source 1..30: mol_type = genomic DNA
ttattggaagaaaatcggagaaacgttggt

SEQ ID NO: 30536 - DNA, 45 bp, Homo sapiens
  misc_feature 1..45: note = chr6:50811838-50811883
  misc_feature 1..45: note = hyper
  source 1..45: mol_type = genomic DNA
cagagcaggttctggcggctgaggaaaatccggaccaataagttg

SEQ ID NO: 30537 - DNA, 622 bp, Homo sapiens
  misc_feature 1..622: note = chr6:50813317-50813939
  misc_feature 1..622: note = hyper
  source 1..622: mol_type = genomic DNA
cttcgtccgagagctcggccgatcgcattagatgtgttctgattgcacaaggccaggagagaccacactgaaaacgatcgtctcctttccttgcagggcaacgcgccccacgcgtgtgacgtgcgagagacgcgatggacgcgccttgctcttactgtgcaggtcctgagagcgtgtgggccacaggcgcccagtcgtgttgaggacatagaatcagccgctggaggggctgccgactgcgcgggcccttcccgctctcggtctcaccctaagggctaaggcgaccgagaaagccccattctccagtaggtaatggggcggcgcccggtgggctgcaggtggggagggctcccagcgccgccagcggccacccggggcgccggctcctggagggagagtggcctagaaatatccaaggaatccgaagcttcccctcctccacctctgccagtacggaaacaccccaccgtcacaatcctaaagcggggagatgggatgggaattgtcttacttggcaaggcagggtaccttcattgccagacgccctcatttgtgtgttcctccttgctccagcgagatagaaccttttgcgcccccaaccccgtttcgtggagtgagccca

SEQ ID NO: 30538 - DNA, 30 bp, Homo sapiens
  misc_feature 1..30: note = chr6:50814569-50814599
  misc_feature 1..30: note = hyper
  source 1..30: mol_type = genomic DNA
ccccacttaaagaaccgaagaggcttttaa

SEQ ID NO: 30539 - DNA, 215 bp, Homo sapiens
  misc_feature 1..215: note = chr6:50817141-50817356
  misc_feature 1..215: note = hyper
  source 1..215: mol_type = genomic DNA
cagggaccctgagaccgccagatccggtgggcggcttacagtggcccagaacgcacccgccggctcgtgttagcgggttaagggcttgattaaaaatagtgctggaaggaagacccgattatttttttatgaagccacattccttttcttcatttgcaaataacagttccgtagggtcccttcccagggaccctgggcgccgaagttaggggcca

SEQ ID NO: 30540 - DNA, 30 bp, Homo sapiens
  misc_feature 1..30: note = chr6:50817727-50817757
  misc_feature 1..30: note = hyper
  source 1..30: mol_type = genomic DNA
tctccgccgggatcgcggtatcctagggga

SEQ ID NO: 30541 - DNA, 559 bp, Homo sapiens
  misc_feature 1..559: note = chr6:50818449-50819008
  misc_feature 1..559: note = hyper
  source 1..559: mol_type = genomic DNA
ttgaaggggctgcagcgtgggaagccttcaattttttttttttgtaagctgcgtgtgctcagattgaggaagcagttttgtcacacatgttcaacacgttccacgctggtcacaagctagcaaggtcaggtagtttttcgcccacttgttcgaaaacctattagttcctgcccaccctgctcttcgcttttcctcctctctcctaagggctgcagccttctggagctgactcaggcgagaggcgtccagagcccaaataggggtcacacctgctgtcgagagagtcctctgcataaaaatgctctttaaaatttttaaaatcagcataatggccaatggacttaacaaagcgtgacttgcccaggctgcacggagggcaactctggcagtcatctgtaactcgaccagttaacgtcccgaacgtgcctgttcgcggagatattagcaaacgtttcaaggatgtggctgtcagatgtcattagccaacgcttgctcacccaaccatttgcctaactgggaggagggcatggccacggcgtataggcgtagaatttggggg

SEQ ID NO: 30542 - DNA, 138 bp, Homo sapiens
  misc_feature 1..138: note = chr6:50819287-50819425
  misc_feature 1..138: note = hyper
  source 1..138: mol_type = genomic DNA
acactggaaattcagcgtccggactctcgatcagatgccctagagctcagaagcacctgattgcgcggaaggctggtggtggttacttgggcaaagagagtgcgactcgaaactcgagtttctcggatttaggaaatc

SEQ ID NO: 30543 - DNA, 35 bp, Homo sapiens
  misc_feature 1..35: note = chr6:52227751-52227786
  misc_feature 1..35: note = hyper
  source 1..35: mol_type = genomic DNA
ttggctggatgggaacgccgcggtggggtgtcgga

SEQ ID NO: 30544 - DNA, 69 bp, Homo sapiens
  misc_feature 1..69: note = chr6:53213645-53213714
  misc_feature 1..69: note = hyper
  source 1..69: mol_type = genomic DNA
gcagcagcaaggcggcggcggcggagggagcgcgggtggcagccggcgcagaggcggatgtagaaggag

SEQ ID NO: 30545 - DNA, 341 bp, Homo sapiens
  misc_feature 1..341: note = chr6:55443840-55444181
  misc_feature 1..341: note = hyper
  source 1..341: mol_type = genomic DNA
gcacattccccatggcggagcctggggcggcagtcggcgaggggagggagactggaggaggatgaggggcgggcaccgcgctgggaaactgcgccagctcgggagcgcgcccctccggtgcactggctgtgaggaccagagctgttctgcgcactgcggcggcgccgagagggcggggagtggggcgtggcaggtggccgcgcctggggcagcgggtgcacggggcacctgcgggaatcgacagaaatgccgagcacctgaacaggagagaaaggagctgagccagaggatgtccaggggtgtctcattttccgcactacactgagcgcccagggctgact

SEQ ID NO: 30546 - DNA, 233 bp, Homo sapiens
  misc_feature 1..233: note = chr6:56112173-56112406
  misc_feature 1..233: note = hyper
  source 1..233: mol_type = genomic DNA
tgtctccttacctggcgcagtgtccaggctcggggttgccgtcgcagccagctgagtgttgcgccagggggacaggtatgttccaggcagtggcaagcccaacccgagcaagacctgcgctgaaacggattggctgccctccgcccggagtccgttctccctgcagcggccagtgcagagctcagaggctcagaaactcgctctcagccccctggaggcggagcccgggagat

SEQ ID NO: 30547 - DNA, 86 bp, Homo sapiens
  misc_feature 1..86: note = chr6:56708805-56708891
  misc_feature 1..86: note = hyper
  source 1..86: mol_type = genomic DNA
cgcagatcgctccaccgctgtgcgcagccccctgctgaggggccagcggctctccctgggtaagggatgatcggggggagggttgg

SEQ ID NO: 30548 - DNA, 113 bp, Homo sapiens
  misc_feature 1..113: note = chr6:56716187-56716300
  misc_feature 1..113: note = hyper
  source 1..113: mol_type = genomic DNA
ctcttacctgctatccgaagcactgccctctcggcagggtccagcactgagcccccttgaatctttcttttcgatctctcatgtttaggcaaattccagggtaaggtgtctcc

SEQ ID NO: 30549 - DNA, 306 bp, Homo sapiens
  misc_feature 1..306: note = chr6:56716389-56716695
  misc_feature 1..306: note = hyper
  source 1..306: mol_type = genomic DNA
cgttcccggaactctacagagaatgacacagaaaaagcattaacagcaaaatactcacatatgctcaatgatttaaacatctcccccaccaaccaccgccgccctccctgcccccaaactgggtctggcatatcctgcaccatcctcggagctgagggaatatgcagaaaccaaaaaaataaaacccggagctcaccatcttttcttggccaagtctccaatcgtaaaaacaatacacaggcagtttcaatacatgaagatttgcacggaagaagtgtgtggcctgtggtccggccaccagctcac

SEQ ID NO: 30550 - DNA, 925 bp, Homo sapiens
  misc_feature 1..925: note = chr6:56818720-56819645
  misc_feature 1..925: note = hyper
  source 1..925: mol_type = genomic DNA
cagactcctggaattcggtgggacatcctgggggagggaggaggagtcctggggccatcggtctctacgtgatttctccgcgagaagtttgcatgaaagttctgggggagttggggagccccgaagtttccatgccttactttcttacccctacgctccagcgaaggatgcgtgaaggcgaggctggcgcagccccggactacgctcaaattacccttaaggctttagcaaactgactaaaaatttgagttctttcctcccctccctgccctcggcatcgccgtggttattcaaacctgggagactggagggcggaggtgacggcaaaaagggcaaggggcgttaaagaaacgcactcagcctggggagtgggcaatgatggggctaggggcagccgaggagaagggagcgagccgcgcttcactctccaaatcggcttaattgttcctggtagcccgcagaaacccgtcgcggcgtgtcttacctcggcttcttgaacgacccgagaagaccgatttcatcggatgcctccctttctggagcttgcggtgccagcagcagaagaagacgatggtggcgatggtgcccagcagaagcaacaagaggaagagggcacattggatgctgtagggtctcagcaagacgaggaaagccgcggcgatcatggtgcgggcgaggcgagggcgactcgacggcggggctggagggcggcggcacaggcacccgcgctgggcgcacgccgggacggcgggcacgggtgagcgcggctcagcgcgtcatgcctggcgctcgcggccccgcgcccagcccaatggctgcgcaccccgcgccagccgcgctacgcgagtgatccagggctgcggggagcgcttgccatgactcagcagacagcgacgaggctgcgactcggcggctgggatcctct

SEQ ID NO: 30551 - DNA, 82 bp, Homo sapiens
  misc_feature 1..82: note = chr6:56820782-56820864
  misc_feature 1..82: note = hyper
  source 1..82: mol_type = genomic DNA
cagtgtgcctttctgcggacggccacggccacctggccaggaagcggctgctgcagcagtcattctgcggcatcttgcggcc

SEQ ID NO: 30552 - DNA, 83 bp, Homo sapiens; identical to SEQ ID NO: 2827
  misc_feature 1..83: note = chr6:58147428-58147511
  misc_feature 1..83: note = hyper
  source 1..83: mol_type = genomic DNA

SEQ ID NO: 30553 - DNA, 214 bp, Homo sapiens; identical to SEQ ID NO: 2828
  misc_feature 1..214: note = chr6:58147762-58147976
  misc_feature 1..214: note = hyper
  source 1..214: mol_type = genomic DNA

SEQ ID NO: 30554 - DNA, 30 bp, Homo sapiens
  misc_feature 1..30: note = chr6:58148921-58148951
  misc_feature 1..30: note = hyper
  source 1..30: mol_type = genomic DNA
gttgctcggaagctacggaagcaaagtaga

SEQ ID NO: 30555 - DNA, 26 bp, Homo sapiens
  misc_feature 1..26: note = chr6:58180231-58180257
  misc_feature 1..26: note = hyper
  source 1..26: mol_type = genomic DNA
ccgcagccctggagccgggcagtgag

SEQ ID NO: 30556 - DNA, 420 bp, Homo sapiens; identical to SEQ ID NO: 560
  misc_feature 1..420: note = chr6:62995455-62995875
  misc_feature 1..420: note = hyper
  source 1..420: mol_type = genomic DNA

SEQ ID NO: 30557 - DNA, 53 bp, Homo sapiens; identical to SEQ ID NO: 561
  misc_feature 1..53: note = chr6:62996077-62996130
  misc_feature 1..53: note = hyper
  source 1..53: mol_type = genomic DNA

SEQ ID NO: 30558 - DNA, 83 bp, Homo sapiens; identical to SEQ ID NO: 562
  misc_feature 1..83: note = chr6:62996131-62996214
  misc_feature 1..83: note = hyper
  source 1..83: mol_type = genomic DNA

SEQ ID NO: 30559 - DNA, 426 bp, Homo sapiens
  misc_feature 1..426: note = chr6:62996215-62996641
  misc_feature 1..426: note = hyper
  source 1..426: mol_type = genomic DNA
gtagcgcaagtcgggtggcctgactggcaggaggcagctgcagaggggaagggagctcggaagatgcaaacgctttcttcttgcgcccaagccttccctggctattaggcatgcccagttttgtggagttctctgtgtcttcagctaaggcgcagaggagagagagcgcgggaaaagcgcaggttaaagagagaggtctgagtacaagtggacaggggagatggagatgagaagtgagccacccgagagggtggaaaagcgccagggaaagtctcaggaaggtagatgggacttcacctgcgtccctaaggcacaggtgtctcctttccctcacacagctcaggcgcactccagttgtgcaggaatcagcagcgcactgggtctggaaatacaatgaagactgcatgtgatcggcagctggtattt

SEQ ID NO: 30560 - DNA, 326 bp, Homo sapiens
  misc_feature 1..326: note = chr6:69344323-69344649
  misc_feature 1..326: note = hyper
  source 1..326: mol_type = genomic DNA
attaagactacaaaacgaaacaaaagtttagaccccgaaaccatgattccattgccaagcacaaagcaatgcaagagcccaacgtcggtcgccgcaccgcgatcctgacaaagcctgtatggagccagaacaaataagatgttaattgcagcctcgcagagaaaaaaatactattgttccagccagagacactcagcagctcggtagctgggatgtgccccctccgctgcggactggatcaattctgaatcccggtactgaaatgacagctctctggctgcgacaggtctgcgctgaaagaaagagaaagacgatcaagtccagca

SEQ ID NO: 30561 - DNA, 461 bp, Homo sapiens
  misc_feature 1..461: note = chr6:69344978-69345439
  misc_feature 1..461: note = hyper
  source 1..461: mol_type = genomic DNA
agaactccaggaagtcgcagcggccgcgccgcgcgagccgagcctctggcgggcggcggggcgcaccgcagctgtgcataagaagggcgcgcggcacccgggacgcgcgcgcacacgagcacgcgggaggccgccgcgcggacgcgctcccgggacacgcgcaccccccgcgcgcgcgcccaagggagagcgagcactgcgcgccggcgcgcacacccgagacagagctttactatctcgctccctctcgcgcctccctcctcgctgggcattcaaacagctttccgacatcaccagccaaggatttttttccccgctctccttagtcgccgtccgtccatcagtacctgcaggggggaggaggaggagggaggaaagcggaaagaggaaaaagcataagcttgagccttccgatccgaccacgaatactcctgtaataaacccaccgccccaacaaatct

SEQ ID NO: 30562 - DNA, 32 bp, Homo sapiens
  misc_feature 1..32: note = chr6:69345820-69345852
  misc_feature 1..32: note = hyper
  source 1..32: mol_type = genomic DNA
tcactgttgctgggacgcgtgcctgtgctggt

SEQ ID NO: 30563 - DNA, 370 bp, Homo sapiens
  misc_feature 1..370: note = chr6:69942843-69943213
  misc_feature 1..370: note = hyper
  source 1..370: mol_type = genomic DNA
ggaagtggctgccaacgctctggcggctgctcgtgctgccgccgctgccgctgctgttcctcgcatagggctggacagagctagtcccggtttcagcacctccggcgctggacagctctctgcacgccgcaccgccgcctgcttgctttttcccactctcgctttgcattactggagatgcatctaaattacatcctgttcaacaacaagtagatttttttttcctgtacaggaattacagtagacgactctctcaattaaactgcattttcttctttacggatttggctatcaggcgtatttatcccgatttcctcccccctcactcccctttgcaggaacgagtctttgggaacgtggtccacccagg

SEQ ID NO: 30564 - DNA, 38 bp, Homo sapiens
  misc_feature 1..38: note = chr6:70576959-70576997
  misc_feature 1..38: note = hyper
  source 1..38: mol_type = genomic DNA
actatcaattcatgccgttagagcgctttttttttttt

SEQ ID NO: 30565 - DNA, 30 bp, Homo sapiens
  misc_feature 1..30: note = chr6:70577378-70577408
  misc_feature 1..30: note = hyper
  source 1..30: mol_type = genomic DNA
agagcgcgccggcgccgcagccacagcggc

SEQ ID NO: 30566 - DNA, 86 bp, Homo sapiens
  misc_feature 1..86: note = chr6:70991963-70992049
  misc_feature 1..86: note = hyper
  source 1..86: mol_type = genomic DNA
ttttctaaactccaacgaccaaacaggttacaatggggtctttgtaagtgaaacctcaaacctcagctgggcttatgcgcccccgc

SEQ ID NO: 30567 - DNA, 81 bp, Homo sapiens
  misc_feature 1..81: note = chr6:70992136-70992217
  misc_feature 1..81: note = hyper
  source 1..81: mol_type = genomic DNA
cgtcccggagccgccagcaccgctagctggactcggggttagtgcagctacggcgggctggaggagcgggagagggagcgt

SEQ ID NO: 30568 - DNA, 622 bp, Homo sapiens
  misc_feature 1..622: note = chr6:70992438-70993060
  misc_feature 1..622: note = hyper
  source 1..622: mol_type = genomic DNA
gacttcgataggactcgcggcaggtgctcgaggctggaggaagcgcgggtctgagagccctggggatgctccgcgcctttctcacagctccctcgaccgctgcgccccgacctgtcctcgtgtgcgcttgaaaaatgcaaacactccctgcccccaacttacctcgtcggtggtctggctgggctggagaagaaaagatggggagaaagtgagaaaagcacccctcaaactcgatcgcaacttacttgagccgcgcacaagcagagccccaacagcagcagccccagggccccgcggtcccgcgcagtccaggccatgcccgccgcccgccgctaatcccttggcccggctctgcagcctggttcccctctaggcttccagacccgccactagcataggtggcacttcgtccctgcagaaaaagcacccccgggagtagcggttgccaaagcgtccaggcccgggaggcgcgcgttccccctgtttatgaatggccccggagagggtcctgggattggaggagagctagggggcaggggaggacggatagaatgacaacagtcgcccttaaccccttccctgccgccgcacaggcgaggactgagcacgcagctctgcctcc

SEQ ID NO: 30569 - DNA, 32 bp, Homo sapiens
  misc_feature 1..32: note = chr6:71665985-71666017
  misc_feature 1..32: note = hyper
  source 1..32: mol_type = genomic DNA
gcccccgcggcccaccgcgtagggagagaagt

SEQ ID NO: 30570 - DNA, 190 bp, Homo sapiens; identical to SEQ ID NO: 8524
  misc_feature 1..190: note = chr6:71666491-71666681
  misc_feature 1..190: note = hyper
  source 1..190: mol_type = genomic DNA

SEQ ID NO: 30571 - DNA, 280 bp, Homo sapiens; identical to SEQ ID NO: 8525
  misc_feature 1..280: note = chr6:71666698-71666978
  misc_feature 1..280: note = hyper
  source 1..280: mol_type = genomic DNA

SEQ ID NO: 30572 - DNA, 118 bp, Homo sapiens
  misc_feature 1..118: note = chr6:72129732-72129850
  misc_feature 1..118: note = hyper
  source 1..118: mol_type = genomic DNA
aaccacttgagcccacggcgcctaaagccgactcacccgcagcccgaggtgcgggagccctcggacggactccggcccgccccgcagtccccaccggccgcgctgcggccccggctga

SEQ ID NO: 30573 - DNA, 119 bp, Homo sapiens
  misc_feature 1..119: note = chr6:72129926-72130045
  misc_feature 1..119: note = hyper
  source 1..119: mol_type = genomic DNA
cgcaaacttttcccggttcgcaagttgccgggatctgcggccgcggaccgacttccttcgccggccaccggagggagggggcgcccctaccccgggagggggctgggcgagccgggaga

SEQ ID NO: 30574 - DNA, 274 bp, Homo sapiens
  misc_feature 1..274: note = chr6:72130190-72130464
  misc_feature 1..274: note = hyper
  source 1..274: mol_type = genomic DNA
cgccgccgccgcccaccgcgttctttgtgtgtctctcgccgccctccagccgcttcgccgctcgcctgacagctgatgggctcaccgcgccgggtcccgcgtcctctcggccgcagccggcggagcccggcccggcaggaggaggaggggagaagaggagcgttgacagatgctgtcttggagcgggcaccgccgggggaaaagtctggactgcctcggcgagaagcggccggtaggcaaccggccccagcctcgcattcgcctcaaagacccc

SEQ ID NO: 30575 - DNA, 79 bp, Homo sapiens
  misc_feature 1..79: note = chr6:72596056-72596135
  misc_feature 1..79: note = hyper
  source 1..79: mol_type = genomic DNA
cgactgtaggggtagcggccggggcacgcgtggctcggacccggggagtgggcgggtgggtgcccgtgggcggagcggc

SEQ ID NO: 30576 - DNA, 122 bp, Homo sapiens
  misc_feature 1..122: note = chr6:72596136-72596258
  misc_feature 1..122: note = hyper
  source 1..122: mol_type = genomic DNA
ccgggactgagtggctggcagctatgtctgcgagagcagcggcatcaccctggatggaagcctctgagactccgcctaactgacacccaaactctccctctccctcccgcagccccaaattg

SEQ ID NO: 30577 - DNA, 107 bp, Homo sapiens
  misc_feature 1..107: note = chr6:72596541-72596648
  misc_feature 1..107: note = hyper
  source 1..107: mol_type = genomic DNA
gaaagactgggttctcgctctccccggctctgctgctgctgctgctgccgccgccgccgctgctcctcctcctgccgccgccgctagggctccgctgtgagggggaa

SEQ ID NO: 30578 - DNA, 75 bp, Homo sapiens
  misc_feature 1..75: note = chr6:72596950-72597025
  misc_feature 1..75: note = hyper
  source 1..75: mol_type = genomic DNA
cactcccctagtcctcgcggctgagtgtggggaaggggctgccagggtgctgggtgcggacggaggcgcccgcct

SEQ ID NO: 30579 - DNA, 342 bp, Homo sapiens
  misc_feature 1..342: note = chr6:73329784-73330126
  misc_feature 1..342: note = hyper
  source 1..342: mol_type = genomic DNA
aggccaagattttgacgtttaaagcgggcacacgagtcattttaagtctctagatctttcaccctgaaagtccctgcacagaaactccatagggagtctaaatatagcaacagcaccccctcccgccccctccgccttcagtcagggtcccgcgcagctctaggattggagagcttactccagggcgctctctgcatctgcctcgaatagcaccgcacggagcaacctctctcgcacctccacagtgcgtgggtgtgaagtgtattaggggaaagctagagagtgactctgggtgatggtgctcggctcacagtcacatggcgtcgccgccagctgcacaga

SEQ ID NO: 30580 - DNA, 494 bp, Homo sapiens
  misc_feature 1..494: note = chr6:73330620-73331114
  misc_feature 1..494: note = hyper
  source 1..494: mol_type = genomic DNA
gaaggccagaggctgcggccagtggcaccgtggcctctctctccgccaagggcgcataggctttgggccacccgggtgccaggggtggtggaagacccagtcagttgttccttgcaacaggtctctaagcttgtatgttacaacataaggtgggtggggtcggaaccccgaaaagccggcgtcctggacaccccatcctccaggtgttctttcccagacactgggtcctcgccgccgctgctgaacttctcaatcatatgactttctcggacttaaatggaaatttcttgacggagggaactgggtttgttctcccaggcttcgcgctgcagtcaggcagagccccggggcagctcgctcaccgcggaggagccactttggagttttacgccctttccacaccccacccatggactggaaaggatgttcagttactcgcgagcttgtctgatactgggatggaaagtcacagtccgcaggctggagtgaggcgc

SEQ ID NO: 30581 - DNA, 123 bp, Homo sapiens; identical to SEQ ID NO: 566
  misc_feature 1..123: note = chr6:73331115-73331238
  misc_feature 1..123: note = hyper
  source 1..123: mol_type = genomic DNA

SEQ ID NO: 30582 - DNA, 612 bp, Homo sapiens
  misc_feature 1..612: note = chr6:73331239-73331851
  misc_feature 1..612: note = hyper
  source 1..612: mol_type = genomic DNA
ctccagcctccaggctagataatacctggaaggcagggcagggctgttcccgctctcaccccttgcggaaggatggcaggatccggcgcagcgacgtagcagcgggagggcacagcgacctgcatctccagtttctcctcaggacacaaggctgacttcaccttccggacagctgcaaagcccctgccagaaccaaaccgaactcgcgcctcggagaggggcttctggggccgtttcgctgcagggcgtggggagtggagagagggaaggggaagcctggggctgggtgtgcgcgcgtgggagcgcgcctcggagcgccccgcactcccccactctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccgg

SEQ ID NO: 30583 - DNA, 1216 bp, Homo sapiens
  misc_feature 1..1216: note = chr6:73331875-73333091
  misc_feature 1..1216: note = hyper
  source 1..1216: mol_type = genomic DNA
cgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtgtgagtacccgcgccccctgctatgcccgctgcaggggaccactgtccctggccccctggggcgtgctccgcgctcgcgcccttgggcccccgcgcgcgtgcacacgtggtggcttttatttcttcgcacgtgttcgtggtcttccttctggagcctctcccctcccccagccccacttctctcatctctacagcttgaaccttttccccgaggacacccaatgaactgcccggtagcttcaggctcccggggcgagagccaggcagacgcgggacttaggctgcgcggataattgggagcaattaggtcccaagatacgtaaacttcaaccgaacggggcgcccgggagctagggaatgcaaagggaggacaggcgcccgtgtgaggcttgagagtatactggagaggttaggaggtgatggcggggtaggacggggagaagtgagggggcatcgagggctaggtcctcagtcctaggggcggagtaggggaagctgctacttggagagagctgctaggttttaagcgcgcccggaaacacgcctcgccaccacccagccaccaccaacggaaaatctgtcagtgcatgtagcccttcctgccacggagaaggtggccaaggtctagaggaggccagcaggccaggcgaagcaacgctcccgcgctgcagggggcggggaggcagcggggaacctggggcgcaggaacgcgggcggaggtgcgatagcagaagcgcaaatgggtcgcctctgacagagatcgggcagtgggttaa

SEQ ID NO: 30584 - DNA, 30 bp, Homo sapiens
  misc_feature 1..30: note = chr6:73972965-73972995
  misc_feature 1..30: note = hyper
  source 1..30: mol_type = genomic DNA
ccagagccctcctcccgcctgctctgtgta

SEQ ID NO: 30585 - DNA, 681 bp, Homo sapiens; identical to SEQ ID NO: 8540
  misc_feature 1..681: note = chr6:74019413-74020094
  misc_feature 1..681: note = hyper
  source 1..681: mol_type = genomic DNA

SEQ ID NO: 30586 - DNA, 84 bp, Homo sapiens
  misc_feature 1..84: note = chr6:74161237-74161321
  misc_feature 1..84: note = hyper
  source 1..84: mol_type = genomic DNA
agcagctcaccttcacgtgctcatagtagctcccggtgttcagcagcccgacgcctctgaacgcggagtcgcacttcagtctga

SEQ ID NO: 30587 - DNA, 114 bp, Homo sapiens
  misc_feature 1..114: note = chr6:74161684-74161798
  misc_feature 1..114: note = hyper
  source 1..114: mol_type = genomic DNA
cgggcggcctctcctgggtgtccggggcgctctttttctgccgggatcccgacttcctggcggggccgaactttcccgccttaggcagggcggcctcgggggcagccggagact

SEQ ID NO: 30588 - DNA, 209 bp, Homo sapiens
  misc_feature 1..209: note = chr6:74161830-74162039
  misc_feature 1..209: note = hyper
  source 1..209: mol_type = genomic DNA
cgtgcggaagccttgggggcagtggctccggcctcggaagctctctgcatggcctttccgtgccaaggctgcatggctggcgctttctgttccccgaaagaagaatccgtttcaggaaaaggccgcaagaggaagagccagcagcagctgttggaaaccaagcactactggcgggcacacaagagtctgcgacccgaaggggaacccca

SEQ ID NO: 30589 - DNA, 38 bp, Homo sapiens
  misc_feature 1..38: note = chr6:74405585-74405623
  misc_feature 1..38: note = hyper
  source 1..38: mol_type = genomic DNA
acagcctgaggaacccggtgggccggggaagtgggcgc

SEQ ID NO: 30590 - DNA, 63 bp, Homo sapiens; identical to SEQ ID NO: 8541
  misc_feature 1..63: note = chr6:74405916-74405979
  misc_feature 1..63: note = hyper
  source 1..63: mol_type = genomic DNA

SEQ ID NO: 30591 - DNA, 52 bp, Homo sapiens
  misc_feature 1..52: note = chr6:75914106-75914158
  misc_feature 1..52: note = hyper
  source 1..52: mol_type = genomic DNA
acttttgctgggtctcgatcgccacctgtcgctttcccgacttagctgcaag

SEQ ID NO: 30592 - DNA, 138 bp, Homo sapiens
  misc_feature 1..138: note = chr6:75914461-75914599
  misc_feature 1..138: note = hyper
  source 1..138: mol_type = genomic DNA
caattccttaactcccgcgtccagttaaaaagaaaatcacacacacacacacacaccgcgtgcgcgtcgcctacctcctctcccacccaccacgaccttggcattagccaaaggagagcttagcgtttatttcctttc

SEQ ID NO: 30593 - DNA, 72 bp, Homo sapiens; identical to SEQ ID NO: 8543
  misc_feature 1..72: note = chr6:75915049-75915121
  misc_feature 1..72: note = hyper
  source 1..72: mol_type = genomic DNA

SEQ ID NO: 30594 - DNA, 36 bp, Homo sapiens; identical to SEQ ID NO: 8544
  misc_feature 1..36: note = chr6:75915170-75915206
  misc_feature 1..36: note = hyper
  source 1..36: mol_type = genomic DNA

SEQ ID NO: 30595 - DNA, 327 bp, Homo sapiens
  misc_feature 1..327: note = chr6:75915601-75915928
  misc_feature 1..327: note = hyper
  source 1..327: mol_type = genomic DNA
tccaggagcacctggcggccgccgaggcgtgggcagctgcggggaagtccaggaggaggaggagaatcccaggaggagaggcgggcgcggcaggaagactggagatggcctgagcctgcagctgccggcgcgcggacgcgtctggggcggttcgccttagccaagtggaaagagactccgcgccgcgggctacttaatagagggctgttcccagctctcagtttactcggttacgaaacgcctgagaaggtggacggctgccacggggtgatgtatgctcctccggcggtgaaggaggtctacttttgggaacgtgtgcatacttcg

SEQ ID NO: 30596 - DNA, 153 bp, Homo sapiens; identical to SEQ ID NO: 8546
  misc_feature 1..153: note = chr6:75916306-75916459
  misc_feature 1..153: note = hyper
  source 1..153: mol_type = genomic DNA

SEQ ID NO: 30597 - DNA, 100 bp, Homo sapiens
  misc_feature 1..100: note = chr6:78172176-78172276
  misc_feature 1..100: note = hyper
  source 1..100: mol_type = genomic DNA
gtcttggtggctttgcgctccctagcggccatgagtttcttcttttccagcagggcgtcggagactcgcactttgacttggttcacatacacaggagatc

SEQ ID NO: 30598 - DNA, 838 bp, Homo sapiens
  misc_feature 1..838: note = chr6:78172322-78173160
  misc_feature 1..838: note = hyper
  source 1..838: mol_type = genomic DNA
cgaggacgtggacccgggggagtcggttatcagctgggctcgggtcaagcgcttgccggtcctgttgggcgtctgtttcaaaatccgggagcgggcttctacgtagatgcggccatagagggcgatgaggagcagggtggggaagtagaaagcacccaccgtggagtagaccgtgtagaggatgtggtcggtgttcaccacgcattccgacacctcctcttcggccttagcctgacgccagaagaagggcggcagcgagatagagatggagaagacccacaccagcgcgatcatgaccgccgccctcttgggagtccttttagctgagtactccacggcgtccgtgatggcccagtagcggtccagggcgatgacacagaggtgcaggatggaggcagtgcaacaagtgatgtccgacgacagccagaagtcacagaccacctggcccagtgtccagcggccggtgacagtgtacatggtgctgatgggcatcaccaggatggacacaagcaggtcggtgaccgccagagaggcgatcaggtagttagccggggtgtgcagtttccgggtccggtacactgtggcaatcacaaaggcattggagagcgtggtggccaaggtgatgagcgccaatagcataaccagcagtactttccagggtagggagatggagtcctggtaaatgtagtccttggcgctgcagttttgggagggagcagaggataagttggcttgaggaacccaggtctcggagcccgcgggcggcggtggagcgcactgagcacccggttcctccatggctctcctcgccccagctccggagcgcagctcttgggca

SEQ ID NO: 30599 - DNA, 170 bp, Homo sapiens
  misc_feature 1..170: note = chr6:78173771-78173941
  misc_feature 1..170: note = hyper
  source 1..170: mol_type = genomic DNA
cggacgagctgccccgcggagacggagccataaaaggggggacacgggggctggagttgcggctgctcgggccgcgccgccgccaccgccaccctggtcccacgggagccactcggagccatgccactgggtgcgcgggtctggaggacctggcgcggcacactgggaag

SEQ ID NO: 30600 - DNA, 234 bp, Homo sapiens
  misc_feature 1..234: note = chr6:78175915-78176149
  misc_feature 1..234: note = hyper
  source 1..234: mol_type = genomic DNA
tgtcctgtgggagtgcggggtgccaggaaacaattttcccgttatcctaggagaactggaaacgattagagacaagtgttaaagggatgggaagcgggggaaggccgacaggaatgtaaccagctccatgcgacctttcctcttttaatttctgctcgggagcatgggacggagaaaaaacaaagcaaaatttgttccccacacggtttttggctttagcggtttggggacctg

SEQ ID NO: 30601 - DNA, 84 bp, Homo sapiens
  misc_feature 1..84: note = chr6:78176445-78176529
  misc_feature 1..84: note = hyper
  source 1..84: mol_type = genomic DNA
cctgggtcaccccttcggagtaggggtcgctgggtaaggtccaagtgccagctctgcagtccccagcggcgctagaaggaacct

SEQ ID NO: 30602 - DNA, 44 bp, Homo sapiens
  misc_feature 1..44: note = chr6:78176790-78176834
  misc_feature 1..44: note = hyper
  source 1..44: mol_type = genomic DNA
aaaaccagatcctagcggtgagctggctgcggaggaaccaaaga

SEQ ID NO: 30603 - DNA, 27 bp, Homo sapiens
  misc_feature 1..27: note = chr6:79620315-79620342
  misc_feature 1..27: note = hyper
  source 1..27: mol_type = genomic DNA
aagtgatatcaagcccgggcagaaggg

SEQ ID NO: 30604 - DNA, 211 bp, Homo sapiens
  misc_feature 1..211: note = chr6:79620474-79620685
  misc_feature 1..211: note = hyper
  source 1..211: mol_type = genomic DNA
ggctgggactgccccagacacgcacaccctcccgacctccgccctgtcgcagttccagggcgctccgcgctgtcatgattgctgggtgcgcgctccgtgctgggacagccgcgcaccaacagcggagggcgttagcaccccaagacgctgctgcaggggtctgaaccgctccttggcctactggcaccgggtcctggacgaaatctaccgc

SEQ ID NO: 30605 - DNA, 191 bp, Homo sapiens
  misc_feature 1..191: note = chr6:79620686-79620877
  misc_feature 1..191: note = hyper
  source 1..191: mol_type = genomic DNA
gtccaactgagctttatcttgtgcggtgacgcccatgcctaggtcttgacacttccctcctatgccctttattgccaagggtcgggatggccttcgtgtcctctgcagcctccgccttccttctgctgccagcagctgtagattttacctctttcccctaacttcctctcaggctcctactccattcctat

SEQ ID NO: 30606 - DNA, 927 bp, Homo sapiens
  misc_feature 1..927: note = chr6:80656673-80657600
  misc_feature 1..927: note = hyper
  source 1..927: mol_type = genomic DNA
cagaagaaaaccctgcgagtgtcgggggaggggaggccttaacattcggatcagattaaccagtgctcaaccgcagtgcccgcgccggcccctccgctgatccgcagcatccgaaagccgcagggcgcgggggcctgtggggccgggcccgggagctgcgagaccaggggccggtgaccccccgcgggggaccgagcgaggatggggaagtcagcggctttacctgcgatggaccaggtccagcggtagaactctaccgtgtcgttgagtgccgtggacactacgtttaggacactacccggctccgagtccaggagccccatcgcggcgatgagcgggcgctggcggcaggagaaagcggagacccagagagagggctgaccccggaggcggtggcggccgacggggcgagcggcggccgggaacccctctaacggcggcggcccggctgcgtcttctcctgctcctcaaggcgccgcggcggcggggatgcggcagaaggcagggccaagcggaaggcgtcgtcaaggttcccgggagaaagacgaggaggtggaggaggcccagccgccagcacagtgcgctgcaccagtctgcagcctcgcgcagccgcccctccaatctcctcagccggcgtcacgtggccgcgcgcgggggcggggggccggccgcccctcctccctccctccctccctagtattgggactcgctggcgtagggatgctgcgctcaagggtgcgacgccaactgggctcgcgcaggcgcgcgccgtcgagcgggagcgggacacctgggctcctccttggcccctccccgcacaagtcgcctcattagccttccccgcccctgtcccgggcatcggcccctgcggaggagttcaccgcctccccacgggtgatttcttatccgccccggatacgtcctggg

SEQ ID NO: 30607 - DNA, 111 bp, Homo sapiens
  misc_feature 1..111: note = chr6:82461362-82461473
  misc_feature 1..111: note = hyper
  source 1..111: mol_type = genomic DNA
acaggcagtccagcacgacgtccttcacagtctgaaactccccttccccgcgcaggtcggcgcagaagatgaggtccaggtccttgtagcccaggccgctgtcctggtgca

SEQ ID NO: 30608 - DNA, 272 bp, Homo sapiens; identical to SEQ ID NO: 568
  misc_feature 1..272: note = chr6:84417429-84417701
  misc_feature 1..272: note = hyper
  source 1..272: mol_type = genomic DNA

SEQ ID NO: 30609 - DNA, 23 bp, Homo sapiens
  misc_feature 1..23: note = chr6:84417908-84417931
  misc_feature 1..23: note = hyper
  source 1..23: mol_type = genomic DNA
cgtgacaccgtccccattctccc

SEQ ID NO: 30610 - DNA, 464 bp, Homo sapiens
  misc_feature 1..464: note = chr6:84418260-84418724
  misc_feature 1..464: note = hyper
  source 1..464: mol_type = genomic DNA
cgccgccggctccaaagcctcgccgaggcccatcgcccgggccccttccccccggttccaaatccctgccgcaggggccgcccgggagctctgcggaggcgccggagtcttggggcgcctcacccttcctggctttggagaggagccgggctgacagcgaagcccagtcccccgcccgccctggagcgctccgcggagctgtcactcggccgctgcccttctccgcaccctgggattatcctctgcggatccccgcgagaccctggcgcggggagggggccgagtacggccgcgggtactcaccccgcccctgagcggcgccgcccgccgcaggatgagcggagcccgggccgccgagggaagccgcgccggtggatgtgtgcgaccgcgcgtagccccggtgcccccgggcgcaaagtctccagccctggccgggccccgctcctcagctccgcggtcccggc

SEQ ID NO: 30611 - DNA, 64 bp, Homo sapiens
  misc_feature 1..64: note = chr6:84418725-84418789
  misc_feature 1..64: note = hyper
  source 1..64: mol_type = genomic DNA
cccaccgcccctggcccctggccccagaagccagtacccgcccgccgccgcctcttctgccagc

SEQ ID NO: 30612 - DNA, 131 bp, Homo sapiens
  misc_feature 1..131: note = chr6:84419071-84419202
  misc_feature 1..131: note = hyper
  source 1..131: mol_type = genomic DNA
gggccgcccctccgctgctggcgccgcacccggcacgcactgggctcgcgcaccacgcacacctgcccgccgactgcggggggagccctgggcgttgggggcgttggccaagacgggcgagtgggcttctc

SEQ ID NO: 30613 - DNA, 126 bp, Homo sapiens; identical to SEQ ID NO: 2842
  misc_feature 1..126: note = chr6:84419203-84419329
  misc_feature 1..126: note = hyper
  source 1..126: mol_type = genomic DNA

SEQ ID NO: 30614 - DNA, 61 bp, Homo sapiens; identical to SEQ ID NO: 2843
  misc_feature 1..61: note = chr6:84419330-84419391
  misc_feature 1..61: note = hyper
  source 1..61: mol_type = genomic DNA

SEQ ID NO: 30615 - DNA, 158 bp, Homo sapiens
  misc_feature 1..158: note = chr6:84562772-84562930
  misc_feature 1..158: note = hyper
  source 1..158: mol_type = genomic DNA
caaaacgtgtagactcgcttaattccatctcctcctggcctcttcacacggaaattggctgctcgggcgaatgttgtttttctccgcagccatgtgtcgaagggcgattaacattcgctcgacaaaaccctgtcccgggccatttgggagttgcacgc

SEQ ID NO: 30616 - DNA, 354 bp, Homo sapiens; identical to SEQ ID NO: 2845
  misc_feature 1..354: note = chr6:84562931-84563285
  misc_feature 1..354: note = hyper
  source 1..354: mol_type = genomic DNA

SEQ ID NO: 30617 - DNA, 437 bp, Homo sapiens; identical to SEQ ID NO: 2846
  misc_feature 1..437: note = chr6:84563416-84563853
  misc_feature 1..437: note = hyper
  source 1..437: mol_type = genomic DNA

SEQ ID NO: 30618 - DNA, 39 bp, Homo sapiens
  misc_feature 1..39: note = chr6:85471957-85471996
  misc_feature 1..39: note = hyper
  source 1..39: mol_type = genomic DNA
cctcaaatttataaccgccctgaacgcagaacatcaacc

SEQ ID NO: 30619 - DNA, 2318 bp, Homo sapiens
  misc_feature 1..2318: note = chr6:85472355-85474673
  misc_feature 1..2318: note = hyper
  source 1..2318: mol_type = genomic DNA
agggcagaggggtcccgggccgggccagggagcgcgccggagaccccttgggggagcctcccggtgacgccagaggggaagctccctgctggaagccgtcctcacagccgcctggacagcaaaggacagagaaagggaactggtgagggaaacagaggggaagccagccgcggagacgggcccacctggtggctgagaagaggaaaatgaccgggagaaaaggggaagctttggtgccatcaggtcctcctaaagaacaagccagtcgatagacacccacattctgcctgtcgaaggggcgcattcagagctccagtgtggcctgcttggtccccaagtcccaagcccgggagaggcgcgcgggcagcgtccaccccacccgctgggcctccgcagggccaaggccccagcagaaaaggcttcacgccgccgccggggtctgggacgcttgcccgacggagtcagaggagctcccgggtccagagtccccagtgcaaactccgacgcaacctgcgcctcgaagcgcaagcagcaaaagcgcccggactctggtcccaagagcctgggcctccttaagccataagcgtctgcggcgcctcgctttgggccttcttttgggccgggccggaggcatcttctagaaggctcttcagaccccgctttcgccaaactcccggcgccctgcgcttccagcccagcagagaaaagtgtgaaaagcaagcccgcggtcgccgtcggccttggcagagaaatcaagaggagaagggaagggaaccgctcaactacccttcgggaaaccaagtttccaaatatgccgccctcttcctggtttgcacaaacggtttagggcattcgttccggtttcagggtggggtatgccgtcgctcccctcctccccgccctgtgcttttaaaagttaggaaacaaaaaagagcacccattggctggaaccccaagggaggcagatgcaggaagcacagagctgcaccgctaggcgcagcaaacagccgcggccgaaggcgcgggtcgccgagtgggcggcggccgcccgcgaggcgagcctggaagcagtatctgaaccgtctggagggtgaccaggttgcgcggcgagctttgcgactgacacggccaatgcgctagtggctgagtggccttggccatgtagggacgcggcgcgcacgcacacccacagactcgcagaagttcaggttcgcgccggagagaagttataggcaggaaggggcccactcacccgcggctccgcgctccaggtctgcgccactccgagccggcccagacgtcgccccagccggcggcgggagcgcagcgccttcgtctccctcagaagaacccttttcgcccgcgccgccgccgcggctgcagcctccgtcgtccacggcccccgccgcctcttcggcgcccagttttcgccgcttcttctgaagctgttgctgcttctcggcgccgatcagcgcctccaccgagaaagcgtgcgccttgaggcttagcatgctgcacggcgagccccttcgcttctcggccatcccccccgccccgcgcccgcccgcccctctctcatatacactcacgcgggcacacgcgcgctctcgctcttcccccaccaaaaactaaaaggctctcggggcctcccgagatctgcccccttccccaccgcgggcaaaaaacagatttggcgtttccgctttctcgcttgtgttgggatccaggaaccggcgacgcgccggccaagtctcctttcctgggtctctctcgcgcgctctctcactgatgcactcctttgctcccaccccttccacctcctcctgctgctccgaggtctgcctcaactgatgcgccagagaggactaacatgggtaaaaaacactctgtggacacaaattagggattgtaattgaaatttgttgccttgatctgtcagcacttccaggcaggagagcggtgggaagaacttgctcattagtgtcaataaagcggcgggggcggagcccgggtccctgtccatcacccagacggccggccaatcaggaggcgccgactccgcgcagcccgcgcccacttccttacaaggtagcgaaaaaccaggagtgaaaagcgccgctgtctggcttggatgtgccagccacacggacgctgaactctgtctctctgacgtccgtagctgagtccagccccgtagtctccagctttcctcaccaggacctggaaaggcggaagttcccggctttaaactagacgttcaacaagttagaaaatcaggaatctttcaaggttccgtaaattgccgtcccacttccgta

SEQ ID NO: 30620 - DNA, 30 bp, Homo sapiens; identical to SEQ ID NO: 8568
  misc_feature 1..30: note = chr6:85476233-85476263
  misc_feature 1..30: note = hyper
  source 1..30: mol_type = genomic DNA

SEQ ID NO: 30621 - DNA, 169 bp, Homo sapiens
  misc_feature 1..169: note = chr6:85476998-85477167
  misc_feature 1..169: note = hyper
  source 1..169: mol_type = genomic DNA
agcccactccaacctcggctcctggagaaggggcgtcgaatctctcttgggcatgggagggaaagacattccgagttggctgggcggagtggcagccttgagagtgacgagtgacagcaaagcctcgtcctagcaaggccttttaccaacagcgcggcatgccctttcg

SEQ ID NO: 30622 - DNA, 421 bp, Homo sapiens
  misc_feature 1..421: note = chr6:85482401-85482822
  misc_feature 1..421: note = hyper
  source 1..421: mol_type = genomic DNA
agccaaattattccccgacggctccaatattgtgccagagtcccagagtcagttatttttatgtctgactgtatttcacatgtgcagggtgataaataaaatccgtctcaagctacaaactatctgagtgtgatgaggaacaatcgacaaaaattaacccagccaaagcgttggggttcaagcgagcgactggaccataaatcagcgtcgcggtggcgtcgggaagctgagcgctcggaggtgcactcagctgcctctgggttcgcccagtccgagagcggggctccgccgcgggagcccgggcaggaatcggactccgccaggggttcggagtcttctggggaaagggcgtgttgggagagaaaggcaagcccacgcaggagcgacctcctaattaattcatcatcgagaattctccagt

SEQ ID NO: 30623 - DNA, 215 bp, Homo sapiens
  misc_feature 1..215: note = chr6:85483309-85483524
  misc_feature 1..215: note = hyper
  source 1..215: mol_type = genomic DNA
cggggagtcagggagcgcggaacgcgggtttctgttgataagtgcaaagtacggccctctcggtgctaagtgcacagtaagtgcgaagaataaatacatcatctcccggggcggctgtctcgaaaacgcctctcagctgcctgcgtttcagagcccgtcaagggttatagcttagtgtgggcgtccgcgccgcgcctgcgcctccgagcgccggc

SEQ ID NO: 30624 - DNA, 173 bp, Homo sapiens; identical to SEQ ID NO: 8572
  misc_feature 1..173: note = chr6:85483759-85483932
  misc_feature 1..173: note = hyper
  source 1..173: mol_type = genomic DNA

SEQ ID NO: 30625 - DNA, 69 bp, Homo sapiens; identical to SEQ ID NO: 2850
  misc_feature 1..69: note = chr6:85484557-85484626
  misc_feature 1..69: note = hyper
  source 1..69: mol_type = genomic DNA

SEQ ID NO: 30626 - DNA, 217 bp, Homo sapiens; identical to SEQ ID NO: 2851
  misc_feature 1..217: note = chr6:85484716-85484933
  misc_feature 1..217: note = hyper
  source 1..217: mol_type = genomic DNA

SEQ ID NO: 30627 - DNA, 125 bp, Homo sapiens
  misc_feature 1..125: note = chr6:86159778-86159903
  misc_feature 1..125: note = hyper
  source 1..125: mol_type = genomic DNA
ccggccctagctgctcgcccctactcgccggcactcgcccggctcgcccgctttcgcacccagttcacgcgccacagctatgtgtccccgagccgcgcgggcgcccgcgacgctactcctcgccc

SEQ ID NO: 30628 - DNA, 56 bp, Homo sapiens
  misc_feature 1..56: note = chr6:86160189-86160245
  misc_feature 1..56: note = hyper
  source 1..56: mol_type = genomic DNA
tgccatggtaagacccgagcccgcgcccgggatagtagtcccggactgagagagga

SEQ ID NO: 30629 - DNA, 92 bp, Homo sapiens
  misc_feature 1..92: note = chr6:87647217-87647309
  misc_feature 1..92: note = hyper
  source 1..92: mol_type = genomic DNA
ccgctctctccctctcgcctcctcttccagtccaggcgcccagactcggcgaagcgcagcgcctgccaccagcggtgcctcgggctgcccgg

SEQ ID NO: 30630 - DNA, 54 bp, Homo sapiens
  misc_feature 1..54: note = chr6:87647316-87647370
  misc_feature 1..54: note = hyper
  source 1..54: mol_type = genomic DNA
cgctcccaggttctgtctcgccgcaccccggcgggcactggcgcgggcaaggac

SEQ ID NO: 30631 - DNA, 170 bp, Homo sapiens
  misc_feature 1..170: note = chr6:87647371-87647541
  misc_feature 1..170: note = hyper
  source 1..170: mol_type = genomic DNA
ctggcggggagaacgccctgggctcaacgtactccagaatcgaatgttgagagaagcagtgctctgatccagctcaggagaaaaaggagcgggttccgagtgagacttctggagccagctggacgtgccggtttgcccagtgcggcgcggctgcacgcaccgtccacaag

SEQ ID NO: 30632 - DNA, 585 bp, Homo sapiens
  misc_feature 1..585: note = chr6:87861548-87862133
  misc_feature 1..585: note = hyper
  source 1..585: mol_type = genomic DNA
agactccagcatccccggggtgggtttccggaggccccgctccccgccgcgccctggaaaggctccagaatctctcggcctggaggcccctggcggcctctgctcccaagcggggagtcgcagccaggctacagcgggcttgatcctcagtgctgggtggaaaaaccgcggcggcaaacgccgggcctgcaactgctgggtgtcggcgttgctggttcgcgggcggcggcggcggcggctccgcgacaacagaggacgcgagcaaccggcgcagcgcccagcagggccttggcggggtggaggggcgcaggctgggttagcggagcagagcggaccgatctggtgccctccgtggcccgaggcctgcggaccttctccgttctccggcccagggcgagagcggggcaagagacagcgccccgatagtggcgcacgctctccgccatccccgggcctcgcgctttcacctcgcgtgctggggcgagggcggggctgcggggtgtactgggtcgggggtaggaaggacctgccaggccttagccctgagctatccgtcatccgctaacgccgcgctccctgcatccc

SEQ ID NO: 30633 - DNA, 133 bp, Homo sapiens
  misc_feature 1..133: note = chr6:88875382-88875515
  misc_feature 1..133: note = hyper
  source 1..133: mol_type = genomic DNA
cagctaagtaaacaccgacgcacgattcgctcacacggaataagaactccacgaaggacacttggggaccacactggtcgtacccgagggggcgggaggcggaaaaagtatttccaaacgcaactctgccagg

SEQ ID NO: 30634 - DNA, 509 bp, Homo sapiens
  misc_feature 1..509: note = chr6:88875729-88876238
  misc_feature 1..509: note = hyper
  source 1..509: mol_type = genomic DNA
tggcagagggagtagcgtgcgggaggcggcgccggcgccgggctgctggcgaggcggggtggggtggagtggggtgtgcctccggcgggcggtcagcaagtcagtccgtccgagcgccggcgtcccggtctccagcgcccgcccgcgacagcgaccgggactggcgccccgctgctccgaccgccggcgagcctcgccccttcccaggctcttcactgggtcctcccgcgagccccgcctggcccggcgtggggccgcccgtctccgccagcccgggcgcccgtcgcctcgtcccgctcgcgcagtccctgccgctccctccgctcgcgctgtctctggctccctctcgctccagtcccatttatgaagcgcggtcccatcacgtgttaatgagcctttgtcctgccctggcagcggcggcggcacagaccccgccgagggaactgcgcggggagggacctgagcgcagcgcccgtagccccaaactttgcttggggcgggggacccgc

SEQ ID NO: 30635 - DNA, 193 bp, Homo sapiens
  misc_feature 1..193: note = chr6:88876284-88876477
  misc_feature 1..193: note = hyper
  source 1..193: mol_type = genomic DNA
cgtcacctacttctcctcttcctcctcctcctccgccgccgcgctcccggaggcccccgctgccatgacctcgctgtgctcccggataccctcacaccctgaccaggccaagaaggggctggtgcatgcgccgcccacgacctcggggccattaatcacacgctcccgggcagcgcgcatcgccaacaccttc

SEQ ID NO: 30636 - DNA, 111 bp, Homo sapiens; identical to SEQ ID NO: 2853
  misc_feature 1..111: note = chr6:88876630-88876741
  misc_feature 1..111: note = hyper
  source 1..111: mol_type = genomic DNA

SEQ ID NO: 30637 - DNA, 322 bp, Homo sapiens; identical to SEQ ID NO: 2854
  misc_feature 1..322: note = chr6:88876742-88877064
  misc_feature 1..322: note = hyper
  source 1..322: mol_type = genomic DNA

SEQ ID NO: 30638 - DNA, 357 bp, Homo sapiens
  misc_feature 1..357: note = chr6:88877065-88877422
  misc_feature 1..357: note = hyper
  source 1..357: mol_type = genomic DNA
tctgcctcctgtgtgcacggatcaaaccttaattggtctttacatttatcatggtgaattgcgaacctccaaacaagcctgggccgccgcttctgccgaggaggcgctcccctcccctccgcccccggggccctgcagggtgtgcggcggcggtcgtggttatttagacatctttatctctcgtgagttggatcgggagaggatcgcacggtttccacctgacggagccacgtcacgtcggccacaagggccccgtgctgggcgctgggttcggttcccggccgtcctcttgtggccgccttggcgttcattttatgacaccttgccggtgttcccagacatcatcccgcaccgctc

SEQ ID NO: 30639 - DNA, 46 bp, Homo sapiens
  misc_feature 1..46: note = chr6:88877474-88877520
  misc_feature 1..46: note = hyper
  source 1..46: mol_type = genomic DNA
cgtactatatctggaccctatatttgaactacgtggtgagaatctg

SEQ ID NO: 30640 - DNA, 30 bp, Homo sapiens
  misc_feature 1..30: note = chr6:90120876-90120906
  misc_feature 1..30: note = hyper
  source 1..30: mol_type = genomic DNA
ccgcgcgctcactcccgggcaggcactgcc

SEQ ID NO: 30641 - DNA, 340 bp, Homo sapiens
  misc_feature 1..340: note = chr6:90143378-90143718
  misc_feature 1..340: note = hyper
  source 1..340: mol_type = genomic DNA
ctggggctcgtccctcgttctcctgctcgcttgcagtttgaaggaagggcggtgggggcgggggtccgagtaccccgcggtctgcggcgcgtaggagggtaggtccctggcctgcggccgcctccgaatgaccccgtccctccccgccctggacgacagcactagggtgcagtcgcaggagaggggccgatacccctcaggagccccatcggcgaagcctcagcaagtggcatctcccggggtccagagagtcggcgtgctgtctggtttgggtccagacatcagctcacccaagcttatcttgggcttttaagtgtgttgcttccggtagatctcgggg

SEQ ID NO: 30642 - DNA, 399 bp, Homo sapiens
  misc_feature 1..399: note = chr6:91004780-91005179
  misc_feature 1..399: note = hyper
  source 1..399: mol_type = genomic DNA
ggtgaaaaccaggaacgccgcgtctcgccgcccgcgggcccgccgggagactgcgggtccgtctcgcgggtggggcgccccggtccctctcgtttcctggaggccacaggtcacggcgacggcggtgaccgggagagcaggctgcgaggcgcgcctcatcgggccacagacaaaccaccccggcagcggccgcgccggaacttccctcaagttaccaaactcgcctacgcgcgggagagtgctggggatgccccatgcgcccgcgaccccagaagccaggagtgtgccaccccttcacacactcactcccggccctgcacgcttcccctcacggtccgagttcctgcaaatgcttggccagaccgaggtcgccgagatgctcgctccagtctctcccct

SEQ ID NO: 30643 - DNA, 106 bp, Homo sapiens; identical to SEQ ID NO: 8585
  misc_feature 1..106: note = chr6:91005208-91005314
  misc_feature 1..106: note = hyper
  source 1..106: mol_type = genomic DNA

SEQ ID NO: 30644 - DNA, 1010 bp, Homo sapiens
  misc_feature 1..1010: note = chr6:91320285-91321295
  misc_feature 1..1010: note = hyper
  source 1..1010: mol_type = genomic DNA
ttatttgggatagcccggcgagggggcgctggagattatgggggtgggggcggtttcttggggaggcctgggtctatggagtggaaaccaatctttgatgaatttggtcacaataacgaacacgggagaaaaaggagaattgaaaggaaatggattctgcgagagactggggagacaaaaccaagaggaaaaacacagaatcaaaaacgacaggaaacactagagaagagtaggcagaaaatagagaagaggaagaaacgagtcggacggagacggggccgggcactgggagcttgaggctgggtctccatccttcctttcatcctctcgggagcccgcagagacggcggcttcagtctcgctttacgggtgggaaagcagcgaccttgagaggttaggtgactgctcaaggtcaccgagctaagtgccagagccaggattctcaccgctcctcaccccagatcggggctccggccagaccacgctggccgccgggggagaggacgcgcggggcgggcagagcgcggccgggggccgggaaggagccggcgccaggcgcgcgcggaggaggcggccgggcggggagccatttcctccccaagcaacggcgcttttcaggggcgcgaccgggaagcctctcttggcgtcccttccccagccgcagtttgggcaggggagcgagggccgggaggcgtctaggctgtggcgaggggagaagcatcccccatccctccgctccccgtctcgctcaagctcttcctgcgccacgggcaggtctcccagcctcgccatcgcggggcgtccccgtcccggcccacacctctttcctctccagccacaccggcgcgccccgagggttgcaggcgggggctgcaccgggttgaagcccagtcaaccacacgtcccagggcttaggcgccgggcggggacaacgtgtctgcctgggctcagacgctgctagggggcatccctgtcggtgagaccagactcagacacgagggggcctgggc

SEQ ID NO: 30645 - DNA, 247 bp, Homo sapiens
  misc_feature 1..247: note = chr6:94126366-94126613
  misc_feature 1..247: note = hyper
  source 1..247: mol_type = genomic DNA
cgtatcccttcccgctcggagcagagtgccgacctccctttgcgcccgcggaggcgcagtccctcggctcacccggacgctgggggccaggcctaggactccagggctccgcgccccggagtcctgtgggccaacaggtgatgggagaggggctagactgggggcgcgccctgacagacccaggcaacgaccgcgcgggcaaaggctggcgtcccggggctggggcggggccgtcggaggggcgggg

SEQ ID NO: 30646 - DNA, 424 bp, Homo sapiens
  misc_feature 1..424: note = chr6:94126642-94127066
  misc_feature 1..424: note = hyper
  source 1..424: mol_type = genomic DNA
cgccaagcatccattacgcctctgccagacctgggcactccagggagccggtggcgccctcgctcgagaaggagtcgggaagaggagagtggctttcgggaagaggagagtggctttcgggaagcatctcctctgaggaagaggcggcggcggcggcggcatttacggagagaaaaagtaagcagctgcactttgccttcaagcgtcagactctgacacgcgctccctgtagcgatgataactgaccaacccgagagaacgtgcacaaggaaagtgagggaagggggtttcttatcttcctctagccacccccaaatgccccaggaggcccggcacctgcttcaagcggttcccagcgctagcccttgggtactgcgggccgcctcggggcttgtgaactcctagaacgccagctcttggtcgc

SEQ ID NO: 30647 - DNA, 46 bp, Homo sapiens
  misc_feature 1..46: note = chr6:94127085-94127131
  misc_feature 1..46: note = hyper
  source 1..46: mol_type = genomic DNA
cgccgcctagaagccgggcgcactcgccgcccgccagccacagatc

SEQ ID NO: 30648 - DNA, 444 bp, Homo sapiens
  misc_feature 1..444: note = chr6:94127455-94127899
  misc_feature 1..444: note = hyper
  source 1..444: mol_type = genomic DNA
tttggaggggatgagcgtgcgtttctagcagatgtccgtccttctgcaaacgcgtaaccgccagcttggaggcacggggttctctgaatgggttcagcatctatacaggttgcagatgtggaaagtggggtcagaaggtcaggctgaaagaaggactagaatttggcgccgggtttgaggggggcttgagcgaactaagaggagtgcacgatgagaataaagaaaaggtgcactaagttttcagaaatagatgaatcaaggacctatatgtaagtcccctcaacaccccgcccgataaccaccatgacctaaatttcataacagattcctctccctctacacatcaggaataagtaattatttctcttctgcttttaacagatcgaaaaatgaaacttagatacacagcctgaaagaccaggggggcgacgggatgaggggggt

SEQ ID NO: 30649 - DNA, 310 bp, Homo sapiens
  misc_feature 1..310: note = chr6:94128439-94128749
  misc_feature 1..310: note = hyper
  source 1..310: mol_type = genomic DNA
gtaacccgagctttccgagctcatcgaagtctcggtccctctgggaaggctccgggctcccgccactcgccggcgggctggcggagacggtaggggctgcatttcccagtctccaacccaactctggccgcagctcccacagaaggcgaataaggagacaaggaagaccgagctagagagagatgtgacccgcctgaggtactaagaaataagctcgccggcagttcctccaaccccaccccacccccgttgctgctcacgccctccagactgcccgcgccagaaatcccgcacccgtcggatggacggc

SEQ ID NO: 30650 - DNA, 239 bp, Homo sapiens
  misc_feature 1..239: note = chr6:94129167-94129406
  misc_feature 1..239: note = hyper
  source 1..239: mol_type = genomic DNA
ccccttctcggtccccgatcggctgctccacgtttagctttttttaatttcccccccactcctgttcgctcgcaccgtgtttgctgcctgcaagtctccgactgcagaccggccgcttgctccacactccaataatatcaattagggggggagggggcggggctccgagctgagagcctccgccactcgggctgagtggcaggcacagccggcctgccaggaggcgattcccagggcca

SEQ ID NO: 30651 - DNA, 32 bp, Homo sapiens; identical to SEQ ID NO: 8594
  misc_feature 1..32: note = chr6:94129782-94129814
  misc_feature 1..32: note = hyper
  source 1..32: mol_type = genomic DNA

SEQ ID NO: 30652 - DNA, 395 bp, Homo sapiens
  misc_feature 1..395: note = chr6:96463220-96463615
  misc_feature 1..395: note = hyper
  source 1..395: mol_type = genomic DNA
gctccaaggggcaggcgatggttgccggcattgagctccctgctggcgccttctggcgggacagccagtgccaaagagcgcccagggaaacaaacaccaatgggggactatacagatgtcatggatgcacatgtaggatcataatctgcccagaaagaggagagaaggagggcgacaggctgcggatcctggtccaggagccgccgcaatggagcgggcggcagtgtgcgcgcacaggtgccacaggccggtggcggggagagctgtagaggctgcctcccggactcagcactcgcaccagcgcgctgaagccgcggctgctgccaagcttgggtaacccccagcctgagccacgagaggaagagcccaaggaaagggcgcgaagggggaaggag

SEQ ID NO: 30653 - DNA, 122 bp, Homo sapiens
  misc_feature 1..122: note = chr6:96464082-96464204
  misc_feature 1..122: note = hyper
  source 1..122: mol_type = genomic DNA
ggaccggtgagtaggcgggagagtgcagggggtcgggcgtcaaagcttggcgcggagagaacatcttttggtttgggaggcaccccaaaccagctgctgtgattccccgtcctccaggcaga

SEQ ID NO: 30654 - DNA, 30 bp, Homo sapiens
  misc_feature 1..30: note = chr6:96464463-96464493
  misc_feature 1..30: note = hyper
  source 1..30: mol_type = genomic DNA
cccttcacccgatctcgcgctgacaaagcc

SEQ ID NO: 30655 - DNA, 32 bp, Homo sapiens
  misc_feature 1..32: note = chr6:99271691-99271723
  misc_feature 1..32: note = hyper
  source 1..32: mol_type = genomic DNA
ggaaaccatccaagacgcggtttaagaaaaca

SEQ ID NO: 30656 - DNA, 936 bp, Homo sapiens
  misc_feature 1..936: note = chr6:99271926-99272862
  misc_feature 1..936: note = hyper
  source 1..936: mol_type = genomic DNA
ccaagagtcagatggcgcgggttccctccctgtgagtttcgacagtgcatcatcttacggaagaggctaaactagtattgattttccactttctaaaaggagtaaccatttggagcaaaggcaagctctcagggacgcgggggttgatagggggcaggtctgcgaaaaagagaaacacttcaaacagcgctgcggagagtgggggatggagctgtggggagcgagcggaggcttctctctgcccaagtagtggggctgcaaagttcctgccacaacggctgagacgttctgattctgtggacctgccaggagaggcgtttcccttgccaaaatagagccttcttaggagaggtttatgtattgttcgggaaggcaggagtatcttctagtcgttttcactctcctccacctttattaccctgaatccttaggccctcccctcggaaccccttcaaagtggagagggagcgtgggagggagagagcgcgcgccaagtttcaaatgtcgccagtctttccagaagcccctggctctcgcaggactgggtgcaggcgcctctccgggcctcggagccccgccccgcctccccatccccacaatcccaaggctccaggctctgcagggaaccgcggcgggaattttccagcctcaaatacggggcggactaattttcaggtccactccaacccagagatcggattccacttgatcttggagttcgcgaagtaactgccaagtcagagcgtgcgttccgcagtgcgcggtggctgcgcggcgctggctcttgctgtggggcagacagcagaggaccaggggcgagtcggcagcgggaggagccgcctggccaggagcctcggacagtgtctccccgtcccgaaccccttcccgccacctcctccaccccccgccccgcattccccccggggcgaccctccc

SEQ ID NO: 30657 - DNA, 230 bp, Homo sapiens
  misc_feature 1..230: note = chr6:99273369-99273599
  misc_feature 1..230: note = hyper
  source 1..230: mol_type = genomic DNA
aactgggagaaggaacgtgccaccaccgaccacctatcctggtgggaggaggtactgctcccccctactcctcccttttccctgctccctctccatcagcaacaggttgtcaagttgaggagacatcccctccaaactctctcactccccacttgtggccgaggcctgccctgtgttcatcccagacagtcaggcagacgctgagctgtccgcgtcggcgtgggcgcctg

SEQ ID NO: 30658 - DNA, 53 bp, Homo sapiens
  misc_feature 1..53: note = chr6:99273848-99273901
  misc_feature 1..53: note = hyper
  source 1..53: mol_type = genomic DNA
ttgcaggtgtcttgccgcttaagtttcctggactgagacgttgactggtgacc

SEQ ID NO: 30659 - DNA, 30 bp, Homo sapiens
  misc_feature 1..30: note = chr6:99275545-99275575
  misc_feature 1..30: note = hyper
  source 1..30: mol_type = genomic DNA
cattccccgcggggccggccccccttccct

SEQ ID NO: 30660 - DNA, 30 bp, Homo sapiens
  misc_feature 1..30: note = chr6:99276704-99276734
  misc_feature 1..30: note = hyper
  source 1..30: mol_type = genomic DNA
acctgctcccctccccgcccacccccccat

SEQ ID NO: 30661 - DNA, 21 bp, Homo sapiens
  misc_feature 1..21: note = chr6:99277180-99277201
  misc_feature 1..21: note = hyper
  source 1..21: mol_type = genomic DNA
tagggggagaaaatgcgagcg

SEQ ID NO: 30662 - DNA, 141 bp, Homo sapiens
  misc_feature 1..141: note = chr6:99277261-99277402
  misc_feature 1..141: note = hyper
  source 1..141: mol_type = genomic DNA
taggctccattgttaagaggtcatttaactgttagtcctttgaaagtgaaattgcgggaagcaaactggaagccaccaattgtctcctgttctgtttctgagatttttgttctgtttctgagatttcgtataaacaagcta

SEQ ID NO: 30663 - DNA, 201 bp, Homo sapiens
  misc_feature 1..201: note = chr6:99278897-99279098
  misc_feature 1..201: note = hyper
  source 1..201: mol_type = genomic DNA
ttcccctccactcagcgcaccccggcaagagggagtcggctccgtttcttcagacaagtccagctcagggtattgactgagtagaggttcctccggacctgggagaagctggggtggcgccagcatctccttacaggtgcctccatcctgtccttgcggaaggggcttaggacaccccgcagtccgcgccccgaggtggcg

SEQ ID NO: 30664 - DNA, 445 bp, Homo sapiens
  misc_feature 1..445: note = chr6:99279350-99279795
  misc_feature 1..445: note = hyper
  source 1..445: mol_type = genomic DNA
agaatggcaggcagacgcgcggactctgccctgacagggtcagcccaaagaatgggccccagagcccggggcgggggaggaaccggtggagaggccccagtctggacctaaaaccagcgagagctcaggtttcgggagccccgaagaggtgccgcgctgggaggcagacaaggaagcccagggtgctcggaacccggcgttcgcgccaaccgggcccctggcgcctggaggggaggcggcggtagctcgtggggaggtgttgctcagagccgcggtgcgagcccagcctggcccgcccggtgattggccgcgcttgggggtgggggtggggtgcagagactgaggccccgggtaggctatttctttgtgtactcccggggatttattgggtatattaaaccctgttgggaacgtttcggctccttggccgccagcgaaatgagac

SEQ ID NO: 30665 - DNA, 240 bp, Homo sapiens
  misc_feature 1..240: note = chr6:99279796-99280036
  misc_feature 1..240: note = hyper
  source 1..240: mol_type = genomic DNA
gggatggaagttggagttgagacctgggaagtcaacgtgggaaggatctcagcattaatcgccggtgatgtcctatcgcagacaggaagttttgatgtacacgtgcagcctattcttgtcccctcacactagcgccctatgccgggaggagggcgggggtgtggggtggggtgtggagagaaagataagaggaggaggaacttttaaattgattcagagccaggccgcctcagttccttc

SEQ ID NO: 30666 - DNA, 234 bp, Homo sapiens
  misc_feature 1..234: note = chr6:99280497-99280731
  misc_feature 1..234: note = hyper
  source 1..234: mol_type = genomic DNA
ctagcagcccccaggcgcgcggccagagtggccccgcgcttgcgctgggacggagcgacacgctgtgtgtgtcctcgcctcgcctcgccgcgcgggtgcgcgcgtggtgggggtgcaggtccgtcctgctggcggcctgtgggctcgcccctcccctatccatttctctcccccacacacgctcataaacacaggacacgtggaaattctcagccaaagcgtcttgcccgggcg

SEQ ID NO: 30667 - skipped

SEQ ID NO: 30668 - DNA, 411 bp, Homo sapiens
  misc_feature 1..411: note = chr6:99281067-99281478
  misc_feature 1..411: note = hyper
  source 1..411: mol_type = genomic DNA
cgcgcccaagttctagctaccgggcttgcaggctcggaaactcgcaggcggcacctgctctgggcggctaaagaactgatggcgcgacgcgcccgcgctccgtagagcggcgctgcgggtgcatggtcccatagtcttgctctggagttcactgctgaaagctgagctgggagcttggccagggagcgccaaagacatagactaaccccacccgctagcgcccaccgaagttactgattaggaaggttcccctggcatcagcccatttgcttcacacactcttcctccttcccaaggggctaacggaaaagttgcacctaccagcggtaggagcacggggaatcgcgcacgcaggccctccgcgcggcttcccggagcggcctttggcgactgcgccgcccctacaaggcc

SEQ ID NO: 30669 - DNA, 37 bp, Homo sapiens
  misc_feature 1..37: note = chr6:99281946-99281983
  misc_feature 1..37: note = hyper
  source 1..37: mol_type = genomic DNA
aggtgaataaaaatccgactcccgctggctcggtgcg

SEQ ID NO: 30670 - DNA, 95 bp, Homo sapiens; identical to SEQ ID NO: 8605
  misc_feature 1..95: note = chr6:99282778-99282873
  misc_feature 1..95: note = hyper
  source 1..95: mol_type = genomic DNA

SEQ ID NO: 30671 - DNA, 240 bp, Homo sapiens
  misc_feature 1..240: note = chr6:99283342-99283582
  misc_feature 1..240: note = hyper
  source 1..240: mol_type = genomic DNA
cggcatgctgggcgccggcgggcagccggccggtctgcaccaccacggcctgcgggacgcgcacgacgagccacaccatgccgaccaccacccgcacccgcactcgcacccacaccagcagccgccgcccccgccgcccccgcagggtccgcctggccacccaggcgcgcaccacgacccgcactcggacgaggacacgccgacctcggacgacctggagcagttcgccaagcagttcaa

SEQ ID NO: 30672 - DNA, 48 bp, Homo sapiens
  misc_feature 1..48: note = chr6:99283978-99284026
  misc_feature 1..48: note = hyper
  source 1..48: mol_type = genomic DNA
aaggatgacccctcccggagggactctgccgggcgccgaggatgtgta

SEQ ID NO: 30673 - DNA, 30 bp, Homo sapiens
  misc_feature 1..30: note = chr6:99284652-99284682
  misc_feature 1..30: note = hyper
  source 1..30: mol_type = genomic DNA
tctctttctccccaccgttaatttgggagt

SEQ ID NO: 30674 - DNA, 142 bp, Homo sapiens
  misc_feature 1..142: note = chr6:99290331-99290473
  misc_feature 1..142: note = hyper
  source 1..142: mol_type = genomic DNA
gtaccttggccttgccgcgcaccccccacctcggggaccctggccgctgtcgcgaaggcccagacagcctagctcggccgcgcggggaggagagagacagggaaaggagcggggcactccctgcactcccagccccggcctt

SEQ ID NO: 30675 - DNA, 30 bp, Homo sapiens; identical to SEQ ID NO: 8608
  misc_feature 1..30: note = chr6:99291312-99291342
  misc_feature 1..30: note = hyper
  source 1..30: mol_type = genomic DNA

SEQ ID NO: 30676 - DNA, 15 bp, Homo sapiens
  misc_feature 1..15: note = chr6:99291682-99291697
  misc_feature 1..15: note = hyper
  source 1..15: mol_type = genomic DNA
tggcctctgcaggct

SEQ ID NO: 30677 - DNA, 15 bp, Homo sapiens
  misc_feature 1..15: note = chr6:99291729-99291744
  misc_feature 1..15: note = hyper
  source 1..15: mol_type = genomic DNA
cgcccgcggccactc

SEQ ID NO: 30678 - DNA, 269 bp, Homo sapiens; identical to SEQ ID NO: 8609
  misc_feature 1..269: note = chr6:99292252-99292521
  misc_feature 1..269: note = hyper
  source 1..269: mol_type = genomic DNA

SEQ ID NO: 30679 - DNA, 114 bp, Homo sapiens
  misc_feature 1..114: note = chr6:99295750-99295864
  misc_feature 1..114: note = hyper
  source 1..114: mol_type = genomic DNA
acatcctggagtcgccgggagtggcgctgcggtgaaagccggtgcctagagtgggcttaggggtcccattccactcggaaagtcctctcacctccccaagggccattctgccgg

SEQ ID NO: 30680 - DNA, 304 bp, Homo sapiens; identical to SEQ ID NO: 575
  misc_feature 1..304: note = chr6:99296061-99296365
  misc_feature 1..304: note = hyper
  source 1..304: mol_type = genomic DNA

SEQ ID NO: 30681 - DNA, 104 bp, Homo sapiens
  misc_feature 1..104: note = chr6:99296407-99296511
  misc_feature 1..104: note = hyper
  source 1..104: mol_type = genomic DNA
cgcctggagggccctgacccttccggtgttccaccgcaatggggtcggggggagaggggggctgtggctgcctgagacctccagggcagcgcacattacgggcg

SEQ ID NO: 30682 - DNA, 30 bp, Homo sapiens
  misc_feature 1..30: note = chr6:100036662-100036692
  misc_feature 1..30: note = hyper
  source 1..30: mol_type = genomic DNA
tcctgctgcgtgagccgatctgcagatcca

SEQ ID NO: 30683 - DNA, 110 bp, Homo sapiens
  misc_feature 1..110: note = chr6:100036959-100037069
  misc_feature 1..110: note = hyper
  source 1..110: mol_type = genomic DNA
acccagcccgctctgcggatgggtcgtagattccggctggaagccggaggaagtgcatagagggcagcttcaaaagccaaggctgcgctgctttgcgcggggcttcttcc

SEQ ID NO: 30684 - DNA, 67 bp, Homo sapiens
  misc_feature 1..67: note = chr6:100038640-100038707
  misc_feature 1..67: note = hyper
  source 1..67: mol_type = genomic DNA
tgccttccttcccctcgtcgccttcctcccactgtgcgagcttcggaaccctaaggccggttcactg

SEQ ID NO: 30685 - DNA, 369 bp, Homo sapiens; identical to SEQ ID NO: 578
  misc_feature 1..369: note = chr6:100038785-100039154
  misc_feature 1..369: note = hyper
  source 1..369: mol_type = genomic DNA

SEQ ID NO: 30686 - skipped

SEQ ID NO: 30687 - DNA, 37 bp, Homo sapiens
  misc_feature 1..37: note = chr6:100050390-100050427
  misc_feature 1..37: note = hyper
  source 1..37: mol_type = genomic DNA
ttcagacctgctccccggcccgcgttcaattattccc

SEQ ID NO: 30688 - DNA, 57 bp, Homo sapiens
  misc_feature 1..57: note = chr6:100050754-100050811
  misc_feature 1..57: note = hyper
  source 1..57: mol_type = genomic DNA
aacagcaaggaaaatcgaattgagtgcgggctcattcggcagcggccggcagagaag

SEQ ID NO: 30689 - DNA, 251 bp, Homo sapiens; identical to SEQ ID NO: 579
  misc_feature 1..251: note = chr6:100050858-100051109
  misc_feature 1..251: note = hyper
  source 1..251: mol_type = genomic DNA

SEQ ID NO: 30690 - DNA, 149 bp, Homo sapiens; identical to SEQ ID NO: 580
  misc_feature 1..149: note = chr6:100051359-100051508
  misc_feature 1..149: note = hyper
  source 1..149: mol_type = genomic DNA

SEQ ID NO: 30691 - DNA, 328 bp, Homo sapiens
  misc_feature 1..328: note = chr6:100051771-100052099
  misc_feature 1..328: note = hyper
  source 1..328: mol_type = genomic DNA
cgtagcctgcctctcggagggccggcggctgctggtgagcattccagcctcgttagggcaacctgttaccggagagggagccttgcccgaacggttctactgtgggcagggagcaggaccgcccctaaaccgcctttccccgcacctcggtgtaggagagatttcgctttaacggagactctggacgcccatttcaagtcgataaaaaaaaaaaaaaagccgagtggaatgttttgattgagtctcaacattgtctttgaataaggctgagaccatgtaattaatgtgtctttttaataagggacaatacggccgttcaagctattta

SEQ ID NO: 30692 - DNA, 107 bp, Homo sapiens
  misc_feature 1..107: note = chr6:100052482-100052589
  misc_feature 1..107: note = hyper
  source 1..107: mol_type = genomic DNA
ggagggccagggaggcgccccgaacccaggcccagcgctcgccccttcccgcttgcagtgctggtaatttaaactgggtgtcatcccagagtcgccaggccagaggt

SEQ ID NO: 30693 - DNA, 222 bp, Homo sapiens
  misc_feature 1..222: note = chr6:100053289-100053511
  misc_feature 1..222: note = hyper
  source 1..222: mol_type = genomic DNA
ctgagttgcaggtgtcgccaccttgcgtcctgccacccttgctaaccacaatcgctccagcactttcagccgacaaagcctcgaggagaagctagcgtgggcgctgctgagggccctctgcccttttgtgcagtggttgggcctctggcgctaggcttggaaatacaccaccactcaggcctctcttggaagaactgcatcgggctccggtgctggctgcat

SEQ ID NO: 30694 - DNA, 393 bp, Homo sapiens
  misc_feature 1..393: note = chr6:100054839-100055232
  misc_feature 1..393: note = hyper
  source 1..393: mol_type = genomic DNA
tccagctctgtcactcgcgcccttccaaggacctggagcacccgagcgcctgcctggtggcggcggcaacaatgcacggagccgccagagcgccagccaccagcgtgagtgccgactgctgcatcccggccggcttgcgcctcggaccggtgcctggtaccttcaagctgggcaagtacctgtcagaccgcagggagcccgggcctaagaaaaaggtattgaccattcagacctctgcccactgccattcgcctctcagtgccctgacccgggaaaggggtacgagagaaagtggaggaagggagtgattgagtcgttacctgctaattctgccgggtggaaggggactcctattattctgagcaagtagcctctttaactgtgagagctgga

SEQ ID NO: 30695 - DNA, 64 bp, Homo sapiens
  misc_feature 1..64: note = chr6:100055269-100055333
  misc_feature 1..64: note = hyper
  source 1..64: mol_type = genomic DNA
cgacagccctgggtggggtgcactgagcgctgtaggtgccgggaccattcgcagcttgtgtttt

SEQ ID NO: 30696 - DNA, 36 bp, Homo sapiens
  misc_feature 1..36: note = chr6:100055566-100055602
  misc_feature 1..36: note = hyper
  source 1..36: mol_type = genomic DNA
ttttttttcccttgccgatgtcggcttgtgggtatg

SEQ ID NO: 30697 - DNA, 701 bp, Homo sapiens
  misc_feature 1..701: note = chr6:100060996-100061697
  misc_feature 1..701: note = hyper
  source 1..701: mol_type = genomic DNA
cagcggcggtggaggcggcgccttcctgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccc

SEQ ID NO: 30698 - DNA, 682 bp, Homo sapiens; identical to SEQ ID NO: 2868
  misc_feature 1..682: note = chr6:100061988-100062670
  misc_feature 1..682: note = hyper
  source 1..682: mol_type = genomic DNA

SEQ ID NO: 30699 - DNA, 186 bp, Homo sapiens
  misc_feature 1..186: note = chr6:100062902-100063088
  misc_feature 1..186: note = hyper
  source 1..186: mol_type = genomic DNA
gagctcaccctgaaccgcccaggcggtctgctcttggtgttcagaatcacatcaatgcgaacgtcacagcgccttcgagggcgcagattttaactgccacgtatttttaagttgtacttttctgtggaggaaattgtgccttttgaaacgacgttttgtgtgtgtatttcacgttagcatttcatt

SEQ ID NO: 30700 - DNA, 196 bp, Homo sapiens
  misc_feature 1..196: note = chr6:100066823-100067019
  misc_feature 1..196: note = hyper
  source 1..196: mol_type = genomic DNA
ctggactcacagcctcgccctccctgggctcacagcctcgcgctccctgggctcacagcctcgcgctccctgggaataggggtttctggggtcttgttggggcagaggtgcgggagtctcgccgcgtttaggtggacagtccaggagtcctgctggagaggaggacctgggaagacccgcgatgccggcaggagga

SEQ ID NO: 30701 - DNA, 283 bp, Homo sapiens
  misc_feature 1..283: note = chr6:100067144-100067427
  misc_feature 1..283: note = hyper
  source 1..283: mol_type = genomic DNA
cgccggcgccatcgcgaggtcaagcgtgacccttggccacccaggtgtgagttgtgaagaggaggactcatcagacggctgggccaacgtgtttagttccagaaggagcgtggcgctcgctctgggctcggcgacctccctacaaaagatgaaaggagggcttctgtcatatgcgactgtagtttaattcaaattaagccgttgtaccacagacaacttgttaatgcctttagcttgcaaaccctccaagagtccttcaaaaagggaccgaaagtgggtggac

SEQ ID NO: 30702 - skipped

SEQ ID NO: 30703 - DNA, 241 bp, Homo sapiens; identical to SEQ ID NO: 583
  misc_feature 1..241: note = chr6:100441497-100441738
  misc_feature 1..241: note = hyper
  source 1..241: mol_type = genomic DNA

SEQ ID NO: 30704 - DNA, 404 bp, Homo sapiens
  misc_feature 1..404: note = chr6:100441761-100442165
  misc_feature 1..404: note = hyper
  source 1..404: mol_type = genomic DNA
cgcgcccacgccagagcccggccctcgcgcggcagcccgcgggacgtcacctgggtgctcgcgtcctccccgcgcggcggacagcccgggcgcccttcctctctgcgggactgcaggtctatccgctaagcgcgcgtgaccaaaaacggctctcagcgggtcccagctgacggaaggtgggggaggagtgcgagggtctctgagacaggttgggagccagccccacctccatttccaaagcgggggtccaggcacaggaacagccaaacgcccgaaccagcggggttacctttgccacttcatccaatccgagcatcgggtgcgtcgtgctcttttctaggagcgtggggtgccttcgcgaataaaatctgaaggcatctctgctctcgcggagcttgttcttt

SEQ ID NO: 30705 - DNA, 169 bp, Homo sapiens
  misc_feature 1..169: note = chr6:100729528-100729697
  misc_feature 1..169: note = hyper
  source 1..169: mol_type = genomic DNA
agggccatcatgaaccggcgtgcggagaccgcctcgccactgctgcattacaaatgctctttattaacagcgatctgtaatcaatgggctcaggctttttgccagagcccccaaatcagacaggcgggcccctgcgtcagggtgggcggagccacggggcccagctatc

SEQ ID NO: 30706 - DNA, 58 bp, Homo sapiens
  misc_feature 1..58: note = chr6:100903347-100903405
  misc_feature 1..58: note = hyper
  source 1..58: mol_type = genomic DNA
caacctattctccttcgtttctgtcacgacctgctcttctctttctaaatcccggctc

SEQ ID NO: 30707 - DNA, 221 bp, Homo sapiens
  misc_feature 1..221: note = chr6:100903560-100903781
  misc_feature 1..221: note = hyper
  source 1..221: mol_type = genomic DNA
cggggacgaagggccggggcactcgagcgagcctggagcgggcaaagactgcgttgcgactggggacaggtctcgcgcggttcccgaagggtgcgaagactgcgctgagcattttgaaggcctcccaaagcggctggaagacaccccgaagcggcctcccaaccagaatgatctgaaaatcccccaggctgggctcgggataaatactagttctgaactcc

SEQ ID NO: 30708 - DNA, 610 bp, Homo sapiens
  misc_feature 1..610: note = chr6:100903832-100904442
  misc_feature 1..610: note = hyper
  source 1..610: mol_type = genomic DNA
cgcctacgagggaaaatgagacttccccacaggttaataaacaacctgtccggcacaggttaacaggagcctctctcgccctctcctgccccacccccgccaccttttaaggaagcttttgccttcccggaggtttgccttctctttctgttccccgtagaaatcttacgattgtgtctgggttaatgttttataagggactggctactctcgtctacctgccgggctttcccgatctaatatcgaaggaacctccccaagtcctagtaaggggtcccccctccctaaagtctcgaagtggggtagagaccttctccctggagcccctcgcctcctgccttcggtgacgcgctctagcacacccaatttcagttggcgagggggtaagctgagatttcgtttctgcacttgacctaccgcagaaaattcgcaaatcctttgattgtctgtttaaaatgaggaggaaaccagctccctttgcggcgggattacagtgggaacaagatctaaagattctcttgcaattcggcgaggccgagggaacggggttttgcaaaagagaaaaggagctctgtgagggaggcgataactaaatcgggttttagacaaa

SEQ ID NO: 30709 - DNA, 76 bp, Homo sapiens
  misc_feature 1..76: note = chr6:100905783-100905859
  misc_feature 1..76: note = hyper
  source 1..76: mol_type = genomic DNA
ccgggccagagacaccgcggccgcacccagggaatccactaatgttactgtaaatgtggggtggaggccgaaggtc

SEQ ID NO: 30710 - DNA, 248 bp, Homo sapiens
  misc_feature 1..248: note = chr6:100905919-100906167
  misc_feature 1..248: note = hyper
  source 1..248: mol_type = genomic DNA
ctctctctctctctctctctctctctctgccttcgcggagctccagccctcgagtttgggcttcccgtagggatagagcctgcgggccaacctggctgcccgagttggagccagccgcgaaaagacggcagaaacccaaggagggcggggttcggccagactaaaactgggggcgaaattcatgcagcgttcatgagacagtcctgcgtgacggccgaaaaacgtcaatcgatgtcgccctgggactc

SEQ ID NO: 30711 - DNA, 373 bp, Homo sapiens
  misc_feature 1..373: note = chr6:100912073-100912446
  misc_feature 1..373: note = hyper
  source 1..373: mol_type = genomic DNA
caagggatcttccgccgcggatccccgagtccgcgcccaggccgggcgcacgtcccaggaaagcaggtttccgcaaatcagaattcctccaaggcgaggcaggggcctttcagctccctaccttggcagatctggaccttggctacctctttaacttgggtctcaagtctgagggattcctcaaaaagtgacacttacacaccaagtctctcgggactcccaaggcgacccagcgctctggctgcccagcaggggctgcaacaagcggggcccagcagcgccaggttaacaggtggcgcgctcgcgacagcccctcgcaggctcccccgggggtgggaggcgccgcggcctctcccacaccaccgcggagctg

SEQ ID NO: 30712 - DNA, 124 bp, Homo sapiens
  misc_feature 1..124: note = chr6:100912465-100912589
  misc_feature 1..124: note = hyper
  source 1..124: mol_type = genomic DNA
cggggcgtcttctgcttcacctaccttcagtccccacaagcggcagaggtttcgggggcgcccatctcttaactgttctcatgcctaccgtccaacccagcgacaccgccggcctctccgcttc

SEQ ID NO: 30713 - DNA, 161 bp, Homo sapiens
  misc_feature 1..161: note = chr6:100912890-100913051
  misc_feature 1..161: note = hyper
  source 1..161: mol_type = genomic DNA
cggccaggggcgaggcgctcattggccaatagggctgagtgacacgagtcggccccgagccgccctccgcgcgcccaggctccgggctctgaatcttactacccgcgggaccgctggactcctaatgagctcagggtgccgggtcggcgctgtccggttgc

SEQ ID NO: 30714 - DNA, 30 bp, Homo sapiens
  misc_feature 1..30: note = chr6:100914823-100914853
  misc_feature 1..30: note = hyper
  source 1..30: mol_type = genomic DNA
gtaaggaagtcttcacgcttaaggctgacg

SEQ ID NO: 30715 - DNA, 30 bp, Homo sapiens; identical to SEQ ID NO: 8634
  misc_feature 1..30: note = chr6:100915720-100915750
  misc_feature 1..30: note = hyper
  source 1..30: mol_type = genomic DNA

SEQ ID NO: 30716 - DNA, 100 bp, Homo sapiens
  misc_feature 1..100: note = chr6:100917210-100917310
  misc_feature 1..100: note = hyper
  source 1..100: mol_type = genomic DNA
cgggaattggcattccgtaagggagcggagggcctcaggccactaggcagctccgaacgcggggaagcgggagcaaagatgagctcagagcgagggttgc

SEQ ID NO: 30717 - DNA, 1266 bp, Homo sapiens
  misc_feature 1..1266: note = chr6:101840708-101841974
  misc_feature 1..1266: note = hyper
  source 1..1266: mol_type = genomic DNA
caatcttggagtctgcgacctcaggttcggcgcccactagatctcgaatccaacttctttctgaaatgtgtttaggttgagagttccggggcctgggcgggagtttggtggggagaggggagtctgctatttaaggcgccatacatacacagagacagcccgcccgacctcctaacactcaggaaaagtcaatttccaagcatctgttctcaataatggtggcagggagcagggcactgtgactcccagcatctgagggaatacccgcagcagcgctaccagagcgcatttgctctatgcgctggaggtcggggtgggagggtgcgcagatcaagatctttttttgcgaacctcagggaaatgaccgtagttggactaagaggtccactttggagactaccagcagccctccaagccctggcagtggagaagtttcgttgctatggtttcggagaggcataaaagccatcacccagaagcaaatgtgtttgggctccttatatgtgttgtcaccacccaaggctaggcaaattcctcggcgctttgcatgcatcactcactccctgacagagcatcttggccttagtctccccatcccaggaggcgggtgtgcgctaagggagcgaagtccagccggaggcttcgtaacatccaagtctagggacaccaggaattctctcgctctagctcctgtggtccaggggtgggagatgcccccgagtggccgcggcggccaggagcgtgcaggggccacggggaaaggagcgcggcgcctttaaagcaagaggcgaggaacccccgccaggaggcgtgtctgtctctgccgccgccgccgccgctgctgctcctcggtcaccgtcttcgccgctgccgtcactcgcgctcggcgccggcggctgcgctggtcggtctggtagctggggacttttccgcccgacctcctccggctgctcctccccgaggaccaccccaccccctccccgcccacctcacccctagctccaggtaaggactccccggctgtgggctgcactccgggctccttcacgaggtgtttgttttcaagaggacgggagggactgcgggtgggcgaggggcattttccacctggagagaaggaagaaggcgaacagtagcgctgcggacgtccgtgcgctcggggcgcccgctggacggattcactgcgagtctttgtcgggcttatctcagccaattcccgtcaagcatgcaagtggctctgttggctgcagtcgcctatgttctcca

SEQ ID NO: 30718 - DNA, 225 bp, Homo sapiens
  misc_feature 1..225: note = chr6:101849985-101850210
  misc_feature 1..225: note = hyper
  source 1..225: mol_type = genomic DNA
gtgaggggcagcccccgcttagagtgctgaacccttgccacgtccctcgcctcccccgcccgtcttcagcgtgcgcaaccctcttccccgcgcttccctctccctctctgtatggcacacacaataacacacacatacacacacacacattctctcacacacactcaaacatagacacgcgctcgcgcgcactaagacacatgcgccctccgggtgcatttggca

SEQ ID NO: 30719 - DNA, 15 bp, Homo sapiens
  misc_feature 1..15: note = chr6:101850524-101850539
  misc_feature 1..15: note = hyper
  source 1..15: mol_type = genomic DNA
tcctgggtgcccacc

SEQ ID NO: 30720 - DNA, 104 bp, Homo sapiens; identical to SEQ ID NO: 586
  misc_feature 1..104: note = chr6:105389509-105389613
  misc_feature 1..104: note = hyper
  source 1..104: mol_type = genomic DNA

SEQ ID NO: 30721 - DNA, 249 bp, Homo sapiens
  misc_feature 1..249: note = chr6:105400913-105401162
  misc_feature 1..249: note = hyper
  source 1..249: mol_type = genomic DNA
tgtcaagaaagttaccgccaagtggtttaccaaaacgcggcggaaggaatcaggacagtttgcccgacgggcgggtcggcggctttcaggcgggagagatcttgccaggggcagagagagatcccgaaaatcgcccccagccttgcgtccagccctttctcgccgacgttttttcttgatcctccgaaggcccagggcgacgtttgccatcgcggcttcccgaaaggacggcgccgggtttgctggaag

SEQ ID NO: 30722 - DNA, 234 bp, Homo sapiens
  misc_feature 1..234: note = chr6:105401581-105401815
  misc_feature 1..234: note = hyper
  source 1..234: mol_type = genomic DNA
tggggtctcaggtctcggccgcctggggagcgacctgcctggagaggcgggttgcgatggcagcgctgggctacagaccccgccttatttgcggggaggagaggacgggtggagtcacttgccgcattgccacagcccctcctcctagttttaagaagaaccgaagcattgtttctgctttaacagaagtcactcattccttataattgaaaacaacgacggtgggctctggca

SEQ ID NO: 30723 - DNA, 155 bp, Homo sapiens
  misc_feature 1..155: note = chr6:105404519-105404674
  misc_feature 1..155: note = hyper
  source 1..155: mol_type = genomic DNA
taaatatgaaattagcgttccaagcaggtttactgccatggaatagctgaattcttaaggggaaaaaaagcgttaacatcggttgttttatttaaacgaccccctcccatgattttagtcaggcttgtgtgtaaggcacgcgtgtgcacatatat

SEQ ID NO: 30724 - DNA, 30 bp, Homo sapiens
  misc_feature 1..30: note = chr6:105404921-105404951
  misc_feature 1..30: note = hyper
  source 1..30: mol_type = genomic DNA
taattgacaaagtcacgtgtgctcaggggg

SEQ ID NO: 30725 - DNA, 889 bp, Homo sapiens
  misc_feature 1..889: note = chr6:105405576-105406465
  misc_feature 1..889: note = hyper
  source 1..889: mol_type = genomic DNA
tttcctcctcgtgcccgccggagagaatagtttcgctgaaaatttctctttgtcaatgggatcagtattaaatcagcaatatacaagtaaagtatcgcatgctgtaatgtaaaatgtggctgaaaaatggagttaaatgaataagtacacgtatgtatagaaacgtggaagttggtgtgatcgatagaacagtgtggcttccccctcccccgctttccttttaacccttttcattttaagtattttctgtggagaaaagaaatcaaaccattaaaaaaaattttttttttctgttacccttcccccccaaccccaggcaggcaattttttttttttaatctttgaatgcacattgaatgggaatacagactgacttttttgtcctgttccttctcaggcggggctagcaaaggtggtggagaagagcccgggaagctgccggagccggcagaggaggaatcccaggttttgcgcggaactggccactgtaagtggttcaatgtgcgcatgggatttggattcatctccatgataaaccgagagggaagccccttggatattccagtcgatgtatttgtacaccaagtaagccaaacttttttgtccccctcttcatctttttccatgtggaggagctgatcggtagttatgccaatagacgtacgataagatgtccttcggtatattgaaagacaaaatcttccctgaaatcactaggtagtccaacgtttagggtacgtgtatgggccttttcctgggttttctgtctaaagagaaaagaaaatatttgaaatttcactatatatattaaggttgacgttattagcatttccccctgcttcattctacagcgaaatagtgttcttgttgtttccggtattacctatac

SEQ ID NO: 30726 - DNA, 139 bp, Homo sapiens
  misc_feature 1..139: note = chr6:105584077-105584216
  misc_feature 1..139: note = hyper
  source 1..139: mol_type = genomic DNA
tgctaagagtcttttcgcacttattcatgcttcaaagcaggcagtttctgggacttgtctggccaacaacccgttcccaaaggctcggggaaggaggttgcgggtgggtggcgcggacctcgggtccccagccatcggc

SEQ ID NO: 30727 - DNA, 103 bp, Homo sapiens; identical to SEQ ID NO: 588
  misc_feature 1..103: note = chr6:105584217-105584320
  misc_feature 1..103: note = hyper
  source 1..103: mol_type = genomic DNA

SEQ ID NO: 30728 - DNA, 185 bp, Homo sapiens; identical to SEQ ID NO: 589
  misc_feature 1..185: note = chr6:105584366-105584551
  misc_feature 1..185: note = hyper
  source 1..185: mol_type = genomic DNA

SEQ ID NO: 30729 - DNA, 1036 bp, Homo sapiens
  misc_feature 1..1036: note = chr6:105584552-105585588
  misc_feature 1..1036: note = hyper
  source 1..1036: mol_type = genomic DNA
gcggccgctgaccgttgagggtctctgtggccgcagcgcccagacccggggagaagggcggcctccaagggccgggagcccctcgagggcgcggccagcgaggagggacagagggcggcgcccccggctgcccgggcgcgtagaacaagcagctgccgccagggccgacaaagttgctccccgaggggctgagatccaactttcgcttcccgatttagccaggggagcgcgaggccgcacacaacccggcgcggggggaaagccggctgcagctgcgcctcccatccttacccggctggtccctggcggggagcctgggcagcgccgaccaaagttcggagcggcagcttcggggcgcgggacgcggggcacacgggctcagctgctcgacgggagcccgacgcgcgctcctcggcgggtcggcgggtccggaagctccgctgcccgggccgggtccccaagcccgcagccgctttgactaaaataggcatcgcgacggcggcggcaggcggcggcagccagggctggggccgcaccgcgcacgcgcatgcgcccgccgccccgcgccccccggcgggcggagcccggcgccgcggccaggatttcccacctcgctcccgcgactccgctgcgggtctgcacacccgaggactcggtttgaaacgcccgcttatttattttcttgtcgcctcgctacaagattctatccttgtttgggcatgagtggggggcggcagtctcgtgggaccggcggcattcgtcgttcctccttacggggataattcgagaagtgcggtccgggtagggagagaaatcaggagagaaaatgagaaagagaatcctcgtttcccctcaaagttggacgacccactcgtatatctcctttttgggagattcgcccataactcagcacaaacagggaatagcccggaaagcgcgcgagttcccgtccgattgtggcgggggaggctgaacgtttggtccacacgggtgcaggacgcgggggtcaggcctcctgctgcggaggaagaggggg

SEQ ID NO: 30730 - DNA, 709 bp, Homo sapiens
  misc_feature 1..709: note = chr6:105627368-105628077
  misc_feature 1..709: note = hyper
  source 1..709: mol_type = genomic DNA
tctgggaggaatattcgcccagaagcctctagggcatacgactcgcgttcttcaggggtcggcgcggataggaaccgcagcaaaggatcccctagacctccgagctgtgagcggcgacacagccgggaccccagaccccggaccccagggcgcggagttgaccggagccgggaagggagcggcgcgggcagcgcggggcagcgagacgcaagcgctcgcaggggtcggcggcccagcagaagccgcgcccgctaagttgcccgaagcggccgcgaggtgcgagggtgcggacagcaccggaaggcggcggacgcagcgcccccgggctcaccttcttacctttccttcccagccctgcccggagcttcagcccggcgcccgcagaagtttcccggcggagcgcgcttgacccgggtggcccgcgcggaagccctcagcgtccccctcgtgagtgcctcgccgcccaccctgcggcgccgggcgcagcgtgaccgcagcgggctccggagcggcgcggcggcgcgggcgggtgccgggcacgggcgcgcgccccggggcgcagccgggtgggcgggcgcggcggctgcgtctgggccggggcaggcggttcggccaccggggtgcggggctgcggagaatcctagcggccgctacggaccgaagtttccaaagatgcggttccccgagtgtacaccgctcccggttgtaa

SEQ ID NO: 30731 - DNA, 473 bp, Homo sapiens
  misc_feature 1..473: note = chr6:106429003-106429476
  misc_feature 1..473: note = hyper
  source 1..473: mol_type = genomic DNA
aaactgctatgaattcggtgactgtgcaatgaaattgtcaattatcctctctgccttcctgcgttgaaagagtttcaagaagttgtggtgagtggatgtattcccagacggatgcgggcggtccccgggcagggaccccgaatccggggtcgcagggtggtagagccggaagattggattccatctccgcaaggattgagaaaaacggactcaccgactgaactattccatctccaagttgtttttattttccactttaagcataagaacgatgagaaccaggagccaggcggccccgcgtagcggtgggagcgcaggtacccgagagtaccctctgggggccggcccggcgcgctcgctcctcctcgcctttccgggaaccgtgcgcaggagctcacacggcacgcctgcggccaggggcaatcgggttctcggttcccggagtcccagttcccggtttccagtttccttat

SEQ ID NO: 30732 - DNA, 35 bp, Homo sapiens; identical to SEQ ID NO: 592
  misc_feature 1..35: note = chr6:106429589-106429624
  misc_feature 1..35: note = hyper
  source 1..35: mol_type = genomic DNA

SEQ ID NO: 30733 - DNA, 127 bp, Homo sapiens
  misc_feature 1..127: note = chr6:106434152-106434279
  misc_feature 1..127: note = hyper
  source 1..127: mol_type = genomic DNA
cgcggggtctctagtccggaggcacggaaggacctgcctgcctgactctagtctgcaagtctcgggcacacgcgcggcttctgcccacccgcgtaaatgccctggggaaaggcgccctttcttttat

SEQ ID NO: 30734 - DNA, 1307 bp, Homo sapiens
  misc_feature 1..1307: note = chr6:106441813-106443120
  misc_feature 1..1307: note = hyper
  source 1..1307: mol_type = genomic DNA
aatgaattgcagagtcggatacagctaatttgggggaatgtaagctggatgtcttttcctaatttatgaaacgtgaacgggggtaaggtatttatttgtacgctagttgaagtggggcaggagcactgattcctggacagtcactcaaaagctgcgcccaaagttttaaaaagcgcggggacggtggagagggaggcgaagagcccgcgctgctgggctgggctcgggtgccgcgctggggacgccgcatctactgagcggtcgccgaagacgccgggaggcgaggggcgaggtaagacgccgcctaaagaggcccgggctctcccccggggtcgttgttggaaaagcaaattccacggtgaactctaccaagctcagcgcgtacacagctagcggctctggattggactgcattcgcctaaattgcgtaattaaaaaaaaaaaatacaccactgccaccctacagcgacgcttccgctggaagacgagcggggacgcgtgacagcgcggggatagcttttctattacgtttcttgttctccgagctcgagcccccttttaaaaagtcgctcaccaaaaacggggtgggggatggaggtggggacgagaagtttccgaatgctgagttcatttggacgaggtgaggagaactagggtcctaacagcaggtccagaggactctcgagataggtttagagcccgtccttttgtctggagtgtcgcgggactccagaagtgggttgtgcaagacaaacttccagataaatctttgcccggatcctcctgcggtcaaagcatcagtcctgcccgtaacttcctaacgacatcttcttggagcagattccgcggcggggatggctgggtgtgcaaaccgaaaacagtttgtcagccctccagtcccgccgcgtcgggaatgcgagcccggccacgcggtccgaccgggtccggggacggcgcgcttgtcgcgggagcctcccggcttgcggagggcttgagttttttggcggagacagaggaaagcctctggtcgagaggattagagcgcgcgttttctccgccgagcacgctgcccgacgccgtcgcagccgcgcacttcccggttttgaaagccagagagatgagtcaagcgcaaaagctccggagtgacaatgcgagcttttggccagcctcatcctcctccccattcccttgccttcttttaggtcttcggttcgtgacaagtgcataggttaggcttgcacggaagagggtcggggcaggtgccagctcagggcacctacccggcgttgtcacgttccctttgggat

SEQ ID NO: 30735 - DNA, 69 bp, Homo sapiens
  misc_feature 1..69: note = chr6:106809115-106809184
  misc_feature 1..69: note = hyper
  source 1..69: mol_type = genomic DNA
agccgctggggttgacgaggttcctcgcggcttttggttcagaccaagcaccggcgagaggaacttgtg

SEQ ID NO: 30736 - DNA, 97 bp, Homo sapiens
  misc_feature 1..97: note = chr6:106958240-106958337
  misc_feature 1..97: note = hyper
  source 1..97: mol_type = genomic DNA
caccgcgcccattggcgggtttgcttttattggtttgttctgcgctccctcccgccttctggcgcgggcactggatgctagccgttttgctccagga

SEQ ID NO: 30737 - DNA, 83 bp, Homo sapiens
  misc_feature 1..83: note = chr6:106960311-106960394
  misc_feature 1..83: note = hyper
  source 1..83: mol_type = genomic DNA
cgctgccagggacgacgcggtgttcgacgacgaggtggcgccaaacgcggccagcgataacgcctcggcggaaaagaaagtga

SEQ ID NO: 30738 - DNA, 356 bp, Homo sapiens
  misc_feature 1..356: note = chr6:106960667-106961023
  misc_feature 1..356: note = hyper
  source 1..356: mol_type = genomic DNA
gcggggaggaggcggcgcgggccatcccccgcgagctcccggtcaagagcagctcgctgctgccggagatcaagcccgagcacaagaggggcccgctccccaaccacttcaacggccgggcagagggaggtcgaagcagagagctgggcagagcggccggagcgcctggagcttctgacgccgacggcttgaagcccaggaaccatttcggcgtgggcaggtcgacagtgaccactaaagtgaccctgtaagtagccgcgcaagtcccggccgagttgctgtccgcacacgtgctgggggtccgctctgagaggctcggggtatctgcattgtggaagaaacgtctggtcactgaa

SEQ ID NO: 30739 - DNA, 77 bp, Homo sapiens
  misc_feature 1..77: note = chr6:107809976-107810053
  misc_feature 1..77: note = hyper
  source 1..77: mol_type = genomic DNA
ccaccactgtcataacgaacactccacagtaacatgcagtggaacaatggacacccccatatcgcattgtgtcaggt

SEQ ID NO: 30740 - DNA, 163 bp, Homo sapiens
  misc_feature 1..163: note = chr6:108434942-108435105
  misc_feature 1..163: note = hyper
  source 1..163: mol_type = genomic DNA
tggtcagcccaagggcgagatgcgcctcggggtcggagtcgcccgagtggagactggacactccatgggggaggctggaaccccctgtgccacagataaatgctcgttctccaccacatgtgaggcatttgaataggagcaagtctcccgggttgggaatact

SEQ ID NO: 30741 - DNA, 715 bp, Homo sapiens; identical to SEQ ID NO: 2884
  misc_feature 1..715: note = chr6:108436072-108436787
  misc_feature 1..715: note = hyper
  source 1..715: mol_type = genomic DNA

SEQ ID NO: 30742 - DNA, 33 bp, Homo sapiens
  misc_feature 1..33: note = chr6:108438124-108438157
  misc_feature 1..33: note = hyper
  source 1..33: mol_type = genomic DNA
acgtcctccctggcccgggcagcccaactgggg

SEQ ID NO: 30743 - DNA, 317 bp, Homo sapiens
  misc_feature 1..317: note = chr6:108438260-108438577
  misc_feature 1..317: note = hyper
  source 1..317: mol_type = genomic DNA
cgtgggcgaatgtctggtggccgggtgagtggaacccgccgcccagtccttgcagcgggctctggtctagtgggtgaggatccctggggaggtcccaactccggtgcagcgtccgcggggtgaagggcgcgagtgcattcaggccccaagggaaactcggggacatctgcacagacaagaatccccaaggaggcccaggtcccacggccaaagtcctcgacccccaccaggctgtctccctctagtcctccccactcctgacctgccattcgggacggagccagtccgcgggcacccaagggcgcaagctggtacaa

SEQ ID NO: 30744 - DNA, 98 bp, Homo sapiens
  misc_feature 1..98: note = chr6:108438779-108438877
  misc_feature 1..98: note = hyper
  source 1..98: mol_type = genomic DNA
catgtgatgtgtgagcggtgtgtgatgtgcgtgtggtgcgaagaggggaggtgacaggccagagaggtttccccaaagggagaggcacggagggcttc

SEQ ID NO: 30745 - DNA, 1150 bp, Homo sapiens
  misc_feature 1..1150: note = chr6:108439495-108440645
  misc_feature 1..1150: note = hyper
  source 1..1150: mol_type = genomic DNA
gtagcagaaaggaatcgaggcccccgtccataatcgcaggtgtcggcgtggaaaggagccacgcgtgcacactcatgggtctcaccgcgcgggcttccgcggcccggcaagccgctgcgcctgcctcgccggcggcccacggagcccgtccgcgcttgccctgcacacctgcgcccgcgcgaggacccagccgccgaggccgtgcgcccgccgggctgcgggggccgtgggcagggggcgcagggggcgcagggggcggccggcgcggcggctgaacccgggctgacgaggcccagccgcctgcggggcccggagcgggaggtaccggctaggggcgcgtttctttcgcatccacaccccgcccccacccctctctccagggattttttttttttttttttttgtatccaggcacagctgggggctccctcaccacccacccctggcctccccatacagaataaagtcagtctgtatttaatggttatggcggatgtgagggggatttggcagaggcagaagagaggcctttcgctctcaaatatcgtcccttacgtcgtgtgagtctaccaacccaccacgacctcatattcttgtgcgggtgtctgactcgaatgacaagcgagctgattttttcagtacatagctgggaaatgtagtgagtgataatagagatttctctttcattttttacgcttgacttggttattgttgcttttcttttcccgtgattccttctgaggattagctctgacttccccactattggcggtcaaagtggccccgactcgggatgacaattgacggggatcaagggattgcccattctgtgcctgtaagaaccgattcgtgccagagaaactcatcaagtggaggcggagaataaagaccgttcgggggtaaatgtattcattgagaagggttctcccaaattgcttctaagtttttttaatgaaaagtaacgattgcggcaatcagcggctttttggcggattacaaatctggagggagctgcggcgctgcattgaaaagtgcccccgccttcgcaccgggcagccggttcacaggagcagcgcgaggggcgggggtccgatagcgggacaaaggcggggagggggcgagcggaggagggcggctcggggcgcccggg

SEQ ID NO: 30746 - DNA, 223 bp, Homo sapiens; identical to SEQ ID NO: 597
  misc_feature 1..223: note = chr6:108440744-108440967
  misc_feature 1..223: note = hyper
  source 1..223: mol_type = genomic DNA

SEQ ID NO: 30747 - DNA, 890 bp, Homo sapiens
  misc_feature 1..890: note = chr6:108478806-108479696
  misc_feature 1..890: note = hyper
  source 1..890: mol_type = genomic DNA
gtggggaatcttggccgcggccccctcccccgccttataaaaaagaaattgacttttgtttggagtttgtgaaaagtggggctcggggcccagtcaatggggcgccccgcggcgcgggctgagtggagctagcgcgaaccgctcagccgcggccccaattaatccgccctttgtgcggcccgcccggccgcccccgccgcagccgcaccagcggcccattgttcggcctcgccgggccgcgggatttacccttttcaaacagccggttttgtccagggcagttcgagcggaagtttctcactgacaatttgccccaaatagatagatttgtcagaagcgaccttcgggaaggaagcaaaaagccaccggcccgaaggttgggcccaaaacagggactctgcgtcccacccgcggccgcgccgcccccccgcgcccccggccctgcagtcccgaagccccgcgggggtccagaccactgcacctgctgagccagacactccgcggacctgacctccgttttacccatctgtaaaatggagcagctgggcgctggcaagccgtaagtccaagagctttggctccaccagcgtgtacgacgctcatttcctttctctctccccacaccctttccaaaaactgtaagccagaaaacctggccaggcctccgcgacggcgagaaacggtcttgaaggtcggtcggtcgccgtaatgcggtccggatcgtgcacgtgctgtttcgccactgccctccggctcctccttaacaaagatgtcaaccgtgctaaatcacaggtggtgcctttgtaagaccagctattgtcccctcataagtcaagatataaaacgctttgtactgaatggcccatgatctggagcgctcaacttgggag

SEQ ID NO: 30748 - DNA, 294 bp, Homo sapiens
  misc_feature 1..294: note = chr6:108484872-108485166
  misc_feature 1..294: note = hyper
  source 1..294: mol_type = genomic DNA
gagtagaaggcagcccgcactaaggctccaggcttatttgggacctggtgggcgacggggcctcagcccctcccgcctaccctggagcttgttgccgccgttaccactgaaccagtcatgccagaaagtcatcacgatgatttcagaactgtattgtgatttatgcaaagcgcgccgataattacagccgggcgcacagaacacaggatgcatatgctgcgggtgtgtgcgcgcagtgttgtgcctttcgccagggctgaatggggtgtgtgtgtattccgtaggcatcttctt

SEQ ID NO: 30749 - DNA, 494 bp, Homo sapiens; identical to SEQ ID NO: 2891
  misc_feature 1..494: note = chr6:108485513-108486007
  misc_feature 1..494: note = hyper
  source 1..494: mol_type = genomic DNA

SEQ ID NO: 30750 - DNA, 456 bp, Homo sapiens
  misc_feature 1..456: note = chr6:108486008-108486464
  misc_feature 1..456: note = hyper
  source 1..456: mol_type = genomic DNA
tgctgtcggagcccactggagcgcacagcccgctccccctgggacgcccaggcggaggacctgctgcgccctcccagggctcgggggactccagcattcacttgcacgcacaggcgaactctgattgaaagcccgggatgacaccgagtctggagaaagagggaccggggggtgggctggcggaattgcagagcgccggccacagctcccctccccgcgaacgtcgagcggagggcgggaggtgtaacctctgacctctggccgggtccacgccctgaggagggactggcaagctcttgttcgacaagttcaagctgccgagagagcttaaatagaattaatctcttagagatcggggatcatcgctccctcggcatgcgctctcccagcgccgcgcacagagcaaggcgcgagagagctcaggaatcgcgggaaggcaagcggaatggggagggg

SEQ ID NO: 30751 - DNA, 160 bp, Homo sapiens
  misc_feature 1..160: note = chr6:108486846-108487006
  misc_feature 1..160: note = hyper
  source 1..160: mol_type = genomic DNA
gcgcgcacaatcacacgccagcacacagccacccaatttcttccgcgaatctatctggcactctggagagagggggaaaagcgttttgagaaagccccgtcacccctccccttccttcttgccgtgaaatatacgaattcatttttattacgagccgcac

SEQ ID NO: 30752 - skipped

SEQ ID NO: 30753 - DNA, 63 bp, Homo sapiens
  misc_feature 1..63: note = chr6:108487419-108487482
  misc_feature 1..63: note = hyper
  source 1..63: mol_type = genomic DNA
tctgcgcttgggttccggcagcgcggagcccgtctgcctctgagactgcggtagtgttttcct

SEQ ID NO: 30754 - DNA, 747 bp, Homo sapiens
  misc_feature 1..747: note = chr6:108487779-108488526
  misc_feature 1..747: note = hyper
  source 1..747: mol_type = genomic DNA
atttccactgttggacgaattctgagcgcccagggagcagcgcagcgcgcgactgacacccacctgtcccgcccaggagccttgcaggctggagggcagctggagagcggcggcgcccggcggcgaggcgggcgctgccggccgggactcgggcagcgcccaccaaccgctccgccccgggacagccagcatgagcaagccagccggatcaacaagtgggtacctctcgggccgccgtggggcctaggcgcgcagcctggggcgagcgagcggggaggctgggggaggtcctgcctggagcgctgcgaatctgagcccctgagagggattccagcgggcgtgtgcgttcggcccagacctgtagaccgtgagttggagcatttcgtggagaggggagagccgtttcgttgcctctggattgcttgatcccccctgtctggtgcggtgagaaggttacgacccgcgcagcccaccagtcggatgagttgtctccatttagccgccaggtgctggatgggggggccatgggggcgggaactgggccgcagctccaggcggtagcacaataacacactcgctcaaaactccgagctccagcgcgcaaaagcaactctgtgcaaagcggattttgaatggaatgctttgcaccccgtttctagctatttcaaataatcctgcaaactgggaagcagaaacaatttaaaagtcacattttccttaatcctaaatccgcgtaggtcataactg

SEQ ID NO: 30755 - DNA, 148 bp, Homo sapiens
  misc_feature 1..148: note = chr6:108489661-108489809
  misc_feature 1..148: note = hyper
  source 1..148: mol_type = genomic DNA
cgcccccgctgtggactaggaggcaggccaaccctccggactttgggggaaaaaccacagcgggctccttgcggaaactttggccgttctaacttgccaagagcctgagtgaggccttggaagcctccagccccggctcaggtcggga

SEQ ID NO: 30756 - DNA, 180 bp, Homo sapiens; identical to SEQ ID NO: 600
  misc_feature 1..180: note = chr6:108490066-108490246
  misc_feature 1..180: note = hyper
  source 1..180: mol_type = genomic DNA

SEQ ID NO: 30757 - DNA, 219 bp, Homo sapiens; identical to SEQ ID NO: 601
  misc_feature 1..219: note = chr6:108490296-108490515
  misc_feature 1..219: note = hyper
  source 1..219: mol_type = genomic DNA

SEQ ID NO: 30758 - DNA, 464 bp, Homo sapiens
  misc_feature 1..464: note = chr6:108490537-108491001
  misc_feature 1..464: note = hyper
  source 1..464: mol_type = genomic DNA
cgaggaggggcccccaccctgcactggtcttccctccaccctcatcgggttctccagagatgttgtcatgggcctcctgtccggatgggaagtggggaaaaagagaccccaccactgctcctcccactcactcatcttggcatcttcaacagtgccacagggaagaggacagctggggtgacagtactgctgggccccaaacgtggaccctggagcggtcagagggcgcgtgttaagcagaggatggttgtaagatatggaaaccaagtttaccgcttccagagtgagtgcagtgcagcggagctccagacccggttcctgagcgaccaggaactcccttgggcgcagtgacaggcccgaaggagtggaggacaagacccgctgtgcccttgcctggccctctccagcccctccctcccacagcacaatctcccctcccgccctgtgggaggggggcgccgagc

SEQ ID NO: 30759 - DNA, 303 bp, Homo sapiens
  misc_feature 1..303: note = chr6:108491107-108491410
  misc_feature 1..303: note = hyper
  source 1..303: mol_type = genomic DNA
cgcggggttgtaattacccggccgagcctggtcgttaccgaacaccccctcacccccaagcacggtcccccgcgctctccttcccccaccccctccacctgagacgagtctgggacccacggtgcaagctcgcccggacgcctcgggttccaggagcaagtttacacctgcggtgcctcgaggccctccccgcgccacgccctcacctcccctactcccctcgcccagacgttccactgccgccccttcccacctcaatcccatcgtagtccccaacccaagcgctttcggcagcagctgtcg

SEQ ID NO: 30760 - DNA, 290 bp, Homo sapiens; identical to SEQ ID NO: 8674
  misc_feature 1..290: note = chr6:108492251-108492541
  misc_feature 1..290: note = hyper
  source 1..290: mol_type = genomic DNA

SEQ ID NO: 30761 - DNA, 179 bp, Homo sapiens
  misc_feature 1..179: note = chr6:108495639-108495818
  misc_feature 1..179: note = hyper
  source 1..179: mol_type = genomic DNA
tctctggggccaagtcgctgtcttcggtcctgaagtctcgtccctgttccaccactccgcgactggcggaagttcccctagcgagagccccgcaggcctgcggggtctgccaaacccggctctctaagcttcacctgcttggagaaggacgtttcccccttgtccgctttcttggggtc

SEQ ID NO: 30762 - DNA, 551 bp, Homo sapiens; identical to SEQ ID NO: 603
  misc_feature 1..551: note = chr6:108495915-108496466
  misc_feature 1..551: note = hyper
  source 1..551: mol_type = genomic DNA

SEQ ID NO: 30763 - DNA, 173 bp, Homo sapiens
  misc_feature 1..173: note = chr6:108497294-108497467
  misc_feature 1..173: note = hyper
  source 1..173: mol_type = genomic DNA
aaacgaggtgtctggcgtgcgcgacgctccctctcttttggatgggggcgaggatacctggctactccagcccagagggtctctggtttccctgcgaacccccttccctggtggggaggagccctggaccgaaggagaacacacctggtcttacttgaggctctgccattatc

SEQ ID NO: 30764 - DNA, 185 bp, Homo sapiens
  misc_feature 1..185: note = chr6:110299509-110299694
  misc_feature 1..185: note = hyper
  source 1..185: mol_type = genomic DNA
tctcactcgcggagccggcacagcgacaggcgccccgcgcttgcctcctccccggcccggccgcctcctgcaggcagctgctctgtttgcgcggggagctcagcccggcgccccgcctcggcgcccatgaccagcgacttccagaagtcctgacgccccaggtgagtggccgagttcccagggaa

SEQ ID NO: 30765 - DNA, 30 bp, Homo sapiens
  misc_feature 1..30: note = chr6:110299948-110299978
  misc_feature 1..30: note = hyper
  source 1..30: mol_type = genomic DNA
ccgccacaacccaggcgggactctcccagg

SEQ ID NO: 30766 - DNA, 509 bp, Homo sapiens
  misc_feature 1..509: note = chr6:110678891-110679400
  misc_feature 1..509: note = hyper
  source 1..509: mol_type = genomic DNA
cggagcctagaagggcgcccggccacggcgacccccaagtactggctgaatagtgaatgaactccgcttggccgcacttcagtctatctgggcactgaaagatgcgacccgtggagccgcctaagagagcacagggggaagagaagaagcggaagcctccggaggtcccatcgaggcggcctgcgggacctgagcgccgggctccgtagcgcggtcgggagggggcttctggtcccaggcccaagaccgaccgctttgcaactgaccttccggcgggggcgcccgcgcggggcacagcagccaggctccggcgtcccgctcccgccgccccccggcggcgcccggcgaccgctgcgcacgtaggtcacctgcctcctgctggcgccgcgcggctggcccggcgcgggcggcaggtgcggcccaggtggccgccaggccgggcccggcggggcgctgcgggtgggggacccgggcccggcgcgccgcagctctgcgcagagccgcaggcc

SEQ ID NO: 30767 - DNA, 298 bp, Homo sapiens
  misc_feature 1..298: note = chr6:110679401-110679699
  misc_feature 1..298: note = hyper
  source 1..298: mol_type = genomic DNA
aacaacagcacagccccgagtagacaccggcgcaggacgccgcagcccctcccgggcggcctctcccgggccatggcgctacactcggggtcccgcgggccgcgcctggccggcagcagggatgtagccccacaggccggagcggccaactgtgggaactcccccgcgggccggggtgcgggctcggacccgcctccctccctcccgaccgaggaagccccggcgtaaccttatcctgccctgccgagcgcgccccgccgctggaacggtggtgggccgaacgcggtcacagggggcc

SEQ ID NO: 30768 - DNA, 230 bp, Homo sapiens
  misc_feature 1..230: note = chr6:110797490-110797720
  misc_feature 1..230: note = hyper
  source 1..230: mol_type = genomic DNA
tccgagcgagcccagcgcctctgctcaccatgccaggtcccgctgccagaggcctagaggagaagcccagctaggggccggcgtctggacgcccgtgtcccgactgcgcggggtgaggaggaagtggagatgttttcggatcgcgagcgccgcgcgagaaccccgccgcaacggaaagaaacagacccctcggcgccgcctcccgcgtggcgccgcggggcccctccccc

SEQ ID NO: 30769 - DNA, 217 bp, Homo sapiens
  misc_feature 1..217: note = chr6:111409641-111409858
  misc_feature 1..217: note = hyper
  source 1..217: mol_type = genomic DNA
ttcaaccccagtcatcgccctgtcatttttgtggtctctttcgtgactatgccagttatgtagttcttcacctgcctccctgggccgcagaggggtgtgcgtatgttggcggggcggggggtggagtttggaggaatgaaagagatttgtacgaaggtcactggagttccaaagggggccctgcaagagtcacggttccgtgcgttcccgtcccccc

SEQ ID NO: 30770 - DNA, 167 bp, Homo sapiens
  misc_feature 1..167: note = chr6:114663194-114663361
  misc_feature 1..167: note = hyper
  source 1..167: mol_type = genomic DNA
gtcttccccaggcagcgcccaggagaaccgaaccccacaaagtgcttttttgctggcatcacccggatgcttccctttggcgatttgccccttctcatttccccccaaatctagaggtctcaaagcccctcccccgcgcgaggcgggcagcgcgccttgctcaccgt

SEQ ID NO: 30771 - DNA, 37 bp, Homo sapiens
  misc_feature 1..37: note = chr6:114663777-114663814
  misc_feature 1..37: note = hyper
  source 1..37: mol_type = genomic DNA
gccggagaccgcagccgctctgcggggggaggtgcgc

SEQ ID NO: 30772 - DNA, 53 bp, Homo sapiens
  misc_feature 1..53: note = chr6:116783514-116783567
  misc_feature 1..53: note = hyper
  source 1..53: mol_type = genomic DNA
ccgcaaccgcagctgcgccgcggagctgccgctggtgccgtgcaaccaggcca

SEQ ID NO: 30773 - DNA, 48 bp, Homo sapiens
  misc_feature 1..48: note = chr6:116937976-116938024
  misc_feature 1..48: note = hyper
  source 1..48: mol_type = genomic DNA
agtctagagccaagacgcctctgggtggccccgcgggaccagaaacat

SEQ ID NO: 30774 - DNA, 240 bp, Homo sapiens
  misc_feature 1..240: note = chr6:117086239-117086479
  misc_feature 1..240: note = hyper
  source 1..240: mol_type = genomic DNA
gaaggtgggtcaccccgcacccttgcggccggggaccgactctccttcgcgcggcggtcgccacacttacgggatccgaggcgggatctcctccatcgatttgaaacgccctgtccacagcaggattttcttgtcgaactgcgaaggcctgcgctgcgtggggactcggtgaatctcccctgcagcgaaagcaacccagatggacgcgggaactgacgcaccggcacagaggatcagcgc

SEQ ID NO: 30775 - DNA, 160 bp, Homo sapiens; identical to SEQ ID NO: 605
  misc_feature 1..160: note = chr6:117086480-117086640
  misc_feature 1..160: note = hyper
  source 1..160: mol_type = genomic DNA

SEQ ID NO: 30776 - DNA, 32 bp, Homo sapiens
  misc_feature 1..32: note = chr6:117197673-117197705
  misc_feature 1..32: note = hyper
  source 1..32: mol_type = genomic DNA
agtaatcgtcagggacgcgtttaaattacaaa

SEQ ID NO: 30777 - skipped

SEQ ID NO: 30778 - DNA, 30 bp, Homo sapiens
  misc_feature 1..30: note = chr6:117198544-117198574
  misc_feature 1..30: note = hyper
  source 1..30: mol_type = genomic DNA
gcttgctagtctatccggaagaaacagtgt

SEQ ID NO: 30779 - DNA, 316 bp, Homo sapiens
  misc_feature 1..316: note = chr6:117585882-117586198
  misc_feature 1..316: note = hyper
  source 1..316: mol_type = genomic DNA
gaaaagccagacatccgaggccgggtaaagcctcctggactcctcgaaagcagctcacaccgggagcagccggaagcgggcgcgatctatgcgaagctaacgggttccggtggagaacatcaaagagaaaggagcaggatcgaactttagaggggcagaagggcacggcccaagagagcagaattggggtgtgggacaggcggcgggaggaccaggttagagggagcgaaaggaagtggattagaggacagcggttacaggtttcagccactgccatttccccgcagaggtagctcttctgcgccctggaggggta

SEQ ID NO: 30780 - DNA, 243 bp, Homo sapiens
  misc_feature 1..243: note = chr6:117586401-117586644
  misc_feature 1..243: note = hyper
  source 1..243: mol_type = genomic DNA
gagcccggatcccttcgtccccgcctccttctctctctctctttctctctctctcctattttgtcctgggagattcctactcgcggtgcgaagcctcggatccgctgggaaccgcatagtctccggcacccttggccgcatgcttgtcagaggtgggccccgggaaacacactcgctgcccctccaacaagcgtccctcgctccccattggccccccggtccccgccccccaccgccccctcc

SEQ ID NO: 30781 - DNA, 157 bp, Homo sapiens
  misc_feature 1..157: note = chr6:117587133-117587290
  misc_feature 1..157: note = hyper
  source 1..157: mol_type = genomic DNA
ggatgcggggattgccggagccgcccccagttggtagtgcaattagctaacccctttagctcgcctgtttgctctcgggaagcagctaagccctgctaatgtgagcctaggtcttccctggaataatcagaggaagatggcacgggctggattttct

SEQ ID NO: 30782 - DNA, 76 bp, Homo sapiens
  misc_feature 1..76: note = chr6:117587572-117587648
  misc_feature 1..76: note = hyper
  source 1..76: mol_type = genomic DNA
taattttttcctttgcgaagttctgggagcattatccggagtgcgaatgacccggcagaggcgagcctgatagaca

SEQ ID NO: 30783 - DNA, 391 bp, Homo sapiens
  misc_feature 1..391: note = chr6:117591206-117591597
  misc_feature 1..391: note = hyper
  source 1..391: mol_type = genomic DNA
gcaagaaggctgaaacgcgagagggggtagtgagatcactaggcggccgaccaagagtgggaagaggtatcgttagcttggggagaggttaaggctaggaaagggaggccgtgctgcgctgagtcgcgggaagctccttgagcttcaaggacttgagtcggggagggagtctctccgctcttgctactctacccgccacttggtttccgcactgaggactcggctgcgaaatgggaggaagcaggcctccttttcgtgggttcccagaagcccccattttgcagttcccccacctcgctttcacaggttgcagcccccttagaaaaacgccgctgcagaggcgggggctgcccatcagccccggccatggctagccagccctgtgcccgcc

SEQ ID NO: 30784 - DNA, 167 bp, Homo sapiens
  misc_feature 1..167: note = chr6:117591683-117591850
  misc_feature 1..167: note = hyper
  source 1..167: mol_type = genomic DNA
cgcctccccggccggcctacagactgctccttcccgatgagccagcgcagcttccccgcctccttctggaatagcgcgtaccaggcgccagtgcccccgccgctgggcagccctctggccaccgcgcactcggagctgcccttcgccgccgccgacccctactcgcc

SEQ ID NO: 30785 - DNA, 72 bp, Homo sapiens
  misc_feature 1..72: note = chr6:117592066-117592138
  misc_feature 1..72: note = hyper
  source 1..72: mol_type = genomic DNA
ggcccgcctcgcaaccgccccggcgcccgcgcccggcagtcctccctgcgagctctccggcaaaggcgagcc

SEQ ID NO: 30786 - DNA, 188 bp, Homo sapiens
  misc_feature 1..188: note = chr6:118228044-118228232
  misc_feature 1..188: note = hyper
  source 1..188: mol_type = genomic DNA
tttgggtttctaatccggggccggcacctgtctcggcgtcctgccgctgtcccaggccggtggtgctggattccgcggcgcttgggcagaaacgaggaatccccgccaactccacagggaggatctattcccagcccccttatccccctaaaaaacacccaaaccaaaacaatcaccacaacctagac

SEQ ID NO: 30787 - DNA, 546 bp, Homo sapiens
  misc_feature 1..546: note = chr6:118228323-118228869
  misc_feature 1..546: note = hyper
  source 1..546: mol_type = genomic DNA
cgcccgcgccccgctctgccgccgccgccgccgccgccgccgccgccgccggcgcccccgcccggctctccgggttcaccctcggtctctcactccgtgagacacagacggtagctttccgaccgagcggggcacaggctgaggcggcgccagcacaactgccgccgcgcgccccgaggagacccgggcacgaggaaacaaggagaaatcaggactccttccccggaaccgaccggcagctccgcgcccccgcgcgacacccttcgcagccacttcgcggggcgggccaggacttggggacgcggctcgggaagagccggggcgggcggcggcggcggcggcacgggcgcgagggtgcgcgcactgggactggagaggagtgagtggcgggctgggcggcggcggccgtagccgcgggtgcctccccgcctcaccgcttcgcaggcagcaccgcctcccgggccgcggccgcccggccgggtcctctgcgcgttcccgggcccggaaccggcacacgatgcacccggctgcgttctgatcgccgcc

SEQ ID NO: 30788 - DNA, 520 bp, Homo sapiens
  misc_feature 1..520: note = chr6:118228870-118229390
  misc_feature 1..520: note = hyper
  source 1..520: mol_type = genomic DNA
cgcctcagcctctgccgcgatgatcccccctgagcagccgcagcagcagctgcagccgccgtcgccagccccgccgaaccatgtggtgaccaccatcgagaacctgccggccgagggcagcggcggcggcgggagcctgtccgcctcctcccgggctggcgtgcgccagaggatccgcaaagtgctgaacaggtgagcggcggcgccgggcgagggcgcggggggcgggggctgcgggcgcccggctccgggtcccctccgtccctggggcggcccacgggtcctttgggacggggttgcggccggaggagactgaggagatcgggcgacgacgcgctccgcgggcgcagagaggccgcggcagctttgtcccggcgcagggagccctggagtggtggagctgcagctggtccgaggcgggagttcggggagaggcggggtttttcgtacctagccaccctgtatgtgtgtccgcactcacaccctccatacgcgtgccgcctcacttccctttccctct

SEQ ID NO: 30789 - DNA, 56 bp, Homo sapiens
  misc_feature 1..56: note = chr6:118229676-118229732
  misc_feature 1..56: note = hyper
  source 1..56: mol_type = genomic DNA
aagtgcaaaacattgcgggcagggtgtgagccggcggcgcccagttattccgaagc

SEQ ID NO: 30790 - DNA, 117 bp, Homo sapiens
  misc_feature 1..117: note = chr6:118229733-118229850
  misc_feature 1..117: note = hyper
  source 1..117: mol_type = genomic DNA
cccatgccggagggggcgggtgccgatcgccggcgcctccagtgctggaatctgcgtagtggattcaggacgttgacgttttaggatgaggacctgggttgacgtgaaaatgggggt

SEQ ID NO: 30791 - DNA, 304 bp, Homo sapiens
  misc_feature 1..304: note = chr6:118241005-118241309
  misc_feature 1..304: note = hyper
  source 1..304: mol_type = genomic DNA
tcagcccaggagctccgcggtacctgtggttcctgaaagagagtttgacaggcttcaggaaagggttagtgcctcttgaactggggagattacaaaacgagcgtgggcctaaaaggctccacagaggcaggcagcgggatggatagagcggctcagagggaagggacagagccgctttaatgtgctaatgaggggaagcccagatgccagcgggctcagtggagctctttgtgacgccgggttcccggggctggctggagtctctgtacctatctggatcctgctgcaggccggggaaacactg

SEQ ID NO: 30792 - DNA, 128 bp, Homo sapiens
  misc_feature 1..128: note = chr6:119399076-119399204
  misc_feature 1..128: note = hyper
  source 1..128: mol_type = genomic DNA
ggtgcaagtcccttacgcgcaccgtgccgctgtgctgtctagcttaaattcatgttgccagcgttccaccaaagtttgcagggttttggaggtgtctccggctgttgcttcggcggaggagtagagtt

SEQ ID NO: 30793 - DNA, 316 bp, Homo sapiens
  misc_feature 1..316: note = chr6:121758621-121758937
  misc_feature 1..316: note = hyper
  source 1..316: mol_type = genomic DNA
gttcctgaaacttcccgagaatgaggcggggcggctcaaggggaaagggcagggaggagagaccctcgggaagctgatgacgcgtccggggcaagtcagcctgtttccgagacgcgcgcctcacggtcgtagcagcgctgcgcccaccctgcccctttagtgacccagccagcctttgctgggggtttctgataacgctcatcgataagctctccttgctcccaaaaggcgtgcttctctttctctccaggtacaaagtaggggtgggaaggggagagctacacaatgttgtaaaaagaagcgtggctttatttgg

SEQ ID NO: 30794 - DNA, 250 bp, Homo sapiens
  misc_feature 1..250: note = chr6:122932220-122932470
  misc_feature 1..250: note = hyper
  source 1..250: mol_type = genomic DNA
agtaaactcaagggtcgcccgtagctattggattttccctgctcctaggaccccggcaggccgcagggagggacacgagtgccaggtggtcgcgggctgagggagcggagggcctgtgttccggttggtgctgatgctagccccttggggaaattcctgaaggtgcatttcggagccaaatgaccctgccttgcagcaggtcccttccaagggagctgagagggccaggtcagaccggtcttcgtagagc

SEQ ID NO: 30795 - DNA, 114 bp, Homo sapiens
  misc_feature 1..114: note = chr6:123316893-123317007
  misc_feature 1..114: note = hyper
  source 1..114: mol_type = genomic DNA
tcatataagttcctccggaggcttaatcatcagtacattgtcttggaaccactctggtgttttctaaattaaatatctctgtctacaacaaatgcgaaaagtacagaatgtttc

SEQ ID NO: 30796 - DNA, 642 bp, Homo sapiens; identical to SEQ ID NO: 2911
  misc_feature 1..642: note = chr6:123317072-123317714
  misc_feature 1..642: note = hyper
  source 1..642: mol_type = genomic DNA

SEQ ID NO: 30797 - DNA, 156 bp, Homo sapiens; identical to SEQ ID NO: 2912
  misc_feature 1..156: note = chr6:123317715-123317871
  misc_feature 1..156: note = hyper
  source 1..156: mol_type = genomic DNA

SEQ ID NO: 30798 - DNA, 673 bp, Homo sapiens
  misc_feature 1..673: note = chr6:124124293-124124966
  misc_feature 1..673: note = hyper
  source 1..673: mol_type = genomic DNA
gccactcgggctttccggccgctctggatgcctcggttgcacccctgttccatgaccccagcttccttccctaaccctcctcttggtcccttctcccccgagcgcgcgcgcacacacacactcggttcgctcccgcggagtggctctgggagcacgaccgacttcagctcagcaaaccgcggtcatgccgcccagactcctcgccccgaggccccggtccccgccgccgccgctttcgcgccgctcctttccgcctagacaccgccgcctgcggccgcctgggcggcagcccctgcggtcctcaaagttggccccctgggagggggcggcagggagcaggatgaaggatttgttgtaggaggaggattcacacatctgggcgaagggaggggcagcgccgctgctgggacgcggcgcggacccgcatcattgcgcgcagcagccgctgcagcagccgccggggaccgcggagccgggacgcccccgctcggcccgcgccccgctccccgccccacccccgcccgccgggcccagcaacgcagggtgcctaggagccgcgggctgcgcagggaggcgggcagcggccctcgcgcgcttctgccgcccccggagccggcgcgcggcgagcgcagggcgagcgcgcgtcgggcggcggccgcgctggggggcgtga

SEQ ID NO: 30799 - DNA, 61 bp, Homo sapiens
  misc_feature 1..61: note = chr6:125282732-125282793
  misc_feature 1..61: note = hyper
  source 1..61: mol_type = genomic DNA
gttggaggagtagatcgaaagtgctttttcgattatttatgggtttcgaagattcttccta

SEQ ID NO: 30800 - DNA, 269 bp, Homo sapiens; identical to SEQ ID NO: 8704
  misc_feature 1..269: note = chr6:125283133-125283402
  misc_feature 1..269: note = hyper
  source 1..269: mol_type = genomic DNA

SEQ ID NO: 30801 - DNA, 250 bp, Homo sapiens
  misc_feature 1..250: note = chr6:125283925-125284175
  misc_feature 1..250: note = hyper
  source 1..250: mol_type = genomic DNA
gtaagagccgagcaccggcgcagcctgcgggactggcactcaccgggcctctcaatccccagaccttgccactgcagttggagctggaggaggaagaggaggaagctggggatcgaaaagagggaggggatgaacagcaggaggcgccccccggcgaagagctggagcccaggacccgcgtgggggccgccgacggactggtcctggacgtgctgggtcagcggcgcccgtccctcgccaagagacaagt

SEQ ID NO: 30802 - DNA, 200 bp, Homo sapiens
  misc_feature 1..200: note = chr6:125420809-125421009
  misc_feature 1..200: note = hyper
  source 1..200: mol_type = genomic DNA
gcgaaaaccttccttcgggaacgcggagctagtgcacgggggcatgttcttcccccgcagccctggcaagcagaggccggcggcctgtggcgcggggcagttgtgctggctgccgggcggggctgctctgggtctgggtgcacggagaggagcgcggagtgaagcgcacggtgcacactgcggggcgctgcttgtcacct

SEQ ID NO: 30803 - DNA, 43 bp, Homo sapiens
  misc_feature 1..43: note = chr6:125475547-125475590
  misc_feature 1..43: note = hyper
  source 1..43: mol_type = genomic DNA
agggagtgagaggatcgcccgccgagggggtggctccgcagcc

SEQ ID NO: 30804 - DNA, 168 bp, Homo sapiens
  misc_feature 1..168: note = chr6:125684529-125684697
  misc_feature 1..168: note = hyper
  source 1..168: mol_type = genomic DNA
attcttgctgctttccggtcccacgggacggctcccaggctcccgcctcacggcaagaaaaataaaggcctccccgcacagccagccagcttcgttcattcacgtcaccgacaaacactcctagcaggcgttgttaaacgttcagggagcgcccgggacctagccgag

SEQ ID NO: 30805 - DNA, 15 bp, Homo sapiens
  misc_feature 1..15: note = chr6:126068007-126068022
  misc_feature 1..15: note = hyper
  source 1..15: mol_type = genomic DNA
ctaagccttcccttt

SEQ ID NO: 30806 - DNA, 110 bp, Homo sapiens; identical to SEQ ID NO: 2913
  misc_feature 1..110: note = chr6:126068068-126068178
  misc_feature 1..110: note = hyper
  source 1..110: mol_type = genomic DNA

SEQ ID NO: 30807 - DNA, 782 bp, Homo sapiens
  misc_feature 1..782: note = chr6:126068793-126069575
  misc_feature 1..782: note = hyper
  source 1..782: mol_type = genomic DNA
aacgtgcagccctcacggaaagttgtgacggtcgagcttgagcctggcgggccgcggagcgttcacctgcggccgggaggtactggcccagggcgctcggggcgggaggtggcaggcgaccggcgcgcgtcaggctcgtcacccgctggattgcggggccggagcggggacggggtctgggtcctggcccgccctcgtgcagccgatcggaggccccgaaccccgcgccgacccagccatccgccctgaggccgacaggggagctggggttcaccgacccccgcggccccgccgtcgggcgcggaccccatccagccccacctggccccgccgagtgtgtgctttgcctggggttaagtttcagaagccaagatggaacgattcgggtttctattcacaaggttattgaaggcatggcggtggggaccgcgcaaaagagatgagagtgtggggggaaaggggtttctgttctaataagggcttagcacgctggccgcaggtcctccgcgccgaccgggctccttcccgctctcccccgggccaaaccccgccagggtcccgtctttcccagtcgcgtcctttcctcttctccccgccccgcgccgggcttgtgtggacagagaacggagtgtcaaagggacgccctgggccgatccccaggaagctatgaatccctccgtgacggaggggtctggggatcgatagacggccctttctcagaggctctctccactactgaccaagcggccctgccaacgtgtggtttccggctggaccccaac

SEQ ID NO: 30808 - DNA, 137 bp, Homo sapiens
  misc_feature 1..137: note = chr6:126069805-126069942
  misc_feature 1..137: note = hyper
  source 1..137: mol_type = genomic DNA
ccaatcttcacctcccggactctaactctgcggctgcgagtgcatacaccagggggactggaggagactggaggcaattatctggataatccaagcccgaaaaactcgaacttgaaaatatacgattatgtcctgaa

SEQ ID NO: 30809 - DNA, 86 bp, Homo sapiens
  misc_feature 1..86: note = chr6:126071232-126071318
  misc_feature 1..86: note = hyper
  source 1..86: mol_type = genomic DNA
cactgaaaggcagagcgcaggagttggcgagggagggtcctggctgtcacagttggacgcgcgaacggcagcgtctgggcgacagg

SEQ ID NO: 30810 - DNA, 83 bp, Homo sapiens
  misc_feature 1..83: note = chr6:127439190-127439273
  misc_feature 1..83: note = hyper
  source 1..83: mol_type = genomic DNA
gaaggtcaggaaagccgggaacaagtcagcagccagaaactctccagcgatctgccaagggggagagggtagttgcgcgccgg

SEQ ID NO: 30811 - DNA, 166 bp, Homo sapiens; identical to SEQ ID NO: 8714
  misc_feature 1..166: note = chr6:127439321-127439487
  misc_feature 1..166: note = hyper
  source 1..166: mol_type = genomic DNA

SEQ ID NO: 30812 - DNA, 727 bp, Homo sapiens
  misc_feature 1..727: note = chr6:127439783-127440510
  misc_feature 1..727: note = hyper
  source 1..727: mol_type = genomic DNA
cctatgtggtgctcccgggagcccagcccaacactggagcgtctcctgctcgcgcacgccagaagcagctcggggtctctccgccgccccttggccatggccgctgtgccgacggcgcccgctcccctgcgctccaggggcccccgccgctgcagccgcagccgccgcagcttctgagcccaaggggccgccgctgcagccgccgccgccgccgctcgcccgcccggatcccgcctgcggcagttgccgcacaacatgctacctgcggccgccccggcggctcctggaaccccggttcgcggcgatgccagccaccccagcgaagccgccgcagttcagtgcttggataatttgaaagtacaatagttggtttccctgtccacccgccccacttcgcttgccatcacagcacgcctatcggatgtgagaggagaagtcccgctgctcgggcactgtctatatacgcctaacacctacatatattttaaaaacattaaatataattaacaatcaaaagaaagaggagaaaggaagggaagcattactgggttactatgcacttgcgactgatttcttggctttttatcattttgaactttatggaatacatcggcagccaaaacgcctcccggggaaggcgccagcgaagaagtaagtgcagggttttttacgcgtttgctccctcccgccgcgttcacctgtcgggtcgctttgcctgtccggagcc

SEQ ID NO: 30813 - DNA, 452 bp, Homo sapiens; identical to SEQ ID NO: 2915
  misc_feature 1..452: note = chr6:127440511-127440963
  misc_feature 1..452: note = hyper
  source 1..452: mol_type = genomic DNA

SEQ ID NO: 30814 - DNA, 1041 bp, Homo sapiens
  misc_feature 1..1041: note = chr6:127441030-127442071
  misc_feature 1..1041: note = hyper
  source 1..1041: mol_type = genomic DNA
cgtgtctgcgcgtttgcagagctgccggacgtcccccgcccgagggttgaagacagcaaaaccccagctgtggggagccggaggtgcggagtttccaggttctctcttgtcacatgtgagcgtctgtaccatctctggccctttcaagtgtgtcccctgggacacacacgtacagagagtggggtctccctaaagattcgcctcctcgctgcccttaatgctgttatttggagggttggattgtgatggcttcttaagacggtgtcctagctggaattaagcggacaccaccacggcagcctcaacctgggttggtctgtctgaaaggtagaatcttcccaagatgaagggacagatgcgaaggtgtcacctctcctcgctccagggtagcctggcgccctcgctgctctagtgtctgtgttcccatggggagtcctttcgcagatctcagagcaggggcgaccctggctctatggttgggggcgctggtggagagagggaggaggaaacttctcctggagctcgcgaggggcaggaagcgatgctgctgctctgggctctcgcacctccgcggcgtgcagcccaggcccagcggccccacctggtttcccaaggggatccctctcccagcgtcccgcccgggaagcctttcggggcagacgtcggggcagcgcggaggacacaacaccggcttgtgtgagatggaaatttagtaatcgcttctcggccgctgtttgtccctgccctgcccctgggcatgagggtcccctgaaagctccctttgtattgctggcctcggccagacaaggtttgattcacctgaaaattgccttttaaaaaggtggcagtgccagagcgacaggggccctggccgggcctcaccgcctttaggatcacctagcagggggcaggagagcccaaactaaatatgtcagggcatccgatttattattcttggcctccgaatggtgtgtactctggtaactccccacccactctttcattccggcccggacgcggaaggggaggcctggggttcag

SEQ ID NO: 30815 - DNA, 190 bp, Homo sapiens; identical to SEQ ID NO: 8720
  misc_feature 1..190: note = chr6:127442089-127442279
  misc_feature 1..190: note = hyper
  source 1..190: mol_type = genomic DNA

SEQ ID NO: 30816 - DNA, 50 bp, Homo sapiens
  misc_feature 1..50: note = chr6:127442649-127442699
  misc_feature 1..50: note = hyper
  source 1..50: mol_type = genomic DNA
atgctcttgctccttcgcacttgagtctgcgtttgcggcttggtttgctg

SEQ ID NO: 30817 - DNA, 30 bp, Homo sapiens
  misc_feature 1..30: note = chr6:127836173-127836203
  misc_feature 1..30: note = hyper
  source 1..30: mol_type = genomic DNA
tcagctcatcgatctcgttctgaggcggtg

SEQ ID NO: 30818 - DNA, 907 bp, Homo sapiens
  misc_feature 1..907: note = chr6:127836715-127837622
  misc_feature 1..907: note = hyper
  source 1..907: mol_type = genomic DNA
ctcttggagctgctgcgggtgcggctgcgacgaagggggcgctgccgcctgcatgcccccgccgctcgcgctgccctctgcgctctgctgggggccctccgccgccgccgccattggggaggcggaggcgacggccagggtctcgcaaacggcaggggggccagacaccggggagctgcggctactgctgccgccgccgttcttagcgtgcatctgagccgcggccgccgccgctgccgcccgctccttcttgagatggaactggatgagctcagactgcagacatccttctttccagtagctccctccaccaccgctgccgccccccgcaacgccgcttccggagtttctgctgccggttcctggggttttgcccgcagaagaggaggatggagaaggggaggccccctccccgccgctgccgcccctctgctgagcgcgtacgcctttccctcgccagcccctgggcggcggcggctgcggagcgcccccctccctttccccggagccgccgccggctcctcctccttccccgccccctcctcccccttctccgagcggagggggttccccgagtttcgagggcacggactctagctcccgaggcggctcctcgggcggtccgggcctcctgccgcccaaagcggccagggtcgcggcgggggccgcttcagcaccagccacaggctggacagctcccggagcggcccctttgggcgccaggggcgtcgccttctcggccccacctccgcctcctcggatgctggcgggcggccccgtgcggctcccggtcttgttaccctgctgttgctgctgctgcagctgctgctgccgaacagaattgagtttagtgccggcccccactggggaccgggtggccgcgattgtctgtcgcagcgaactgtcc

SEQ ID NO: 30819 - DNA, 15 bp, Homo sapiens
  misc_feature 1..15: note = chr6:127839806-127839821
  misc_feature 1..15: note = hyper
  source 1..15: mol_type = genomic DNA
tattgtgcctttctg

SEQ ID NO: 30820 - DNA, 68 bp, Homo sapiens
  misc_feature 1..68: note = chr6:127839929-127839997
  misc_feature 1..68: note = hyper
  source 1..68: mol_type = genomic DNA
cggtaacgtcaagattcagctgcccccagagcgggtgacttcccggcggtccgcggctgggctggagc

SEQ ID NO: 30821 - DNA, 337 bp, Homo sapiens
  misc_feature 1..337: note = chr6:127840356-127840693
  misc_feature 1..337: note = hyper
  source 1..337: mol_type = genomic DNA
gctttgtcctgggttcggtcattctccatcaattatttacttgagcttcttttccaaggaggcggactagaacagccttccgggcgtgactaacatctcctgatgcagctggctggcggctgctgggagttctctttgttcactcactttaattctcagtcgagctctacacgcggtgctccctccccacccccagcccgggcggagtcatcagatgtcgtttccacgaatagataatggttgccatgatgggacccaccgtcccacagacaaagggttcttgcgaagccacgactaatttagtgcaaaccgaaataaatatcggcccacagagatc

SEQ ID NO: 30822 - DNA, 276 bp, Homo sapiens
  misc_feature 1..276: note = chr6:129204360-129204636
  misc_feature 1..276: note = hyper
  source 1..276: mol_type = genomic DNA
cgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtacagtcgaggcatgggcttgggttgcatcctttgccgggaccgagattcctcacttcttccactcttccgagagttgctgtctgtggactgccgtcttgcttcgccttcagagagtgcgctctggggcaaga

SEQ ID NO: 30823 - DNA, 30 bp, Homo sapiens
  misc_feature 1..30: note = chr6:130088257-130088287
  misc_feature 1..30: note = hyper
  source 1..30: mol_type = genomic DNA
agatgctctccttaccggaggtgaaagcat

SEQ ID NO: 30824 - DNA, 55 bp, Homo sapiens
  misc_feature 1..55: note = chr6:130339629-130339684
  misc_feature 1..55: note = hyper
  source 1..55: mol_type = genomic DNA
acagggaagccagagcgagcctccccggcagcggcggcggcggcggcggcaccgg

SEQ ID NO: 30825 - DNA, 786 bp, Homo sapiens
  misc_feature 1..786: note = chr6:130686407-130687193
  misc_feature 1..786: note = hyper
  source 1..786: mol_type = genomic DNA
ttggagtcgaacatccgcactgctcatcgaagacccccgtgcttcagttccctctgtcttccatttcccccgcccatggttctcgcccccccaagccgttctccggaaccccttgccgggccggcgggaagcgtggaccgagcgggccttggccgcgtcttttccggccaggtttggtttagctcgcgcagcgcccgcgcagcccgccagggggaccccggcccgccgggcggcatctgaggagaaagcgtccgaggggcgtggagccagggtcctgcggtgcctgctccgggaatactgcgagtcggctggagctccccagccgctccggagaactgggggagccgggtccctggctcggtaaccggtggtcccgcggtagctagaggcgggccccacgggtgggtgtgtccgtttccgcacgccagccttccagcccgggaagagcgcctgcaagcgggtactttgttcccaaagatgggttttgtctgcgggtgatttgggctctcgaagtgcaactttgtggccgggacgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggctgggatccatctggagccgagcagaaaacttttcccctcc

SEQ ID NO: 30826 - DNA, 625 bp, Homo sapiens
  misc_feature 1..625: note = chr6:130687224-130687849
  misc_feature 1..625: note = hyper
  source 1..625: mol_type = genomic DNA
cggtggcggcgccgcctgagcggcgactccctctcccctgcccggcttgctgcgcccggtgccctccgagggcaggcgcgcctggactctgcgcccggatggcggcggccctctgtgagcaccggcagcggcgcatcccctgccccgaggcctccggtgcccccccggcgcgggcataggggcgcccccaccctccgtccgcttgcaccccttgccacccgccccctcgcctgactcatccgcccgcggtggccgcccgagccctgggatggggagggagaccgcggctgcccgcggcggccgagattcccgctgacgcccccgaccctgccgccttcttcgtccgcctccagaggcgcccgacgtcccgacagctcctggagtgagaccaggactgagaacagggagaggcgacccgacccccagggcccggtgctcaggacaggtgaggggaaggaaagggtgctgacgggagtggggaggtgggtgggcggccaccgcagccgaaaccgggcacttcttcagccctctgccctcccctcccctccgctacagcctccagagttaggtaaacgctgtctctcctaaagtttgggaaataaaccaagtccgccatcaggtccag

SEQ ID NO: 30827 - DNA, 30 bp, Homo sapiens
  misc_feature 1..30: note = chr6:131602928-131602958
  misc_feature 1..30: note = hyper
  source 1..30: mol_type = genomic DNA
gggactgacttgcagcgtgctgtttaagtt

SEQ ID NO: 30828 - DNA, 30 bp, Homo sapiens
  misc_feature 1..30: note = chr6:132271740-132271770
  misc_feature 1..30: note = hyper
  source 1..30: mol_type = genomic DNA
ctctcacatccagagcgtcagggatgcgag

SEQ ID NO: 30829 - DNA, 64 bp, Homo sapiens
  misc_feature 1..64: note = chr6:132722078-132722142
  misc_feature 1..64: note = hyper
  source 1..64: mol_type = genomic DNA
ctgcctggggtcatccgtgctcggcttccctaccgcgcgccttctggggctccgggagagcagg

SEQ ID NO: 30830 - DNA, 859 bp, Homo sapiens
  misc_feature 1..859: note = chr6:132722157-132723016
  misc_feature 1..859: note = hyper
  source 1..859: mol_type = genomic DNA
cgagagtgagcgtggccgggggcgcggggctgcgccaggtgagagagagctgcgggccccggggacgacccgcacctgcgccctctctggggtccggacgggaccgggctcggccgggcgggctccgggaggagacgcgcttacctggaggtagggccgcccgtgggccaccccgcccacgacgatgtcggcggacgccatggccccggtgggcgagaagccgaagcccacgtagcctgcagtgcgcacctggaggcggaaggcgatctggctgccccgctggctccagcccagccagtacttgccctccgagtccaggagggtccggtgcggataggttcggcccgagccccccgccgccgtcccggggagcagcccccacagcaggagcagcggccagcagcacatcctcgggcgcctcctgcccgccggtaccggcctccagccgctggggagtgaggagcagaacgaggagcggcagcggcggcgagcgggagcccagggaccgcccctcgggccggccgcgcgcccgcccgggaggggcaggacccgctctccccgccccgggccgcctgcagggcgcgccgcgtcccgtccggtcccgtcccgttccgtcccgtcgggtcccagccccgccaactctcaccctgcccggcccttccagcggatccacttgcagcccccgacccctgacttggtccccgaggtcggggctcggtgggaaggaaagcgaggggcttcccggaaagaaagggaggaggaggcaggaggaggcagacgccgagagaggagaaaaggaggccagaggcagagggaaaaggaggagggcaagagaatcctagagcgggaagagcgtggg

SEQ ID NO: 30831 - DNA, 302 bp, Homo sapiens
  misc_feature 1..302: note = chr6:133561966-133562268
  misc_feature 1..302: note = hyper
  source 1..302: mol_type = genomic DNA
tcccttggggtaagtggaaaggagtccggcagggggcccgcagtggcctgcacaggggaactgggtagcgagagagttccaggcaattccgggggctgccccacagaagcaggtggggatcgacagtggctctccggcccagggaggagagcgcggtcgcgggtccctcccctcagcctggaggctgcagccgctcgagtcggcccgggtgggggcggggtgggggcggcgcggagggcacggagattacggcggcgccacccgggacatccagggccccgaggccctgggcggtccccacg

SEQ ID NO: 30832 - DNA, 89 bp, Homo sapiens
  misc_feature 1..89: note = chr6:133562348-133562437
  misc_feature 1..89: note = hyper
  source 1..89: mol_type = genomic DNA
cgcgtccctggcggcctcccccgaggcccccggcggcctcacgagcccgcagtagccggtggcgacgtcgcccccgccccacctccctg

SEQ ID NO: 30833 - DNA, 421 bp, Homo sapiens
  misc_feature 1..421: note = chr6:133562674-133563095
  misc_feature 1..421: note = hyper
  source 1..421: mol_type = genomic DNA
ggagccggcttctccctccgccccgcttctcccccgcttgtgtacgctatttgttgtggggtggccgaaggggatgtcctgttttcaccagaggcacagcgcgaaggggaaacttcgacactggaaggaacgagaataaatacttaattacggacgcactgaaccgcggctgggacagacacttcgggaacccgaggcggaccgggcgacgaggtgagtgaccccttcttccaacccccgccccagggctcccgggggagcctgagttgagagaacccccaaactttccgggaaagtgcgcgaggctccgccggggacgccgagcgctgggtactgaggacgcgcagctggacggtgcgtgggcgcctgcgtccccggggggcgcttggaggccgggtgccccacgcctgagggcccgggc

SEQ ID NO: 30834 - DNA, 945 bp, Homo sapiens
  misc_feature 1..945: note = chr6:133563157-133564102
  misc_feature 1..945: note = hyper
  source 1..945: mol_type = genomic DNA
cgagcctgcctgtcccttccggggtcggcgcggagcctgcgcgtaacggagttcatccagcagtccagcgcgcggcttctacctgcaccccgcctccacctggcagaggcgcgagcatcggggtctcccccacatctttcttatgacgtgtattactttctgatgaccccctagatggtccaggcgcgaggatgctgacccagagtccttcggagggtcacaggcgcctgggctttcccggtgccgggtgcgtgtgtactttaaaggctcgcgttctaatctccaggcactgatcgggcttttcaactgcggcgatcccactttaatagtttttatgtggcgtggactgaatgtctcctgcagtttgccagggtcggtgaaattagaggcgccttgtcagagcagtcgcgttcattggctcgagtagcgggtgccatggaaggcttataacttctccaaaggaagggacctggctgggtagagcaggtttttctctccttccaagcctgctgggtctggggaggcagtggaacttgaaatggctcggatttttagcgtggtgaagcgaggtttggaagtagacgtgtgtgtgcttgttttattctgcgccgcacagcaacccgaactttcgtttggtagcacttgaaagagttttctccctttgtttgcgagattctgaacagctcggagcgattagggaatttgcggaccgagtccggtggcagagctggggcgaaagcagagagcgcaatttaatttttgtcatctcttccctgcttgggaggatagtgtttcccttcaccaccacccctctttctccttcctatgaagacaacggatttgcgcctggggtgagagtgtgtgcgggagagtggtgtggagactgtcctctctcaccgcgtctcctgcgcctctccccgccatcccgagcgggcctagagagtc

SEQ ID NO: 30835 - DNA, 46 bp, Homo sapiens
  misc_feature 1..46: note = chr6:134175969-134176015
  misc_feature 1..46: note = hyper
  source 1..46: mol_type = genomic DNA
cgatctcgcagaagccgcggcgagtctcccccggaggtctaggagg

SEQ ID NO: 30836 - DNA, 462 bp, Homo sapiens
  misc_feature 1..462: note = chr6:134210557-134211019
  misc_feature 1..462: note = hyper
  source 1..462: mol_type = genomic DNA
atgtggaggaccttcaagaggtggagatgttggaatgtgacgggttgaaaatggattcgaacaaggaatttgtgacttccaacgagagcaccgaggagagctccaactgcgagaatgggtctccccagaagggccgcggcggcctgggcaagaggaggaaggcgcccaccaagaagagccccctgagcggggtcagccaggaggggaagcaggtccagcgcaacgccgccaacgcgcgagagcgggcccgcatgcgagtgctgagcaaggccttctccagactcaagaccaccctgccctgggtgccccccgacaccaagctctccaagctggacacgctcaggctggcgtccagctacatcgcccacttgaggcagatcctggctaacgacaaatacgagaacgggtacattcacccggtcaacctggtgagtgctcccggggctgcagctgcagtccagg

SEQ ID NO: 30837 - DNA, 224 bp, Homo sapiens; identical to SEQ ID NO: 611
  misc_feature 1..224: note = chr6:134211111-134211335
  misc_feature 1..224: note = hyper
  source 1..224: mol_type = genomic DNA

SEQ ID NO: 30838 - DNA, 76 bp, Homo sapiens
  misc_feature 1..76: note = chr6:134212320-134212396
  misc_feature 1..76: note = hyper
  source 1..76: mol_type = genomic DNA
ttgcgatggaagaaacgaaagtcggactagggaaatagatggtgatgaaaggcgatgaaagcgacagggccctgaa

SEQ ID NO: 30839 - DNA, 288 bp, Homo sapiens
  misc_feature 1..288: note = chr6:134214076-134214364
  misc_feature 1..288: note = hyper
  source 1..288: mol_type = genomic DNA
cgaggagcctgcgacccgggtccctcactgccccagcgcagcccgcggcggccgatgcgccagatgccaccggggctgtttaatgttcggggttatgaccgcagtgtttacaagacgtcttcggttatttatactgttattcctcgcagagagccttgaaacttccgcttcatttgctctttcttttcgattttttacccttttttctcggcttagtttggtacctggagcgagagcttctccgcccttccaccaaccccacaggccgcttcgcgggtggagccctct

SEQ ID NO: 30840 - DNA, 97 bp, Homo sapiens; identical to SEQ ID NO: 8736
  misc_feature 1..97: note = chr6:134216904-134217001
  misc_feature 1..97: note = hyper
  source 1..97: mol_type = genomic DNA

SEQ ID NO: 30841 - DNA, 91 bp, Homo sapiens
  misc_feature 1..91: note = chr6:134217370-134217461
  misc_feature 1..91: note = hyper
  source 1..91: mol_type = genomic DNA
ttcttcagagtccgccgggcttccttcaggcgtttggaggaacacgcctttgatctttgggtctgggcaggctgcgcgggcccaccctcct

SEQ ID NO: 30842 - DNA, 299 bp, Homo sapiens
  misc_feature 1..299: note = chr6:134499553-134499852
  misc_feature 1..299: note = hyper
  source 1..299: mol_type = genomic DNA
gaggggagggggagacgggggagctgtgtgtgacgcgcgcctgttaacactgcacaggcattaggttgccctgtagctgctattcaaactcttgatctgttcttccttcctgtcgccagcctctttctttggtccagatagtcctcctactgggaggaatccggcccctttcctcatactccctggtggcgaagtggtccgagtagcctcccgaactgtttgtaaatgcaacctagagggcgatcgagttctctgggagaacttgctccatatacgcgtatacgcggcttcccccactt

SEQ ID NO: 30843 - DNA, 228 bp, Homo sapiens
  misc_feature 1..228: note = chr6:134638726-134638954
  misc_feature 1..228: note = hyper
  source 1..228: mol_type = genomic DNA
gctcagttcttcactcgcgcattctgcagcaccagctactgcagcaacctctccccactttcagttgccaccgacagcggcttttctccttccatcattgctccgaaacatatgcatcaccgctgcaggaccctgggggccggacggtgggatacggccaatctccggggagatgctgtggctcttaccgagcgggagaagggtacgcctccccgcccccagctacct

SEQ ID NO: 30844 - DNA, 244 bp, Homo sapiens
  misc_feature 1..244: note = chr6:137241818-137242062
  misc_feature 1..244: note = hyper
  source 1..244: mol_type = genomic DNA
ctttggctgaagtgtcgcgttcagcacagaggtggaagtaagaggcagaaaacagaagaaccacgagagaaatggatcctgtctattaaggcaacgtgatgcagcgctaaaaggttaggaggttacgattcccggggctaagagaaataaactgctggtggtgaacgaaaggggtgctggagcgcagcgatctcgaacctttcccttatagccaaaccctggccaaggccacaaatttcaaatc

SEQ ID NO: 30845 - DNA, 537 bp, Homo sapiens
  misc_feature 1..537: note = chr6:137242063-137242600
  misc_feature 1..537: note = hyper
  source 1..537: mol_type = genomic DNA
cctgaaaaccaaactgtctggcgcttaacggttacctcggctgagcgaaacccttggctgctgctgatttaactacaggtccgcgcgagttactttccagggaactgaattcagaacaaagagttaccgaagccttactccctctccaaaattagaattccctttttctcttagtcatataggaaacacacagttcacaagtcctgtggtgcaaaggtgtgaaccctggcccagggaggtggtgactctccccgccctccgcctgccggttgtcctgcttccgaaagcaacccacgacggtcccgcagggtgagggttccctgggatcagttccctgggatccggagaacgccacgcggagtctccctgcagggtgaggggccccgggttcccgccccctccccctctactctcccattctgcgagcgcagccagcctcccctcccacgcttcgggaagcgtcgcccccgagctcctcggttcctggtggtggctactcgtgttagtgacttcgtttctgcgcgtttgcttattttc

SEQ ID NO: 30846 - DNA, 297 bp, Homo sapiens
  misc_feature 1..297: note = chr6:137242949-137243246
  misc_feature 1..297: note = hyper
  source 1..297: mol_type = genomic DNA
gctgcagcgccggggcgagggggctgggggcgccgtcacttgttgcgaccaataaacggcgctcgatcctgatgcgctgtttctaaaatctttagctgtgtcccgatccctccaacccaagcccctcggccaggaggaaggggcaagcgagagccgctggctctgtggggggagaggggcgccgcgccccaagagcccccgtcccgccctgcggcagccgccccggggcgcccagccgcccgcttccctccgcagagcgtcttccctgacggtgaaaccgcgcgggacacaacccac

SEQ ID NO: 30847 - DNA, 68 bp, Homo sapiens
  misc_feature 1..68: note = chr6:137243566-137243634
  misc_feature 1..68: note = hyper
  source 1..68: mol_type = genomic DNA
atgcggcagctgtgccggggccgcgtgctgggcatctcggtggccatcgcgcacggggtcttctcggg

SEQ ID NO: 30848 - DNA, 310 bp, Homo sapiens
  misc_feature 1..310: note = chr6:137243839-137244149
  misc_feature 1..310: note = hyper
  source 1..310: mol_type = genomic DNA
acgctctggtccctgcgcggcctcagcctgcccatgtacgtggtcttcaagcgctgcctgcccctggtcaccatgctcatcggcgtcctggtgctcaagaacggcgcgccctcgccaggggtgctggcggcggtgctcatcaccacctgcggcgccgccctggcaggtgagcgggcccccgcgccgacccccagccgaccccacccaccccgctccgtcgggcagagaccgcggggatcactgagttcaacgacctcacttccagatggggagactgaggcagagagagccggagagctttgagagtggt

SEQ ID NO: 30849 - DNA, 231 bp, Homo sapiens; identical to SEQ ID NO: 613
  misc_feature 1..231: note = chr6:137244235-137244466
  misc_feature 1..231: note = hyper
  source 1..231: mol_type = genomic DNA

SEQ ID NO: 30850 - DNA, 67 bp, Homo sapiens
  misc_feature 1..67: note = chr6:137310875-137310942
  misc_feature 1..67: note = hyper
  source 1..67: mol_type = genomic DNA
agtccaaagccaccccgggaaagatgtggcccgcagcctggcaggctgaggacgtgtagggggctgc

SEQ ID NO: 30851 - DNA, 222 bp, Homo sapiens
  misc_feature 1..222: note = chr6:137311158-137311380
  misc_feature 1..222: note = hyper
  source 1..222: mol_type = genomic DNA
tgccgccctccgccccgctcccctgcacttacccacccacctcgcctgcgctgatccgcagacgcgcgcggggaaaggcacgcgcgatgctttcccactcgctcagcgggcgccgctcactggaaactcgctccggattccgaacccgagagcagagcagagggaagcccctttgctgagcagctccttagtggagggcaatgaacgcgctgaaatcccaga

SEQ ID NO: 30852 - DNA, 126 bp, Homo sapiens
  misc_feature 1..126: note = chr6:137808768-137808894
  misc_feature 1..126: note = hyper
  source 1..126: mol_type = genomic DNA
gccataaaatgcacccgcgccaccctccatgtcccccagtggaattgaggatcttgcttgtggcaaaagtgcgttcttggcaccacagccccgcagctggggaggggggcctcagtacccggcttc

SEQ ID NO: 30853 - DNA, 366 bp, Homo sapiens
  misc_feature 1..366: note = chr6:137809000-137809366
  misc_feature 1..366: note = hyper
  source 1..366: mol_type = genomic DNA
cgaggaaaagaggggtcttactcaagtcagggccggacagaactccaaaacttacgaggacagctatccaacactgcctcacagacccttaggcgctgccccctctttgcccctgtcctcctgcggtgcgagaaacccgaccactctgcttctacccgaaccccaggacgcaacagtaaaatcaaggcccgtcgttgaactcccaggtctgcgcatccctccctcctggctccctggggtcttggccccagcaggtccagtacccatccccagagggacccactaccctgggcgtcccagggtgccaggcacgatggcctgcaatgggggctgcaatttaaccgaggcgagttaaattccttttgc

SEQ ID NO: 30854 - DNA, 472 bp, Homo sapiens; identical to SEQ ID NO: 615
  misc_feature 1..472: note = chr6:137809445-137809917
  misc_feature 1..472: note = hyper
  source 1..472: mol_type = genomic DNA

SEQ ID NO: 30855 - DNA, 1092 bp, Homo sapiens
  misc_feature 1..1092: note = chr6:137810032-137811124
  misc_feature 1..1092: note = hyper
  source 1..1092: mol_type = genomic DNA
cggggatcgctcacaggggctccggggccaccgcgagcgcggactgcggctgctggcgggctccttcgtcgtccaacgcaccccatcctctcccgccccgcagtgtcccagggaaggcttcactgaaaacagacgctcgacggaaaactgactctgcaggcccgagctttcggagtttgatttctgtgggccccttaaacgggcactgggtacaggagaggccccaactctctgcagggacggggagggaagggcactcactctcccgcaagttttcctagaggcgagctgaagatgcaggccacctccctcccgcacggcccctcccttggcctagttctgtccaaagacacttcccagccctcgagcggcggctcctccactcgattcctgcctacacgtgaagagcttggacccagcggggctgcactcgggaggacaggcccagatcctgcacggccgggaggacacctggccccgctgtcttctcttcacagctcccctttctcggcttcggcctggagcggtgcagggaggggtggacctggggtggccttaagatatctagcctgggtgcggagacttgggagcccacccttagcagtcactcctcctccccagtggagggtgagaaaaggggaacagagggccccggagtctctggaagggacgtggaacgcgaagttaaatgttggtgtctgagcgatgtgctggtggggcagagggggttccagcgtcctcccagagtgaggaggcttttgcaatttctgctgaatgcgtcagtggaggcacaaaaccttgcttgacctagcagctgggaaaaaaagaagttcgaggggacacaaggccccctgctgctggagcgaggaaaccctgggcttggccagctcgggccgcttctccctgcccgtttgcgggctgtcggcctcagcggtcccagaaacaaagatctagtgagcccagccgacgccggcctcattttccctttctaagggtcactttcttccgccctctaaattaggtcatcgcctgggaaagcgccgagaggtttctagtgtgggcttctcaaggtgtctccgcccaggaggattt

SEQ ID NO: 30856 - DNA, 100 bp, Homo sapiens
  misc_feature 1..100: note = chr6:137813941-137814041
  misc_feature 1..100: note = hyper
  source 1..100: mol_type = genomic DNA
ggtcttgatctctctcgcgctctctctctctttctctctccattgtctctagaaaaactgtggcaaggacagagacaatcataatcgcatccatctcaag

SEQ ID NO: 30857 - DNA, 279 bp, Homo sapiens
  misc_feature 1..279: note = chr6:137814340-137814619
  misc_feature 1..279: note = hyper
  source 1..279: mol_type = genomic DNA
agatctctcagacagcgtgggaggctgcgggccccggagcctgccctcccgtgggccgagcgtgcagcctccctcttccctcccggcccggcaccgcggcccctcccgccgctctccctcctccttggcagccgggcccgcccgctgctcacttgagcaagtccttggactcggccgacagccgggccatgttggctgtggagagagcggacaggtgcggcggcggcggcatctggcagatggtgcaggggcagggcagaccagcccagtgctggaagc

SEQ ID NO: 30858 - DNA, 518 bp, Homo sapiens
  misc_feature 1..518: note = chr6:137814653-137815171
  misc_feature 1..518: note = hyper
  source 1..518: mol_type = genomic DNA
cgccttgagtagcgagtggggaggccggatggtgccgatggcgggaagtgaggcggcggacagcggtgacgaggcgttgccagatgagagcgcgccgcccaagatggggtgcaccgggtgcacggagttggccgcgtgcgcggggtggccggccgagtggcccacggtcccgcagtgaaaggccgagtggtggcccccatagatctcgccaaccagcctcttcatctcctccagggagctggtgagcatgaggatgtagtttctggcgagcaggagtgtggcgatcttggagagcttgcgcaccgacggcccatgcgcgtagggcatgacttcgcgcagcccgtccatggctaggttcaggtcgtgcatccgcttgcgttcgcgtccgttgatcttcagcctcaactgctgtaggtcctgctccgacagctgcttcttgattttgtacttgctgctctctcccgcggccttggcgccagcccgcgagaggctttccccgggcatcttctgcatcatat

SEQ ID NO: 30859 - DNA, 727 bp, Homo sapiens
  misc_feature 1..727: note = chr6:137815224-137815951
  misc_feature 1..727: note = hyper
  source 1..727: mol_type = genomic DNA
cggtggtggtggtccctcaggtacatctcatccatgtccggagatgaagctctgctggagacagagctcgaatcagaattcattttattacaggggatgcggccctaccgtggggaggctttaggcgggaaattaaagaaaatcttgaattaaaaaaaaaaaatctgcactgcccaggaacccacttctccgcggcaagacgtgagaagaaaagcggagacgctgcttttccccgcctctctccctcccacgcccctctctctggttaggctgcttcctggacagctagttggtgtgtgcttgaactaacctcacgctgaaaaagaggggcttttatagagctgcggcggagaaaagagacaaaaggagccctcctatctatcctgggctggttaggatgacgtgccatcattcagggcggtgcgctttgctgtcccatttagcaaggattcctattcatattcattgtggggccgccctgggacacctctgctccgaaccgctaggagcccccaggcacaaaaccctctgattgacacactcaccgctccagcttacgccttcctgattttttttttaactttcttccaccccaccccccttcccaatttctctaaccaaatcacacatcaggaacggaaggaaggcaagagaaggtggccaggcggttggtggaggttcctctgagtttggagagaggaattgaaacattcgctctcctttcttt

SEQ ID NO: 30860 - DNA, 777 bp, Homo sapiens; identical to SEQ ID NO: 619
  misc_feature 1..777: note = chr6:137816459-137817236
  misc_feature 1..777: note = hyper
  source 1..777: mol_type = genomic DNA

SEQ ID NO: 30861 - DNA, 148 bp, Homo sapiens
  misc_feature 1..148: note = chr6:137817618-137817766
  misc_feature 1..148: note = hyper
  source 1..148: mol_type = genomic DNA
agtggctagtcctaacgacaaccctctgcgactcccctgctgatcaaatggggtgaggagagagaggcggacgggggagggcattgggagcgagcactggactggacgaagagcagcttccccgccctgcggacggtgcacaggtctg

SEQ ID NO: 30862 - DNA, 537 bp, Homo sapiens
  misc_feature 1..537: note = chr6:137818062-137818599
  misc_feature 1..537: note = hyper
  source 1..537: mol_type = genomic DNA
gggtagagcagccctcgaaatacaagcttgcggggctggaagtccggggccagggttctgggagtccaaaccagaagccactctccttcagcacagcctttcagccgagagggggctgacgcctgccgcagccggttccgagggggctgcgatgggccgggaaggggcgactgggcctttgcccgaacagaccaggacattcccttccttcttccctaagggttttcagctccagtaacagaggtgcctgaaatgggagatctgcggggaccaggccgggactccctggctccgaggccgggacgtggcgcgccctccgctcctcggtcaccctctgctttttcgaaggtccgtaatgcgtgagtgtgggtggtccaaggttcagggcctccttccagtaagtacttttagaagctagttcccccacttcccatccgttgcggggcttgacaactagacgaggggagtgagtaaaggtgccacaactttgcttaccgtaaaatgggttaatactcgccggggcccaaaaggctgagt

SEQ ID NO: 30863 - DNA, 649 bp, Homo sapiens; identical to SEQ ID NO: 621
  misc_feature 1..649: note = chr6:137818618-137819267
  misc_feature 1..649: note = hyper
  source 1..649: mol_type = genomic DNA

SEQ ID NO: 30864 - DNA, 280 bp, Homo sapiens; identical to SEQ ID NO: 622
  misc_feature 1..280: note = chr6:137819268-137819548
  misc_feature 1..280: note = hyper
  source 1..280: mol_type = genomic DNA

SEQ ID NO: 30865 - DNA, 45 bp, Homo sapiens
  misc_feature 1..45: note = chr6:142409847-142409892
  misc_feature 1..45: note = hyper
  source 1..45: mol_type = genomic DNA
aggactgaacgcccacgatttaggtttaatcgatgtccctccctc

SEQ ID NO: 30866 - DNA, 109 bp, Homo sapiens
  misc_feature 1..109: note = chr6:143247641-143247750
  misc_feature 1..109: note = hyper
  source 1..109: mol_type = genomic DNA
tgtgaaaagaaagagcgtatattctatccgggcaatgacaaacggactcaggcctcctgaggtcagcgctcctgggcaccatcaggccccacttcgggagcccccggtg

SEQ ID NO: 30867 - DNA, 91 bp, Homo sapiens
  misc_feature 1..91: note = chr6:146349205-146349296
  misc_feature 1..91: note = hyper
  source 1..91: mol_type = genomic DNA
ggagcaggggaggaacgggagagggagccaacttcagccccgcaggcggctgagatttggcgcctctgtccccaagcgggtgggtttggat

SEQ ID NO: 30868 - DNA, 148 bp, Homo sapiens; identical to SEQ ID NO: 8761
  misc_feature 1..148: note = chr6:146349536-146349684
  misc_feature 1..148: note = hyper
  source 1..148: mol_type = genomic DNA

SEQ ID NO: 30869 - DNA, 201 bp, Homo sapiens
  misc_feature 1..201: note = chr6:146755460-146755661
  misc_feature 1..201: note = hyper
  source 1..201: mol_type = genomic DNA
cagcaacttcagtaccgcgatcccggattttcacgcggtgctggcaggccccggtggtcccgggaacgggctgcggtccctgtacccgcccccgccacctccgcagcacctgcagatgctgccgctgcagctgagcacctttggggaggagctggtctccccgcccgcggacgacgacgacgacagcgagaggtttaagct

SEQ ID NO: 30870 - DNA, 42 bp, Homo sapiens
  misc_feature 1..42: note = chr6:146864466-146864508
  misc_feature 1..42: note = hyper
  source 1..42: mol_type = genomic DNA
cttccaggctgggcccggaccccacgccgaccccggccccgg

SEQ ID NO: 30871 - DNA, 116 bp, Homo sapiens
  misc_feature 1..116: note = chr6:146864762-146864878
  misc_feature 1..116: note = hyper
  source 1..116: mol_type = genomic DNA
gggtcctccccaagccggcgccaggccctgccctcgtccggccctgccctcgtctggccccgcccgggccgcgagcactggcgggttctgggtcctgtgaccggtcaggcggcgtc

SEQ ID NO: 30872 - DNA, 30 bp, Homo sapiens
  misc_feature 1..30: note = chr6:147829471-147829501
  misc_feature 1..30: note = hyper
  source 1..30: mol_type = genomic DNA
cagcgtagaagccaccggcttcccgccggg

SEQ ID NO: 30873 - DNA, 32 bp, Homo sapiens
  misc_feature 1..32: note = chr6:148663762-148663794
  misc_feature 1..32: note = hyper
  source 1..32: mol_type = genomic DNA
aagatctagaggctccgcggccacccctgccg

SEQ ID NO: 30874 - DNA, 41 bp, Homo sapiens
  misc_feature 1..41: note = chr6:148664007-148664048
  misc_feature 1..41: note = hyper
  source 1..41: mol_type = genomic DNA
gtggccacctagacccgaggtgcgggcgcctgcgaagggcc

SEQ ID NO: 30875 - DNA, 303 bp, Homo sapiens
  misc_feature 1..303: note = chr6:149069188-149069491
  misc_feature 1..303: note = hyper
  source 1..303: mol_type = genomic DNA
agggaaggtcctcttcgttgcattgttagtgaccgcagttcagtcccgtcccgcgccccggggagtgtgggtgggtttagccctttgccaccgtccgctctgagaattctgtcccgcagatcccccgcctgcccgccggccctagtggctccgcgctgtccccgggctggcttgtcccttggctgccgctgcccaccccgccgcccgcagctagcctggcgcggggaacgggttgcatccaggggtttggggatgcccgagggcgctggtcagcctggccagcagtgtcgcccccagtaaccc

SEQ ID NO: 30876 - DNA, 111 bp, Homo sapiens
  misc_feature 1..111: note = chr6:150284700-150284811
  misc_feature 1..111: note = hyper
  source 1..111: mol_type = genomic DNA
cggctgcgccctggacggagaggggcggggacttcgcgactgcaggcggagggagggcgggtgtcgctggcgcaggcggtgacagggagacaccgccgccactgagtattc

SEQ ID NO: 30877 - DNA, 314 bp, Homo sapiens
  misc_feature 1..314: note = chr6:150285055-150285369
  misc_feature 1..314: note = hyper
  source 1..314: mol_type = genomic DNA
gcatgcctaggatcccgcccagtgtatccctgcgcgcggcgggccgggctgggcagctttataaacagccgtggtgtgagcctcgaagggaaccatcagcgcctcctgtccacggagctccaggtctacaatggcagcggccgccagccccgcgttccttctgtgcctcccgcttctgcacctgctgtctggctggtcccgggcaggatgggtcggtgagttcggggatgtagcctaagcagggcgggggccaaacctgggaggttgtggactgcagcgggtttcagaggaggggaggcttctggaaggaccgg

SEQ ID NO: 30878 - DNA, 342 bp, Homo sapiens; identical to SEQ ID NO: 624
  misc_feature 1..342: note = chr6:150285544-150285886
  misc_feature 1..342: note = hyper
  source 1..342: mol_type = genomic DNA

SEQ ID NO: 30879 - DNA, 454 bp, Homo sapiens
  misc_feature 1..454: note = chr6:150286099-150286553
  misc_feature 1..454: note = hyper
  source 1..454: mol_type = genomic DNA
cgaacatgcccggctgaaggcactcagttcccctccgcggctcctttcctccgggtccgcttcctgcggctgctgcttgccccataggccaggaggcttctgggtggaccagcgcgatctccccgaatatcgcggtctacccgaacatcgcggcctccccgaacatcgcggtctccccgaacatcgcgatcccccagaacatcgcggcctccccgaacatcgcggtctccccgaacatcgcgatcccccagaacatcgcggtctacccgaacatcgcggcctccccgaacatcgcggtctccccgaacatcgcgatcccccagaacatcgcggtctccccgaacatcgctgtctccccgaacgtgcctggctgaaggcactcagttcccctccggggctcctttccgccgagtccgcttcctgcagctgctgctagcaccgcagtccaggggga

SEQ ID NO: 30880 - DNA, 30 bp, Homo sapiens
  misc_feature 1..30: note = chr6:150310175-150310205
  misc_feature 1..30: note = hyper
  source 1..30: mol_type = genomic DNA
gaaagaaatcatttacgtagatagggtaaa

SEQ ID NO: 30881 - DNA, 324 bp, Homo sapiens
  misc_feature 1..324: note = chr6:150311072-150311396
  misc_feature 1..324: note = hyper
  source 1..324: mol_type = genomic DNA
tacaacctggcaacccgttcgggacacctctctgtgacagagagctgttctttcctttctcccataaaactcctgctccaatctcactccgtggatttgcgtccccgtccttgatttccttggccgcgagaccaagcatttattccaggcgaccagctgtttcactgcccttagtttctggtctcgtttccgccactgtgttttctcgggccgggagaagcagtcccagggacgcgacaggggcagaaggagccctgcgtggggaattgagaagggtgcggcgcggtcagaaagatccgtcctccgcgacgccctctcctcttt

SEQ ID NO: 30882 - DNA, 258 bp, Homo sapiens
  misc_feature 1..258: note = chr6:150311819-150312077
  misc_feature 1..258: note = hyper
  source 1..258: mol_type = genomic DNA
gtgatgaaatcgggtcggagtcgctctaaagtcatttttgtctcttgcgcgcctcagggaggatattaaaggcttttgtggatttcaaccgctaaagcctttcctcaaagttcattgcgaggggtttcagttccgcccggcagcatccctcagggttctgcgcgctcccgtggcaccgtctgcgcccgagctccggtcccgtcccgattgcctgatgccccgcagggagcgcccagcggccgccgatgtcccaccagc

SEQ ID NO: 30883 - DNA, 40 bp, Homo sapiens
  misc_feature 1..40: note = chr6:150312743-150312783
  misc_feature 1..40: note = hyper
  source 1..40: mol_type = genomic DNA
cactcctgcccctgccgcactcaggcgggcagctgatgtc

SEQ ID NO: 30884 - DNA, 105 bp, Homo sapiens
  misc_feature 1..105: note = chr6:150358880-150358985
  misc_feature 1..105: note = hyper
  source 1..105: mol_type = genomic DNA
cctctccgagttctgcgcgctcctcccagggcgcccgctgtccccgagctctggacccgggtcctgcccagtggagaccgcggagttggtgccccgcttgcggcc

SEQ ID NO: 30885 - DNA, 207 bp, Homo sapiens
  misc_feature 1..207: note = chr6:150358986-150359193
  misc_feature 1..207: note = hyper
  source 1..207: mol_type = genomic DNA
atgctcccgggcctccgagtccacagcgtccggacaaaacggcctttggaagacctgggaggactcgccggtagcggcaagggaaggagccaggaaatgcgggggtcggtggggtgaggagcacggggttcctacttcatcctcgcggaaactttgccaccggctcagtgtggagacctcaccgtcccgcttggatccgtggggctc

SEQ ID NO: 30886 - DNA, 15 bp, Homo sapiens
  misc_feature 1..15: note = chr6:150359438-150359453
  misc_feature 1..15: note = hyper
  source 1..15: mol_type = genomic DNA
cgggagaaagggaga

SEQ ID NO: 30887 - DNA, 346 bp, Homo sapiens
  misc_feature 1..346: note = chr6:151560995-151561341
  misc_feature 1..346: note = hyper
  source 1..346: mol_type = genomic DNA
tccctgctcttgccacgtgaggtgcccaaatatggtcggactcaggaggagccagggagcgcttgcctttctcctgctaatggggaggaggctggaacaaatgtttggagttaaacacaatctgcaggaaagcaaatggggactcggactcgctcctgggcgagctgaaagtcggctgcagcagaagctcctgccttgggtgatccatcatttaataaaccccagagaatccagtgtccccggcaggctttttgctcccctgctctcttgccttctgaggccctgggtcgtccccgcagctctagtcgccctgttagaaacgggaggcgcccgagggccgggtggg

SEQ ID NO: 30888 - DNA, 624 bp, Homo sapiens; identical to SEQ ID NO: 8773
  misc_feature 1..624: note = chr6:151561368-151561992
  misc_feature 1..624: note = hyper
  source 1..624: mol_type = genomic DNA

SEQ ID NO: 30889 - DNA, 387 bp, Homo sapiens; identical to SEQ ID NO: 8774
  misc_feature 1..387: note = chr6:151562056-151562443
  misc_feature 1..387: note = hyper
  source 1..387: mol_type = genomic DNA

SEQ ID NO: 30890 - DNA, 637 bp, Homo sapiens
  misc_feature 1..637: note = chr6:151814974-151815611
  misc_feature 1..637: note = hyper
  source 1..637: mol_type = genomic DNA
tcccaccgggaggaccgaccgttatccccgccgactccccccaggtcgccctggcagtttcggccgctcagttgcaggccctcgccacggaggccacgctcgggggttcggggtccaccccggcctcctgcggccgggccaccctactcgcgcgcagccgcgcgccgccgcgtccccgcggtgtttacccgttgcccgaggagacacccgcgccacccgccggctcccggcgccgccgcttcctcagggccggttccgggtccgagcgcgcccccgggctcgggtcgtcatgagcctggactgcaccagccatatcgcgctgggtgccgcttcgccagcgcccgaggtacggtcccagccgccggccgcgcgcgggggtggccctggggatagacgacccaggaggggccgaggcgcccctgatttgcacccttttcctcccggaggcgtgggcagaatcagagcagctctgtgcccgcgagggctgtggcctgggactgccagggcgctgatttcaggaggggatgggcaggaccggagtttgcggagcgcgtctgaattttaggttgtgccactctgcttctctgaccatttaaaccggtgacattcgaaagactgtggccgggcagttcctccc

SEQ ID NO: 30891 - DNA, 558 bp, Homo sapiens
  misc_feature 1..558: note = chr6:152622914-152623472
  misc_feature 1..558: note = hyper
  source 1..558: mol_type = genomic DNA
ccctgaaatcagccacggagagggaacatggagccactcgccaggctccagtcaaagagcaaagccgcggggacccactggatccttaccatgaccacagaggggtgggccgaaggcgtggggaggagctccccatccaggtcctctgtcccttccgccagcccctcgacctcggtcaccgtcagcagcatggtggcgtgcttggctttcatcgtcagcatcttgcacttggaattcaaagaagcgatctgctcctggtagcccttaattttctgcgccagctcctgaggaaacatttcccccaccggggtgtcagagcagcatcaaaaggaaacagaagtagtagcgttcatcttcctgcagggcgagccaatgagcgcgcagagccgcgcgggcccgggaggcaggatgtgtaggcggcgagtcctcctgcatctcgctaccgagccagaccgcaggctgcgcggcgcggcgcaggcacagccaaagtgcccgagcccgcgtccccgcgtcggtacaaaaggagaaatgaggggatgaggccgaatgagtggtttc

SEQ ID NO: 30892 - DNA, 293 bp, Homo sapiens
  misc_feature 1..293: note = chr6:152957488-152957781
  misc_feature 1..293: note = hyper
  source 1..293: mol_type = genomic DNA
gagatgtgccacaagcggaaatgacaactcagagagggggatattaatagggacatctacgtacgagatgcaaagaggctccccaacctcctagtctccttatctatgagtatcgcacacgtacacacatcactgccaccaccccctcccatcaagcacgcagagccccagcgtgcaggcacaaacttgctgacaatttgtctgcaatgtgttcgtcttgcacctctctctcctctccctgtctctgtctctccctgtctcccagtctctgtctttccttttaccttctctct

SEQ ID NO: 30893 - DNA, 184 bp, Homo sapiens
  misc_feature 1..184: note = chr6:152957815-152957999
  misc_feature 1..184: note = hyper
  source 1..184: mol_type = genomic DNA
cgagcgaacgcttcctcccggctctctgcgcccaggctcggcgggaccccggggatgcgcggctgtccgcccgccctgtcgccgggatcgggcgcggtctgcaggactgcgggagcccagccgccctggtgacagaggacaacaatctcagcccgctgcggccggcggccgcggcccggcgccc

SEQ ID NO: 30894 - DNA, 485 bp, Homo sapiens
  misc_feature 1..485: note = chr6:152958000-152958485
  misc_feature 1..485: note = hyper
  source 1..485: mol_type = genomic DNA
cgctcaccctggctggctcgcccacactcactcccgcgccgggctgctcagccgcgctccccgccctccgcgaccggttcctcctcccggctgctcgctggggggtgaggcctcccccttcgccctcccccacgcatctactgctcctgtcgggaaggaaggtcgcccaggccggttcagcctctgggcagggtccctgcaccgccctggcccgccacaccccctccccggctccgtgccccgcgccccgcgcccggctccgggatgcgccggtgcctggaagagctgggggcggggacccggaggctcgcaggcttccctacctcctggagatgcacggccttgggcgtttctccgcagctgcaaagctgtgctgtgacccacccgctcagcgagcctttataccgggaccacctcccgggggtcgaggtgggaaggaaatgtccctgagagccgggacgcgctgcctccgctgcctggaggag

SEQ ID NO: 30895 - DNA, 1153 bp, Homo sapiens
  misc_feature 1..1153: note = chr6:153450977-153452130
  misc_feature 1..1153: note = hyper
  source 1..1153: mol_type = genomic DNA
ggagccagggtcaatcgtccccgggcgacaggggttctcccacgtgaaccgacgtcccgggctccgggcgaggcgcagggctcagggcgcagggcgggtcccgtacgcagggcgggcgcgcgggcatctttgtggccaggcgaccccggctcgctctcccggagcccagggactcccgaggctggcgcgggctgcccgcgacaaggtgccagcagcctcgggctcgcgaggagcagctcccacccgcggcttccgagtccagctctgtccctccgccatcccctagtcctccggcatttattcagggagacagggaggcagagagaagaggagaaagcggccgtgtctgcacccagcctctgccgcagcactcgatgagggacagcagggaggctggcggggaggcagagattaaactatgattccatcgatcacggaaagaccaccatcacctacagcaaaggaggctccgatgcgcccacccgggcagcgactcgcggttggtgggcgttcctcgtcctcgccccctcggtggctgtggaatccaccccgcgccgcacacgccaggactccctttcctttgactaaggggaggggaaggaacaaaagagaccccccaccccctatacatacatacacatacacacacacacacacacacacacacccctccggtattttactgctggtcaaaggattcattttcgcaacctcttcttcgaacaccttccccacctgagcagtgcattttcccaaaggtaaagagagataagggaggaaacacagcacccaaggtgatcagtcgattggacactgttgatggcacattctcctcgttcccaaccaaccgcacaaaacccgcaacacctcgcgtccccgcggggtctcccgcgcccctggcccggccctcccggccgcccccagcaggcgccccgctctccgcgggaactctgggacctggccgagcgttccccggcgggcaggacactcgcccggttccctgcagcagctgagggcggcgagcggaccgcgtccaggcagcgacgcgggattcaacttcccggacccgcggcgcggcccccgctcccgctcagggcgccgcggccacagctgagaccccagcgccgcgcagccgcccccgccggggcatggg

SEQ ID NO: 30896 - DNA, 187 bp, Homo sapiens
  misc_feature 1..187: note = chr6:153452568-153452755
  misc_feature 1..187: note = hyper
  source 1..187: mol_type = genomic DNA
tccccgggcggcccccggccccgcccgacctcgcgcgctcgcctgggcgcggcgcccaccgtgcggaggggctcggccgggactctcggcttcggtgacgcccgtccggagcttcgcgggaggcccggagtcccgagagcttccctgggtgacagcggctctccgcccgggcccctgcaactccact

SEQ ID NO: 30897 - DNA, 136 bp, Homo sapiens; identical to SEQ ID NO: 8783
  misc_feature 1..136: note = chr6:154360584-154360720
  misc_feature 1..136: note = hyper
  source 1..136: mol_type = genomic DNA

SEQ ID NO: 30898 - DNA, 106 bp, Homo sapiens
  misc_feature 1..106: note = chr6:155316115-155316221
  misc_feature 1..106: note = hyper
  source 1..106: mol_type = genomic DNA
ctgacctcagttttgcgtgcctttcctcggtgggacccgggaagagccgtctttaaattccttggggaagggacggggtcgcactggcgcatcgcatccccggtag

SEQ ID NO: 30899 - DNA, 96 bp, Homo sapiens
  misc_feature 1..96: note = chr6:155316256-155316352
  misc_feature 1..96: note = hyper
  source 1..96: mol_type = genomic DNA
cgatgtttcttgaattgttttatttgtgttgttccaaagaaagcgcgagggacatggtccgggaccagccgggagctggcgcgggggtcctgggcc

SEQ ID NO: 30900 - DNA, 295 bp, Homo sapiens
  misc_feature 1..295: note = chr6:155317032-155317327
  misc_feature 1..295: note = hyper
  source 1..295: mol_type = genomic DNA
ggggagcgcccgctgcgcccacgcccgcccggcgacctcggagcctcagaaaggcgctgcggcgaagcaggatcccaggcggtcggctcagcgagtgtagaccgtgcggtccctgctcagcccctccggcctttccgagcgcgggagccatcccggacgggcgcggctcctgggggggctgaggtgccaagtttctgtgaaagccgacacgttgtgcccctaatggatcctatttaccaaaaacagttcagaaagaaaagagtccattcttccagccattcgttgctgacagccg

SEQ ID NO: 30901 - DNA, 573 bp, Homo sapiens
  misc_feature 1..573: note = chr6:157556724-157557297
  misc_feature 1..573: note = hyper
  source 1..573: mol_type = genomic DNA
aggcatgagccaccacgccggaccaaatataaccatttctaaaagcattcctcagcgcttggaacttgcgagctgatggcttttggtggagcccaggaggggcgctgtggggcacagacgtgtgcggggccggcagctgcggagagagcagcgcaccccagccttcaattccccgccgaagatgggactctgcccagagccgaggcccctggctgctgccccgctcccttgcggccgcagtgacactcagagccagattcctcagacaatcttcactcctccgtggtggctgccttgggaggcgttgcggggtgaaggaagtcgcagctggtcccaagcagtggggagggcaggacagggagtaagacaccgccttcctggggtgcacacggaggaggggcgctgcccaggagcggaggggaggggagcggagcgcggagaggagaccggtgccagacttcacccgcctagctctcggaacccccgggggccgcgctcggctccgcctgggggctaccggttctgggccaggagaagaagtggcatccgcggggcagggcgggcggtgacggc

SEQ ID NO: 30902 - DNA, 65 bp, Homo sapiens
  misc_feature 1..65: note = chr6:158430625-158430690
  misc_feature 1..65: note = hyper
  source 1..65: mol_type = genomic DNA
aagcaaagacattctcgtgtaggaaaacttacaggaaatgcaactaaaagcgtgggagacaggaa

SEQ ID NO: 30903 - DNA, 188 bp, Homo sapiens
  misc_feature 1..188: note = chr6:158957782-158957970
  misc_feature 1..188: note = hyper
  source 1..188: mol_type = genomic DNA
ctgcctttgagcccccgctctgcagcgagctcaagcacctgtgccggcggctgcgggaagcgtaccgcgagctcaaggaggacctcacgcccttcaaggatgaccgctactacaggtgggcgcggcgcgggcagcggcggggcggccggaggcttccgggccgcagtcccctccgggaccccggcgcg

SEQ ID NO: 30904 - DNA, 109 bp, Homo sapiens
  misc_feature 1..109: note = chr6:158958375-158958484
  misc_feature 1..109: note = hyper
  source 1..109: mol_type = genomic DNA
cctcggaggcgggggcgccgccaagggctgggggcggatgggcgcggcggggaagacgcggcggggcgccatgcggggacacggcgcctgggagcggctgtgtggaact

SEQ ID NO: 30905 - DNA, 88 bp, Homo sapiens
  misc_feature 1..88: note = chr6:159589999-159590087
  misc_feature 1..88: note = hyper
  source 1..88: mol_type = genomic DNA
tgggcgcgccgggtgcgggtagggacgtggaaggactgggctagccacaggaactacagcgctgcggaccgggtgaggggtcccggcc

SEQ ID NO: 30906 - DNA, 608 bp, Homo sapiens; identical to SEQ ID NO: 2944
  misc_feature 1..608: note = chr6:159590154-159590762
  misc_feature 1..608: note = hyper
  source 1..608: mol_type = genomic DNA

SEQ ID NO: 30907 - DNA, 290 bp, Homo sapiens
  misc_feature 1..290: note = chr6:159590971-159591261
  misc_feature 1..290: note = hyper
  source 1..290: mol_type = genomic DNA
cgggaggctccagccgtctaagtgtcccgggagattcaggcacagcggggaaaaaaggaaaagaaaggcgactttcagcgtgcggactggggtaatgcctttctttgcccagaatttctcgggagcgtaggtggtcatcctactttctccgcgttcacctctcgcgaggcaggatgacgggcgcactcgggagaccggagggaggcagagcagggctgttctagaaggtcgtgggggaaaggctgcgagctgccgcagggcgtcgggtgcctctgcgctccagaggagaa

SEQ ID NO: 30908 - DNA, 106 bp, Homo sapiens
  misc_feature 1..106: note = chr6:159654897-159655003
  misc_feature 1..106: note = hyper
  source 1..106: mol_type = genomic DNA
cgcaggggcaggtggcgaccacaggtcccagcgcggacatgcggcctcccccgccaggcccagccgacccggcggcccccagtcccgcgcccgggtacccagcagg

SEQ ID NO: 30909 - DNA, 30 bp, Homo sapiens
  misc_feature 1..30: note = chr6:160402852-160402882
  misc_feature 1..30: note = hyper
  source 1..30: mol_type = genomic DNA
catcaacttagatgtcgtgtttgacttagg

SEQ ID NO: 30910 - DNA, 55 bp, Homo sapiens
  misc_feature 1..55: note = chr6:160769518-160769573
  misc_feature 1..55: note = hyper
  source 1..55: mol_type = genomic DNA
tgctgctgtgcctgacgggcgtcaccttcgccttcctcttcgtcggcgtggtctt

SEQ ID NO: 30911 - DNA, 98 bp, Homo sapiens
  misc_feature 1..98: note = chr6:160769827-160769925
  misc_feature 1..98: note = hyper
  source 1..98: mol_type = genomic DNA
cgtgccgcggcggctggcgctacgcccaggcccactccaccatcgtcagcgaggtaagggcgccccggccctttggaagccggcgggagaggacgatg

SEQ ID NO: 30912 - DNA, 133 bp, Homo sapiens
  misc_feature 1..133: note = chr6:161188410-161188543
  misc_feature 1..133: note = hyper
  source 1..133: mol_type = genomic DNA
cgaccctggattgctctccccattctcagcctcaccccccactccttccaccccatattttgccgcctcgaaggacatgaaccatctgctggctgaaggcgcttggacctgaaaccagcgacaggttttggca

SEQ ID NO: 30913 - DNA, 187 bp, Homo sapiens; identical to SEQ ID NO: 8792
  misc_feature 1..187: note = chr6:161351859-161352046
  misc_feature 1..187: note = hyper
  source 1..187: mol_type = genomic DNA

SEQ ID NO: 30914 - DNA, 44 bp, Homo sapiens
  misc_feature 1..44: note = chr6:161352264-161352308
  misc_feature 1..44: note = hyper
  source 1..44: mol_type = genomic DNA
tggccaggccaaggccgctgggaaaggcaggacgctcgcccatg

SEQ ID NO: 30915 - DNA, 69 bp, Homo sapiens
  misc_feature 1..69: note = chr6:163834314-163834383
  misc_feature 1..69: note = hyper
  source 1..69: mol_type = genomic DNA
ctgcttttcagactacgcgcacagcctctttatttcctactgcggcttcattccctcacggaacactga

SEQ ID NO: 30916 - DNA, 128 bp, Homo sapiens
  misc_feature 1..128: note = chr6:163834405-163834533
  misc_feature 1..128: note = hyper
  source 1..128: mol_type = genomic DNA
cgagcacgactgacgctccccttattatttgctaagccgctgcgctcgggtctggctacgatttgctttcagaataacgggaaggtgcaacaagatcgcttccctagaggcgcgtcgcccgcgtggcc

SEQ ID NO: 30917 - DNA, 119 bp, Homo sapiens
  misc_feature 1..119: note = chr6:163834710-163834829
  misc_feature 1..119: note = hyper
  source 1..119: mol_type = genomic DNA
cgacaaagcgggagccgggcgcgccggccgagggcgcccggcgcagagtcccgcagaggcggacgccgcggcacgcgcctcgaaaagcctcaaactcttatcctcggctctcccgcccc

SEQ ID NO: 30918 - DNA, 687 bp, Homo sapiens
  misc_feature 1..687: note = chr6:163836544-163837231
  misc_feature 1..687: note = hyper
  source 1..687: mol_type = genomic DNA
gggccggggtggacccgccggtgccggacgccccctgcccggccgggaccccgcgccgctggcgtccaagttggcgcgttgcggagggctgcggggtgagccctgcggcccctctagcttcggcggtcacatttccgagaggtcggcgggggctgcgcggactcggtggtcctcgccgagccctcccgagagcaggcccacgccgcgccgccggcctggaggacgcgtgtgcccggcgcgggccccgctcctccgctcggcctcccgagcctgctctgcgcggacccccaccgccccgcgttcgggagctctcccctcccgtgaggactaaagcggggtttcgtggttggggagttggtgcagctgttcaatactaagtggaagtcagtgtggggctcgttagtttaaagaaattccgtaggagaccgaaattatgctggcgtagccgacaaggaggactaagtgacggcgaaaagcacttttttcccttttgtttggggaagcgagaactgttagggagttgaacttcacttttcgggggtggggggggggggggtggagtgcgaaataacgcgatgacagatcggagcgcagcctgagttagaagaacttgggcggagggtttgctcccggggacgcagccgcctgagtttgtaggacagggtttcgagacgtttggaaagggcg

SEQ ID NO: 30919 - DNA, 97 bp, Homo sapiens
  misc_feature 1..97: note = chr6:163837469-163837566
  misc_feature 1..97: note = hyper
  source 1..97: mol_type = genomic DNA
gcttagaggcaccaccggaggactgtgtaaaggaaactgaaaactacaggttgaagagatgaacaatggagtttagatttttcgcaagaatttcgag

SEQ ID NO: 30920 - DNA, 1105 bp, Homo sapiens
  misc_feature 1..1105: note = chr6:166074020-166075125
  misc_feature 1..1105: note = hyper
  source 1..1105: mol_type = genomic DNA
aggagcggccgatcccggcgcgaatacgctcgccagcccgggggctgcaccccaaaggtgcctgagcgggcggtgagcccggagcagcttcggccgcagggaggggctcaacctcgggtgccctggagacccgggtcggccaaagcctgggaatgagccgcagttgggagcgggaaaccgaaacagcaatcctggaagagcgtcggcccagagaaggcgccgcggaaacgcggctcctgagcgaggcgcagacaaaggctcgggtgcacacgcggtggacggtggctccggagccgcgctctgggccgcgggaagccgcacccgccccgactggcgccggagtcgggcgggggcccatgggcgcgacctcctgcacccggaggtgctcctacccggccccgccgcggtcttcccgtcctcaccctgctccccctccatccgcgaccgcgacgcccccctcctctgcgcaccgggcgcctcctctttcctcactgtctcccgcctgcctgcttccttctagcgaacccctgccttgacttttctgctcaatcttgtcccccacccccgtgacatgcctttctgccacctctgcctcagcgcgctctcggccccgcgcccgcgggtggcgaggaggagtggccacgccacagtgggcccgggggcgcatcctgcgagtcggaggcggcggcgcctttctcttccaccctagcgacctattgtccttcccttttctctaccaccccggaccccagagaagcccgggaccaacaggacgcggcccggggtgggggtgcgtcccctgggtggaggtgcaaccgtttccaccccgccagtccatgctctggatgccggtcactgcgcggggtgggaggccgggcgcccactccgagtcctggagaacggcggtgccatcacagttggaagcgcggggttctgaggccctggcctccctcaccccggctacagggacccggtgggctggacccccaagtggaaggaagcgcatctgctccagccaagtggccacaggctcaagagggaggaacctaagtggtcacaaagttgagtataaatacgcgccggacaagtgtggccagaaacggca

SEQ ID NO: 30921 - DNA, 231 bp, Homo sapiens
  misc_feature 1..231: note = chr6:166075258-166075489
  misc_feature 1..231: note = hyper
  source 1..231: mol_type = genomic DNA
cgctccgccaggggcaccggctcctgcccctccagagaagccccctgggcgctccacgcccgggcacgggcacctcgctcgacacccgcttcccacccagcaggccaagccccccacctgcccccaggggatgaggagccgccccacctccggggaacggggagcaggccacttactggggctcaggaagcactcggtcagccttcggaagcagctcgcattattagaagg

SEQ ID NO: 30922 - DNA, 107 bp, Homo sapiens
  misc_feature 1..107: note = chr6:166076095-166076202
  misc_feature 1..107: note = hyper
  source 1..107: mol_type = genomic DNA
gggcgggcgcgggggcgcggcgcgctccgcccggccacggccaggccactcgggggccgggcccgggcccgccgcgctccccccgccggccgcgctgagccggggtt

SEQ ID NO: 30923 - DNA, 98 bp, Homo sapiens
  misc_feature 1..98: note = chr6:166076501-166076599
  misc_feature 1..98: note = hyper
  source 1..98: mol_type = genomic DNA
ctgggggccaggccccggcgacggcgcctggctaccctcaggcgcgcacaatcggcgtcctcccgggccggggctagggacggcggagaccctccctg

SEQ ID NO: 30924 - DNA, 44 bp, Homo sapiens
  misc_feature 1..44: note = chr6:166077015-166077059
  misc_feature 1..44: note = hyper
  source 1..44: mol_type = genomic DNA
gaatcctcctggtagcgggccagcagctccgacccagctgtgct

SEQ ID NO: 30925 - DNA, 298 bp, Homo sapiens
  misc_feature 1..298: note = chr6:166077335-166077633
  misc_feature 1..298: note = hyper
  source 1..298: mol_type = genomic DNA
acccccacccccttccgtagccatgaatccaggcagttgccactgaagggaaatgagccgcccaatgggcgctcagaactaggagccgccagaagtttggggaagttggagcgcaagagcgcacacagatgcacaggtgtccgcgttcgggcaggcacgcgcggcggggccaccatggcgcgctgggtccgaggaggggcggtggctgtgctgttccacggtggcacgggctgtccggactgcctggacgaggtcaccttccccggagtggagcacacgcgccaaagctcagctttca

SEQ ID NO: 30926 - DNA, 332 bp, Homo sapiens
  misc_feature 1..332: note = chr6:166077668-166078000
  misc_feature 1..332: note = hyper
  source 1..332: mol_type = genomic DNA
cgctacagtgcagcaactgggttgacccagggccctgggctcccggtgtgccccgggtcccggggccatttctcgccctccacgttttcttctttctatccagtttcacatgtttattttgaagcgtgctccagattcctcactagtcgatgctttccccgactcccatccaaactccccccaatggaaaataacacttttgtatttgcaccaagctgagcagttgggatgcaaaggacatgctggggctcccctcccccagtaaagtccacagacgtctccgcgattgccgggcagattctgagtgtcgcgtgtaacgggcatcagacttg

SEQ ID NO: 30927 - DNA, 52 bp, Homo sapiens
  misc_feature 1..52: note = chr6:166218127-166218179
  misc_feature 1..52: note = hyper
  source 1..52: mol_type = genomic DNA
gccttggcctgcaggcggggctggtgggatcagagcgcgtggtcgcgaaggg

SEQ ID NO: 30928 - DNA, 244 bp, Homo sapiens
  misc_feature 1..244: note = chr6:166218546-166218790
  misc_feature 1..244: note = hyper
  source 1..244: mol_type = genomic DNA
tggagggacatggggcgtacggaggggcagcggggcctggggtcgagcagaggggcgcatggaggggagcatggagggacgtggggcgcgcggaggggcggcggggcgtgggacgcgcggttcttcctcgcgaagttggagaggcctcgggtcgcagggcacccactgtgcgccctggacgaagcctaccctggaggcagcggctccgagggacgccggaaggaacggccgctttcctcagggt

SEQ ID NO: 30929 - DNA, 367 bp, Homo sapiens
  misc_feature 1..367: note = chr6:166267525-166267892
  misc_feature 1..367: note = hyper
  source 1..367: mol_type = genomic DNA
gtggtgagcaggctgcgctggacccagacagacgcgcggggtcctagggaagagcccaggcagggggaagcccgtgggcggtgagaccctcccgtgccacgggcgcagcgcagcgctggctggggccgacggggcgcaccggcggacggtgatgaacccggagacccggcagccaggctgggctgcagcagcctttgcctggacgtcagggtggagcccgggaatcgcccctgcgccgggtgacggaggagaaaggggcccgcaggaggcaggagggagcgcctggcacagggacccagggactcgagcaggtggtccctggggaacggggagtgaggccggaaggagagaaagccaagaccaggtg

SEQ ID NO: 30930 - DNA, 30 bp, Homo sapiens
  misc_feature 1..30: note = chr6:166399418-166399448
  misc_feature 1..30: note = hyper
  source 1..30: mol_type = genomic DNA
tatcctgaagaaacacgtaaaatcccatct

SEQ ID NO: 30931 - DNA, 349 bp, Homo sapiens
  misc_feature 1..349: note = chr6:166400601-166400950
  misc_feature 1..349: note = hyper
  source 1..349: mol_type = genomic DNA
ctcgggaggcacctgcgggtctggcgcggcagccgctgcggtttgcagctggcgcgcagccctcgctgggaacttggagctctcaaactcctcggatcaagcgttagccccgaggctgtcagttggcgctggggcgggctgcagtctctctcccctcctctgcaaacccttgagtcttcggctttatatactcccttttcttctttctcgagtccactcatcaccctttcccccaaacagtcacctccacaagcacaacacaccacacacgcgcacacgttttcttattgccaaaaagggtggagggaaaggacaggaagtttttttaagtacacgcacacacacacaa

SEQ ID NO: 30932 - DNA, 232 bp, Homo sapiens
  misc_feature 1..232: note = chr6:166401268-166401500
  misc_feature 1..232: note = hyper
  source 1..232: mol_type = genomic DNA
gcgcgccgatcttctcgcaaaaggcgagtgtgtggggttcctccttccctcctttccatctgggggtctcggggaaagctgcacccagcgccttgggcgcccatgaagaccagtccatctcagctcaagctcccagcagcagcaacttcggactcagacctctctctttagaacatgagtgcttgtgtgtgcgtgcgtgtgtgtgtgtgtgtgtgtccgagtgcacttcaca

SEQ ID NO: 30933 - DNA, 702 bp, Homo sapiens
  misc_feature 1..702: note = chr6:166401949-166402651
  misc_feature 1..702: note = hyper
  source 1..702: mol_type = genomic DNA
cgccccttgtcactacgtgtcgggctcgctctgcctggagggaggctggggtgcggggaagcagggagtgcaaacagacattggttctctttcctcttcccattcatacatttctgttggagtcctagggccgccgcgccgggagtcgcaatgaatggatggatgcccgcgcgctgggaccaccaggtccgcagagatgtcgccggcgctaggggcgctcctcccgcgtggggacaggcgccctcgcctaggcgcagtgtggggggaccccaaaagacccttaagaggccaaaggcctgctctccccgttctccccaacacacaccaggggtcttttctgccccggagaagttgggacgcaaaacgtagggaactgcgctcagtctccgcaccacgaagagtcgagatggggaccgagaccagcacggacggtagcaacagagaggggagcgcccaagtggcgcaacgttgtggctgaagccaagcctgtcgcctccccctgagtaccgctggcggcccaggaccgtgcgctctcccttcctgagcacccagggatgcactgcgcagggaaggagggcacggcgggagggtgcttgcaggggactgctgcgcggattccccatccgcacccggctcgcggggaatccgtgggcttgcactcgccagaaagagctgctgcaggagcagccggatggtgaggcc

SEQ ID NO: 30934 - DNA, 30 bp, Homo sapiens
  misc_feature 1..30: note = chr6:166420026-166420056
  misc_feature 1..30: note = hyper
  source 1..30: mol_type = genomic DNA
ggtttgcaggcaaatcggttggttagaggg

SEQ ID NO: 30935 - DNA, 59 bp, Homo sapiens
  misc_feature 1..59: note = chr6:166421933-166421992
  misc_feature 1..59: note = hyper
  source 1..59: mol_type = genomic DNA
gcgggggcggaggagcgggtcgcgccgctgacattcgccaaggacaggatggggtgggc

SEQ ID NO: 30936 - DNA, 226 bp, Homo sapiens
  misc_feature 1..226: note = chr6:166421993-166422219
  misc_feature 1..226: note = hyper
  source 1..226: mol_type = genomic DNA
cccgccggtggccgactccgccccgcctctcaggggtgcgagtcatcagcgcagcggcggatcctggcccagggagccaccggcccaccctcgcgcccaggagccggactcggagacgtccacctggtggagagacgcgagggagccatgcagacaggggctgctccgtggagagcccgggaagcctgcggggcgccggaggggtgggtcccgggacagaccagtg

SEQ ID NO: 30937 - DNA, 2678 bp, Homo sapiens
  misc_feature 1..2678: note = chr6:166579715-166582393
  misc_feature 1..2678: note = hyper
  source 1..2678: mol_type = genomic DNA
tttacaagtttgttccgactccacgcagtaagtactgtggcgcatgtttaaatttaaatgcgactttgccatcaaggctgatatcttttccacccccaggagagtttagggctagacaacggaagttccccaaaagctccagtccttcaaaggggagtgctcccgctccccgttcgccaggcgtggatgttatcagcttagtataaacagcgctaaaggccttattagagaaggctgtggcagtttctccagggcagacgtcgcctcccgttcaagcagcgtcccttcccacaacccccgtgcagaaggcgcagcgcggccccctcctcgctggtcccagacctggcgggctcctcacacctacctggccccctccgttgagcttgttggtgagcttgactttgctgaaggagacgggagccttcatccagtgggccccgaagttgggcgagtcggggtggatgtagacgcagctgggcgcctgcggctccggcttgccccccggcacccattccccgttcacgtacttccagcggtggttgtccgccgccacgaagtccagcaggaaggagtacatggcgttggggtccaggccagacacgttcaccttcagcaccggaaacatcctcctggaaaacacggggcgggcgcaggaggaccccgacactgaccaggtaggccggaggcagaagctgggcacagaggcctcagttatttcggggcacagaggagccccctggggaacgtccgagggtgactcccaagctcccccttccccgagccctgccaggtccaggtggcctcctcaccatctccacggcctcgggagggaggggaggagaggacctggcgaagggtttcagtgcaggaggccacatcccgcggggacaggcggggaccagggcgcgcctcgcgggtcccgggatgcctccgaggtcgggacaccgaagtgcgcgttcctcctccccaagcttccgcggagaaagccccagaagaggggcttgtagaaatgcactcgagggagttaaccagagcgggaacaaacacaaagccctcctccaggagaaaaagggttcgacctccgggaacttgccaggtcccccaggctgcccaggcgctggagagcgcggcgcgcgcgggctccggacgcgcacccacctgccgttcttggtcacgatcatctcattggtgagctccttgaagcgcagccacagctcgctctcctccaggcccacgcgcagttcgcgctctgtggggtcgcccttctcgctgcccgcctgcagctcattctccacggcgctcagcaggtggtccactcggtactgcaggctctttcccgcgctctcggtgccaggggagctcatcctcccgtccggctcccctccccgccgtccccgaagcccagactcgctacctgagatccaccttccctgctcttggccgccgcccttccgagaaaaggggccccttggaccgagacctgcgacggctcccgggtcccgggtcccggcacagacccgggaggagggcgcggaccaagacttggggggaggggacgggggcagaggggtggggagaagttattccacttgaactccccaaggctctactagtgtaggtctctggggaccgaaattcagtgccctccccataaatagagccgcggcggcagcgctggggtgctcggcggattgggccgcgcacgctttgaagtgccgggcagcctcccattggccgagagcggccatatcagacccagccgggcgggtctgggaggccgggggccaacaatgggctcccgcacgcctgtttcatgtaaatccggggccccagccctgcgagccccggcccagcccctacacccccgcccttctccaaatgtttgcacctccatcaaagcggcggggcaagccccggaggaaggtaagctggacgccccggcctgccccagcccgccccagcccgccccagcccgcacttccgcgaggggctgcccggcagcctgcgatgctccctgattcccgcgcggggtcctcctcgctttcccagcgcgcccggatcccgcagccgcgccaggctggaacgttcgcgcggcctcacctgtccccgctccaggcgcgcctccctcccctcccagggacgagcgcatttggccgggctttgggatgcgccgcgctcgtctcgccgcagtagtagtgctgttctcgcgcctccgatgcctcaactctccagtctggcagtttccggtgcacctgtccccacacgtccctcgcccacggagccccaggcggcgttacgcacacccaggatcgtggatcagcctgccccggcgtcgggtgtccccgcggctctcaccatctggaaaaggaaggtccgcgcgcagagagggaaatggacggaaataagcaaaagcaaaacaaccccttctgagaagtgtcctcctcgctctcttataaaaacaggacttgttgccgaggtcagcgcgcgcatcgagtgtgccaggcgtgtgcgtggtttctgctgtgtcattgctttcacggaaggtgggagaaggtcggggctggcggggtggtccggactagtgggactcggggcgctttccccgcccggcccagcgccaagcggtgtcggcagcggttgttttattacctttcggtgagaacttacgcgaggagagc

SEQ ID NO: 30938 - DNA, 433 bp, Homo sapiens
  misc_feature 1..433: note = chr6:166582394-166582827
  misc_feature 1..433: note = hyper
  source 1..433: mol_type = genomic DNA
aaggagaggtgacaatgagcaggaaatagttcagtggggtctctttaaacagtaacattcctcctaaaacgggagcccaggaagggggaaggaggcagaagctcccccttccaaggcctggctttgcgcttctgcacacctcgcccattcgctggacgagggcctgcctcgggtagcagcctctgtttcccggtctcctgagcgggcaccccagccccaacccctctagagaaagcctgcgcatcgggtggggcagcgagttcagaggagtcttgcgccctagcaagggggctttcccgcggacatggtatctgcgccccgcgctaagtctcccctgccccctgccccctgcccctcgcccctcgcccagccgggctcgctccggggtcgggaattgctggggaagccgaaggagggatccccgcccgggact

SEQ ID NO: 30939 - DNA, 155 bp, Homo sapiens
  misc_feature 1..155: note = chr6:166582941-166583096
  misc_feature 1..155: note = hyper
  source 1..155: mol_type = genomic DNA
cgacgagtcaggaagccggagcgtctagtccctgtccgcatttctcagtgtcttttgatgtctgggatgcatggatattcccagggggctgacccgaggtggggaagtttccttctagaaagaggcaccaaaaggacctcatttgctcctgacgc

SEQ ID NO: 30940 - DNA, 88 bp, Homo sapiens; identical to SEQ ID NO: 8811
  misc_feature 1..88: note = chr6:166583152-166583240
  misc_feature 1..88: note = hyper
  source 1..88: mol_type = genomic DNA

SEQ ID NO: 30941 - DNA, 114 bp, Homo sapiens
  misc_feature 1..114: note = chr6:166666746-166666860
  misc_feature 1..114: note = hyper
  source 1..114: mol_type = genomic DNA
aagaaaaagaaaaccagaacgagaaagtgcggccagcccgggctcaggagctgggtgggaaacaaagccgccagaaaatgacaagtaaacacgcagccgcgggaagccactggg

SEQ ID NO: 30942 - DNA, 184 bp, Homo sapiens
  misc_feature 1..184: note = chr6:166666879-166667063
  misc_feature 1..184: note = hyper
  source 1..184: mol_type = genomic DNA
cgcgcagcggggccgccacgcccgcgcggacacggagcagcggcgcctttccctgcgactggctgtgtcgcctggagcccggcggccgccaccccagggagaaagctccggtgaggggagcagacgctgggacccgtggtctcgccctctgctctttcctggctggggacgggggtagctccca

SEQ ID NO: 30943 - DNA, 83 bp, Homo sapiens
  misc_feature 1..83: note = chr6:166721361-166721444
  misc_feature 1..83: note = hyper
  source 1..83: mol_type = genomic DNA
cacgtggctggggcccgcgcgcggctgggcaaggcctggggggagacgcccggaggggccggcggctgcgtcctgtccaggcc

SEQ ID NO: 30944 - DNA, 442 bp, Homo sapiens
  misc_feature 1..442: note = chr6:166721677-166722119
  misc_feature 1..442: note = hyper
  source 1..442: mol_type = genomic DNA
cgctcagccactgtgcgcggagcgggtccccgcagtccgggcggcccctccacacccacctgcgtccagccgcggcctctccggcttcctcacatcccagcgaccaaacccggggactcaaagagaggcgctcccaccctcccctcctcctgggggtgctcccgggactggaccctgcaggaaccgcctcccgccgtccgactgtgggcgagtcgcggcgcccccgggtccccacagctgagacgcgggccgggccggcaggaggaggagcccagcgcgctcgctaaggacgcggccctgccaggccccgggctgtgcccggctggtgtcacgaccgactgttgaatgggagcaaagtgccaggacagcggagggcggagcgcgcgccaggcatcccggggctcccccagctggcgctccggtggtccgaggttaatgtagt

SEQ ID NO: 30945 - DNA, 165 bp, Homo sapiens
  misc_feature 1..165: note = chr6:167040127-167040292
  misc_feature 1..165: note = hyper
  source 1..165: mol_type = genomic DNA
gaccatcccacaccccgtgcagccagcggcggagaaaccagctggaaatgcagtgggggtggagttgcccccgcgaggacccacggaccgcccaattactacggagtcccagcgataacgtttggagccgtttggttcgattttcggaaccggaccagctttcca

SEQ ID NO: 30946 - DNA, 88 bp, Homo sapiens
  misc_feature 1..88: note = chr6:167041866-167041954
  misc_feature 1..88: note = hyper
  source 1..88: mol_type = genomic DNA
gagcagaaacgagtgcggtggtgagttgacaagtcttgcttgctcttttgcagtgcgaactgcaaaatcctcgcgttgttttgctccc

SEQ ID NO: 30947 - DNA, 291 bp, Homo sapiens
  misc_feature 1..291: note = chr6:167275668-167275959
  misc_feature 1..291: note = hyper
  source 1..291: mol_type = genomic DNA
tccttttctgctggtcgagtattgatagtaggaaaggaaataaacagaggctcggaccggcacagggggacggccagacgggatgtcggaagccaagggacgcagaggccggcgggtggcggcgatggagaggacagatccggctcccagaggaggtcgtgagcgcggggcctgcgccggccggaggagggacccggggggctgcaatatggctgctcgggcgccgtcccctccctgccaagccagggctctggggagctgctgccgcttcccgctcgggctggggcgagg

SEQ ID NO: 30948 - DNA, 149 bp, Homo sapiens
  misc_feature 1..149: note = chr6:167276322-167276471
  misc_feature 1..149: note = hyper
  source 1..149: mol_type = genomic DNA
cacggacggagggaccgggacgaggggagggctccacgcagcacagctgctttcctgcggagcgttcaggagactcgggcacctctggaagcgctgcggactgagctgcccgcggctgcccccgccccgagggccgggacagcacctca

SEQ ID NO: 30949 - DNA, 124 bp, Homo sapiens
  misc_feature 1..124: note = chr6:167764978-167765102
  misc_feature 1..124: note = hyper
  source 1..124: mol_type = genomic DNA
gttacttcagagatgcgctgtgagctgctttgtgccgcgaaatgacctgtttacccgacagcgccctctgcagcccagcgccggaacgggctttttcatgatgttcctgcgttgtgtttacagc

SEQ ID NO: 30950 - DNA, 19 bp, Homo sapiens
  misc_feature 1..19: note = chr6:168719889-168719908
  misc_feature 1..19: note = hyper
  source 1..19: mol_type = genomic DNA
cgcgcggggcctccatgtc

SEQ ID NO: 30951 - DNA, 59 bp, Homo sapiens
  misc_feature 1..59: note = chr6:168841594-168841653
  misc_feature 1..59: note = hyper
  source 1..59: mol_type = genomic DNA
gtgtgtgtgagagtgcgcgcggggaaggaggcacagagacagcccggacaggccactgc

SEQ ID NO: 30952 - DNA, 490 bp, Homo sapiens
  misc_feature 1..490: note = chr6:168842028-168842518
  misc_feature 1..490: note = hyper
  source 1..490: mol_type = genomic DNA
cgctcccgccacctccgccaccatgctgctcccccagctctgctggctgccgctgctcgctgggctgctcccgccggtgcccgctcagaagttctcggcgctcacggtaagcccgggcccgcgggacctggagctcaagtggtgccgcctcttgcagccggccgggttcgggtccccgcgccccgctccaggcccaggcgcctgggcacggggagcaggtggccccgggggccgtggagccttcgcctgccggcgaggctggagcaggtaggacgcagcgtgcgcgcctgggacccggctgggatgggcttctggggaccctgcccgccggggtcctgctgcggctgcgacgggctcctcgggttccacccggctgggaccccacctgcctcgggggctctgacccggctgtgagaggatcctggggtcctgcagaccccggacaagtgggagctgcgggtgcgctcgggtgtcccgcactcactgctgg

SEQ ID NO: 30953 - skipped

SEQ ID NO: 30954 - DNA, 164 bp, Homo sapiens
  misc_feature 1..164: note = chr6:168843080-168843244
  misc_feature 1..164: note = hyper
  source 1..164: mol_type = genomic DNA
cggccgctgggccaaggccgggtgtctgcagcccccagctccagccgtcctcctgggcttgcagggtttgcaaacccatcattaatgcaatcgccagaaacgaaaacattccacttaaatgtgtttttgaacaagtgtttgagaaaacacgaaggtagtgagaa

SEQ ID NO: 30955 - DNA, 124 bp, Homo sapiens
  misc_feature 1..124: note = chr6:169653925-169654049
  misc_feature 1..124: note = hyper
  source 1..124: mol_type = genomic DNA
tccggtggacgtggccgagcggctcccgggcagcgcggctttatatgccgcttctcctgtgcagggctgtcaatcagacacacgaggaagcacgtttaattcattccttcgaaggaatgacatc

SEQ ID NO: 30956 - DNA, 30 bp, Homo sapiens
  misc_feature 1..30: note = chr6:170598584-170598614
  misc_feature 1..30: note = hyper
  source 1..30: mol_type = genomic DNA
aggtgcggcactcaccggccaggtgaagcc

SEQ ID NO: 30957 - DNA, 262 bp, Homo sapiens
  misc_feature 1..262: note = chr6:170605558-170605820
  misc_feature 1..262: note = hyper
  source 1..262: mol_type = genomic DNA
ccggtggaccccagtcgccgtcgtgacggccccacgcagcctcgcgcccggccgccgcctcgtgcgggactcgtgcccgcattcccacctcaccgggtgcagccggcccggccccgggctgtgcgaggcgacggcgcacacctcggagccctgggggccggggtcggcgggcggggccggggcgcgccctttgtgcgctcttagcggaaaccgcgcgttcccagaggagcgcggcccgccgagaccccggatcccgacgcca

SEQ ID NO: 30958 - DNA, 32 bp, Homo sapiens
  misc_feature 1..32: note = chr6:170921693-170921725
  misc_feature 1..32: note = hyper
  source 1..32: mol_type = genomic DNA
gttgggtggaagcagcgcggacccacggcaca

SEQ ID NO: 30959 - DNA, 30 bp, Homo sapiens
  misc_feature 1..30: note = chr7:191863-191893
  misc_feature 1..30: note = hyper
  source 1..30: mol_type = genomic DNA
ctcacacacccccgtcggccccaagcagga

SEQ ID NO: 30960 - DNA, 71 bp, Homo sapiens
  misc_feature 1..71: note = chr7:192430-192501
  misc_feature 1..71: note = hyper
  source 1..71: mol_type = genomic DNA
gaggaggaaggagagcgggagcgcagccggcccgggcccagccgtgactcgtggggcggcggctccgccaa

SEQ ID NO: 30961 - DNA, 52 bp, Homo sapiens
  misc_feature 1..52: note = chr7:192976-193028
  misc_feature 1..52: note = hyper
  source 1..52: mol_type = genomic DNA
tccggagaggccgagcggggacgggcccgagatggcgcggggacccagcgct

SEQ ID NO: 30962 - DNA, 72 bp, Homo sapiens
  misc_feature 1..72: note = chr7:193612-193684
  misc_feature 1..72: note = hyper
  source 1..72: mol_type = genomic DNA
gctgctgcgagaccccggcccgcgtcggtccgagtcgccccccggccccggcggagacgcctccctcctggc

SEQ ID NO: 30963 - DNA, 50 bp, Homo sapiens
  misc_feature 1..50: note = chr7:329805-329855
  misc_feature 1..50: note = hyper
  source 1..50: mol_type = genomic DNA
gggggccgccccgcccgtcggaccacccagcgcgccgcctcctcctccct

SEQ ID NO: 30964 - DNA, 253 bp, Homo sapiens
  misc_feature 1..253: note = chr7:330425-330678
  misc_feature 1..253: note = hyper
  source 1..253: mol_type = genomic DNA
cgcggggaggggcctccgcaggtcgggaaagagcttctggggtctgggtggcgccggggaccgcgagctgcggggacactttccccaacaccgcctcgctcctccgcctctgcgccccacggcgtcctgcgggatggggggaaggacggggggctgcccggtggagaccccgcctgacccccgggctccgcagctacatcgccttgatcgccatggccattcagcagagccccgcggggagggtgaccctgtc

SEQ ID NO: 30965 - DNA, 27 bp, Homo sapiens
  misc_feature 1..27: note = chr7:330720-330747
  misc_feature 1..27: note = hyper
  source 1..27: mol_type = genomic DNA
cgccaaccagcgcgcctggcagaactc

SEQ ID NO: 30966 - DNA, 30 bp, Homo sapiens
  misc_feature 1..30: note = chr7:560245-560275
  misc_feature 1..30: note = hyper
  source 1..30: mol_type = genomic DNA
agggaaaggagccaccggtgagggtccccc

SEQ ID NO: 30967 - DNA, 163 bp, Homo sapiens; identical to SEQ ID NO: 2953
  misc_feature 1..163: note = chr7:751986-752149
  misc_feature 1..163: note = hyper
  source 1..163: mol_type = genomic DNA

SEQ ID NO: 30968 - DNA, 156 bp, Homo sapiens
  misc_feature 1..156: note = chr7:752150-752306
  misc_feature 1..156: note = hyper
  source 1..156: mol_type = genomic DNA
ccgccctccacgcccgcccccgcgccgcgcgcagctgctgcacccccaacgccgcccgcgcgggcctgcagcccgtctccccccgaccgcctccccgcggggcccccaaccccggcccccacccccggctctccccgcccccgccccatcccccac

SEQ ID NO: 30969 - DNA, 78 bp, Homo sapiens
  misc_feature 1..78: note = chr7:752350-752428
  misc_feature 1..78: note = hyper
  source 1..78: mol_type = genomic DNA
cgccccccgccccctccactcagactctgagtcgcccactccagccggtgcaggccgcggggccgcctctgatggcct

SEQ ID NO: 30970 - DNA, 104 bp, Homo sapiens
  misc_feature 1..104: note = chr7:1126563-1126667
  misc_feature 1..104: note = hyper
  source 1..104: mol_type = genomic DNA
gaagacccacccctccgcctggagagccggggctggcggtgcctgaggaccccttcggcctggacagcccacgcgggcttggggggcctcgctctgccctcatg

SEQ ID NO: 30971 - DNA, 566 bp, Homo sapiens
  misc_feature 1..566: note = chr7:1263707-1264273
  misc_feature 1..566: note = hyper
  source 1..566: mol_type = genomic DNA
cccaggttcggttcccggcttcctggtctttgtttaccaggctccgaggaggacctgcctctctcctcccgcagccctgggccccccactcgacagtttcacatccagggagggacaaagggggacgcggccggattagctttcgcagcgcgcggtgcgttcccggggtgcagctgcttcggggcccctgccaaggctccggcttctgcaggcgggactcgggctcgggccaccaccgcgagcactttcctggccagctccgttcccgccccatcgggccgggccgggccgagctgagcggggcgcggagaccgcggcggacggtggggagagcgcgcgcgcgtccatccgatttcaggcctttgttgccggagcctcgtgccgatgggttaatggggcagaagagatcggtgaagggcgacagaagcggcctttgaaagagggtgtcagcgcggggcagcgagacaaaggccaaaacacacacgggcggagagggacagatggggacgggcgagggaaaacaattaggccgcaagtgcgggggcggggcgcggctccatcgtttt

SEQ ID NO: 30972 - DNA, 321 bp, Homo sapiens
  misc_feature 1..321: note = chr7:1265151-1265472
  misc_feature 1..321: note = hyper
  source 1..321: mol_type = genomic DNA
gggatgacctgagagcgtttcctggaagccgcgcagcccctctcccggcctccaccatcggggccgctcaccctctggggactctggccccgggaccccgggatccaggcccggtgcgcgcggctccggccccgagcgcgctgtccaggctggatccccaccaggcggcgctgcgcccctccgagcccgcccggccgcgctctgcaaaccgatgctgtttaattaacgtgcaaattgagtagattaaatgactctaaataattagccacagatcctacaaacaggataacagatttaattaagcagcgatatagattttgg

SEQ ID NO: 30973 - DNA, 267 bp, Homo sapiens
  misc_feature 1..267: note = chr7:1269197-1269464
  misc_feature 1..267: note = hyper
  source 1..267: mol_type = genomic DNA
cgctccggccgcccccgacccggacccggactccgggcccccagctgggcccaagcgcaggaggccggtcctcacggtgcgcccgggaagggaagggccgagcggcctggagctgccagaggccgcggcccgggcgggggaaggggcaggcggaaggcgggccccggaggtctccggctgggccgggcgcgcgcgcctgggccctttgtctcgcgcggccgtcgggcccggggccccagccctgtgcgctcggggcgaggaggttcc

SEQ ID NO: 30974 - DNA, 127 bp, Homo sapiens
  misc_feature 1..127: note = chr7:1269552-1269679
  misc_feature 1..127: note = hyper
  source 1..127: mol_type = genomic DNA
cgggctggaccgggccggggcgcgtccggcagcgctgagaccccccaccccgaatcaaagtagcggcggctgcgggggcggcgggtgggtgggggggagccgaggaacacggcgaggcgagcggcgt

SEQ ID NO: 30975 - DNA, 455 bp, Homo sapiens
  misc_feature 1..455: note = chr7:1270162-1270617
  misc_feature 1..455: note = hyper
  source 1..455: mol_type = genomic DNA
aggaggttttcggagcgcgagccggcccgacagcatgaaaaacacagggcgattgaaatgcgagcattgggacgcacggagccgccgcggcgcggactcgctcttgaggtcaagtgacggacggattgtatgcttcttcataataatattaattaaacaatttgcatgctaataaggtaacaattatcagggcctctgttgaaagattcgggttattacaacacgccaatctgaaggccaggggtcagagagtgagaggcgagcgaaatttcaactcaaattaacattctgtcagctccagaaaatgggataaataaagtcgaattaattcattataataaagagagatgggcgagggagctcggccggcgcgcgcccctcctctgccctccccccgggccgaatagattacagctctgtattcagaaacacgcgccgcgcgcattcctcctcgc

SEQ ID NO: 30976 - DNA, 82 bp, Homo sapiens
  misc_feature 1..82: note = chr7:1271057-1271139
  misc_feature 1..82: note = hyper
  source 1..82: mol_type = genomic DNA
accccccaccctccccggcccaggcacgggcacctgacccggagggacgcagagatgcgcacggtcccggcctgcccttccc

SEQ ID NO: 30977 - DNA, 30 bp, Homo sapiens
  misc_feature 1..30: note = chr7:1272309-1272339
  misc_feature 1..30: note = hyper
  source 1..30: mol_type = genomic DNA
cccccgcccccagcccgtcttgttgtgaca

SEQ ID NO: 30978 - DNA, 443 bp, Homo sapiens
  misc_feature 1..443: note = chr7:1272543-1272986
  misc_feature 1..443: note = hyper
  source 1..443: mol_type = genomic DNA
ccgggtccctgtctccgccgccgccgcccgcgcctcccgccgctggcccgccccggccccggcccgcgcccccgcgccccgccaccggccccgccggccccccgcgcgagatgatggacggccgcctcctggaacacccgcatgcccagttcgggggctcgctgggcggcgtggtgggcttcccctacccgctgggccaccaccacgtgtacgagctggccgggcaccagctgcagtcggccgccgccgccgcctcggtgcccttctccatcgacggcctgctcgggggctcgtgcgccgccgccgcctcggtggtcaaccccacgccgctgctgccagccgcctgcggggtcggcggggacggccagcccttcaagctgtcaggtaggcgcggcgggcgggagggcggggaggagtgcggctgggggcgggggccctggtcc

SEQ ID NO: 30979 - DNA, 96 bp, Homo sapiens
  misc_feature 1..96: note = chr7:1273204-1273300
  misc_feature 1..96: note = hyper
  source 1..96: mol_type = genomic DNA
ccgcaccaacttcaccggctggcagctggaggagctggagaaggcgttcaacgagagccactatcccgacgtgttcatgcgcgaggcgctggcgct

SEQ ID NO: 30980 - DNA, 366 bp, Homo sapiens
  misc_feature 1..366: note = chr7:1273589-1273955
  misc_feature 1..366: note = hyper
  source 1..366: mol_type = genomic DNA
cgtccgaaccgggaagcggcgtggtgggttggcggaggccgggccaagtgaggtctccaggcaggggcgaggaggggaggaggggccggcttggctccgacccggaggagagagggaaggggacccccccccgcccccgcaccgcctcaaccttccgcgcgaggctctgtcacccagcctggagcgaacgagtctgtttaccttgcgcctgcaaaatattcagatggaaacatgtatttattcatcgctttgcagaagggaacagctgaggaaggggaggcagaagcttaaacagttaacacattgagaaagtgggagaaaaaaaggtgtctgaatttttaataataaccccggtctcatcttttt

SEQ ID NO: 30981 - DNA, 452 bp, Homo sapiens
  misc_feature 1..452: note = chr7:1274473-1274925
  misc_feature 1..452: note = hyper
  source 1..452: mol_type = genomic DNA
ggacaaggctccctgcgacaaggctgggcctgctattgtgcaagtctctgtgtggccgcgacaaagaatccgtattaacgcgccctcctggggagggcaggactgcccgagcttccgcggggctcagacggatttgactgtgtgtgtttggtggctggcggttgagtgagggtgtagcgctgccgtccccggatgtcctgtgtggctccccaggacaaggactgcagagaggatggaagagacgcgatgggcccagcctctccttccggcctggtggtcgcctcttgcctccccacctgccttggccggtggcccaggccaaggaccgcaggtttgggaaggctccgttggcgccctggcccagggtttgcggaaagaaggctgtgttagctgtgccctgggagggaggctgcagaggcccacccaagtacggctccccaggcccttccgga

SEQ ID NO: 30982 - DNA, 113 bp, Homo sapiens
  misc_feature 1..113: note = chr7:1275567-1275680
  misc_feature 1..113: note = hyper
  source 1..113: mol_type = genomic DNA
gcgagcccatggacccggaggagatcgcgcgcaaggagctggagaagatggagaagaagaagcgcaagcacgagaagaagctgctgaagagccagggccgccacttgcactcg

SEQ ID NO: 30983 - skipped

SEQ ID NO: 30984 - DNA, 104 bp, Homo sapiens
  misc_feature 1..104: note = chr7:1276436-1276540
  misc_feature 1..104: note = hyper
  source 1..104: mol_type = genomic DNA
ggggactgcgcggacgcggggaccgccggccccgcgcccccgccgcccgcgccgtcgcccaggcccggccctcggcctcccagccccgccgaggagccggccac

SEQ ID NO: 30985 - DNA, 382 bp, Homo sapiens
  misc_feature 1..382: note = chr7:1277174-1277556
  misc_feature 1..382: note = hyper
  source 1..382: mol_type = genomic DNA
ctccccctcctaccccgcgccgcacacgcacgctcacatccgccgcgcgcccccgcgcgcactggcacacgccggggcgcgcggcgcggggtgacggagccgggggctgcgagggccgggccgctgggctcctgcagagttttgatatgaaagtaattattttccggtggctgctgcggggactgggtttcttgcccaaagggttattatacattaccgatttctagtgatatggaatcacataaacttcctacaataatagaattagcatgaaaggctggggtgtcaaattgaaattggagaataatagcgccggcagctgggggagtgcgtgcgcatattggagcggagatggggaatcgtggggcggaattttcatgag

SEQ ID NO: 30986 - DNA, 115 bp, Homo sapiens
  misc_feature 1..115: note = chr7:1277861-1277976
  misc_feature 1..115: note = hyper
  source 1..115: mol_type = genomic DNA
catcccaaagtgaaccgccacccgtcctccatctccccccacccccccaaaaaccccaacccactggcctcaattttcctgggccctgggtcctcgttgccgcaaaagccaccaa

SEQ ID NO: 30987 - DNA, 431 bp, Homo sapiens
  misc_feature 1..431: note = chr7:1280395-1280826
  misc_feature 1..431: note = hyper
  source 1..431: mol_type = genomic DNA
aaattagccaggcctcgcagtctcctaatgagagggtattatttcggcacctcggaaggagcgtgaaaaatgagagagactccatccggaggtgtcggatcgattcaggatcagggtgtaaattatatacaactaaatatccagccgcccataccgctgcttaatacggagcttagaaatgcaacattaaacaaagattatgagagatcgacgcctctggaccgagcccaattcactgctcagccgggtcagcccctgccccgcgggccgaggatggggagggggcgcgcaaggagtgaaaacggcgagtttgggatgagagccagggccaggaggggagcctcgccctcgctactccttccctttcttctaaagccagggagctccccgcccagcattgcccgttccttcctccccgccagggcccagag

SEQ ID NO: 30988 - DNA, 150 bp, Homo sapiens
  misc_feature 1..150: note = chr7:1281075-1281225
  misc_feature 1..150: note = hyper
  source 1..150: mol_type = genomic DNA
gtttatctcacttagcggtggagggactggagggaaggggcggcccgaagggaggccttggtggggcccagcggctccctggcgcaccccggacacggtggccacgaggagccggggctgtggccgagggctgcccgcaccccgagaccc

SEQ ID NO: 30989 - DNA, 84 bp, Homo sapiens
  misc_feature 1..84: note = chr7:1281471-1281555
  misc_feature 1..84: note = hyper
  source 1..84: mol_type = genomic DNA
cgcccctcgcccagccgtgactccctttcctctcggccgcccgactccgcgcgcccctctcggcttttccgagctgggatcacc

SEQ ID NO: 30990 - DNA, 268 bp, Homo sapiens
  misc_feature 1..268: note = chr7:1281876-1282144
  misc_feature 1..268: note = hyper
  source 1..268: mol_type = genomic DNA
tcggaaagtttgcagcgtttcccgagcagcgcgggcaaggccggacctgcggtggagccggcacctgccgctccgcccgggattagggagctcccggcttgtggggggtgcgggcggccggtggtccagctcgcccgccccggccgagacgctgggcccggcccccacaggctgcgcctgacgggaccggcgggaggcctttgttcgcagcccggaggccccaggctccaaaccacactcgggctgcggggagcgagcgcgggcgttg

SEQ ID NO: 30991 - DNA, 109 bp, Homo sapiens
  misc_feature 1..109: note = chr7:1282572-1282681
  misc_feature 1..109: note = hyper
  source 1..109: mol_type = genomic DNA
cctaagatcacacagcgtcccagaggccttactgggcaggggagggggtggcccggccgggccctcgcgcgccggcttctgctgattctttctgcggcctgataataag

SEQ ID NO: 30992 - DNA, 170 bp, Homo sapiens
  misc_feature 1..170: note = chr7:1283626-1283796
  misc_feature 1..170: note = hyper
  source 1..170: mol_type = genomic DNA
gacacaggggctttccgggatcgaaaggtgtttcttccctttctaagtcacgtcaggccacctccgaccccagccgacacgctaccaggcctgcaccatagaagtgggctctgagagtgttcccaagccctgggggagggggactccccagagatcgtgtccccgacccc

SEQ ID NO: 30993 - DNA, 30 bp, Homo sapiens
  misc_feature 1..30: note = chr7:1284194-1284224
  misc_feature 1..30: note = hyper
  source 1..30: mol_type = genomic DNA
ggggaattcaattttcgctgaatggtgaga

SEQ ID NO: 30994 - DNA, 104 bp, Homo sapiens
  misc_feature 1..104: note = chr7:1286007-1286111
  misc_feature 1..104: note = hyper
  source 1..104: mol_type = genomic DNA
tttgttcttgttatccgtgataattgcgaagttcagcctctcggaattgggccggcctggtgcctccagcgccgggcagggcgggcagaggccgggctgggagg

SEQ ID NO: 30995 - DNA, 287 bp, Homo sapiens
  misc_feature 1..287: note = chr7:1286886-1287173
  misc_feature 1..287: note = hyper
  source 1..287: mol_type = genomic DNA
cgaagggagtcgccgggtacccggctcaggccgtgtctgagcgccagggatgcgcagaaatgggagcctggccgcgcctctgcagcggccttggaggagcctctggagcgggccccgcgggcgcgtggggtgggacctgctggagacccgcaggcggcggcggccaagcagggtcaggcggttggcaccacaggtcgcgccctcggctgcagtcggggcagctccagggggccgcgtacctcccgcttcacggctacgcgtgggggcggctccgtcctggcctcacc

SEQ ID NO: 30996 - DNA, 30 bp, Homo sapiens
  misc_feature 1..30: note = chr7:1288109-1288139
  misc_feature 1..30: note = hyper
  source 1..30: mol_type = genomic DNA
ttcggtgctgaggtgcgtgtaggcagggca

SEQ ID NO: 30997 - DNA, 283 bp, Homo sapiens
  misc_feature 1..283: note = chr7:1288552-1288835
  misc_feature 1..283: note = hyper
  source 1..283: mol_type = genomic DNA
tctgagggagctttccgtgggatggctgggcctctgttgcagttgcgaccaatgctgcggtttaaattctccctgggtccaatcctgcttccctcccctaagcctctcgcacacacacctcggctcaggctattcaccgggaaagccacgcggaggcagggcaggcagcgccccgccagagacccccggatggtggagatggtgcggtggagtcgggactgctgggggcacctgctgatgaggtgggagggtaaagccacgggggatgcgggtttctggactt

SEQ ID NO: 30998 - DNA, 122 bp, Homo sapiens; identical to SEQ ID NO: 8836
  misc_feature 1..122: note = chr7:1289414-1289536
  misc_feature 1..122: note = hyper
  source 1..122: mol_type = genomic DNA

SEQ ID NO: 30999 - DNA, 270 bp, Homo sapiens
  misc_feature 1..270: note = chr7:1408501-1408771
  misc_feature 1..270: note = hyper
  source 1..270: mol_type = genomic DNA
cccgcccctgcctggcgagtgcagattcccgcctattttccgacacccgcctgcagaggagtcgggcgccagatgggatcgaacccagcaaggtgagaaatccgggcggggtggcagatggggaggccttccccggggaactccaggagaggggaggacagcgagggccccgggcgcggcctctcgtgtgcccccagccgcggggcgcaggcccgcagccccccaggggcgccgcagctgtcactccgcggtgagtggcgccatccggat

SEQ ID NO: 31000 - DNA, 201 bp, Homo sapiens
  misc_feature 1..201: note = chr7:1408874-1409075
  misc_feature 1..201: note = hyper
  source 1..201: mol_type = genomic DNA
cgcggaccccggcccatcccggaccccgcccaccgcggacctcacccatcctaggccccgcccatcccagacaccggcccatccctgaccccgcccgtccctagccccgcccaccaccgaccccacccctccagaccacgcctatcccaggccctgcccaccgcggaccccgcccatcctgcaccccgcccaccacggacc

SEQ ID NO: 31001 - DNA, 144 bp, Homo sapiens
  misc_feature 1..144: note = chr7:1443541-1443685
  misc_feature 1..144: note = hyper
  source 1..144: mol_type = genomic DNA
gggtggcgcctggcccggcatccacactcctggtgagctctgtttgttttcataaccaattcaatatttaagacccggccagccgcggccgcaagctctccagctcccccttcctttgtctctgccgctccctgcaccccgcct

SEQ ID NO: 31002 - DNA, 15 bp, Homo sapiens
  misc_feature 1..15: note = chr7:1443733-1443748
  misc_feature 1..15: note = hyper
  source 1..15: mol_type = genomic DNA
cggctggtctctttc

SEQ ID NO: 31003 - DNA, 616 bp, Homo sapiens
  misc_feature 1..616: note = chr7:1704139-1704755
  misc_feature 1..616: note = hyper
  source 1..616: mol_type = genomic DNA
aggccgttggacccacgtccggacaggagccccgcgcgcccatccccggcccggccatcctcggggcgcgctgtctgcggcctcccgcgccacccccacccctgtcccgggacctcctccgggaaagacacccggggagcagccccctcccctccagtagtcccctcccctcccctctccctgccctcttgacggtgtggggctccccggccggaggggcgcggcgctggcagcggggtccagagtgtcgcgcccagcgcgcgctgggggtcccgggctccgcagctccgcacgcggccggtttgtgaagcggcgcgcgggggcttagccgggcgagggcgctcttgagcctggtttggaatttttagcccacacgaaagccgcaggctggggaaggggcgggtgggagcgggagacgccctgggaagccgtgagaccgctcggcgagggctcgggaccaccagggagcgacgggggacccctcggctcagagcccgagggcgcgatttcggatccgctgggattccggaggcacatgaagggagagggaaatccgctaaaccgaaccttccgggaatcggaaggcgccgggccgctcccacgcctccccctcctc

SEQ ID NO: 31004 - DNA, 138 bp, Homo sapiens
  misc_feature 1..138: note = chr7:1704984-1705122
  misc_feature 1..138: note = hyper
  source 1..138: mol_type = genomic DNA
tggggtcaacttccacgaggttgccgggcgcctgtgagcacagccgtgtccccacccaggggcccacctcccagcgccaccagggtcccgacccccagaccttcggacgcttctcttccaaaccgaagcctgggagcc

SEQ ID NO: 31005 - DNA, 198 bp, Homo sapiens
  misc_feature 1..198: note = chr7:1705412-1705610
  misc_feature 1..198: note = hyper
  source 1..198: mol_type = genomic DNA
cggccgccaccactgcgcccgcgcccgagcccgagtcggagccggagccgccgctcccccgcctgcccggccagccccgggctccgagcgcgcggtccccgccgccgccgccccgcgctcgccccgcgcttgacgcagtgagcgccgcagcctggctcccgccggctccgctgggctccgggtcgcaggccgagtcca

SEQ ID NO: 31006 - DNA, 183 bp, Homo sapiens
  misc_feature 1..183: note = chr7:1706209-1706392
  misc_feature 1..183: note = hyper
  source 1..183: mol_type = genomic DNA
gcgccgcggggaccccgaaactttccggagcgcgctgagagcaaaaagccggctgggcagaaagagggggagggggctgggcgcgccttcgagtgcgctggggtagccgcggcgccccaagttgaaccacagacgaacccctcttcatctgaaacctggtctcggagtcggaggtggggaggg

SEQ ID NO: 31007 - DNA, 82 bp, Homo sapiens
  misc_feature 1..82: note = chr7:1706634-1706716
  misc_feature 1..82: note = hyper
  source 1..82: mol_type = genomic DNA
ggctgccgagtggggcgggaccccggggcccagagcggacccccagctctcctggtccctcttccgccgctcttccctccct

SEQ ID NO: 31008 - DNA, 274 bp, Homo sapiens
  misc_feature 1..274: note = chr7:1706985-1707259
  misc_feature 1..274: note = hyper
  source 1..274: mol_type = genomic DNA
ggccccatctgagggcggggagaggtcgctgggggcagcttcgggggttgtggagggcaggggggacccgcgaagctcctggagcgtttagggatgcagctcgggcggcgtgtgcagggaggaagcagcgtcccggcgtccccccttcagcgtcgccttcgcgcgcctcgagggcccaggagggttcggtctcccccaccccacctggacactcaggtctgagcctgagtggatttgaggatctgggggacggggaatacggagtccttcttcc

SEQ ID NO: 31009 - DNA, 488 bp, Homo sapiens
  misc_feature 1..488: note = chr7:1709074-1709562
  misc_feature 1..488: note = hyper
  source 1..488: mol_type = genomic DNA
ccgccggggcctgcccggcccgagcgtggagtcccgaggctcctgccgggggtccaggctgcccctggggctctgccttcgacgcgctgtgtagggccagattctgggcctctcttgactcagtttcccttcctgtaacatgcggacgggggcttccgcacaggcaggttgtcagggtgaaactgagccgaagagtgctccagaaccccctgaagtcctcacagaggttggggtgaatgaaggaaggaagcggggccagggctgggcagaggaggcccggcctgcgccctgcgttctccgcccctaggtccctgccctcccggataaggggcggaccgacgggaggacctgagaacgccttggctttgcttgaggtggtgggagtcgcgggtagcttgttcagccaacagctgtcgcccccactccccccacccacccacccaccccctccaccttttagatgtgggcggggagggccggggacggac

SEQ ID NO: 31010 - DNA, 306 bp, Homo sapiens
  misc_feature 1..306: note = chr7:1709617-1709923
  misc_feature 1..306: note = hyper
  source 1..306: mol_type = genomic DNA
cgtcgccgggagagggaaggagcgggttgccgcggggagccgaggagagcagggggctcgggaggccagggagagaaggggagggccagaggctccgagccggactcgcggcggaggaagagggggtggaagggagcgcgcaggcgggcgagggagcgagggagggagagaaggagggagggagggagggaaggggggcgggagggggcagggcgagcttgaattcccccccggccgcgcggcgaggggcggggccgcgcgcgcagatcgatgggcgaagctggggaggaatttcaatcccgggag

SEQ ID NO: 31011 - DNA, 289 bp, Homo sapiens; identical to SEQ ID NO: 8844
  misc_feature 1..289: note = chr7:1709955-1710244
  misc_feature 1..289: note = hyper
  source 1..289: mol_type = genomic DNA

SEQ ID NO: 31012 - DNA, 46 bp, Homo sapiens
  misc_feature 1..46: note = chr7:1710324-1710370
  misc_feature 1..46: note = hyper
  source 1..46: mol_type = genomic DNA
cgtccgcaccctgcccggcgccccccagacgcggccccctgccctt

SEQ ID NO: 31013 - DNA, 386 bp, Homo sapiens
  misc_feature 1..386: note = chr7:2727866-2728252
  misc_feature 1..386: note = hyper
  source 1..386: mol_type = genomic DNA
ctgctgcccggggctcggtgcccggcgcggcctctgccggctccggcgggcgcgggactgcgaggtaggggggcgcgcggggaagactcgggggcgcagggaccgagagggacctccgtgccggggcgggtgggtaggggcagctccgggtccagcccggcccgcgcaccaagtcccgagggcgcccgggcggcggcggctacgggcgcgcggggaccgcggagacgcgaagggcgcacttggcgagggtttggtgcagcgccgcgccggggtccgcacagccccggcaggtcctgcagagggaaggccgggccagggaagggccacgcgccccctccccgccatcctctcccaggccagggcgacctgcgcgcttcccgatggga

SEQ ID NO: 31014 - DNA, 45 bp, Homo sapiens
  misc_feature 1..45: note = chr7:3083160-3083205
  misc_feature 1..45: note = hyper
  source 1..45: mol_type = genomic DNA
actcccatcccccgacgccccccccgccaccgtgtcatctcactg

SEQ ID NO: 31015 - DNA, 34 bp, Homo sapiens
  misc_feature 1..34: note = chr7:3083407-3083441
  misc_feature 1..34: note = hyper
  source 1..34: mol_type = genomic DNA
tcctccgaggggcgccgcccgcccaggggctgca

SEQ ID NO: 31016 - DNA, 584 bp, Homo sapiens
  misc_feature 1..584: note = chr7:3340231-3340815
  misc_feature 1..584: note = hyper
  source 1..584: mol_type = genomic DNA
cccgccctcctccagcgccggccaaaagtgaccttggacgcttctacaatgccatatccactcctctgaacaggaggcgagtttgcacccagtggtgcctttggttgctagaaattaaaaacccgattgcgcgtgtttgcaattacggtaacttggcgcgtcacccccaagcactgagctagctggtggtagccgggcgcctctcggggcgcgccctattccgccctcggccctgggctgccgcacgatctgcgcgtcctgctgcacctgagcccttcccactcgggcgcccgcaccgctgcggggccgggcgaggatgcaccacccccgcccgcgagcccgccacgggagcgcgtgccgaatcgacgccgcctgcagtccccactacgggtccctagggggcgcagccggcgcgggaagccgcccgagccaggcgccgcggccggcacaaaattgcaggcgggcgggcgccgcgactttgaaaacaagcgagggcctggggggcgggccctgggagcgggcgccgcctccctcggccaatcaacggcgggcggcgggcggcgggcgcgggcggcgcgtgcggc

SEQ ID NO: 31017 - DNA, 123 bp, Homo sapiens
  misc_feature 1..123: note = chr7:3341286-3341409
  misc_feature 1..123: note = hyper
  source 1..123: mol_type = genomic DNA
gggccccgggcggccgcggggatccccgcccggccgcgcccgcccctcgctggcgccgcgccccggcccggagccctcgcgaccccgggcggcgcccgagacctccggcggggacacggcggg

SEQ ID NO: 31018 - DNA, 417 bp, Homo sapiens
  misc_feature 1..417: note = chr7:3341569-3341986
  misc_feature 1..417: note = hyper
  source 1..417: mol_type = genomic DNA
cgaacttgagcagcgagagtgtgtccggggtccccccgcttcccggcccgggtcgggatgcgccttgctgggggctctagggagcccaggggctcctccacgccagactcggaggagagggaaacggagccccgtagagcctgcaccccgtctgctactttgcgttttattttttttataccgcagtagcacaaacaaaaatttttaagttgaggacccatttctcagctccttaaaaggatgcccgagtccccttcccattgcatggatgaaaaaggggctggtctgtacctgagtcttcgcaccgcagggtctggtttccggtgagtgacatccagaagacttggaaatatcaagtgccagtcgctgtgaaaagccttttccagcccctccccagggcctcgtcctctccccagc

SEQ ID NO: 31019 - DNA, 68 bp, Homo sapiens
  misc_feature 1..68: note = chr7:4785735-4785803
  misc_feature 1..68: note = hyper
  source 1..68: mol_type = genomic DNA
tcctgatttctccaacgtggagatcaaaaatgaaagtaactcgtacaattcggcgaaggtcagcagta

SEQ ID NO: 31020 - DNA, 112 bp, Homo sapiens
  misc_feature 1..112: note = chr7:4837872-4837984
  misc_feature 1..112: note = hyper
  source 1..112: mol_type = genomic DNA
agggcgcggggcggacgcgctgcacctcgccgtagcgcacaccagggggcagcgtggagctgcacgaggcccagggcctgggacagacccaggacaccgatctggggacccc

SEQ ID NO: 31021 - DNA, 103 bp, Homo sapiens
  misc_feature 1..103: note = chr7:4922604-4922707
  misc_feature 1..103: note = hyper
  source 1..103: mol_type = genomic DNA
gaggccccaggagctcggctcagcatctgttatcttggatgcagtatttgtcgaggggctggaaatggtacataaatagccgggaaacaatgctttgagctgg

SEQ ID NO: 31022 - DNA, 135 bp, Homo sapiens
  misc_feature 1..135: note = chr7:4922839-4922974
  misc_feature 1..135: note = hyper
  source 1..135: mol_type = genomic DNA
ggacgaagctccccctccagggcacagccgggaaaactgagggccgagagtcccctggagttgggggtccggggcccacgcggacagccaggctcaggagctctcgggggtcggcagcgcggacccccggatccc

SEQ ID NO: 31023 - DNA, 302 bp, Homo sapiens
  misc_feature 1..302: note = chr7:4923327-4923629
  misc_feature 1..302: note = hyper
  source 1..302: mol_type = genomic DNA
ggcggcgcaacgggcggggcggggcctcaaggggacggggccacaaagggtggggcgggggagaacaggtgggctggagctgggcctcggcgcccaataggcagaaagaaagcctcgaggaggcggggtctccaggagaggggcggggccaacctgctagaaaaggcgggctgtgctctggcgcctcctgccggccgcccaatggacggggatgcagcctcgagggggcggggcctcaccggagaggcggggttttgaagaaaggggtggggctggttgtggagaggcgggacttgcagccc

SEQ ID NO: 31024 - DNA, 386 bp, Homo sapiens; identical to SEQ ID NO: 2958
  misc_feature 1..386: note = chr7:4998201-4998587
  misc_feature 1..386: note = hyper
  source 1..386: mol_type = genomic DNA

SEQ ID NO: 31025 - DNA, 121 bp, Homo sapiens
  misc_feature 1..121: note = chr7:4998770-4998891
  misc_feature 1..121: note = hyper
  source 1..121: mol_type = genomic DNA
cggcgcccggagccggagccggagcccgagccggagctggaggcgcccggagccgccgacgccaaatcccgagcagatggtggcgggggcggggcgggcgggggcacgggggggctcccgg

SEQ ID NO: 31026 - DNA, 30 bp, Homo sapiens
  misc_feature 1..30: note = chr7:5459075-5459105
  misc_feature 1..30: note = hyper
  source 1..30: mol_type = genomic DNA
gacccaaaagacacacgcatgcacacacac

SEQ ID NO: 31027 - DNA, 30 bp, Homo sapiens
  misc_feature 1..30: note = chr7:5467207-5467237
  misc_feature 1..30: note = hyper
  source 1..30: mol_type = genomic DNA
tctctctcaattcggcgttgaacccggttc

SEQ ID NO: 31028 - DNA, 400 bp, Homo sapiens
  misc_feature 1..400: note = chr7:5467505-5467905
  misc_feature 1..400: note = hyper
  source 1..400: mol_type = genomic DNA
cgtgtctggcgggcgcggctaaaacccggagaggctgtgcccgggaaagccacgttcgccgtcccctcgctgcgacaggcccagccgcgatacagcgccaagtctaggtcgggccaacccagccaggagctgcccggacctgcctgaaagaccagggacgcggcgccagcgccccacaccccaccgagaccagggcgcaaggcgggcagaattcggactgatgcgccaggcccagccccgatggattccagctcctctcggccccgcctccggccctggcctcttcctccagccggggtcgggtcctccactccactgtttggctgggaaaggaccgagacgcgctcagtgcacagggggccggctgcggccataaatctccgggcgggccctccttccc

SEQ ID NO: 31029 - DNA, 105 bp, Homo sapiens
  misc_feature 1..105: note = chr7:5526299-5526404
  misc_feature 1..105: note = hyper
  source 1..105: mol_type = genomic DNA
aagaaaaagaagagacggcggccgatacccagtcgtgtgtgaaggtgagtctgtcagagacaggagggtgatggccatcaaaaaaggcagcgcggtcaccagcaa

SEQ ID NO: 31030 - DNA, 72 bp, Homo sapiens
  misc_feature 1..72: note = chr7:5632917-5632989
  misc_feature 1..72: note = hyper
  source 1..72: mol_type = genomic DNA
ccgcctgtcctgcttcgcgcagacggtgtcccccgccgagaagtggagcgtgcacatcgccatgcaccctca

SEQ ID NO: 31031 - DNA, 35 bp, Homo sapiens
  misc_feature 1..35: note = chr7:5635640-5635675
  misc_feature 1..35: note = hyper
  source 1..35: mol_type = genomic DNA
gaaagggatgtgggacggcgcgggggtgggggtac

SEQ ID NO: 31032 - DNA, 72 bp, Homo sapiens
  misc_feature 1..72: note = chr7:6543150-6543222
  misc_feature 1..72: note = hyper
  source 1..72: mol_type = genomic DNA
ggcggccgggcgcctcgcggaaggcctggtagcgctgctcctcgtcggcgtcgggcgcgaagagcagcagct

SEQ ID NO: 31033 - DNA, 107 bp, Homo sapiens
  misc_feature 1..107: note = chr7:6566129-6566236
  misc_feature 1..107: note = hyper
  source 1..107: mol_type = genomic DNA
agtgcctgtgagccccgcgtacctgcgcgcgcccccggggccggcgaggccgcccaccagcaaggaggccctgcgcgggggcggctcatcggggcggcgcggcgggg

SEQ ID NO: 31034 - DNA, 320 bp, Homo sapiens
  misc_feature 1..320: note = chr7:6566246-6566566
  misc_feature 1..320: note = hyper
  source 1..320: mol_type = genomic DNA
cgtggacaccaggaggcgctccggccgctcctcgctgcggctccggcgcagtcgctgcgcgccctgggcccggcgtgcgcggcacagcttgcccaggaggccctgagacaccacctcgtcgaagcgcgcccggtgcttcttggggatgaagatcctgccggcgaggacggcggagtcggggcgcgttcccggaccccggatctctgcaaaccgcggcccgaaggcgcgtcctcgcgggcgccgccctaggctctcccacctcttcctaggagtggcggagggctggggggatcgggatgagcagccggtagcaccccagt

SEQ ID NO: 31035 - DNA, 409 bp, Homo sapiens
  misc_feature 1..409: note = chr7:6570454-6570863
  misc_feature 1..409: note = hyper
  source 1..409: mol_type = genomic DNA
gactctttagggccacgcacgggttctgagcgcccaacgcttagacctcgccgccccggtacccaccgagtttatttccaacctccctgggcctcgggctccgcccaggctcggagggtgcccacccagggcagggaagcccctccacgctccagccccacccgctttcagaccagcccgaggcggatccgtggcgcagagggcgcacggttcccggaggcgcgggacgcgatggggaagctaccgaaagtgccgagagaagccctggtccttccccatctggagccggggaccgcggcgcggcaggtgccgaagggcagggggtagccgagcccaggaatggagcgagcgcgccgcgactccacgcacctctgccctgcgagcgcgcgcggcccctcccgagccgtcc

SEQ ID NO: 31036 - DNA, 277 bp, Homo sapiens
  misc_feature 1..277: note = chr7:6570900-6571177
  misc_feature 1..277: note = hyper
  source 1..277: mol_type = genomic DNA
cgccccctccaggtagccccgcctctgccctgctgggacccttttggtcgctctggggtgcagcggaaactggcggcggtttgaagccgccgcgctcactccccttggctctctccgttattcccttcccaggatcctcgcctgcgtcctctccagctactgcgccccggacccccacacagtggcgagtccccgcagttcagaggaagccccgacggcctttggtagaacatgcaatattttccggaggggatgccctttacgctgggcctccagg

SEQ ID NO: 31037 - DNA, 48 bp, Homo sapiens
  misc_feature 1..48: note = chr7:6576049-6576097
  misc_feature 1..48: note = hyper
  source 1..48: mol_type = genomic DNA
gcgccctgcccgacccgctgccgcagctgccggcggcttggggaccag

SEQ ID NO: 31038 - DNA, 357 bp, Homo sapiens
  misc_feature 1..357: note = chr7:6654798-6655155
  misc_feature 1..357: note = hyper
  source 1..357: mol_type = genomic DNA
cgcctactccctctccgagtgccatcgaattgtgtgctaattagccacaatttgcaccgcggcaggggcgccccgaggccacgcctgccctctagggggtggcagggatcgggttgggtaccccccacccagacacccaggcagtgacagtcgccaaccccgtggcgcgaggacacgcgcagcagggatgcggcacagcgcgcgctgcgctcggcaccggccagcccgggacgccccaggggccgccgcatcgtgtcccccgggccgggtgagtggccgggccgggaatggttaagcccaccgagctgcggctgcctagagcggcggcggcgacggcggcggcggcggcgggggccg

SEQ ID NO: 31039 - DNA, 30 bp, Homo sapiens
  misc_feature 1..30: note = chr7:6655418-6655448
  misc_feature 1..30: note = hyper
  source 1..30: mol_type = genomic DNA
gccgccgaccccaggcggggccaccccgtg

SEQ ID NO: 31040 - DNA, 30 bp, Homo sapiens
  misc_feature 1..30: note = chr7:6655736-6655766
  misc_feature 1..30: note = hyper
  source 1..30: mol_type = genomic DNA
ccgtggccttcacctcgcagcctctgctga

SEQ ID NO: 31041 - DNA, 153 bp, Homo sapiens
  misc_feature 1..153: note = chr7:6703555-6703708
  misc_feature 1..153: note = hyper
  source 1..153: mol_type = genomic DNA
gtggagcctcctgcccgggcctgtgtcgcggcagagcctggcgggctttgtgcgcaggcgcttgcggcttcgcggggctgaccgtgcgcttcgcctgcggggtcgtgctggggcggcgggtgagcctggggggctgcagagcgggcgcggggc

SEQ ID NO: 31042 - DNA, 94 bp, Homo sapiens; identical to SEQ ID NO: 8858
  misc_feature 1..94: note = chr7:6703709-6703803
  misc_feature 1..94: note = hyper
  source 1..94: mol_type = genomic DNA

SEQ ID NO: 31043 - DNA, 66 bp, Homo sapiens; identical to SEQ ID NO: 8859
  misc_feature 1..66: note = chr7:6703804-6703870
  misc_feature 1..66: note = hyper
  source 1..66: mol_type = genomic DNA

SEQ ID NO: 31044 - DNA, 173 bp, Homo sapiens; identical to SEQ ID NO: 8860
  misc_feature 1..173: note = chr7:6703915-6704088
  misc_feature 1..173: note = hyper
  source 1..173: mol_type = genomic DNA

SEQ ID NO: 31045 - DNA, 223 bp, Homo sapiens
  misc_feature 1..223: note = chr7:8473070-8473293
  misc_feature 1..223: note = hyper
  source 1..223: mol_type = genomic DNA
agagacagccagagtcggagcacagaggccgagtctgggagacgctggttgagtgggaggtgtcagtagcgagggaggtggtgacggctcgaagcatcccccgtcctcctcctcccccttcacgctcagcccagccggcggcgaggagtccagaggccaaggtcgcccagtcctctcggctgtctcgagctgaatggctggcagtctgcggctcccccgcctc

SEQ ID NO: 31046 - DNA, 607 bp, Homo sapiens; identical to SEQ ID NO: 629
  misc_feature 1..607: note = chr7:8473635-8474242
  misc_feature 1..607: note = hyper
  source 1..607: mol_type = genomic DNA

SEQ ID NO: 31047 - DNA, 47 bp, Homo sapiens; identical to SEQ ID NO: 630
  misc_feature 1..47: note = chr7:8474515-8474562
  misc_feature 1..47: note = hyper
  source 1..47: mol_type = genomic DNA

SEQ ID NO: 31048 - DNA, 271 bp, Homo sapiens
  misc_feature 1..271: note = chr7:8474839-8475110
  misc_feature 1..271: note = hyper
  source 1..271: mol_type = genomic DNA
cactgccagggctggcgaagaaccagccgccgcctttagtccgagccgccgggccacccaacacaagggcaggtctcgctgccggagaagcctgggctccgaaccagcctgcacgcggctcagtgtgctccgccgcctgggaactcgcacccgaggagcgcagggggcaaggagcccctcaccctccctctcgtccgcccgcccgcctccccagctgcggaccgcgcgcttgctggtctcaggcgctggatttactcgcttttcaattttt

SEQ ID NO: 31049 - DNA, 119 bp, Homo sapiens
  misc_feature 1..119: note = chr7:8475321-8475440
  misc_feature 1..119: note = hyper
  source 1..119: mol_type = genomic DNA
aggaagtttgagacgcgggagaatgcaggctgcgtgctggtacgtgcttttcctcctgcagcccaccgtctacttggtaagtcttggaaggttcggggctttcgcatttttaccccggc

SEQ ID NO: 31050 - DNA, 107 bp, Homo sapiens
  misc_feature 1..107: note = chr7:8476614-8476721
  misc_feature 1..107: note = hyper
  source 1..107: mol_type = genomic DNA
gaatgtgtatttaaccgatttcagcttcaatccaagaaccctcaatgttgcctgtctttgcccctttatcgcctgaccgtagcagccgcggacgccagagggcgctg

SEQ ID NO: 31051 - DNA, 264 bp, Homo sapiens; identical to SEQ ID NO: 631
  misc_feature 1..264: note = chr7:8480763-8481027
  misc_feature 1..264: note = hyper
  source 1..264: mol_type = genomic DNA

SEQ ID NO: 31052 - DNA, 959 bp, Homo sapiens
  misc_feature 1..959: note = chr7:8481339-8482298
  misc_feature 1..959: note = hyper
  source 1..959: mol_type = genomic DNA
gataatatattttggcggcttcttcaaacccctccgcgcgcccaagagcgcgtttgcgcattttccaagtttgccctgccctcgcgggttggtggctgttgtttaaacttctgatgagcgcgctgcgtttctgctacgggatgaaaacctaattacctcctctgcaaagagctttccctagtatattttattgattgcggaggtgggagccggcagggggtctgtgggggtgggcggggaggggattctcttgctccggtgccctctgttgccgaaagttccttaggcgtctagtcaggggttcggggtggtggaaagcgagatggcgttgggagccagggcgttgggacggcacaagcagtggggtcccaggagcagcaagacagtagctcctctcgggccacggcttacgaaaagctttcctagctccttcttcctataaattaatgagggtattttactcgttcaagccggaaatacgatggggagggggagacacaggccgcatccagagcgcatcgcctcatctgcatgagaatggagaaccgggaggcttttcttgtactgtttctttctcccacaataagacaaattgctgcttagaaaaactgagtgtttccttagaaactggcttgcgggagctctgcgcgtccccgctgaacctgcctctggccgcgcctcgccatcacccccgccgccctaatggattctgaagcgaaggatcctagctgccgcggctaagggcgcagggggaggccgcgcgtcctcgccacaccggaaggagagggcatccggctcacacatcccaccctatgtcttagaccccgtcctcacacattgactttaaaaggccattttccttcgtcttctacaagaagcaagaaacttttttcgacgtaggcttcataccctcccttcggaaactcagtccgctgaccaaagccgcagtgttcaggccc

SEQ ID NO: 31053 - DNA, 156 bp, Homo sapiens; identical to SEQ ID NO: 2965
  misc_feature 1..156: note = chr7:8482669-8482825
  misc_feature 1..156: note = hyper
  source 1..156: mol_type = genomic DNA

SEQ ID NO: 31054 - DNA, 1107 bp, Homo sapiens
  misc_feature 1..1107: note = chr7:8482884-8483991
  misc_feature 1..1107: note = hyper
  source 1..1107: mol_type = genomic DNA
cgtgatcaccacggagattttgcgaatccttcttttccccaacttctccccctacccagtctcccattctttcacagttcattaaatctacccctcccccgaaacagaaacgtgaaggctgtaacgaagagctagaagtgtctctagtaatgtaaaagtctcaactgacagacaaggaaactgaggcaaccaacttattcgcaagagtaaaaccctatggggagaagcgattcctgcccctcttcccccggcgaggaacacggctggagccacccaggcgccttccaggctaaggcgcctttagcggcgcgcaggggtgagggagagggtggggagagtcctaattattatgaatttctaaaggcgcagtaattattcacggggagcaggacaaaccatggctaggcagggaaatcgatatatttgctatcgaaagttcctggctcgcctttaatgcagacgaatgggggatgcagcctcattattttccgtggttaggctcgccagcgtggggcctgatgcagcgtgaaatctatcatcattagacccgggatggagcggcgggggggagtttctctttacttaccaaaccgcaacaacaaacaaacaacgacgaacaaccgccccctacaaacactcattctcacacaacgttgccctacctccctcgccgcttgccctggccgctgttgcacactcccctgggggctgtctgcacgccctagagcagacactgcggtcacttaaagtgcgcccagttcctccaccgcagcggtcacaccgttgatttgatccagaaataagacggatagtaccgagcgttggcgctaggggttgtctatgtcaaaggcgaaggttggctgggaagttctgtccgtttctcttgccttagcataggagtcaatccttttcttgtcacccgattctgcaaattctcgctgtattaaaggagcagagatctggcatgtagtgctccattaacccgtagcataagttagctcggacataaggcaagccctcgagaagggaacgaatcagaaggtgaaaagagcggtcggaaggtgaggaagagaaggtttaggcgcaacgcctcggaggtattctctg

SEQ ID NO: 31055 - DNA, 465 bp, Homo sapiens
  misc_feature 1..465: note = chr7:11871392-11871857
  misc_feature 1..465: note = hyper
  source 1..465: mol_type = genomic DNA
cagatagagggtgggcgcctccgcctcgccctgcgccgcagccctgccggcgcccgggcgtagcagcagcagcaggagcagcggcagcggcagcggcagcggcagcagctgcaggacgccccggcgcggccccgcagcgccccggctcccggacgcccagcgcctggcttgcagccccatgccgcctgcagccactccagggtccagagccgtagcacgctcggcagggaatttttctccgctcttggaacgtcttttcaaagagtacagaaagcaaagctctttcctgctattgttcgcttcagatgagaaggagggagagcgcgtctaacaccagggaacaatagcgtccgcggtggtggccgtggccgctgccgccgccgccgccgcctctggcggggatgctgctgccgctgccattcctcgcagaatggcaggtcccggcggctccggaggcaactgtcc

SEQ ID NO: 31056 - DNA, 303 bp, Homo sapiens
  misc_feature 1..303: note = chr7:12151170-12151473
  misc_feature 1..303: note = hyper
  source 1..303: mol_type = genomic DNA
gggatctgggcagagcgtgggagggcctgtggggcctggggttctctctgcgcacgaaatccggggcgggcactatgtgattcgagcccgctgcgccctgggctcctcgtgtcgcccgcggggaaaggaggagggagactgctcacatggcccacttcgcggcctgagatggagtgcgcgcagggcgtcagggcagagggaggcggggattcaggataaagagcggcctgatgcccagagccgggtgcccggacctcctgcctcctgcttctgatccctgcaagccgcccaccctgcgatcgc

SEQ ID NO: 31057 - DNA, 185 bp, Homo sapiens
  misc_feature 1..185: note = chr7:12151523-12151708
  misc_feature 1..185: note = hyper
  source 1..185: mol_type = genomic DNA
cgtcgccggtcctgtgcgcctctggtggcgcgtgcgccctgtccttccctgcccaagagggagaaccctcagtgccccagcctcagctctgcgcacagcggtcccctgcatgtccgcactcctgttctgtactgcacgctcgccagagcacagagccccatgtcccattgcgagggtcccacaga

SEQ ID NO: 31058 - DNA, 424 bp, Homo sapiens
  misc_feature 1..424: note = chr7:12443294-12443718
  misc_feature 1..424: note = hyper
  source 1..424: mol_type = genomic DNA
ggccaggaacatcagcgcgatcaccagcacgcaggctccgccaggcatcgctgcttccgcaggtggggcgaaaggcgtcgcagagcccgggccgcgggtgccaggaggatggggccacagcagcccctcgggcctcctttcttggattttctcagtctgttgctgcttggaacagggaagctccgcgtcctcgttctggggtgcacccagtcctttcgtgggatagagccttcgcgtaatccgtctgcgactcctcccttcccattttggctgctggctgacctgaaagccacgcccaacctgtccccatagcccagcgtgtaccggcagtggctccgccgccttggatgtcaccgtgcagtcgcacagccaggagtcaagctacagggatgtagctctccgcccgctgcgtcttgctgttcta

SEQ ID NO: 31059 - DNA, 30 bp, Homo sapiens
  misc_feature 1..30: note = chr7:12610212-12610242
  misc_feature 1..30: note = hyper
  source 1..30: mol_type = genomic DNA
cagcgctgcgctccccgtgggaagcgatcg

SEQ ID NO: 31060 - DNA, 34 bp, Homo sapiens
  misc_feature 1..34: note = chr7:14029885-14029919
  misc_feature 1..34: note = hyper
  source 1..34: mol_type = genomic DNA
aaaattagatcctatcgttcgtgggacagaaaca

SEQ ID NO: 31061 - DNA, 261 bp, Homo sapiens
  misc_feature 1..261: note = chr7:15725085-15725346
  misc_feature 1..261: note = hyper
  source 1..261: mol_type = genomic DNA
cgagccactcagagtcggcaacttgcaagagaaaagtcaagaagcggcacccgcacgcacgcctgcccaacggacgctgcatccctgggcgcacgcccctccctccccagcgctgggatggaaggtcacgcttcacaatcgatttcacagccacttgtccttttttatcaaccttctggtaaactagtttaggactttggagggcttagagctgctggctgtatacgcattgctctcgaataaacacgtgtccccaaatat

SEQ ID NO: 31062 - DNA, 241 bp, Homo sapiens
  misc_feature 1..241: note = chr7:15725949-15726190
  misc_feature 1..241: note = hyper
  source 1..241: mol_type = genomic DNA
agaggattgggagaacgggtgcaagccttgcgccgtggcgtgagggctgcgcaggcagccaaagagcgggtgttccatagcatgcaagtttcgggttccaggcagaagacttcacggcggttccaaaggccaccaccctctgtcactttttcactggaaaccgtgtgattttttttttaacctcccaaagcaatagcggtgcacttctgcagagctcggataatcccggtcctgagcccca

SEQ ID NO: 31063 - DNA, 391 bp, Homo sapiens
  misc_feature 1..391: note = chr7:15726686-15727077
  misc_feature 1..391: note = hyper
  source 1..391: mol_type = genomic DNA
gaaaagctagggatacgcctatcctttcaggaacacgaaagaagtaatagggttaaaggaaaagaccagagctagtttggcgcaccctcgaagtttttcaaactttgcatcttcccgtgccccgggcgccgcagcgcgcctaggttttcgcagctggtttctgtcggtgggttgttaataggctgggacgccagatctgaggttgcggggatgagcaccatggcctggaaaaggcggttctcagtgcagaaagaagacggacctggttgggtgggtgggaggaaggcgtgagtctgaaagggttgcagatgcctgctccctggcatcctcacgtgcgatgccaggtggaggctcccttccccctctttcccggtcccgctcaatttcctag

SEQ ID NO: 31064 - DNA, 54 bp, Homo sapiens
  misc_feature 1..54: note = chr7:15727290-15727344
  misc_feature 1..54: note = hyper
  source 1..54: mol_type = genomic DNA
agaattcttacatttcgatagctcccaaaattcactcaccgtgggcacttggtt

SEQ ID NO: 31065 - DNA, 30 bp, Homo sapiens
  misc_feature 1..30: note = chr7:16460326-16460356
  misc_feature 1..30: note = hyper
  source 1..30: mol_type = genomic DNA
gcagagccccaggaccgcgagactatccgc

SEQ ID NO: 31066 - DNA, 33 bp, Homo sapiens
  misc_feature 1..33: note = chr7:16461245-16461278
  misc_feature 1..33: note = hyper
  source 1..33: mol_type = genomic DNA
ggcaggcccagctgtcgccgcaagtggaaatgt

SEQ ID NO: 31067 - DNA, 82 bp, Homo sapiens; identical to SEQ ID NO: 8881
  misc_feature 1..82: note = chr7:18125980-18126062
  misc_feature 1..82: note = hyper
  source 1..82: mol_type = genomic DNA

SEQ ID NO: 31068 - DNA, 76 bp, Homo sapiens
  misc_feature 1..76: note = chr7:18126082-18126158
  misc_feature 1..76: note = hyper
  source 1..76: mol_type = genomic DNA
cgcttcagaaatcccaagtcgtcttaggttccctggtccttcccctgggggggaaaaaaaacgctggtgcagccca

SEQ ID NO: 31069 - DNA, 549 bp, Homo sapiens
  misc_feature 1..549: note = chr7:18126466-18127015
  misc_feature 1..549: note = hyper
  source 1..549: mol_type = genomic DNA
gccgcccgctcagctcgcagctcgcagccgcccgctgccgccctcccgagccccccccgcgcggcggcggcggcggcggcggcggcggcgcgtcccgcacatcgcgcagcgcgcaccgagccggccgcgccgcgcccgccgctctcgccgctttcgccgcggtctcctcctctagcgcccgccgcggccggtaaatctcggctggaggagcagcggcggcccccgagtcaactttcattccctttttgcttctgcctcaccattctcttctcctcctcgaaagatggctgtttggagaagggggagaagttaagaggtcgccagcgcggagcgaaggagggcgcgatagcctcagcaggagcgggcggaggtgagtggcaccacggcagagtccccggctggtgcttgaggaaagccctgggaattgggggccaccggtcctcaggatgcgccgcggtattcccttctcgggttccgcaggttaacagcatctcagtccggactctgatgccacttgccttgcatctcgcagcccggagaccggtgggt

SEQ ID NO: 31070 - DNA, 37 bp, Homo sapiens; identical to SEQ ID NO: 633
  misc_feature 1..37: note = chr7:19145857-19145894
  misc_feature 1..37: note = hyper
  source 1..37: mol_type = genomic DNA

SEQ ID NO: 31071 - DNA, 154 bp, Homo sapiens; identical to SEQ ID NO: 634
  misc_feature 1..154: note = chr7:19146031-19146185
  misc_feature 1..154: note = hyper
  source 1..154: mol_type = genomic DNA

SEQ ID NO: 31072 - DNA, 345 bp, Homo sapiens; identical to SEQ ID NO: 635
  misc_feature 1..345: note = chr7:19146237-19146582
  misc_feature 1..345: note = hyper
  source 1..345: mol_type = genomic DNA

SEQ ID NO: 31073 - DNA, 957 bp, Homo sapiens
  misc_feature 1..957: note = chr7:19146942-19147899
  misc_feature 1..957: note = hyper
  source 1..957: mol_type = genomic DNA
cttttctggagtcctcggaacagctggccggggcttttagcacacgggacgggaccttcgcctttgcctgtttttttttcgaccaggagaagcaggtgcgagagtctggggcttaggaggtggaaggcggggaaagagaatccactaggtcctcgtgtagagaacaacagtcgctccttagatattactccaggacggaaacctgattgcaaaccgctgttccttcgaaacttgcaaaacccggaacagaaaactcccgcccagccaattttagctctcgctgaactctcccgcctgcgttacgtttgcacagcaactctttgtaaatgtccgagtcctctcggaggaaagatcgttagggcgacgagaacattaagaggggacctggagggcagatatcctcgatcccaagagagcaactttgtcgcctcagaaaacacgccaacttccctcctgctctttccttggtcaactcagaatcaaccgattgtattgaaatctcctgaaatcccgaacagggattggcccagtcggcttctgaaaccgaggccggggaatggcaggaatggggggcagagaggatcggaaagaagagtccttcccccacagacattcccagctgggacacgagctcgctcgcagcgcgtttatggaaagagggggcgctgggaaccgcgctggcggcgagcagactccagggtcgagattattcgacacgtgtcttttattcctcacaatccatttcttacgggtgatttatgaacgaatctctttgatcagggacggttttatctgtccactgctacagatgacagatgcggctgctaaaatgcctggtccccgctgcctaaaaggttgctcccccccttcccaaatgctgttgctttttctctggcggtccccaccccctgcttcttcgttctccttccctacccccaaccccgtttgctgtcttag

SEQ ID NO: 31074 - DNA, 62 bp, Homo sapiens
  misc_feature 1..62: note = chr7:19156000-19156062
  misc_feature 1..62: note = hyper
  source 1..62: mol_type = genomic DNA
aaaacggtccttacccgtgaccctgggtgtctctgtctcccctcctgtcacgcacactcacg

SEQ ID NO: 31075 - skipped

SEQ ID NO: 31076 - DNA, 443 bp, Homo sapiens
  misc_feature 1..443: note = chr7:19156303-19156746
  misc_feature 1..443: note = hyper
  source 1..443: mol_type = genomic DNA
ggccctgctgagggggtggggggctccgcctgctagtgggacgcggacatggaccaggccccctccatcctccagaccgagaaggcgtagctgagccgctcgtgagccacatagctgcagcttgccatcttggagtccagctcgtcgctctggaggacctggtagaggaagtcgatgtacctggccgccagcttgagggtctgaatcttgctcagcttgtccgagggcagcgtggggatgatcttccgcagcgcggcgaacgcctcgttcagcgactgggtgcgctggcgctcccgcacgttggccatgacccgctgcgtctgcagctcctcgtaagactgcggactcccgccgccgctgctgctgccgccgccgccgcccgcgccgccgccgccgccacagcccgcagacttcttgccgcgcttgccctgggccgggctgcc

SEQ ID NO: 31077 - DNA, 138 bp, Homo sapiens; identical to SEQ ID NO: 640
  misc_feature 1..138: note = chr7:19157055-19157193
  misc_feature 1..138: note = hyper
  source 1..138: mol_type = genomic DNA

SEQ ID NO: 31078 - DNA, 69 bp, Homo sapiens; identical to SEQ ID NO: 641
  misc_feature 1..69: note = chr7:19157194-19157263
  misc_feature 1..69: note = hyper
  source 1..69: mol_type = genomic DNA

SEQ ID NO: 31079 - DNA, 303 bp, Homo sapiens; identical to SEQ ID NO: 642
  misc_feature 1..303: note = chr7:19157264-19157567
  misc_feature 1..303: note = hyper
  source 1..303: mol_type = genomic DNA

SEQ ID NO: 31080 - DNA, 382 bp, Homo sapiens
  misc_feature 1..382: note = chr7:19157633-19158015
  misc_feature 1..382: note = hyper
  source 1..382: mol_type = genomic DNA
cggtggcagccccatccggagtggctgtgacagcagcaatggcaacagcttctacacagtgggtgatgtctcatctcgcccaagagccctctaggtccgtggggccgatttgggattgctggggctgggggggtggtgtggcgcggggtgggggggcatgccaagaaaagtgtcaaccgcggagcccacccaatggtcaggtagacgaaccccttggagttccaaaggccaaaccgcggcggcccagcccggaggtcctgggcgtttctgaagacgtggccgcgccgcgggggctgaggatttgcgtcccggcctgctctctcgcccttctgggccctcctttcccctctacaacgacccagtctgacgctccccaacatcc

SEQ ID NO: 31081 - DNA, 30 bp, Homo sapiens; identical to SEQ ID NO: 8895
  misc_feature 1..30: note = chr7:19183647-19183677
  misc_feature 1..30: note = hyper
  source 1..30: mol_type = genomic DNA

SEQ ID NO: 31082 - DNA, 368 bp, Homo sapiens
  misc_feature 1..368: note = chr7:19184058-19184426
  misc_feature 1..368: note = hyper
  source 1..368: mol_type = genomic DNA
caggctttttaaaaacgtaagaatttctactttattatctctatgaaaaaaaaaatgtaaagaagagaggttagattttatagaagctccaaagtctgccatttgcgaggagggttcacttcccacccacccagcccacggaagctcttaggagcagcctgaacggccccgactcagcctcacgctctctgacttccccgctcgcccctgaccccgacttcacttagggcggtcgcgtagatatgaactctacagcagccactctgctcagcgcatgtggggatcttacaatctcgaccccgacctccagaagaccagacgttctgtcttggggcctccctcccggccctttagcctcacccagtgcc

SEQ ID NO: 31083 - DNA, 166 bp, Homo sapiens
  misc_feature 1..166: note = chr7:19184669-19184835
  misc_feature 1..166: note = hyper
  source 1..166: mol_type = genomic DNA
cggcctggcgctgggcgtaggtgatcacccttttcctcttggggcggcctaatagggagacacctcttccgcgctcctcttcctcctcctcttctccgtccccctggtccacttcgcactcctcttcttctgggtccccctcttcaaaccgcgccatcctcctggg

SEQ ID NO: 31084 - DNA, 317 bp, Homo sapiens
  misc_feature 1..317: note = chr7:20816259-20816576
  misc_feature 1..317: note = hyper
  source 1..317: mol_type = genomic DNA
cagctttccggaccccggagagagggggtgggggtgtgggctcacatcgccggctggcttgagggaggagagtggtggcggctccggaggtggacgtgtcaattatatcctggagctccgggaagccagattgcttctaccggcggctgcaggggcttgcaagcgaagataggcggccctccttccttccccactgtgggggattggggtcagtggagcccgtggatttagccacgaggggacatgactggagccctgtcacgcgcaggtgtgcgtctccgagagctctttcaatataagtgcgggagaagatttat

SEQ ID NO: 31085 - DNA, 83 bp, Homo sapiens
  misc_feature 1..83: note = chr7:20817170-20817253
  misc_feature 1..83: note = hyper
  source 1..83: mol_type = genomic DNA
agtcacacttaattgcgccttctttatgataacagtgtggggaaatgtgggcaagttccttcactcgtcgagtctgccaaccc

SEQ ID NO: 31086 - DNA, 309 bp, Homo sapiens
  misc_feature 1..309: note = chr7:20817648-20817957
  misc_feature 1..309: note = hyper
  source 1..309: mol_type = genomic DNA
ttgagagcccacaggcgagcggggcggggggaggctccccgcgcattcccaccgtgggtttgcccaaggtcagaggcccgggactggcggggcgggtctggccggcattgcccgcgctgagcgcgctgcagaacgggagcagggcacagggtggcgctcgctgtccgtgcagcgggcggaggcggccgcggtgcctttgtgtgcggtgggcgcggcgatgggctgctccggcccgcagcccgaggggagcggcgggcccgggccggggccagggctcgcggggagaccccagaccaccacctcactctt

SEQ ID NO: 31087 - DNA, 305 bp, Homo sapiens
  misc_feature 1..305: note = chr7:20817982-20818287
  misc_feature 1..305: note = hyper
  source 1..305: mol_type = genomic DNA
cggatcgccagttcggaaccctccccgggagggccccggggtctttctcaatgtactgggcacttcgaggagctgggaagaggaaagcggagggtagcgtttagaaagggagggaaatcctcccaggctcaaaacctctcgcagaattcattcgaaaagagaacgaagggaactttgggcaggccggacctcggctcagcgccctgcgagagaagcagaggtcgctgccagcgtttcctcccgcgcagcaagaaattggtgcctgagaagcaaagttgaggaatgggctttttaaaagcggcagc

SEQ ID NO: 31088 - DNA, 70 bp, Homo sapiens; identical to SEQ ID NO: 645
  misc_feature 1..70: note = chr7:20823261-20823331
  misc_feature 1..70: note = hyper
  source 1..70: mol_type = genomic DNA

SEQ ID NO: 31089 - DNA, 497 bp, Homo sapiens; identical to SEQ ID NO: 646
  misc_feature 1..497: note = chr7:20823382-20823879
  misc_feature 1..497: note = hyper
  source 1..497: mol_type = genomic DNA

SEQ ID NO: 31090 - DNA, 120 bp, Homo sapiens
  misc_feature 1..120: note = chr7:20823919-20824039
  misc_feature 1..120: note = hyper
  source 1..120: mol_type = genomic DNA
cgttgcggtgcccgggctcggggggctgcagcagctctggggagtggcagggcgggctgcccgcggcgctgtgctcgctgtcggtgtcgctgcccttcttgccgccgctgcccgagcccg

SEQ ID NO: 31091 - DNA, 345 bp, Homo sapiens
  misc_feature 1..345: note = chr7:20824475-20824820
  misc_feature 1..345: note = hyper
  source 1..345: mol_type = genomic DNA
cgcgccggccagcggcgacggggccgagtccgggtaggagccgggtagcactggcttgaagccgtccatgaggtgctgcccggcggggctgagcaggtgcgaggaggcgccgctgctgaaggccgagtgactcaggcccgagtaatccgagttgtagcctccgagcggcgagtgcagcgaggtttggagccccccggcggcagggtgcagcgagccgggcagcgcagccgcgctgttcgggttctgcacgtcgatccagccggcccccacgtcccaccagctggaggcgccggccgagcccacctcgcccgcagcacccaggcccgggtgcgagggcttaaacca

SEQ ID NO: 31092 - DNA, 131 bp, Homo sapiens
  misc_feature 1..131: note = chr7:20824835-20824966
  misc_feature 1..131: note = hyper
  source 1..131: mol_type = genomic DNA
cgccatgcccacccgcgggtagatgccctgcagcccgtccacagaggtgtgcaccttggagatgaacaccggctggtgggagccgtcctgcgagtgcgcggaggagccgccgccgccgcccccgccgccgc

SEQ ID NO: 31093 - DNA, 227 bp, Homo sapiens
  misc_feature 1..227: note = chr7:20826611-20826838
  misc_feature 1..227: note = hyper
  source 1..227: mol_type = genomic DNA
gcgccgtgaggtcatcggcgccgccgcctgccgccgtggtggaagggggagtgggagcggagggggcgggggcggctgcgtgtgttacaaagcgcaaagcgcgcgctcgcgtgtatgagtgtgtgtgtaacaatgtaactgtgtgcgagtgtgaccaggcgtaggagaggacagtgcggagactggagggaggggggatgggggtgtgacaccgtaacagtgacagt

SEQ ID NO: 31094 - DNA, 99 bp, Homo sapiens
  misc_feature 1..99: note = chr7:20827355-20827454
  misc_feature 1..99: note = hyper
  source 1..99: mol_type = genomic DNA
ccaccttttctttcccggctctccaacgaaatagtagaaaggttgagaggctaagggttatttttagggatgcgttgggacgtggatgcgcgcctgcgc

SEQ ID NO: 31095 - DNA, 93 bp, Homo sapiens
  misc_feature 1..93: note = chr7:20828502-20828595
  misc_feature 1..93: note = hyper
  source 1..93: mol_type = genomic DNA
tctgaatgattttagcgtgttgagaaggcgtgacaggccagcccagaaggaggaaggggtgggggaaggagggtactccgtttaacaaataaa

SEQ ID NO: 31096 - DNA, 265 bp, Homo sapiens
  misc_feature 1..265: note = chr7:20830670-20830935
  misc_feature 1..265: note = hyper
  source 1..265: mol_type = genomic DNA
gggagacagagcgaacgcagtgctggcactgcgtccctggcctgcgcctctcccagaatgggaagacgacccccaaccccttgactagtgtgcggggtcctcgcacgcggacgtgttggctactaaataaagcgtgaagagggatcgctgggtagctgagcgccgccggcggccgccgggagcagcgagctgagccaggttgggtgggggtgtttcctcgtcgagagctctctggtcaaagtttccttcccgctggaaaacaaaa

SEQ ID NO: 31097 - DNA, 30 bp, Homo sapiens
  misc_feature 1..30: note = chr7:20831186-20831216
  misc_feature 1..30: note = hyper
  source 1..30: mol_type = genomic DNA
aaatgggaacttccacgctgaacaatagcc

SEQ ID NO: 31098 - DNA, 198 bp, Homo sapiens
  misc_feature 1..198: note = chr7:20833089-20833287
  misc_feature 1..198: note = hyper
  source 1..198: mol_type = genomic DNA
tgctttagaatcattcgactctgagtccaggaaaagcagggggtgtggtggcagtgggggtggctagggaggggtgtatatgagtgggggagccgatttcatctcggatcgcaggaagagaacttgctcaaaagaatttttccccagcaaaagtggtataatttacagcgcaacttaataatccgaggggcaatgcaa

SEQ ID NO: 31099 - DNA, 30 bp, Homo sapiens
  misc_feature 1..30: note = chr7:20833492-20833522
  misc_feature 1..30: note = hyper
  source 1..30: mol_type = genomic DNA
gcatggcaatgagtccgagcaggagccctc

SEQ ID NO: 31100 - DNA, 30 bp, Homo sapiens
  misc_feature 1..30: note = chr7:20834600-20834630
  misc_feature 1..30: note = hyper
  source 1..30: mol_type = genomic DNA
ttgaaacatttttcacgactgagttcaggg

SEQ ID NO: 31101 - DNA, 30 bp, Homo sapiens; identical to SEQ ID NO: 8910
  misc_feature 1..30: note = chr7:20836099-20836129
  misc_feature 1..30: note = hyper
  source 1..30: mol_type = genomic DNA

SEQ ID NO: 31102 - DNA, 208 bp, Homo sapiens
  misc_feature 1..208: note = chr7:20836779-20836987
  misc_feature 1..208: note = hyper
  source 1..208: mol_type = genomic DNA
aaggaaattacaagccgatgctgattgacttttgaaaggcctggcacgtcccagtctatataataactcagttggaggaagaacctcgaggaccgagtgtctccagatcacttaatgcatcggcatccaccacgctcggctcatgggcagggcccccgaggctgccaccaacccacggagccttgaggagctgcgcttccccgcgatg

SEQ ID NO: 31103 - DNA, 50 bp, Homo sapiens; identical to SEQ ID NO: 8912
  misc_feature 1..50: note = chr7:20838460-20838510
  misc_feature 1..50: note = hyper
  source 1..50: mol_type = genomic DNA

SEQ ID NO: 31104 - DNA, 105 bp, Homo sapiens
  misc_feature 1..105: note = chr7:21582536-21582641
  misc_feature 1..105: note = hyper
  source 1..105: mol_type = genomic DNA
gagggcctctcccctcggccttggccttggcgtatactgggcggtggcgcggtgcgctcactccgcccccagcgggctggggcggggacaccgtcccccgggaaa

SEQ ID NO: 31105 - DNA, 161 bp, Homo sapiens
  misc_feature 1..161: note = chr7:21582791-21582952
  misc_feature 1..161: note = hyper
  source 1..161: mol_type = genomic DNA
cgctcacttcggggggcccagagtctcgggtgaggagccagccggcctcgcgttccctcggacggttgcccaatggcagcccaggtggcagcccgggaggcgcgagacttcagagaagccccgacccttcgcctaacctcgggggccggcctggaggcagt

SEQ ID NO: 31106 - DNA, 15 bp, Homo sapiens
  misc_feature 1..15: note = chr7:21583263-21583278
  misc_feature 1..15: note = hyper
  source 1..15: mol_type = genomic DNA
gggagacagcccagt

SEQ ID NO: 31107 - DNA, 84 bp, Homo sapiens
  misc_feature 1..84: note = chr7:21583303-21583387
  misc_feature 1..84: note = hyper
  source 1..84: mol_type = genomic DNA
cgctcactcgggcactttaacaaacttggcttgaagtccccatcctgaggcccgcaggactcctccccacgtgcacccactctg

SEQ ID NO: 31108 - DNA, 80 bp, Homo sapiens
  misc_feature 1..80: note = chr7:22539833-22539913
  misc_feature 1..80: note = hyper
  source 1..80: mol_type = genomic DNA
gcctgctgcaggccccgcctccttgtcagttgcgcgtccagcgccacctgctggcgccccgcgtccgcagggttcgggaa

SEQ ID NO: 31109 - DNA, 572 bp, Homo sapiens
  misc_feature 1..572: note = chr7:22589298-22589870
  misc_feature 1..572: note = hyper
  source 1..572: mol_type = genomic DNA
ctcaaactatctcgacggtcaggcccctttcccaggtggtgccgtggtggccgtggggtgaggaaaatatgtacggctgtagcccgtccatttctcatcctgggatagcgaggggtttccggaggaggcgtcagcggtgggaagtgggagaaagcgagcaaaaggggcgggggcgaaggagcggactcgcctgctgccgcgggggcgggaatccgcaagccagcctgggagaagggacagaacagcggctgatccttccctgggctagggaaggaaaataaactgtgctggcctcggagtgggggatggagaggggcgatggcgctgcatctgcaggacgttgcaagggctaggagcgggcaagactagtgtcggcaggaaggtagtggtggtgatggcgggggtgtgtggcaaacagagcccgagcgaaagcctgagaaggttctggttgccccccagcctactttagtccctaaccctccagcggggcgaggagggagcgcatcggagaggtacctgtgcgatgggcagcggtgcttggcacctgagcgtaggtacgatactcagcaagg

SEQ ID NO: 31110 - DNA, 123 bp, Homo sapiens
  misc_feature 1..123: note = chr7:23287228-23287351
  misc_feature 1..123: note = hyper
  source 1..123: mol_type = genomic DNA
ggaagagagctgagccgctgtaaccctgggcctgggattgcggggacgggacgggtgggaagcggccaaaggcgcagcggcttctggtcagagccgcagaggcctgagacgtgggccgcgccc

SEQ ID NO: 31111 - DNA, 92 bp, Homo sapiens; identical to SEQ ID NO: 2987
  misc_feature 1..92: note = chr7:23287532-23287624
  misc_feature 1..92: note = hyper
  source 1..92: mol_type = genomic DNA

SEQ ID NO: 31112 - DNA, 1569 bp, Homo sapiens
  misc_feature 1..1569: note = chr7:23508102-23509671
  misc_feature 1..1569: note = hyper
  source 1..1569: mol_type = genomic DNA
ttgcctttttgggaccgagtgctcaacttctatgggtttcccgtgcagttctattttacctgcggacacacaagaagtgagacggtcggccgagttcagcggctctccctgcccgaagacccgcacagcccaagcggcgacacaaatggcctcctgaggccctcgaagggcccccgaggcccggacgcggctccaggcggagggagaagccgaccccctcgagcggcgtgggcatttaactcgcagatggttggggagcagggtccgctggcgggcccactacttgggtatcagtccagtctccaagcctcccccacccacccctgggggccaccaacaccacgaggcccgcaagagggacgcggcccaccctctcaccgccctggacacgctccacagggcagactcggggcagggggctcccctggctttcttcaggagggggcgccctggccctgccctctgcttcagcccagacccgccgggaacactcagcggtgggcttgaggaagacagggagtggcgagaaagggtcggggacggcaggggagaccacgaacgggagaactggcagaggcgcagctcggcacaggctgaaccaggcgcgaaggacggcgaggcgcccgcaccacgtctgaattgattaaaagggaagccgaaaggcacggggctcccatggggaccccaacgcagccttccccctgggcgtcctgctccgcccggcaccgtccctcgccctggcggagccatacccggaggccgcagccccgcgccagggcccggagagcggcgggcggccggtgcgtggcggcgactcccttccaggcgaccagccgcccccgcccacctgcccctatcgctcgtcggaccaggggaggtggaacggggaaaccgggcacacactctctcctcccacagggtggggaggaagcgcggggccgcctgtgcgaggcaccagcctcgcggtctcactcggcagcacggtcgaggccactttccgttctccacggccgggggtttcggggcgcagcacagacagcgccgtaaataacgaccgaggaaagcaggaaggaacgaggcacaggcgggcattctagctcggcccccgaggcccagcgtgccggggcctggagcacgcgcctgggcccgggcggggcgccgggggagcgcgcctcccccagccccgcgccccccttagccagcgccggggctttcttgacagcgcgttcgccctcacccagcaaaccccggccggggaagcagagccgcgggccggagtgggagccggagctgaggagagccccggcccccacgcgcgtgggtgtgggcgctcaggcctcacccccgctcccccagcgcgccgggcctggggcccgcggagccacccggtgggcctgggcgggcggtgcagggctggggcgagagcccgggtggggccaggcccgggcccacctgaaagcgcctcgatggccttgagggcccagctctcgtccgggcagtccacgaacgcgtagccagtcttcaccaggaagggtcccgacaccgggatcttggcgtccttgaagatac

SEQ ID NO: 31113 - DNA, 108 bp, Homo sapiens
  misc_feature 1..108: note = chr7:23510878-23510986
  misc_feature 1..108: note = hyper
  source 1..108: mol_type = genomic DNA
ccgcagcgtcctgggcgggtgtctgggcgacacctcctccgcctccgcctgcgctcgcggtggctctcggcttcgcgtttgccattggttgcgcgattcagaaaaggc

SEQ ID NO: 31114 - DNA, 906 bp, Homo sapiens
  misc_feature 1..906: note = chr7:23513519-23514425
  misc_feature 1..906: note = hyper
  source 1..906: mol_type = genomic DNA
cctctggctctgccccgagaaagagggcgggatcctcacggctcacagtggggagggtctttcgtcggccgccggctcgcctcggagggcctggaccactggaccgcccttccccggggccctgccgcgggaccgcgggcttctggctcctcctggggctgcgtccgtatgcgcggagcgtgtggccgggccgtcgccgcgccaccccacctgagtccgccggccagcgcggggacgcaccgggcagcgtgtgtttggcgaccctcccgcacctctggtctcagttgcgtgtgtgcacgaggggttccatagggcccagggatgcttggtacccacgggggagaatccctcgccgaaccctgcgggtctgcggggcgggccgcgagactggcgcgcaaaagcggctccaaggcggggctcccgcgctccccggggccggcttgccgagtccaagttgagcaaccggcgtcgagagagacaccgcccctgctgcgggcgggggcctctcctcgcttccgattggctgacggggggaacctatcgccgtcggccgcctccgccagagcggtttgctggttttcattcattggccccggagccgcccctggatttccatcttttgtggcgcgaaaataaccctttgctccctcgttggttttgttgaggttgaggggtgggactgtgttcccctctgctcgctctcgtttttcctgccctttaacagctcgcccccagccccaacccccaaggaagaaagagggaggtaacgctgaggaagggtggaaagcagttctgcgtccgtgggtggagcccgccccttggctgaccgcatggtgcccgcacggtcccttcccttcccccagcgtccagcgcccggaggttctggatttgcgccatgctcagcag

SEQ ID NO: 31115 - DNA, 36 bp, Homo sapiens; identical to SEQ ID NO: 8922
  misc_feature 1..36: note = chr7:23514666-23514702
  misc_feature 1..36: note = hyper
  source 1..36: mol_type = genomic DNA

SEQ ID NO: 31116 - DNA, 156 bp, Homo sapiens
  misc_feature 1..156: note = chr7:24796478-24796634
  misc_feature 1..156: note = hyper
  source 1..156: mol_type = genomic DNA
gagctctctagataccggagcaaagtggagggggacttttttccgtccagagagactgaactccgtatctgttccgcggtccgcctccctgcacacacgcccccgagccgggagagcctccgcagcacccagagaagagaccggaacacaaaggat

SEQ ID NO: 31117 - DNA, 15 bp, Homo sapiens
  misc_feature 1..15: note = chr7:24797022-24797037
  misc_feature 1..15: note = hyper
  source 1..15: mol_type = genomic DNA
ccgctgctgggtccc

SEQ ID NO: 31118 - DNA, 543 bp, Homo sapiens
  misc_feature 1..543: note = chr7:24797067-24797610
  misc_feature 1..543: note = hyper
  source 1..543: mol_type = genomic DNA
cggaggagcctgcgctgggccggcggggggcgggcgcttggggagggcggagagagggcccgcccgccgggacctttgctcggtccgggcgccccagagccgcgggactggccgccggaggctgcgggaggggcccgggccagacctcccagaagccccagagagagccgcttcccctccttcgtgtgactctctgggagccgggttgctgacggcccagcgctcagccggagtccccgcgcgcttttcgggactcacccgggagatgtcggggcctctcgggaagagtgggctgcgcctgccttccgcggccgcctcgcctcttcgctgcgcgggaccgtggggtttgagagcggcgcctcctcgcggggccgaacccgccacccacagtggagtgtggactgacaccgcggcctcacggttcaaccaggaaagtccaaggcctgtccagcctgtgggagcccctaatgcccgtgcctggagtagtatctgggtgtgtggtgcgacagtgcccacacttaggcctgccgctaatcagtgatt

SEQ ID NO: 31119 - DNA, 297 bp, Homo sapiens
  misc_feature 1..297: note = chr7:25891946-25892243
  misc_feature 1..297: note = hyper
  source 1..297: mol_type = genomic DNA
gccttcaggccgccccggcccctcgtgggaatgcgccgcgccccccggactctggagcggcccgaccctgcttcccaggccccgggcaggcgggcgggcgagacacaaagcaggccccgcgggcggtgctccgggtttcgcgagggcggcggtgcgcttgattgatggattcacggcgtttaacccccgccgcctcgccggaggcggccgatccagctgcggccgagggcctagggtggccatgggcccggcccccgcgtcctccgcgcccccgccccggctcgggagggctgcccc

SEQ ID NO: 31120 - DNA, 199 bp, Homo sapiens
  misc_feature 1..199: note = chr7:25896420-25896619
  misc_feature 1..199: note = hyper
  source 1..199: mol_type = genomic DNA
aaattccttccagatcgacctcagtgtgggtgagagcgcagtctgtgaccaccagcgcttctgactcagcggaaaacgccggcaaacaggactacacctcaccgcggcggcaaaagcggcctcagctccagcactcacagccaccactttcaccgtcgccccgccaccaccaccttcgctgcctcaaccctgagagaga

SEQ ID NO: 31121 - DNA, 259 bp, Homo sapiens
  misc_feature 1..259: note = chr7:25896679-25896938
  misc_feature 1..259: note = hyper
  source 1..259: mol_type = genomic DNA
cacaaacacctctccctgctgtcaatcatacatgcgcgccatagcgcgcatgcgcactggtggactccagcccccaccgatcctacgccctgtctctgcgtctgggaccagacgcaccaataagagagcggattcgggggcgggccacaaggaagtagccaatgagagcgcggttggaagccagggctagagaggagtaaatccttctgtcgtccccgttctgccgcccccgcgatgatttatgcgtcctttttattat

SEQ ID NO: 31122 - DNA, 304 bp, Homo sapiens
  misc_feature 1..304: note = chr7:25902345-25902649
  misc_feature 1..304: note = hyper
  source 1..304: mol_type = genomic DNA
gtttaataaagagggcgtgtttattttgcataaatagtgggcgggcacccagggctgctttgtaactcgagaacccggtgtcccgcctgtctcccggggggtatgggcgggtctcccgccagcctcgccagactgagccaagggcctgaaggaaataaatggctttctgaaaaaattcgtcttaattcgcccttttgagagaattctgtttctaaatgcatttttttcgttggttcttacaagtcgttaagagttgtaacatgaaataagtagagatcaccaatctatccgcccccaaattaat

SEQ ID NO: 31123 - DNA, 36 bp, Homo sapiens
  misc_feature 1..36: note = chr7:25990174-25990210
  misc_feature 1..36: note = hyper
  source 1..36: mol_type = genomic DNA
tcccggtcttccagccgcccgcgcccagccccggga

SEQ ID NO: 31124 - DNA, 41 bp, Homo sapiens
  misc_feature 1..41: note = chr7:26192685-26192726
  misc_feature 1..41: note = hyper
  source 1..41: mol_type = genomic DNA
gaggtaggtgcagagcgggaagcgagcgaagtgcggcgtct

SEQ ID NO: 31125 - DNA, 310 bp, Homo sapiens
  misc_feature 1..310: note = chr7:26415774-26416084
  misc_feature 1..310: note = hyper
  source 1..310: mol_type = genomic DNA
gccgcctgttggttgcggcgcctccgcggcccgcgcgcatcccccgcgctgcgtcccgcacacgcgcgctcccgccgcgtcccgcccgggccgctccgctggcggcggcgactgggctgcaggtagcgagccagccggcctcggtccggtaacccatggcaaccgccctggtaacccatggcaactgcgcggcggaaagaaaaaaaagaaccgtggtggggcggggggcggcgggcggtgaatgggaacaacgaccgcaaagagacagcgatttaccgcgcgggcctgcggctcccggccgcacctgctg

SEQ ID NO: 31126 - DNA, 138 bp, Homo sapiens
  misc_feature 1..138: note = chr7:26416380-26416518
  misc_feature 1..138: note = hyper
  source 1..138: mol_type = genomic DNA
gaggaggggctacaccgtgctgccccggccccatggggcccggcccccgagggtccccgcgagcggacgcggtggggccgggcaaactctacgtgccctaaattttgtcatctgcacacgcatcgcacacattagtta

SEQ ID NO: 31127 - DNA, 34 bp, Homo sapiens
  misc_feature 1..34: note = chr7:27128016-27128050
  misc_feature 1..34: note = hyper
  source 1..34: mol_type = genomic DNA
ttgccgcagcctagccggccgggggcaggcgctg

SEQ ID NO: 31128 - DNA, 505 bp, Homo sapiens; identical to SEQ ID NO: 651
  misc_feature 1..505: note = chr7:27135266-27135771
  misc_feature 1..505: note = hyper
  source 1..505: mol_type = genomic DNA

SEQ ID NO: 31129 - DNA, 445 bp, Homo sapiens; identical to SEQ ID NO: 652
  misc_feature 1..445: note = chr7:27135979-27136424
  misc_feature 1..445: note = hyper
  source 1..445: mol_type = genomic DNA

SEQ ID NO: 31130 - DNA, 365 bp, Homo sapiens
  misc_feature 1..365: note = chr7:27136425-27136790
  misc_feature 1..365: note = hyper
  source 1..365: mol_type = genomic DNA
acttggaggggcggatgagccctggaaactcagagctcgccggaaaaggccgggggcggccgggctcttcttccccaccttccctctctcgtcgctctccgcccctttctctttcccactcagttttgcaccgggagccctccgggatgcggagctactcgaccgccggatttttaggggtaggaggcgggggagagagatgacgctggcggacgtggccagcgcgggggccgggcggtgcgctgcaggccatctgccggcgccctgagacccaggagcctccgcgctcccgcgtgggcctcacagggccggtccacagctccaacatagtagctgaactcccttcgttgcgttcctctttttct

SEQ ID NO: 31131 - DNA, 892 bp, Homo sapiens
  misc_feature 1..892: note = chr7:27190219-27191111
  misc_feature 1..892: note = hyper
  source 1..892: mol_type = genomic DNA
tacaggtagtctctccgattgcagaatcccaaagccagagtgttccctgaaccagcgtgcgcccccagaacgccttgggacgcgcagtttggacagaagcagccatgacgtgccaggcggcctgtgcaaccagtctccatggtgctggagtgggggtgggggaggacccgagtctataacggcgtccagctccggtcaggggtagccgaggcggggagatttcccggccatataggctctgggtgatcgccccccaggtccccttgcgtccccctctaccctgcttgctgggaaatctctgaggggccagtacagcagtcgcgccaggctgcaagaggcgggctgcagctggcgccggtcccggcgacggccacggcgtggcagcagcgagcgccagcacggtcgcaataaataatcggcccgcggcagccgcagtcaggaaggcggcggacctaggatgcaaatgcgccgctttatccgccccgagcgcacgcagagcacgggctaacgtcctaaacatccacagccccttcctatttatcgaatccataccaagatattgtctcaagttggggaaacaacaacccaaacaaaaaacaaacaaaaagaacctcggactcttttcttgtcgctgtccgaggagttctcggggcaaatctggtctgatgtgcacttaggccgagctacagttcgagccaccgcgctacgcaaagccaccgccagcagcacgctctgcgcttcctcccgggcagctccaccatcctctccccgctcgcggaaggtggggagtgcggtcgccagtccgttgcgccaaggtggattggggggtccccctatcgcccagactcggtttgcgtccttccttcaaccttagctgcgggaccctgccacg

SEQ ID NO: 31132 - DNA, 47 bp, Homo sapiens
  misc_feature 1..47: note = chr7:27191507-27191554
  misc_feature 1..47: note = hyper
  source 1..47: mol_type = genomic DNA
aacccaaagggctggcggggaacacagtgtgccgggccacttccttt

SEQ ID NO: 31133 - DNA, 16 bp, Homo sapiens
  misc_feature 1..16: note = chr7:27195586-27195602
  misc_feature 1..16: note = hyper
  source 1..16: mol_type = genomic DNA
atgctatgggctccac

SEQ ID NO: 31134 - DNA, 27 bp, Homo sapiens
  misc_feature 1..27: note = chr7:27195866-27195893
  misc_feature 1..27: note = hyper
  source 1..27: mol_type = genomic DNA
cgcctttggcgaggtcactgcagagcc

SEQ ID NO: 31135 - skipped

SEQ ID NO: 31136 - DNA, 132 bp, Homo sapiens; identical to SEQ ID NO: 658
  misc_feature 1..132: note = chr7:27196154-27196286
  misc_feature 1..132: note = hyper
  source 1..132: mol_type = genomic DNA

SEQ ID NO: 31137 - DNA, 351 bp, Homo sapiens; identical to SEQ ID NO: 659
  misc_feature 1..351: note = chr7:27196287-27196638
  misc_feature 1..351: note = hyper
  source 1..351: mol_type = genomic DNA

SEQ ID NO: 31138 - DNA, 368 bp, Homo sapiens
  misc_feature 1..368: note = chr7:27204402-27204770
  misc_feature 1..368: note = hyper
  source 1..368: mol_type = genomic DNA
ggacgaaggcaggctcgagagaaacctggcgggccagcagatccgggaggccggcgtggaggcggcggcggatttgaagggaggagacacttactgggatcgatggggggcttgtctccgccgctctcattctcagcattgttttcagagaaggcgccttcgctgggttgtttttctctatcaactggaggagaaccacaagcatagtcagtcagggacaaagtgtgagtgtcaagcgtgggacagtcaccccttctggccgacagcggttcaggtttaatgccataaggccggctggagggcaagcccgcgaaggagagcgcaccgggcgtgggctccagccaggagcgcatgtacctgccgtccgg

SEQ ID NO: 31139 - DNA, 116 bp, Homo sapiens
  misc_feature 1..116: note = chr7:27205265-27205381
  misc_feature 1..116: note = hyper
  source 1..116: mol_type = genomic DNA
cgctattaatggtccgatgttttgcagtcataatttttatagcaaaagccatatgtttttatgtaaagggatcgtgccgctctacgatggggtttgttttaattgtggccaacgac

SEQ ID NO: 31140 - DNA, 13 bp, Homo sapiens
  misc_feature 1..13: note = chr7:27205382-27205395
  misc_feature 1..13: note = hyper
  source 1..13: mol_type = genomic DNA
attaaaagatcaa

SEQ ID NO: 31141 - DNA, 148 bp, Homo sapiens
  misc_feature 1..148: note = chr7:27205642-27205790
  misc_feature 1..148: note = hyper
  source 1..148: mol_type = genomic DNA
agccacacaggctggcgggaagtcggaaacgaccaacagattcgtttgcctcgccgtggctcccagctgtaaaaatttacgaggacttggaaaggttagactgttgtgtttggttggcgagctccctgtaaataatccctgcggtccc

SEQ ID NO: 31142 - DNA, 165 bp, Homo sapiens
  misc_feature 1..165: note = chr7:27209508-27209673
  misc_feature 1..165: note = hyper
  source 1..165: mol_type = genomic DNA
tgcagcccagcgagccggcgccaagaggcggtagccgtggaaggctcgaaagcgccagggacggtacagatcccggctccctgtctggccccggcctcccgcctctcgctctccccctctccctcctagctgcccgcccgccggggcgcgcgctcctgcgccccc

SEQ ID NO: 31143 - DNA, 485 bp, Homo sapiens
  misc_feature 1..485: note = chr7:27212499-27212984
  misc_feature 1..485: note = hyper
  source 1..485: mol_type = genomic DNA
cgtaaactcgaacttcgccggttaatgggcttatttattggcgctggcggctgcttattttggatgccttacaaacatccgcgctatctgcgggcgagctactttccctccctccccctccccccgcgtgggccgcgccgcgcaggctgggcagggaccagggctctgggtcctcccggccacaggaaagagcgcacaggagggggcctgctcgctggtgtcctcgtccctagtcagggggagctgaggccagcgccgaggacgtcttgctgtggggcgctaagccggacatgaattttactgcgtccccacgcccaaatattaaaaagcaagttcacaaggtcagcctgcctgcagcttgggccaaggccggccggctgctgcgcgggctcctagttttctgatccttctcctccttgtgtctgcctgtctgcccgcctgactgcagccctctgcagccctgcttacccagggaatccttctcc

SEQ ID NO: 31144 - DNA, 796 bp, Homo sapiens; identical to SEQ ID NO: 661
  misc_feature 1..796: note = chr7:27213188-27213984
  misc_feature 1..796: note = hyper
  source 1..796: mol_type = genomic DNA

SEQ ID NO: 31145 - DNA, 277 bp, Homo sapiens; identical to SEQ ID NO: 662
  misc_feature 1..277: note = chr7:27213985-27214262
  misc_feature 1..277: note = hyper
  source 1..277: mol_type = genomic DNA

SEQ ID NO: 31146 - DNA, 37 bp, Homo sapiens
  misc_feature 1..37: note = chr7:27214329-27214366
  misc_feature 1..37: note = hyper
  source 1..37: mol_type = genomic DNA
cgcagaagctgccactagtccccggtgtactctaacc

SEQ ID NO: 31147 - DNA, 448 bp, Homo sapiens; identical to SEQ ID NO: 8945
  misc_feature 1..448: note = chr7:27219396-27219844
  misc_feature 1..448: note = hyper
  source 1..448: mol_type = genomic DNA

SEQ ID NO: 31148 - DNA, 79 bp, Homo sapiens
  misc_feature 1..79: note = chr7:27223114-27223193
  misc_feature 1..79: note = hyper
  source 1..79: mol_type = genomic DNA
ccttaacatctggggcggctgccgggtctttgtcagcctgagtcctggccaccagcttctgcctccccggccagccttc

SEQ ID NO: 31149 - DNA, 59 bp, Homo sapiens; identical to SEQ ID NO: 8947
  misc_feature 1..59: note = chr7:27223221-27223280
  misc_feature 1..59: note = hyper
  source 1..59: mol_type = genomic DNA

SEQ ID NO: 31150 - DNA, 1035 bp, Homo sapiens
  misc_feature 1..1035: note = chr7:27223574-27224609
  misc_feature 1..1035: note = hyper
  source 1..1035: mol_type = genomic DNA
actttatctgttaaacgcgctcctagcgccgtcgttaaacagcgacgcctttgaatcccggccgggactggagtcccggcgcaacacatggcttttataaaaatctccggattacctcgctatcaaaagctcccgaagcccttgcagggggaatttacaggcgcccacctccggctccccagcctggagctggccccgagcggggtcgagctgctgggcttgggagctgagaagggaaaaaagggaaaaggggagttgtttttttttgcaggcatgccttggccggtgggtatttcacggccaatttcagcactcgccacgtgatcccgccttttataacaaagttttgttgggggaaacctaaaggcccttcataaaccttatatgcttataaaacagcatataaaaatttaacagcggtgctgcgctagatttccaactcccctttcataaagcgcagggcgctgcctttatacgtactggagccgccggccttgtcctcagtgtggccggaagacgactcggggctgctgctgctctcggggcgccgccgccgctctttctcctctgctgccgccgccgtctcccggcagccgccgccgccgccgctgtccgaacttgaagttgccggcgcgcccgttgcagccgccgccgccgccgcggaggtcgccgtggccgccgggggccccttctcggcgctcttgtccccggggtagtcggaggaggcgaggttttccggggtgccgtaggctgtctcgaaaaactggtcgaaagcctgtggcaggacgccgttcctgcccacggtgctatagaaattggacgagactgcgggggtggggtggtggtagacgttggccgagctcttggccagcacgtcgccaggcacgccggccgcgctgggcgcctgcaggcagtctctgtgcacgagctcctccgcggagtagcagtgggccagattgccgcgggggtgccatttagtggcgggctcaatggcgtactctctgaaggtcacttcgcgcacgggttggacctggg

SEQ ID NO: 31151 - DNA, 152 bp, Homo sapiens
  misc_feature 1..152: note = chr7:27224906-27225058
  misc_feature 1..152: note = hyper
  source 1..152: mol_type = genomic DNA
gctggtcatgtgacccgatgttgaaattgacaagctgctagctagtccgggccttttccccccccctttccttttttttttttcctcctctcccctccctcccggcttcctttctttgtagccacctcaggggaagcaacagatcgtcactc

SEQ ID NO: 31152 - DNA, 98 bp, Homo sapiens
  misc_feature 1..98: note = chr7:27227776-27227874
  misc_feature 1..98: note = hyper
  source 1..98: mol_type = genomic DNA
tggggctgagaaaggcgctccgggagcggctggcagggcaattcggcaggctgcaccgaagccgagtgcccggagggacttgccgcccggaagggggt

SEQ ID NO: 31153 - DNA, 30 bp, Homo sapiens
  misc_feature 1..30: note = chr7:27228676-27228706
  misc_feature 1..30: note = hyper
  source 1..30: mol_type = genomic DNA
gaaggccaacgcctgcgccaggcttgtcag

SEQ ID NO: 31154 - DNA, 724 bp, Homo sapiens
  misc_feature 1..724: note = chr7:27232256-27232980
  misc_feature 1..724: note = hyper
  source 1..724: mol_type = genomic DNA
gcctcgggctgcgggcggcttcggggcctacagcccagcggcgcggagcgtggcagaggcgcggggcgcagcgcagcccgaggctgcctcccgcccgggcggacggcgcggccgctggggtgcacagcgtagccccgcgtgcccggctcgctctccgttccctcggatagctcccaccgctcggctccgggctcagaaagcggaagtatttggtagagaaaaacacggtttcttttcagctcgtctcaaaatcccttttagagaaaatgctcctgtcaagttttatttcccgttgcaaaccaccttccacgctgccaagaattaagaccgggagagattaaatacccgattattctcctggggagggcggggcggggccgggaagtgggcacccacaccaaacattccttgaagtaggcttgtcctgatccagccgcgcccggggagccccacgaaggcccgcgcggcctgcggtgacgtcagcctgcagttgcggggccactcacccgcacagacacggcccttgctgttccgcgccgggacctccgccagccgtcctgccgcagccccgactggcccgcgtgccgtcagagggaggcccgctttacaccggcctgagcctccattttgagtagggggttcttgtagaagcgtggagggtttggggccgcgcctctgtccccgaggggcgcgacatcaggtagctctccgagttcacacccca

SEQ ID NO: 31155 - DNA, 30 bp, Homo sapiens
  misc_feature 1..30: note = chr7:27237273-27237303
  misc_feature 1..30: note = hyper
  source 1..30: mol_type = genomic DNA
atttcagtaccttctcgtttcccctctaaa

SEQ ID NO: 31156 - DNA, 88 bp, Homo sapiens
  misc_feature 1..88: note = chr7:27238082-27238170
  misc_feature 1..88: note = hyper
  source 1..88: mol_type = genomic DNA
aagttacacagggatcggaccccagccagggcataggcgacagctcgatctgagccacccgccttgcagcgcccggctgctctttgcc

SEQ ID NO: 31157 - DNA, 78 bp, Homo sapiens
  misc_feature 1..78: note = chr7:27238793-27238871
  misc_feature 1..78: note = hyper
  source 1..78: mol_type = genomic DNA
gaggtggggaggctgcgcctgctctttggggcagtacatttggccgttccagccgttgggcagcgcccagggctggta

SEQ ID NO: 31158 - DNA, 32 bp, Homo sapiens; identical to SEQ ID NO: 8952
  misc_feature 1..32: note = chr7:27239141-27239173
  misc_feature 1..32: note = hyper
  source 1..32: mol_type = genomic DNA

SEQ ID NO: 31159 - DNA, 618 bp, Homo sapiens
  misc_feature 1..618: note = chr7:27239225-27239843
  misc_feature 1..618: note = hyper
  source 1..618: mol_type = genomic DNA
cgagcaggggctgcattgcttggcggcctctgcgcccgccgggcccgccgggccgggacctcccgaggacgacgcggcggcggcggcggcggctgcagcggcagccgcggcagcagcggcggcagccgacgggggcgcctccccgggggcgctgctgtaggcggacgcggctcctggcgccaagggcgccgggtgcgccatcaggttgcggcactggttggccgcggccgccgccgcagccgcggccgccgccgccaccgagaagttgccccctgccgccgcagccgccgggtgggggaagcccccgcccccggccccggcagccgccgccgctgcagccgctgctgcagccgccgccgccccttccatgttcttgttgagctcgtcggccaccaggccgccgccgttgtcgtagagaaacatgacggtgggctcgatccagcgggggtggaggagcacggaggctgtcatagcccgagccgcatggagaagaccccagtggcgctgttttaaaaagcccccaagaagtgaagagcgcgcggcgcggggccggggcccgagcgaggggggcggatcgcgccccgcggggtcgcgccaggcggccgcccattggcccgg

SEQ ID NO: 31160 - DNA, 77 bp, Homo sapiens
  misc_feature 1..77: note = chr7:27240230-27240307
  misc_feature 1..77: note = hyper
  source 1..77: mol_type = genomic DNA
tttctttccaggaaccggcgcgtatttctgcagtgagaccacaggacggacatcggcgccttcggcttcgatggagt

SEQ ID NO: 31161 - DNA, 181 bp, Homo sapiens
  misc_feature 1..181: note = chr7:27240992-27241173
  misc_feature 1..181: note = hyper
  source 1..181: mol_type = genomic DNA
tgaagaaccaagcagcgacccgtcttgtagctgccatgttttgtcgaggggttctgggggtcctgctgctttagagccacatacttccacttcctgattcactactgtgagctggtcagatgcctagaagaggaacaagcgttcaaagtgaaagtgggcacattaccggaatagtgctggg

SEQ ID NO: 31162 - DNA, 72 bp, Homo sapiens; identical to SEQ ID NO: 8957
  misc_feature 1..72: note = chr7:27244539-27244611
  misc_feature 1..72: note = hyper
  source 1..72: mol_type = genomic DNA

SEQ ID NO: 31163 - DNA, 513 bp, Homo sapiens
  misc_feature 1..513: note = chr7:27244797-27245310
  misc_feature 1..513: note = hyper
  source 1..513: mol_type = genomic DNA
cgcgggggacaccggcttgctggactgcaggggcccgtgccacccaggaagtgacctgcgggtcactcagccggggcgctgggcgagcgcgggacggcccggagaattccgtgcggctgcgacgggaaaaggacgaggggtctctgtacccgacgctgccactggcccaaaggaattttacccgcgagcgcccaccccaccctagcttgatgcttacgcccgcaacaaaacaggaaaccaggactgggcagtgcattctttaagtcaacaaatacactgaagacttcgagcgtttgaaggaaggagggggtttgcacgtaagcctggccccgccgggctcggctttctcgctgagaaagcggcgcaggcagccaggcggcctgggcccgcgggggtccatctcgccctagactcctaagaactcccacggccctgttcccagctgcgaattcttaatgcacaacgcgacggagggaaggaaattcaccagcgcagcgacgaggaaggggaact

SEQ ID NO: 31164 - DNA, 64 bp, Homo sapiens
  misc_feature 1..64: note = chr7:27245526-27245590
  misc_feature 1..64: note = hyper
  source 1..64: mol_type = genomic DNA
gctggtgacatacttcgctggcgcatctccttactcactcttacttttccgacccctcaccatt

SEQ ID NO: 31165 - DNA, 165 bp, Homo sapiens
  misc_feature 1..165: note = chr7:27250066-27250231
  misc_feature 1..165: note = hyper
  source 1..165: mol_type = genomic DNA
ccaggaggttgcagtcgctgtgggcggcggcggaggatgctcgcaggacaccgctgcagttgcgacctcttcccactagatgtcttcccagttaatcggaactcaagggcgctgtctctgctcctcgggccgagactcggtttcccctgccgctttttgaagtct

SEQ ID NO: 31166 - DNA, 175 bp, Homo sapiens
  misc_feature 1..175: note = chr7:27252380-27252555
  misc_feature 1..175: note = hyper
  source 1..175: mol_type = genomic DNA
gcgaccgcacccttccgctgaagtcccccacttctgcccctccgaggtggggtgggggtgttctgaaataacggtggctgcagttagatggctgaggacatagaaagcggttgttatttattccaggcaccatcacaaaaggcttccaaaaatatcgagccgagatattttattg

SEQ ID NO: 31167 - DNA, 24 bp, Homo sapiens
  misc_feature 1..24: note = chr7:27252795-27252819
  misc_feature 1..24: note = hyper
  source 1..24: mol_type = genomic DNA
tttttctttctctcccggattgtt

SEQ ID NO: 31168 - DNA, 284 bp, Homo sapiens
  misc_feature 1..284: note = chr7:27252895-27253179
  misc_feature 1..284: note = hyper
  source 1..284: mol_type = genomic DNA
cggagaggcctacgcaggtccccggtgcccgcggccctcggaggccgggccctgcgtcttggccaggcactgggtggcagctgaggctggtggcccggagccctcgcggccgcgggcaggccccttcttgggcagggtcgggcactcccgctgtccagggctcttcggcaccctccttccaatcaggtcgctctcccctgctccccagactcaactcctccgaagctgctccaggttgaaatgtgaccgctaggccgactccctgggcccgcgagcagttctcg

SEQ ID NO: 31169 - DNA, 787 bp, Homo sapiens
  misc_feature 1..787: note = chr7:27264797-27265584
  misc_feature 1..787: note = hyper
  source 1..787: mol_type = genomic DNA
agttcttttacacaacgtgaattatattgaaattgggctacttcatagagcttcgcctcagtggaggacagcctggaataggtgagggggtctcgaaaggaataccaggccggggagtactggcaagtgtcggaggggaagggcaggtcggggagaggatccccaggggctgggtgtctgcagggctccccgtaactcagaggggccggcggccgccgcccgaagcctgagcttttctcagcagatggagaattcatttttaacccccaggaaggaatgggctgagacatcagaccaccgctcctagagggtcaaatttcctccccataaatccaaaacattctctttagggagttccctccgtggcgcgcaaacccgggaagccgcgcgccctggggtttcttggcgggccgtgcgcgcagcctgaaccgccaaagtcgcgtcatcccgcatttgcctgcacccaggagtttgcaacccgcagagcccgcagaggccaccgccaagagtgcgcgccttggcgccccgtcggcctctacttcctcggatctgagccagcgccgctaatccgcaggctgcagcagaacctgtcgccagcttggagagtccctcgcgctgccctggcttcccggtccgcgggcgactcgcgctgctcccgggtttgtcgggaccccaggagggcgctcaagcctgtcggcccctacttgtgtgtagagaataggcccgggtacaccacctcagaaatgcagaggaagccggggacactgaagcccgggtggttgcagtg

SEQ ID NO: 31170 - DNA, 57 bp, Homo sapiens
  misc_feature 1..57: note = chr7:27275040-27275097
  misc_feature 1..57: note = hyper
  source 1..57: mol_type = genomic DNA
atgggggattggggccgctgctccgggcagagccgcgggatccgagccagcaaggat

SEQ ID NO: 31171 - DNA, 132 bp, Homo sapiens; identical to SEQ ID NO: 665
  misc_feature 1..132: note = chr7:27279237-27279369
  misc_feature 1..132: note = hyper
  source 1..132: mol_type = genomic DNA

SEQ ID NO: 31172 - DNA, 62 bp, Homo sapiens
  misc_feature 1..62: note = chr7:27279453-27279515
  misc_feature 1..62: note = hyper
  source 1..62: mol_type = genomic DNA
cgccgggcctggagcggcctccacctcagctgctatcaccccctctccgctgtcatgggatt

SEQ ID NO: 31173 - DNA, 1058 bp, Homo sapiens
  misc_feature 1..1058: note = chr7:27282237-27283295
  misc_feature 1..1058: note = hyper
  source 1..1058: mol_type = genomic DNA
gaggcccacacctggcgcatcactgccgagccattagctgcgggtttcctttcatcttcgctgtggcagacgtttctatttatccacttgcgctcgccgagtggcgtcaccagcggtactgtaatgacgattgcagcaggaggatgacagcttagaaagaagagggcaatggggcttcctcccagaggcggtgcggcacagaggagcgctcgcttcacaaggtgaccctagctcccaccgccaccgccgcggtcgcggtccagaccgcgctccagcagctccgcgccctcccaggcacccggcctttctttctccctcttgcaaccaagatccgtccggccgctggagacccagggagccggggttaggaactcacttggggctttcccctcccccaccggagagccccgggatggagagccgaaaggacatggttgtgtttctggatgggggtcagcttggcactctggttggcaagagagtctcaaatttgtccgaagccgtgggcagcccgctgccggagccgcccgagaaaatggtgccccgtggttgcctgagccctcgggccgtccctccggccacccgggagcgcggcgggggaggcccggaggaggagccggtagatggactcgcaggcagcgcggcggggccgggcgccgagccccaggtagctggggcggccatgctcggcccaggacccccggccccctcagtcgacagcctctccggacaggggcaacccagtagctcggacaccgagtcggatttctatgaagaaatcgaggtgagctgcaccccggactgcgccaccgggaacgccgagtaccagcacagcaaaggtagccaccgtgcccctccgctccccgggcctcccactgcgcccacccttcacttcggcgcaggccaggaggaagacactcccttcccctagggcaggatggctggggggacccacctgagcaactctctctgctatctgcgttctggcgggggtctcctactgtgttctggcattggcgggactgagggtgacagcagtgccttgagtgcggggtgct

SEQ ID NO: 31174 - DNA, 15 bp, Homo sapiens
  misc_feature 1..15: note = chr7:27284655-27284670
  misc_feature 1..15: note = hyper
  source 1..15: mol_type = genomic DNA
tcgctgtgcagggtc

SEQ ID NO: 31175 - DNA, 205 bp, Homo sapiens
  misc_feature 1..205: note = chr7:27285620-27285825
  misc_feature 1..205: note = hyper
  source 1..205: mol_type = genomic DNA
cggcctgccctaccccttcccatcgcacctgcccctgccctactactcgccggtgggcctgggcgccgcatccgccgcctccgccgccgcctcgcccttcagcggctcgctgcgcccgctcgacacgttccgcgtgctgtcgcagccctacccgcggcccgaactgctgtgcgccttccgccacccgccgctctaccccgggccc

SEQ ID NO: 31176 - DNA, 84 bp, Homo sapiens
  misc_feature 1..84: note = chr7:27289482-27289566
  misc_feature 1..84: note = hyper
  source 1..84: mol_type = genomic DNA
ggcatgccccacgaacggtttctttagtgattatgttgactccaccttcctagtttcaaaccctgcacccgcactctccagaca

SEQ ID NO: 31177 - DNA, 55 bp, Homo sapiens
  misc_feature 1..55: note = chr7:27289813-27289868
  misc_feature 1..55: note = hyper
  source 1..55: mol_type = genomic DNA
cagccaccatatgtccgccggagaataagcgtgagtgtcgcggtggacagttgcc

SEQ ID NO: 31178 - DNA, 173 bp, Homo sapiens; identical to SEQ ID NO: 667
  misc_feature 1..173: note = chr7:27290946-27291119
  misc_feature 1..173: note = hyper
  source 1..173: mol_type = genomic DNA

SEQ ID NO: 31179 - DNA, 877 bp, Homo sapiens
  misc_feature 1..877: note = chr7:27291314-27292191
  misc_feature 1..877: note = hyper
  source 1..877: mol_type = genomic DNA
gggctgggcaagccgaggaacagcgagcccccggacgctgactgcaggacgtcccagtttgtgcccgggtctccgtccctccccgtacggggctcgtacccccgggcctgggtctgacccacagggcgctgaggcctttgtagctgaagtcggaaggcctcgttgcgagcgcggcacaggttgctggtagcttctggactctggaggcttggccttccttctaagccgatggcggggaaagaacctcgtttccacagcttccccgacccccgccgcttgccatttggggacgggaagcgcgcccgggtcgcttcacgtccctctgggccggagccctttccatggctggctcctctgggggcccttgggcctgtgagcagcgtctacttccctcagagaagaatcctttccttcccccatcgaagtgtccctttctgtatcctgaaataacccctcctgggtgaggccagttcccctctgtcgccctcctcccgcaggcgtccgggagcctcgtgaggaccccgtgcagttgagtccaggcgacaggtgcctccccaggtgtctacttgccctccctcaacctgtttagggaaagaccagaacgatgtgcgcggggaggtggttttgtttctcccgaaactggcgctcttgggtaaaaccgcgtgccgcgtctacgcgggctctgttagtgtgcgtgtcccagaagagtgggccttctaggcggcactctttggagaagtaagtgaggtgaactcagaacagagaagcgggaacgatcgtttgatgtgccgagccggaaaaagagaggagagggagaggctcccagcgagcgcggagacagaggagcccacgcggcacagcacgagccctactcttg

SEQ ID NO: 31180 - DNA, 371 bp, Homo sapiens
  misc_feature 1..371: note = chr7:28448920-28449291
  misc_feature 1..371: note = hyper
  source 1..371: mol_type = genomic DNA
cccacgtgacgtcaccgggggggtgatgtaatgcactctaaatagaatgtattgtaatctttgctcagtccaacgtggtcccttcacccgggctccgctcttgccttctccacacttgtttggtaagttcctaaaaatacggctcggccacttctggggcttttgcatttagccacttttgttgcacttgccgcaggagccatctcgggagtgtacttgtttgcaggggttggttctcggcagcagccgcgaggttacttggtccagtgggcaggtcacagggcaaggagtagggaagatgcgatgcatttttttctggagggtgatctgtgtttgtaaacattttggcggaccagagggaagtccggccc

SEQ ID NO: 31181 - DNA, 124 bp, Homo sapiens; identical to SEQ ID NO: 3013
  misc_feature 1..124: note = chr7:28449658-28449782
  misc_feature 1..124: note = hyper
  source 1..124: mol_type = genomic DNA

SEQ ID NO: 31182 - DNA, 184 bp, Homo sapiens; identical to SEQ ID NO: 3014
  misc_feature 1..184: note = chr7:28449857-28450041
  misc_feature 1..184: note = hyper
  source 1..184: mol_type = genomic DNA

SEQ ID NO: 31183 - DNA, 221 bp, Homo sapiens
  misc_feature 1..221: note = chr7:28893380-28893601
  misc_feature 1..221: note = hyper
  source 1..221: mol_type = genomic DNA
acaaaacaaaaactacgcaaaagacctgcttctttgccttgggccctgactttttagggggcagggtcttctgcgaggggcggttaagtggcagggaagcgcagatcccgctgcacgccgcagcagcccgggtgtggagcgcgcagagggggcacctcggctgagtttcgggcacgctgcgcacccacgggaggatttcagggaggcggtggccaagtcgg

SEQ ID NO: 31184 - DNA, 222 bp, Homo sapiens
  misc_feature 1..222: note = chr7:28995770-28995992
  misc_feature 1..222: note = hyper
  source 1..222: mol_type = genomic DNA
ggctgctggccaaagcggtcaaagagcaggcggaagcgcgcgccgcccagcggccggggactgcggtgctcgcgcacggcccagcgcaccgaggcgctgtctgcgcccaccgcctccaccgtcaggttgcacagaatgaacttgttgaagtcgcatgggtcggacaccagcggcggcagcccggccccaccgtcggactgggcggcacgctcctggtgctcc

SEQ ID NO: 31185 - DNA, 56 bp, Homo sapiens
  misc_feature 1..56: note = chr7:28996341-28996397
  misc_feature 1..56: note = hyper
  source 1..56: mol_type = genomic DNA
tcatctcctcccctgcggccgtgggtaggggctgccgcctgcggtcagcggtcagg

SEQ ID NO: 31186 - DNA, 862 bp, Homo sapiens
  misc_feature 1..862: note = chr7:28996623-28997485
  misc_feature 1..862: note = hyper
  source 1..862: mol_type = genomic DNA
cggcgaagatgtccccggatagggcgctgagcgcgttgttgcgcaggctgagctcgcgcagccggcccaggtggccgaaggtggccgggtgcagggcggacagctcattgccgctcaggtccagcgcctccaggctgtgcagaggctccagcagcgcagttggcagctggctcagccgattaccctccaggcgcagctcgcgcagggcctccaagccccaaaaggcctcaggcgcgaggtgcgtgagctggttgcccctgagcgagagcaggccgagacgtggcaggtgctggaagatgcgcggcccgaggtgctgcaggttgttggccgagaggatgagggaggagagggagcgcagcggtgcgaaggtggccgcgtggcgcagggagggctgtagctcgttggcagagaggttgaggaagcgcagcttgcctagctgggcgaaggcgttcttgcccagaaagcggatccggttggactccagatgtaggtagagcaggttgcccaagggagcgaagaccgcgtccggcagcgcccccagggcgttcccgtccagccgcagcttgactagactctccaggccctcgaaggagccgcggcttaggcggctgatctcgttcccgttggcgtagaggatgcgcagcttgcgcagcggggccagcgtgcccggggcgagcgcctgcaagaggttgttccccaggtacagctcttccagccgcgagagcttctcgaaggtcttggggtgcagagagcggatctggttgtactgcaggtccagccgtctgagctgccccagacggtggaagtcgaaggccgtgatgttggttatgaagttgccgccgaggctgtaggtgagcacgtc

SEQ ID NO: 31187 - DNA, 160 bp, Homo sapiens
  misc_feature 1..160: note = chr7:28997486-28997646
  misc_feature 1..160: note = hyper
  source 1..160: mol_type = genomic DNA
tgggggctcggccagcgagctggtcttgggcactacgcggagccccctgttggtgcacaggagatgctggggatgctggcagtcgcagcgctccgggcacacgggctcggcagcggcgggagcgcgaggcagccgcacaccacgagcaggaggcgcaagg

SEQ ID NO: 31188 - DNA, 511 bp, Homo sapiens
  misc_feature 1..511: note = chr7:28997676-28998187
  misc_feature 1..511: note = hyper
  source 1..511: mol_type = genomic DNA
cgtgcagcggccggatcgtcctcttggcccgccggctctgtgtctcctctgcattccccttagcctggccagagtcgctaaatggcctctttcggacttcgcagcgccgtccagcccctcctccgtcctttgtccggaggccggcccgggtctctgcaggcgggcttcgcccggccaagtcaggcggcgcggggcgctctgcagaccccgggtactacttgttgcatttctgtataaaactgtttctccgggtgcgcgtcggcgggcgggaggagggagcaagacccggcgctttttgtttgcagctgagtccggagagctggattccctggcgcggattctcccagccgagtggattccccagctgcaggcgggagccgttccaagagcttcgcggggcgcggcttggcagcagagccccggctgctcggcccccgcagacggcaccttctcgctcgcggtcccggacggggagggcggctccagtgcaatagctcggggagcacgcggg

SEQ ID NO: 31189 - DNA, 382 bp, Homo sapiens
  misc_feature 1..382: note = chr7:29185815-29186197
  misc_feature 1..382: note = hyper
  source 1..382: mol_type = genomic DNA
tcaagagtattccctcggctgggcgcacgcagtacatccccaatgctccaatttgaactttgactcggccacgaccaccccactccagtctcactctacggtgctttctcccctgttggtgctgagggcttttgagactacctgccccgcgctccctaagtccgagggaccgaggcgaggacctgtcccgctgagctggcacgacccacgcagggcaggcggcacttacgcggcgcagtcggtgctcctccctgagccgcggcgcgcaaggaccccagccggttgtccttgcagcgcttcccaaatcaggcagaagtgaggcagccccacccagtcacgaggaccctgcagaactcgagcctttaagcgctcctctaggctc

SEQ ID NO: 31190 - DNA, 141 bp, Homo sapiens
  misc_feature 1..141: note = chr7:29603652-29603793
  misc_feature 1..141: note = hyper
  source 1..141: mol_type = genomic DNA
gaaacactactagcccggaaagccgccctggaccttccacccgggcagcgagtctggcggcccctcgccgccgccccctccgaccagaacagactgcgctgcgagccccgggcttccgccgcagcgcgcagcaattggagg

SEQ ID NO: 31191 - DNA, 441 bp, Homo sapiens
  misc_feature 1..441: note = chr7:29604285-29604726
  misc_feature 1..441: note = hyper
  source 1..441: mol_type = genomic DNA
aatgacttgggggtacgggttgcttttccgatctgcaaagtaggagggaatgggatgtttgcagacgcagttgctaattgtgcctgagggcgtgggtgccttttgtaccgaaagaacttttggccgttttttcttgtattgttttcaagtcgctgcccgagtgtgtcctcagggcatcctggggaggagccggtgttgcggtttcggggcgcagccgaggccgccccgccgcctcccgtaggcgatcagacttcctctccctggcggttccgggaggagaacctcctacaacaaacaccgccgaagtttccctctccagcgcgatcgccaatcccaggagcgcccggcgcgtgggctgggaaggagccgagcggaaacctggaagtgagccgcggcgcaggcgaatcctgccgttgctggtggcagcgcccaagagacccc

SEQ ID NO: 31192 - DNA, 495 bp, Homo sapiens
  misc_feature 1..495: note = chr7:29846202-29846697
  misc_feature 1..495: note = hyper
  source 1..495: mol_type = genomic DNA
ctgcgggacggagcccggagccggaggcggcggcggcggagacgtcggccggagctcgagtccagtccagcccccggctccgccacctgcaggtagcggcttcccgcgcgggtgcgggtcggtgcccgagggtggaaggaacgggcggtgtggcggccgccgccctggtcggtcccggagcagagtggcccggcccgggacagagatcctgagggcgtgggagggccggggaacccccgccgggctgcagccccgggcccaggaggttgtcgacgtgccgcgcggcgctcacgccccccacccgcaccctgccacgccgccccggccgggccgggccgggccgggcggaaacaaaccgcggggtggggagcgaggtcaccacggggttgcttggtgacttctccggactggactccccggtgagcagcccctggcaccgaggccgcctcggcctggtccttcgcgacgctctctcttctccgcttcgcccccgga

SEQ ID NO: 31193 - DNA, 741 bp, Homo sapiens
  misc_feature 1..741: note = chr7:30721202-30721943
  misc_feature 1..741: note = hyper
  source 1..741: mol_type = genomic DNA
gggaacttcaggcaacgggaacctacaatgagggaaggaggtttacactccaagaggaggaagtatttccttctcccctttttgggctgtcaccgcatggagcacgggaattgtgggcaaatcactggcttactgagattagacgctgtattgggggtagaagcagaaggcgcgcccccaacactgtaaggggtccttaacgcccgcggtccgcggtaccgcggccgtcagcagctttgtaccgctgggtccggaatcctctttactccctaaaccgccttctcaggaggccggtgtagagcaggcagcgagggccgggggcactcacgggtcgtgttgtacttgacgccgttgaagtactcggggcacggcctctccacgagggctccggcagcgctgcggggccagcacgttccgatctggtccaaggtcgtgttgcagtaggagtagggacctggcggcgggagagagcgcagtagggctcagaggggcccgcagggacgcggggctctcggagcgcggggtcaggggcgcacccagcgcgcgagagaaggagcccgcgcagcctccgaccgctcgcctcccgcctaccctcggggtccaggggtggcccccagccgtccaagagcagctcttcagccagcgccaggctgcagttggcctccagcaggctgtggagcagtgccgcgtccatcgcgtcccgcagccgcgtgcggagagggagtgggagtgcgcgcccgg

SEQ ID NO: 31194 - DNA, 96 bp, Homo sapiens
  misc_feature 1..96: note = chr7:30722018-30722114
  misc_feature 1..96: note = hyper
  source 1..96: mol_type = genomic DNA
cgatctcccgggcagcctttgggcgccacctccggtcgcccagagctgtcaagtggggaccttcccggagaggagccgccgagtgcacggagctgc

SEQ ID NO: 31195 - DNA, 332 bp, Homo sapiens
  misc_feature 1..332: note = chr7:30722115-30722447
  misc_feature 1..332: note = hyper
  source 1..332: mol_type = genomic DNA
ggtacagccgctccgccgcggccaatggctgcgccggggggcggggccgggcggctcctctcggaggggctcagtctccagcccccgggccctccaccctgcccaaagtacggcttctcagttcgcagctctcttccactcgcggcgtccagaggagggcggtgggctggagagcgtgggcctggggtgacggaatgctctgtgcggggatcgcaggcccccgagctgcagggggcagcaaagcgcgcccacctgcccgcctgcccgaggagaacaccgcagctctgctaatcgagggacagccgcaacccaaagttcggcagctttccgcc

SEQ ID NO: 31196 - DNA, 222 bp, Homo sapiens
  misc_feature 1..222: note = chr7:31091945-31092167
  misc_feature 1..222: note = hyper
  source 1..222: mol_type = genomic DNA
gcttcgcggcggaggcggcgcctctcccgcaggacggagccaagctggactgccgcgccgcgcggggcgggcaaagggggcgctgcgctcggccccgggcagggagtgacggcggcggcggcggctccgggcgagcgtggtccccgcgtgcgcacacgcacacgccgccgcgcagggacacacggaccccggccgccagccggccacacaggcgcggagacc

SEQ ID NO: 31197 - DNA, 458 bp, Homo sapiens
  misc_feature 1..458: note = chr7:31092241-31092699
  misc_feature 1..458: note = hyper
  source 1..458: mol_type = genomic DNA
cgtcctttgcggagtctgccccggccccacggacaggccccgcagtgagcaggtaagggtcgccccgccgcggctgcccctccacgcctcggccgtcttctccccctccagaaccttcgcccagccgggacctcggatcccctcctctggcttggcggtctccgccagccgcgacctccaccgacggagagcgggcgagggccggcgccaggcaagcctcccagatctgaaatgaagccccctcccgccgctgcgcccttcctgcgcgtcaggctgacaccccccaacccaagtgtctggcgctgcgctcggggcggccgatcgccgcagactgccggggtgggggtcgacctagctatctcacgcccctcctgatgcggagaagggagaccaggggggcaggcaagccatgcggccggagggacccggagggacatgcctccctacccttaggtgga

SEQ ID NO: 31198 - DNA, 167 bp, Homo sapiens; identical to SEQ ID NO: 8988
  misc_feature 1..167: note = chr7:31092713-31092880
  misc_feature 1..167: note = hyper
  source 1..167: mol_type = genomic DNA

SEQ ID NO: 31199 - DNA, 296 bp, Homo sapiens; identical to SEQ ID NO: 8989
  misc_feature 1..296: note = chr7:31092894-31093190
  misc_feature 1..296: note = hyper
  source 1..296: mol_type = genomic DNA

SEQ ID NO: 31200 - DNA, 30 bp, Homo sapiens
  misc_feature 1..30: note = chr7:31232688-31232718
  misc_feature 1..30: note = hyper
  source 1..30: mol_type = genomic DNA
ggctgcggattgccgcgctgcccctagagg

SEQ ID NO: 31201 - DNA, 151 bp, Homo sapiens
  misc_feature 1..151: note = chr7:31376067-31376218
  misc_feature 1..151: note = hyper
  source 1..151: mol_type = genomic DNA
gatagctggagctatcgccgcctgcgccgcgtccctgcttgtggcacaaggggcgggtgaaggggcaaccccctttctccctctccgagcgagtgcggggcagagcctccaggcccgcgcgcggcggtgcgctcgccgctctccatgccac

SEQ ID NO: 31202 - DNA, 128 bp, Homo sapiens
  misc_feature 1..128: note = chr7:31528357-31528485
  misc_feature 1..128: note = hyper
  source 1..128: mol_type = genomic DNA
taactccaaggagcccgggtatcattgtagtccatgtcaatggcgccccctggtgttcgggggcgcagcagccctgtgcgagtcctgcagcaggccctcctggcccatccactcggtataccccactt

SEQ ID NO: 31203 - DNA, 143 bp, Homo sapiens
  misc_feature 1..143: note = chr7:32110353-32110496
  misc_feature 1..143: note = hyper
  source 1..143: mol_type = genomic DNA
acaaagccacagaagcgatcagcgcgcagctaaagggtttggaggtgaaaaggagggctgggtggggaggagagaaagtgagaagggagagaaaagcggcggctgagcaaagcgggagccggcgcgggcggtggggcctgacc

SEQ ID NO: 31204 - DNA, 99 bp, Homo sapiens
  misc_feature 1..99: note = chr7:32110703-32110802
  misc_feature 1..99: note = hyper
  source 1..99: mol_type = genomic DNA
cgccgtctgccgggcacacgctgggctccgaccccggccgggcacactcacccccgcagggcagccgcggccaccaccgacctgcggagctgcgtgggc

SEQ ID NO: 31205 - DNA, 176 bp, Homo sapiens
  misc_feature 1..176: note = chr7:32337807-32337983
  misc_feature 1..176: note = hyper
  source 1..176: mol_type = genomic DNA
ttctatcagtgtccccgtgtctggatgttcctgccgctctgtctgtgtgtctctatcatgtccacatcttcctgtcgctttctgtctccctctctcggcactatcttcatctctccatcgcagcgtctccagccctatttccacccctcctttcccccggcctgccttattaaaat

SEQ ID NO: 31206 - DNA, 175 bp, Homo sapiens
  misc_feature 1..175: note = chr7:32338043-32338218
  misc_feature 1..175: note = hyper
  source 1..175: mol_type = genomic DNA
cgccgggtcggagcccgcgaggggtgccgggggggacagcccagggtgcggcttctgtcccgacccagtcgccgctcccgggggctcccgcccggagagcaccctccggccccagcccgacccctgagctccccctgcccgcttagaaaggaactctgaccgccaccggagaggg

SEQ ID NO: 31207 - DNA, 403 bp, Homo sapiens
  misc_feature 1..403: note = chr7:32338283-32338686
  misc_feature 1..403: note = hyper
  source 1..403: mol_type = genomic DNA
cgatgctgaaagtggcgctccggcattttttgaagccctccttcctgttgccggcgtccgtcatggctcggccggccgggcaggggcctcgcagcgagaccagcggcgtctgcggtcccccccacggcggagtgagcagcccggggctcggcggcgaatcctcccccggccgcgccgcgctgtcactctcagccccgccgcgcgctggcagctgagcgcctggagacaacagcggggacccaatgtcaacagctaaagcgctaggagctcggcggaggcaggagccgtcgcgactgccccatctccaagccgagttccagaggcggcgagaggagtgtcaggaagggaggacgcgcgcccgagcgcgtggacggggctgaccggtgggcgcggagatccctgc

SEQ ID NO: 31208 - DNA, 143 bp, Homo sapiens
  misc_feature 1..143: note = chr7:32338925-32339068
  misc_feature 1..143: note = hyper
  source 1..143: mol_type = genomic DNA
tccaaacaaggaagtcgggaaaatcgccacgcccacttccttctagccactgcccccagcactggcctggagccccgatagtgtttcttctccactgtccctgccaggaaggtaattgtcaaagtcaccggaggctctatgat

SEQ ID NO: 31209 - DNA, 30 bp, Homo sapiens
  misc_feature 1..30: note = chr7:32467165-32467195
  misc_feature 1..30: note = hyper
  source 1..30: mol_type = genomic DNA
ccatggtgccggccccggtactaagctggg

SEQ ID NO: 31210 - DNA, 237 bp, Homo sapiens; identical to SEQ ID NO: 670
  misc_feature 1..237: note = chr7:32467419-32467656
  misc_feature 1..237: note = hyper
  source 1..237: mol_type = genomic DNA

SEQ ID NO: 31211 - DNA, 116 bp, Homo sapiens
  misc_feature 1..116: note = chr7:32467946-32468062
  misc_feature 1..116: note = hyper
  source 1..116: mol_type = genomic DNA
cgcctaacagtctggggtggatgggacttggggagtcgctatatagaggctgtccggaggctttactggaaattgaggggaggaaggggcgtggcattaggcgagggatacttttt

SEQ ID NO: 31212 - DNA, 30 bp, Homo sapiens; identical to SEQ ID NO: 8997
  misc_feature 1..30: note = chr7:32468472-32468502
  misc_feature 1..30: note = hyper
  source 1..30: mol_type = genomic DNA

SEQ ID NO: 31213 - DNA, 36 bp, Homo sapiens
  misc_feature 1..36: note = chr7:32801612-32801648
  misc_feature 1..36: note = hyper
  source 1..36: mol_type = genomic DNA
cactcgcaggacccccgcctccgagcttccctgagc

SEQ ID NO: 31214 - DNA, 70 bp, Homo sapiens
  misc_feature 1..70: note = chr7:32997312-32997382
  misc_feature 1..70: note = hyper
  source 1..70: mol_type = genomic DNA
tgcccgacgagtgcccgcgcaccgtgcgcagcggcgacttcgtgcgctaccactacgtggggacgttccc

SEQ ID NO: 31215 - DNA, 799 bp, Homo sapiens
  misc_feature 1..799: note = chr7:33943650-33944449
  misc_feature 1..799: note = hyper
  source 1..799: mol_type = genomic DNA
ggagacccttaggtccgttccgtggggacccggtttcaactcttggacagaggaagtcggtagtccaccgtgagctcaaggacagctagctgatcgtcaggtcccaacacttgccaagcgtccctcactcccacctcgcgccttcgtactttggttacaaaaatcatctctctgcgattgcaccccttttgagtagagggtgccactgcgtggggaggaggcggcgattcagcagggggatcacaggagctgactccccgacacccagtgctgcagaggcgagagggcgcagccgggctgagagagcgacggagctccgagctgcagaggccgccgcgcggcggcccccgccagagatgagcggtggggcgggggttcctccctcttttcgggtgaatgaatgattagtcaaacaccacctccccgccccggtccgcccgagattggaagggaggagtctcggagcgactgttcattttttaaggacgaaaggcgtttgcctcggtacgtttttaaatcgaccttgtgtgtgtttcaacttcggtcatccctagtgtcaggacgcgcagacagctaagcacagaacacatctctaaggccacttgcccctctgtccgctcagccccctgagttcgctgtcgcgcccccgccagagggaagcaaagcagggcatgaaaagttgcgggggccctactgccccgggtgtgtcgctccttcccaaaggtggggcacccgggagcgagcagggtggtggggcgcccctgcgtcccgtttgctgctccctcgctggattggggca

SEQ ID NO: 31216 - DNA, 497 bp, Homo sapiens
  misc_feature 1..497: note = chr7:33944650-33945147
  misc_feature 1..497: note = hyper
  source 1..497: mol_type = genomic DNA
cccgggcgcccccagcgggttccgggaggcgcccggtgagcccacgtctgttgcggcggagcgagcgcgctccgggagggccgagagccggcggggctggcaggaggtgaggagtgcgggagtggaggacgctgcggcagcgacagcgacagcccccgaaacagtagcggcagcccgggcggcggctgagcggcagtgcgcagtcggcagcgccgcagctcctctcagtctatctccggctgccgcaacaccccttcctcctggccccctctccggcgctgaggggctgactgctaagccactgcaagcaactccctcaggaaaaaaaaaaaaaaagccgcatcggaggagcctggccgcaggacccctcctccccgggcgcccccacaccttggtctctccccccgccctccctcacacccccccgccccccagctctcgggcgcccgcctccctccttcgcggacggtctcccgacacgccggctgagagccctt

SEQ ID NO: 31217 - DNA, 198 bp, Homo sapiens
  misc_feature 1..198: note = chr7:33945356-33945554
  misc_feature 1..198: note = hyper
  source 1..198: mol_type = genomic DNA
aggtaggggagggggcgggagggaccggccctccgggacgccggtttggtacctgggaaaggtggcgctggcttgccccggggatgggagggtggggagcgcgcaccttggcgcttgccctgcgctggtcgatggggatgaagcgaagccccgggagggctgggaaggctggtgaagaggttgcgggctgagaggctg

SEQ ID NO: 31218 - DNA, 561 bp, Homo sapiens
  misc_feature 1..561: note = chr7:35225273-35225834
  misc_feature 1..561: note = hyper
  source 1..561: mol_type = genomic DNA
aagactcaagaaaagcgccatgcggctccctcctagggctctcctgccctctccttaccgatgctgagagtggttctgctggggaaccaccgcgcctgcagttcgtgcacctcttcccggagctgcgccagggaattacggacgaactggaaggggtcgagaagggtcttggccaccacctttagctccaagccttttcgctttttcagatttgggatcctccccggggaggacctcctggcgccccctggcagtttcccgccgcctagggccgacttttccacctccagctcccgggcgggggaggccccgtacggccgcttagacgggctggggcgggaagattgcagcggctttgggtttactccttgtttcttcataatccctagtggagctgggtcaatttcaggcacagcccatccgagtcaggcgaggtccagaaaggcctgactcgcctggcagcctcaacggacttgtccccgcagccgttgactagccgttgacgagcggacctcccggtcgtcatggcgactgtgaaatgtagggtggagcgcatgcgtt

SEQ ID NO: 31219 - DNA, 479 bp, Homo sapiens
  misc_feature 1..479: note = chr7:35226044-35226523
  misc_feature 1..479: note = hyper
  source 1..479: mol_type = genomic DNA
cgcagccccacgtacagcccccaacacgctcccagccccactggcgcagaacccatcaccgcttgcccttcacgcgcttcattgggagtgcagctcccaccccgagcgcgcagctccacgcagcctctccacactctccccagcgcttgcagcaccccccagtgcgcacagctctgccagtagcttcccggcgcgccgcccctgcaccgcttcgggccataaccttgctggcgactaagtctgaagaacttcctgtggtttcattcttttcttcaggtttagtcttagctctgacattttaaccaaaaggttacacgttaattaacgaggtattaaaggggaagatctcagctgaaagaaatgactgtaggaagtgtgtcagggaagccaacggaaccgctggcccgccggtggtgcgcccggcattaggaaagtctctacgatcgctgaggtatcgggcagtcagtgcccgttgccaa

SEQ ID NO: 31220 - DNA, 54 bp, Homo sapiens
  misc_feature 1..54: note = chr7:35226556-35226610
  misc_feature 1..54: note = hyper
  source 1..54: mol_type = genomic DNA
cgtggcagagccggcgtgagtccggtgggtctgatcccagagcctcaggttgac

SEQ ID NO: 31221 - DNA, 92 bp, Homo sapiens
  misc_feature 1..92: note = chr7:35226611-35226703
  misc_feature 1..92: note = hyper
  source 1..92: mol_type = genomic DNA
ccacttccttggcacggaacagcgtttactgaatcttagagcaaaatgcttttccaatgaggttcctcagaagtcatcggccctaggagcgg

SEQ ID NO: 31222 - DNA, 210 bp, Homo sapiens
  misc_feature 1..210: note = chr7:35292877-35293087
  misc_feature 1..210: note = hyper
  source 1..210: mol_type = genomic DNA
gacaacttaggagaccgacgggcccagatataagatgcacattcacagcattcaacagactgaagcctccaaagaaaacttggacccaaaagaaaaagatctcccacccgcgatgtatggctcatggcttgagcatcagacgttgctgcgagccgcctgcagccaggggcacagacggatgcgcagcatccccagtcctcggcggacagc

SEQ ID NO: 31223 - DNA, 296 bp, Homo sapiens; identical to SEQ ID NO: 673
  misc_feature 1..296: note = chr7:35293182-35293478
  misc_feature 1..296: note = hyper
  source 1..296: mol_type = genomic DNA

SEQ ID NO: 31224 - DNA, 641 bp, Homo sapiens
  misc_feature 1..641: note = chr7:35294031-35294672
  misc_feature 1..641: note = hyper
  source 1..641: mol_type = genomic DNA
cgcccgagatccgggcatggcccagttggggaagctatgaccagaccagtggaagcctcgggagttctcgctttttccattctttttcttacctgcgctcaaagttccaaaagaaagtagggaagcgctcagtagaatccggcgcctctgagccggcgccaactggccaggtccatactcggggcagatcccagggctgggactctcattcgatggtcccaaatttgatctctttgacagtggggctgagcaaatgcagccctgaaaaagataagcttagcgagagctgcgggcatttggcaaaggatgctgctctcagaaccgtggcttctgctcctcaccagtgcgtctctagcctggggctcctattttccctagagggaccctggaaaatgggacggctgccgaagagaaggcgaaggtcagggcgcggagctctacggtaaccacgcgacgcgtagtgggagagtgcgaaccttatggtagcgcccggactaagcggacacagacccctctggttttacaaaggcggctgtgacgaggacttcccacggccttgttggagggcgtcctgttagccctgctcagcctgaataactcaaattctccgaattcgcagggtaatccgcttcgcttggagc

SEQ ID NO: 31225 - DNA, 29 bp, Homo sapiens
  misc_feature 1..29: note = chr7:35295077-35295106
  misc_feature 1..29: note = hyper
  source 1..29: mol_type = genomic DNA
gctggaaggaatttacgctgtcttctagc

SEQ ID NO: 31226 - DNA, 266 bp, Homo sapiens
  misc_feature 1..266: note = chr7:35296739-35297005
  misc_feature 1..266: note = hyper
  source 1..266: mol_type = genomic DNA
ccgtttaaactttggcgcctaagaatgtaaaattttgttatacatctgagtttgtttatatggaatttgattatatggaagactggaagatgtctccttatatacaccactctttcaaattctcatttgtagctcccggaactcagaagacagtcgacccccaaaactgtccaggaagtaatcggtttccggcttttggacaatggtccctcgcttaacgaatgctaacgaatgctcccttagctgggagctgcagggaccggtcc

SEQ ID NO: 31227 - DNA, 217 bp, Homo sapiens; identical to SEQ ID NO: 676
  misc_feature 1..217: note = chr7:35297137-35297354
  misc_feature 1..217: note = hyper
  source 1..217: mol_type = genomic DNA

SEQ ID NO: 31228 - DNA, 547 bp, Homo sapiens; identical to SEQ ID NO: 677
  misc_feature 1..547: note = chr7:35297470-35298017
  misc_feature 1..547: note = hyper
  source 1..547: mol_type = genomic DNA

SEQ ID NO: 31229 - DNA, 27 bp, Homo sapiens
  misc_feature 1..27: note = chr7:35298121-35298148
  misc_feature 1..27: note = hyper
  source 1..27: mol_type = genomic DNA
cgagctcactaccgcagggaccggccc

SEQ ID NO: 31230 - DNA, 222 bp, Homo sapiens
  misc_feature 1..222: note = chr7:35300787-35301009
  misc_feature 1..222: note = hyper
  source 1..222: mol_type = genomic DNA
gccgcacgtggacaacgggcccgggcggcctttgtaatgttattttttcttttctgaagataattacctagtattctgcaggttcctctggtgcaacagagactgccgcggggcgggggagaaggtggtgaggggggtcgcgcatcgctcagtgcaggtctgtgctttcacttggcctgcgctcaggtcagtgcgccccttaccggagcacccatggcctcc

SEQ ID NO: 31231 - DNA, 847 bp, Homo sapiens
  misc_feature 1..847: note = chr7:35301101-35301948
  misc_feature 1..847: note = hyper
  source 1..847: mol_type = genomic DNA
cggagccttagtttccctagttgtgaagagggagggtgtgaccatggcccggagctctccgaaaggctgtgcggattgctcggtggcgggatgtggagcgcgtcttctatgatgccaggtgctggccaagcgctcgatgcaggctgctccagttaggtcgatgcgatggcgggaagcactttcctctgcaatggagagacgccgacaccccgagcccgaaggcttgcaaggcgcgctctcgccactggggtcggggatccgtgggttctctatcccgcttacccactccatccttagcagctgtcgtcggtcccagacctctaccttggagagaccaaggcggcccagagcccaggagactactgcgcggtacgccaggatccagaagtggattctgacttctaaagacccctcccaagccaacgctatcagggtccctgcaagcggttgactgtggcggaggcagaaccaaaacctttgctctgcccgcggcgctccagcctctcacccaggacagtgctctgggctccagccgctgcagtggggtcgggacacagacgccgagttagaagccccgccgctgcaggtccctgcttggtcggcgcggtgacggtgtcgctggcggcggcgggggccttcctttggctgcccggccatttaatcagagctattatcagacagggcttgcaggatggcgccggccgagctttacccccattagcacagggcaggctgggggctgggtcctgaggccaccgccggtcccggccagctgcagcttttctggggagctatgagaaaggcaggcctggtggctccggccttctctacccggccactctcaggc

SEQ ID NO: 31232 - DNA, 87 bp, Homo sapiens
  misc_feature 1..87: note = chr7:35839940-35840027
  misc_feature 1..87: note = hyper
  source 1..87: mol_type = genomic DNA
caatgggggctacagcggccgacctctggggctgtgccaggccactagagtgtgatggcgcgagggaagggtcggggaaacagggcc

SEQ ID NO: 31233 - DNA, 143 bp, Homo sapiens
  misc_feature 1..143: note = chr7:37487113-37487256
  misc_feature 1..143: note = hyper
  source 1..143: mol_type = genomic DNA
ggtcaaggcaggtcccgacccgcctccaacttcaaatggccccctaggcgggagagggtcactgggcggggagttcctggctgtgcggtcacacacacacacaccgactcacacacacacccacaacaccccccccacacaca

SEQ ID NO: 31234 - DNA, 78 bp, Homo sapiens
  misc_feature 1..78: note = chr7:37487376-37487454
  misc_feature 1..78: note = hyper
  source 1..78: mol_type = genomic DNA
cagcaccgacttcccaaccccaaacacacgcgcgcacccccgggacagctgagttctgtatttcctcttcctcaaagc

SEQ ID NO: 31235 - DNA, 211 bp, Homo sapiens
  misc_feature 1..211: note = chr7:37487755-37487966
  misc_feature 1..211: note = hyper
  source 1..211: mol_type = genomic DNA
gggggattccctcccatccccgagtgcaggagaagacgccgagtctgagccgcagccgcttctctagctctataggaatcttgactccaagatcccagccccacatcccccgtccccagtaaccccgcgccagcgtcgcaaccctcccgcgccccccctcccgcagaccctggtcgaaatgtctcggcgggctcccgggccccgggccctg

SEQ ID NO: 31236 - DNA, 1035 bp, Homo sapiens
  misc_feature 1..1035: note = chr7:37487984-37489019
  misc_feature 1..1035: note = hyper
  source 1..1035: mol_type = genomic DNA
cgcacctccagcgccccctccctccgctcccactcccactcccgccatccccggagctcagacttccccaactgcagagcgccccgacgcgcccgcagccctcaccctgccgagcgcggcggccacccccgcccgagccgcggcgcccccagggaggaaacaaaagtgtctccgcggcgcccggagtcccccggagcaggacgcctcctcccggccccagtcccggccccctcccctgccgcgccgaggtcagcgagtcggggcgcggcgccagcccaggaaactttacgaacctgcttggggtcgcaggacagcagcggcaagggttcccggcgatcagagctccggcgacccgccaccattgaaggggaactggaggctctgtcgcccagcgtggggccgcggcggcgtgggtggctctgcctctatcctgtgcccatcctcgcccgctcccgctcgccccagcacacgcacttacactctgggtcggccggctgctgcaccgccggctgccgctgctctcacttcctcttccttcctcctgctggccagagacacattttgcatctgcaaggcatccggagatcagccgcgaactctcctcccgagcggacgctgcggagttgcagccgccgcccccggcacctgcgccaggacactcgtggtctgcgcgttcgccttgcgcccgcaccctgcctggtccctgcccactgcactttgcctagggggatgcccacgactttttgaagtccccctacttaaaagacagaaatgtcaaacaccatgcatgcctcagatctgctataaataatatgtgtgcagagcatgacttcgatgagctcacacacggcgtttggaggcactaattaactccgtcaccctcatagcgccatctccgggaggccaaaagcgagtagcatcttttcacatccttttttaatttttggcaaccggttccggatattaaggggaaacttcggtgggctgtttgaacgctactttaagacgtgtttgttttgacgctgtgcctctacc

SEQ ID NO: 31237 - DNA, 289 bp, Homo sapiens
  misc_feature 1..289: note = chr7:37955745-37956034
  misc_feature 1..289: note = hyper
  source 1..289: mol_type = genomic DNA
catagacaggcagctcgtcgcaggccaggctttcgggccagctgtggttgtacatcttcatgaggggctcgcagtcgtcgcgcgcgcgttggcacaccgacttgcacggcttgatagggtcgtgcaggaactccagggtgcaaatgggcgcgtacatggcacagaggaagaagcgcagcacggcgctgcagttcacgtccaccagctcctcgtactgctcgatggccaggatggcgttctcctgcgtgctgtggtgcaggtggttgggcatccgcgtgatgttccaggg

SEQ ID NO: 31238 - DNA, 308 bp, Homo sapiens
  misc_feature 1..308: note = chr7:37956260-37956568
  misc_feature 1..308: note = hyper
  source 1..308: mol_type = genomic DNA
cccccaaactccagtcggcagcaaagcggggccgcggggtccggccgcggagctccgccgtctggcacacagggcacgagcagcgccagctctcagccttcggggcgcgaacccgcccgggcagctccagtcccggactccgcagctcggagcgcagccagccacggccattgcgggaccctatttatcccgacacctcccctgacgtgggctcggaacgctcccttggcagctgcagccgcggcgcgggctccccctcggccgccccacccccaggcccgtcggtgcagaagcggtgacatcacccc

SEQ ID NO: 31239 - DNA, 302 bp, Homo sapiens
  misc_feature 1..302: note = chr7:37960235-37960537
  misc_feature 1..302: note = hyper
  source 1..302: mol_type = genomic DNA
gtgagcagtgaaaaccgaagcggcagaaggcagtggcagcaggcagtggcagcaggcagtggcccaggcagaaatagctcccgcgcgattcactggagccttccccgggccctggtcccggctaccgggactcgcgcgtccggatctcaaaagcggcagaggccaccgaagggacaggaagcactttggtccagaccacactcccggcacagtgcggaaagagccggcgggagccactctgatcccggacgcctcagcgcccccttgggcttgggcttgccctcgggccggggaaggctgac

SEQ ID NO: 31240 - DNA, 396 bp, Homo sapiens; identical to SEQ ID NO: 9019
  misc_feature 1..396: note = chr7:37960562-37960958
  misc_feature 1..396: note = hyper
  source 1..396: mol_type = genomic DNA

SEQ ID NO: 31241 - DNA, 358 bp, Homo sapiens
  misc_feature 1..358: note = chr7:38670306-38670664
  misc_feature 1..358: note = hyper
  source 1..358: mol_type = genomic DNA
agcactgtgtgatcacgatcctaccctattggtcctgggagatttttggtggcttctctgttaaatcgttcgtgtctgctgcacttaagtagccacaaaatcccccgcaagaaggaaggctgctgcaatctcccgccccgatctgcgggccgcgtccccgcgagctgcctgcgggcgcgctgggagccggcccggggagatgcgagcgcagggagatgcgctctgctccgggcgcagcgggcaagctgccgcacctcctacttctgttgcctggcttggggccaggagagcggcaacccggggccggctccggagctggacatatccggcgtctccggggccagggtctgcgggtccc

SEQ ID NO: 31242 - DNA, 29 bp, Homo sapiens
  misc_feature 1..29: note = chr7:38670956-38670985
  misc_feature 1..29: note = hyper
  source 1..29: mol_type = genomic DNA
cgggtccggggagctgcgaagagcagagc

SEQ ID NO: 31243 - DNA, 178 bp, Homo sapiens
  misc_feature 1..178: note = chr7:38670986-38671164
  misc_feature 1..178: note = hyper
  source 1..178: mol_type = genomic DNA
cgcagcggggctggcggcggcgcggaggagcgggaggaggagcgggaggaggaggagagggccgagcaagggaggagcgggagaagcggcggggagccgcggagcgcggaggggtgagggcggggcgcggcggcgggaccagcttaaagcgacagagcgggggcgggatgcgtcggga

SEQ ID NO: 31244 - DNA, 391 bp, Homo sapiens
  misc_feature 1..391: note = chr7:39015542-39015933
  misc_feature 1..391: note = hyper
  source 1..391: mol_type = genomic DNA
ccgatcgggtggcagcgcgtggggaacccaggctgcactacagaggacgcaggacgccaaaaccaccccggggctcacgccatccgcgcaccggctctgctgcctaagtccgaggacgcaggcggagggcgcggggctcccgggcgcccaggagggcggtgccgccggggtgcgctccaggcttggctgcaaaccccccaagaattagaaagcgggggcggctgctcagcggctgctgcggcctgggactgcagctcgcccctcctccgcaacttcccactggtcccgtcacctggctttctgtctagtgtccgcccaggcggggtcccaagaaggcgatgccaggagcagtcgcgccccctgccctctgtgagcccgcaggtttcgggca

SEQ ID NO: 31245 - DNA, 748 bp, Homo sapiens
  misc_feature 1..748: note = chr7:39453541-39454289
  misc_feature 1..748: note = hyper
  source 1..748: mol_type = genomic DNA
aagatgccccacaaacgacggtcccctggtccgaggagccgggcagcgccgcgcagccgtctcgcgtgggacccacccgcgggcggagccaggcggcagggctgccccaccgagcttcaccccagcaacccctttaactttcttaaccctgtattccccaaccgaacacttcccagagttcacgctggcagagcccacttcaaaaaatgctgcaggaagccattcacactcattcctatccacgtttttaaaaatgcgaaatagtgatttaaatcagaacagaacctcttccaatgggggtttcctttgcaaccggggcttcgcggtgatttctgtgctgttttgagggcacacacctacataacacgtttgcagagataagggatctcaaactgttcccaaaagtcccagggactcgtaatatgcaaaccgagggcaaatgaacgtgggaggatccgaggcgctcgctgaaggggctctcctgcagtgcccaggcagagggagagtggagggggcggctgtggagtgaagggcggaagtgccctcgccgtcctgaggcctgggaccctcttgatggtaaatggcgctgttgagccccgatgcgcagggactccgcgggcggcggacttgacaggaagctttgctgcggggcggcccagctgcggacgcgcgggacgtcagggccccagcagaagcgccgggctgtgcgtccttaagactgcgggtgcggccccgcccaaggtcgccc

SEQ ID NO: 31246 - DNA, 38 bp, Homo sapiens
  misc_feature 1..38: note = chr7:39873278-39873316
  misc_feature 1..38: note = hyper
  source 1..38: mol_type = genomic DNA
cagagaccttcttgtcggagattcgatgggaaaaaaac

SEQ ID NO: 31247 - DNA, 84 bp, Homo sapiens
  misc_feature 1..84: note = chr7:42267628-42267712
  misc_feature 1..84: note = hyper
  source 1..84: mol_type = genomic DNA
ttcaccacttttgcccgcgcctgcgtcccctgcccgaggtcccaggccgcggcggcggcgcggtgggttcattagcgggcgcgc

SEQ ID NO: 31248 - DNA, 89 bp, Homo sapiens
  misc_feature 1..89: note = chr7:42275797-42275886
  misc_feature 1..89: note = hyper
  source 1..89: mol_type = genomic DNA
ctctctgccttctcccgcccgttttcccgctgctactcaagaaagtaactgtcccctgctgctctgtgtaaacgcggcaccttaaatga

SEQ ID NO: 31249 - DNA, 799 bp, Homo sapiens
  misc_feature 1..799: note = chr7:42276096-42276895
  misc_feature 1..799: note = hyper
  source 1..799: mol_type = genomic DNA
cgcggcggaggtccccgcgcgcacccaccatgcctcccgcctccttccgcccatcccgagcgccgtgcgcgcccgaagcccgagccgtagagcgccaccgcgcaaaggaaggagccaggcgcgtgcggggctcgcggagttcttctgaaccctttggatgggggcggaggcgaggggcgccgccaccactgcggcaaacttcgtcccccctccgggaggtgaaattctccaatccgtctccggccggtccgcgggtcggactcttcggaaaggaccttccaggaggagggagcgaatgcaagccttgctcggacgcctcaccggcggctctctaaatctgggcgccttttgacagccattttcactccatcccgtccccacgctggggaccacctctggccccggaggcgcgggcgcggccgcaggagcgggctgcggggtccgcgaaacaaagaacttcgagcgggacgtacctgcggcggcagcggctgtcaagtccccgaacttcccatagacccgcggacggggcgcaggctggcggctccccgctccgcgcggccgcgggcggctacggctaccgcgagcggccgggctgggcgcggggtgcgcccgccgcgggcatggtgcggcgcgggcggccgcggggcgcgcggggaaggcgggagagcggcgcgggtgagtgggagcggcgggtgtgcgcgagtgcgagtgtgcgagcgcgccggtggcgctgcccctgcccgctccctcccgctcgtgcagctccggcatcagtttcggggatcgtgtaatccgatcc

SEQ ID NO: 31250 - DNA, 141 bp, Homo sapiens
  misc_feature 1..141: note = chr7:42277420-42277561
  misc_feature 1..141: note = hyper
  source 1..141: mol_type = genomic DNA
cccgcttctcccgcccgccgggtccccaagcccggagtgggtcccagctgcgaggcgggcggcggcggctgggaggcggcgcgtcgcgggccggggtcgggggctgggggggagcccgggcgccgcgagccacgcgcgcgc

SEQ ID NO: 31251 - DNA, 200 bp, Homo sapiens
  misc_feature 1..200: note = chr7:42277621-42277821
  misc_feature 1..200: note = hyper
  source 1..200: mol_type = genomic DNA
cttctcctcctcctcctcctcctccgcccctccccggtcttcacacagacacattcatgcctgctcctcctcttccccctacttgaccccgcgccctcccggcgcgccgaagccccacccacccggcgaggggaagggggcccgggcgtgatgtcacccgcgccctctctcttctctctccacaccgccaggacaccccc

SEQ ID NO: 31252 - DNA, 20 bp, Homo sapiens
  misc_feature 1..20: note = chr7:42533061-42533081
  misc_feature 1..20: note = hyper
  source 1..20: mol_type = genomic DNA
ggaaagggaggaggccggga

SEQ ID NO: 31253 - DNA, 30 bp, Homo sapiens
  misc_feature 1..30: note = chr7:42927875-42927905
  misc_feature 1..30: note = hyper
  source 1..30: mol_type = genomic DNA
gaggagagtaattgccgggctaaactgata

SEQ ID NO: 31254 - DNA, 30 bp, Homo sapiens
  misc_feature 1..30: note = chr7:42928140-42928170
  misc_feature 1..30: note = hyper
  source 1..30: mol_type = genomic DNA
ccggctccttgcctgcggcgcggagggcag

SEQ ID NO: 31255 - DNA, 238 bp, Homo sapiens
  misc_feature 1..238: note = chr7:43151970-43152208
  misc_feature 1..238: note = hyper
  source 1..238: mol_type = genomic DNA
cacacacaaaagggccgaggagccagggttggtgttggatatgcccagtacgcgtgctgggtgttggaaggatggggccggcggtaacaagaatcgatatatatttaccgcgggggcgggggtgggggtgcgcggaggctgcagggcggggcagcgctaatgagagcaagcccggcttgtggttggttctggagtctggtacccacagaggagcaggcagggagggaggggatgcaag

SEQ ID NO: 31256 - DNA, 502 bp, Homo sapiens; identical to SEQ ID NO: 3038
  misc_feature 1..502: note = chr7:43152413-43152915
  misc_feature 1..502: note = hyper
  source 1..502: mol_type = genomic DNA

SEQ ID NO: 31257 - DNA, 315 bp, Homo sapiens
  misc_feature 1..315: note = chr7:43153229-43153544
  misc_feature 1..315: note = hyper
  source 1..315: mol_type = genomic DNA
cgacttgcagacaggcagggagggagctgccggggcggggagggggggggaatgcgtccggtccatttttggctggaggtgcgcttcctgctacccccacgttcccgggcggtgacaatgcagcaaaatccgagggctcaaacaatgtggcccctccatccccggctccagggcattctgattgctctgccgctttgacgtcccggccacttggctgattttcagagccatgatgcgcggtgtctctgtcttgcacacagaggctgggcaccataacttcttccctgccgaatttcagcgcgtagggggagctgg

SEQ ID NO: 31258 - DNA, 27 bp, Homo sapiens
  misc_feature 1..27: note = chr7:44143915-44143942
  misc_feature 1..27: note = hyper
  source 1..27: mol_type = genomic DNA
aagccccggcgcccccgccccgggccc

SEQ ID NO: 31259 - DNA, 405 bp, Homo sapiens
  misc_feature 1..405: note = chr7:44144029-44144434
  misc_feature 1..405: note = hyper
  source 1..405: mol_type = genomic DNA
cgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggcccc

SEQ ID NO: 31260 - DNA, 33 bp, Homo sapiens
  misc_feature 1..33: note = chr7:44349574-44349607
  misc_feature 1..33: note = hyper
  source 1..33: mol_type = genomic DNA
cgggaagagcctttccgccggctgagccgtggg

SEQ ID NO: 31261 - DNA, 44 bp, Homo sapiens
  misc_feature 1..44: note = chr7:44349655-44349699
  misc_feature 1..44: note = hyper
  source 1..44: mol_type = genomic DNA
cggtggccgagaccgggcgggggcgggggcgctttgggagttag

SEQ ID NO: 31262 - DNA, 194 bp, Homo sapiens
  misc_feature 1..194: note = chr7:44364485-44364679
  misc_feature 1..194: note = hyper
  source 1..194: mol_type = genomic DNA
tcccgccacccccgccgcctgccgctcgggtgggggtggggacagcgcacccgcgtcggggacgaccctctggggccgcagccgacccctcccggcgctccaggcccgggggccacccccgcgcgcccctcctctctgacctccccgccgccaaatgcgtcacgtctgccgggcgctccggggacacctgctgc

SEQ ID NO: 31263 - DNA, 384 bp, Homo sapiens
  misc_feature 1..384: note = chr7:44364698-44365082
  misc_feature 1..384: note = hyper
  source 1..384: mol_type = genomic DNA
cgcgagcccggagccccggcccggcagccgcgctgggcagagctgggcagggccgcgcgcgctgaggtcaggcagccaggcccggggccgggggctcgcgggtcggggccgcgcggggccgtgcgcttgggcccggagcccagagaagccggcggcgcgcgggcccgcagtgcgcctggagccggcggcgcggagggtcccggaggtcccggccctctggggtccccggcccagcccgcgcgcgccgctgctcttacttgccaatatcctcgtagagctggtactcgtcggtgaagcgggtgcaggtcaccgtggtggccatggcggcggcggacgggctcggcgtgcgctcggctgcgctcgggcggcggcgactccggctcc

SEQ ID NO: 31264 - DNA, 119 bp, Homo sapiens
  misc_feature 1..119: note = chr7:44365117-44365236
  misc_feature 1..119: note = hyper
  source 1..119: mol_type = genomic DNA
cgggagacacctcggctcgcggcgccaggcgggggccgggctgggctgcgccgggcggcgagcgcacgcgagatctgctcgctccgtcctcgccaggagcgcgccgcacacctacgcgc

SEQ ID NO: 31265 - DNA, 30 bp, Homo sapiens
  misc_feature 1..30: note = chr7:44924253-44924283
  misc_feature 1..30: note = hyper
  source 1..30: mol_type = genomic DNA
agcgcttggagtccacggtgatggaggtgc

SEQ ID NO: 31266 - DNA, 292 bp, Homo sapiens
  misc_feature 1..292: note = chr7:45128841-45129133
  misc_feature 1..292: note = hyper
  source 1..292: mol_type = genomic DNA
cctcagggtggcattcgcccgtggccaggaagaggcggggacgcccctagaaccctggttgtgggaggctggggaggtggttgggattctgggatgctcggagcgctttgggtggagttggcggcgcagcctccttccccgctgaccaagcagagggtgcagggcctggggagggagggggccccgcccagcccgatgcctccatgcaaaaggtgagctggagctgcagctctggagtgattggctggtcctggcagtcgtcggtctccgtggcaaccgcctcctgtctcca

SEQ ID NO: 31267 - DNA, 51 bp, Homo sapiens
  misc_feature 1..51: note = chr7:45197382-45197433
  misc_feature 1..51: note = hyper
  source 1..51: mol_type = genomic DNA
cgcccccagcgggaccgagcgtgacccagctgcggccggccagccatggag

SEQ ID NO: 31268 - DNA, 327 bp, Homo sapiens
  misc_feature 1..327: note = chr7:45613487-45613814
  misc_feature 1..327: note = hyper
  source 1..327: mol_type = genomic DNA
tgcgcatggaagggacgtacgccccaggcctccaccttcctcctgaccccggggattcttggacgtcgattctccgtctcgtaggggcgagggccctgggttcgcagtcagacgcgggcccctctcaaatctagtggcctggttttattgagtgggggaaggcacatattttccaagattaactgccccgcaacagggaatttcgcaggatttcagtattttcgactccccaggtgacgccaagagggtgggttccactgtgcacggtggggaaactgaggctcggaggggacaaggaaggtactcgaggtcacgcggctcctccgg

SEQ ID NO: 31269 - DNA, 880 bp, Homo sapiens; identical to SEQ ID NO: 3040
  misc_feature 1..880: note = chr7:45613857-45614737
  misc_feature 1..880: note = hyper
  source 1..880: mol_type = genomic DNA

SEQ ID NO: 31270 - DNA, 87 bp, Homo sapiens; identical to SEQ ID NO: 9039
  misc_feature 1..87: note = chr7:45928490-45928577
  misc_feature 1..87: note = hyper
  source 1..87: mol_type = genomic DNA

SEQ ID NO: 31271 - DNA, 51 bp, Homo sapiens
  misc_feature 1..51: note = chr7:45959968-45960019
  misc_feature 1..51: note = hyper
  source 1..51: mol_type = genomic DNA
cctgggattgcagtccgtgtgcacccccgtgcggggcgaggagaatctcct

SEQ ID NO: 31272 - DNA, 267 bp, Homo sapiens
  misc_feature 1..267: note = chr7:45960227-45960494
  misc_feature 1..267: note = hyper
  source 1..267: mol_type = genomic DNA
cagtgagaagaaaagcggagtctcccgcagcggcacccagcaacccccaggcccttcggcgccagtgcgccgggtgctgcacgcagcgcacctggcgcgggcggctcacctggagctggcggcgctggcagcaggtaggcgcgcaggcggctgacggcactagcgttgacgcagagcccgcggccgtccagcagcgcctgcagcggtcgcgcctcgtcgggcgacggctggcagcgaaggccggagccacagcgctcggtgtagatg

SEQ ID NO: 31273 - DNA, 373 bp, Homo sapiens; identical to SEQ ID NO: 9040
  misc_feature 1..373: note = chr7:45960743-45961116
  misc_feature 1..373: note = hyper
  source 1..373: mol_type = genomic DNA

SEQ ID NO: 31274 - DNA, 43 bp, Homo sapiens
  misc_feature 1..43: note = chr7:45961508-45961551
  misc_feature 1..43: note = hyper
  source 1..43: mol_type = genomic DNA
gcaagaagactctcacgtgttgctacaccgcaagtctccaatt

SEQ ID NO: 31275 - DNA, 201 bp, Homo sapiens
  misc_feature 1..201: note = chr7:45961756-45961957
  misc_feature 1..201: note = hyper
  source 1..201: mol_type = genomic DNA
gtcattttttgaaggcgacttcgtattactgtattctcgatgcgttgggattctagcttatctctgcaatctaaacacttttcagtaaagttcgggggcgcaattgcgcgctgaggtcgctgtaactcctgtcggccttctctggcactcgagtttcttcagttttgtctgcgcaccccctcccttcggtgaccaacagag

SEQ ID NO: 31276 - DNA, 962 bp, Homo sapiens
  misc_feature 1..962: note = chr7:48074917-48075879
  misc_feature 1..962: note = hyper
  source 1..962: mol_type = genomic DNA
ggttccccgtggcatcgctgcgctgccctgccctggtccggctctgggctacgggcagttgacaggcggcgcccgcgctccgcttcctgccctgattggcccaccgctccccctcaggcttcccctattggctgacagtgctccagccgcgcccgccggttggccgttcagccgttgccctggcgacgccgatgttgtggttccgcggcgcgctgggagtttgggtttggttggctgcagccagccagccgtgtaaaaactccaacgccgggcgccgcgggcagcacccacggagacccgcggggagctggtgagcctgagcgggctggaggacaatgggggcgcccactgtggtcccgggccttgtccactgtgcggagctcgcagtgcgggcagtgcgcgccggggctggagggaggggaccaccttgtcgccgggttgggatgagcacagggcgggatctccaagcctgcccaagtcccgcggccccttggttacctgttgcttatcctctctgtacttgctgtgtccctggcgtggacgtgcctgtactggatacccggcgtgacgtgccccctctgtgtgccccgcacgcacgtgtctctgctgaataccccgcgtgaatgtgcccctgctgtgtacccggagtgcgtacgtccctgctgtgtaccctgtgtggacgtgccctgctgtctacccggcgtgcgtgtgttcctgctgtataccggcgtgatgtgctcccttctgtttacctggcgtggacatgccccctgctgtataccctgcatggaagtgccagcgctaggcgatcgtaaggcgcctgcaggcgtgtcagggcgaggcgtacagaccgacccagagcgggcgcgcggattttgcttttgcagctgcagctcctggcaactggtcaagcaggcagcgtccagcgcacccgcgaacaccaggtccggcagcatctgtct

SEQ ID NO: 31277 - DNA, 327 bp, Homo sapiens
  misc_feature 1..327: note = chr7:49812691-49813018
  misc_feature 1..327: note = hyper
  source 1..327: mol_type = genomic DNA
agaggaagatgggagcggggagagattggcagagattcagaaagttcgcgcttgagatttttacgtttcttactcgtaaacgtctatttctctgggtttctgaatgcaaagacgagaaagtctcaacagtctgctaaactaacacggccttcgaatcccaatctgaacacagtagctgaaacaagctgtccacaaagaggaaagccagagggggccaattaggaaggaagaaattaaagaaaagagaaaagccaagatgaaaggtccagcgcaaagtgaatgactcgactggagaatggcagccctggcagggtctgcggccggctg

SEQ ID NO: 31278 - DNA, 284 bp, Homo sapiens
  misc_feature 1..284: note = chr7:49813809-49814093
  misc_feature 1..284: note = hyper
  source 1..284: mol_type = genomic DNA
ggaggaaccccctcccccgcccaagtttgtgaatatgggcgcttcgcccagtgttgaggtcggcagggaccgggcagggggtcagcagggccgggcacgtccggagccctcagggaggagggctgagggggaggggacagacgcaccggagtgcgcagagtgggggcgttcggggagtgaggcggagagaggctggattgccggtgtcctgcggcgtctcgggctctcccagcccctttgggcggcagaaactttggaatccagaaaggctggccgggatccag

SEQ ID NO: 31279 - DNA, 630 bp, Homo sapiens
  misc_feature 1..630: note = chr7:49814121-49814751
  misc_feature 1..630: note = hyper
  source 1..630: mol_type = genomic DNA
cgccctggggccccagcctcccgcactgcacaccttggtgctgcccgggcgcttctgctccgcagccaggacactacaagactgagcgctgcggccggcgacctggctcccaaggctcggaggggcgggccggcagaggagctgaagccccgggaatccccgacccggccctctggcaaggggccgagggcatcctttcatgcagcggggcttagagagcggggagggggcgtctgctcccgagacgggagtcttttaagaagttgttagaaatgaatcgtggagtcctaggagaagctttgtttaacctccccgcattttcccagcacaaccccctaaagcaaatgaggaagagtttccctcttatcttcctgtacattcgtccgtctctaactccactgctgaattctccatttaataaccttcgggaaatgtggccaggacctagggagggacaccctgggtgcctgaattacgtggttcaaggcagagctttgcaggggggcgcgggcctggctcgctgcgttccctgggctccgcaagccgcccttggccatctccaacactaatcacgactacatcagaaacacgccggccggtgtcgttcttggatttcgcttccaatgtatc

SEQ ID NO: 31280 - DNA, 134 bp, Homo sapiens; identical to SEQ ID NO: 685
  misc_feature 1..134: note = chr7:49815116-49815250
  misc_feature 1..134: note = hyper
  source 1..134: mol_type = genomic DNA

SEQ ID NO: 31281 - DNA, 109 bp, Homo sapiens; identical to SEQ ID NO: 686
  misc_feature 1..109: note = chr7:49815656-49815765
  misc_feature 1..109: note = hyper
  source 1..109: mol_type = genomic DNA

SEQ ID NO: 31282 - DNA, 269 bp, Homo sapiens
  misc_feature 1..269: note = chr7:50343221-50343490
  misc_feature 1..269: note = hyper
  source 1..269: mol_type = genomic DNA
ctcgcatcctggggccggagcctgaacccgggagccaaggggccccagttccagggacgtgaagctgagcgtacagcgggcgctcccagacactggggaaagtgctttacgatgtcccgagtccctccagtctcgccagcggggcgagcgtgagggtgccccgaccgaccagcggccccgggtgcagggtggcgggcccggcggcgcgcgtccccctccccctcctggcggcccgcacgtgtcgcccgcgccgcgcccccacgggttac

SEQ ID NO: 31283 - DNA, 320 bp, Homo sapiens; identical to SEQ ID NO: 3046
  misc_feature 1..320: note = chr7:50343974-50344294
  misc_feature 1..320: note = hyper
  source 1..320: mol_type = genomic DNA

SEQ ID NO: 31284 - DNA, 36 bp, Homo sapiens; identical to SEQ ID NO: 3047
  misc_feature 1..36: note = chr7:50344295-50344331
  misc_feature 1..36: note = hyper
  source 1..36: mol_type = genomic DNA

SEQ ID NO: 31285 - DNA, 406 bp, Homo sapiens; identical to SEQ ID NO: 3048
  misc_feature 1..406: note = chr7:50344332-50344738
  misc_feature 1..406: note = hyper
  source 1..406: mol_type = genomic DNA

SEQ ID NO: 31286 - DNA, 40 bp, Homo sapiens
  misc_feature 1..40: note = chr7:51383352-51383392
  misc_feature 1..40: note = hyper
  source 1..40: mol_type = genomic DNA
aactacaaagtccaccgggactgcgcgctaccccgcggcc

SEQ ID NO: 31287 - DNA, 46 bp, Homo sapiens
  misc_feature 1..46: note = chr7:51384251-51384297
  misc_feature 1..46: note = hyper
  source 1..46: mol_type = genomic DNA
gccccctctccaccccgcccgaccgcggggccgcttacccggtcgg

SEQ ID NO: 31288 - DNA, 166 bp, Homo sapiens
  misc_feature 1..166: note = chr7:54609786-54609952
  misc_feature 1..166: note = hyper
  source 1..166: mol_type = genomic DNA
tgtcctcctcggcaccgagcgatctgatccgccgagccagaaagacacccgatgggggagagaagcaaagtggaaaaaaaccgacgtccctgctctccagaagggagaccccagcggcgccgacgagccctgcgccctccgcggccgcccggcgcgagctcccggg

SEQ ID NO: 31289 - DNA, 31 bp, Homo sapiens
  misc_feature 1..31: note = chr7:54609991-54610022
  misc_feature 1..31: note = hyper
  source 1..31: mol_type = genomic DNA
cgcagccattagagggaaaagttgcggcgcc

SEQ ID NO: 31290 - DNA, 130 bp, Homo sapiens
  misc_feature 1..130: note = chr7:54610023-54610153
  misc_feature 1..130: note = hyper
  source 1..130: mol_type = genomic DNA
cgagcccggcgaagtcctcagcccgccccgcttgcccactccccacttcccgagccggctccgtgtttagggagggcagtgatcacgcaagccggagcggcgggctgacgttggacgagctgccaggtag

SEQ ID NO: 31291 - DNA, 434 bp, Homo sapiens
  misc_feature 1..434: note = chr7:54612363-54612797
  misc_feature 1..434: note = hyper
  source 1..434: mol_type = genomic DNA
tgtggagatgtcctgcgccttccagagcggctccgcctcggtgtatctggagatccaatggtggttcctgcgggggccggaggacctggatcccggggccgagggggccggcgcgcaggtagcggagcccgccgaccccgcgtctccccttcgctcgcccggtcctcagggtgtccggcccggggctgggggccgaggtgctgcctggacacccctggggacctgcccggttctgtggaagcgagtgacccccagggcttctagggagggaaagggaatttgtcctggggacgcgaagttaaaacccagaaggaagtcctgctgcccagtttcttcctgttaaaccgggaagcgcctcctcctgtaagttctggtacttaggcagatgcccgccttgcccctaccacgctgccacatcccgggacatccgggag

SEQ ID NO: 31292 - DNA, 99 bp, Homo sapiens
  misc_feature 1..99: note = chr7:54614009-54614108
  misc_feature 1..99: note = hyper
  source 1..99: mol_type = genomic DNA
ggaaaaggaaaatagcgggaggaggggagaggggaagggggtccgggcgagggagacctagttgagcgagaggcggcgcccctgcgagccagcaagaga

SEQ ID NO: 31293 - DNA, 50 bp, Homo sapiens
  misc_feature 1..50: note = chr7:54614391-54614441
  misc_feature 1..50: note = hyper
  source 1..50: mol_type = genomic DNA
gccccgggacagccccggggaaagcgcggggacggcgtggggtatgccag

SEQ ID NO: 31294 - DNA, 30 bp, Homo sapiens
  misc_feature 1..30: note = chr7:54614739-54614769
  misc_feature 1..30: note = hyper
  source 1..30: mol_type = genomic DNA
gcccttccctgtccccgagaaggcggcttg

SEQ ID NO: 31295 - DNA, 510 bp, Homo sapiens
  misc_feature 1..510: note = chr7:54732044-54732554
  misc_feature 1..510: note = hyper
  source 1..510: mol_type = genomic DNA
tcagctttcccaggccgctgttgccgggcacaggctccgggcacacgagggggttccgtgcagcccgctttgcagagggaacggaggcgcagagagcctggcccgggcgcgcggccgcgagggtcgggagcagggaatccaccgctgcagctcagctctgggcaacgctgccacctgctgtcccgcgcagccgcacagcggcccgggcgtcccagcctccgcgagaaagactgtgcctgacctgcacggaggatgacgctgaccggccggtgatgaggaagccaccaagggaagcaattagacacaggacgtgctggacctgcaggctgcacaggccaagggagggccccaggcgcagcgggcggatctgcgggtccgcgggctgcgtccctgccctgtggccgagactgtgacagtctccgcagttggcagccgagtgcactgacacttaggctgagtccgcaaacagaaaagcaccaaatctcagtggctccacgcaacaggtgtgtt

SEQ ID NO: 31296 - DNA, 65 bp, Homo sapiens
  misc_feature 1..65: note = chr7:55086624-55086689
  misc_feature 1..65: note = hyper
  source 1..65: mol_type = genomic DNA
ctcctctgctcctcccgatccctcctccgccgcctggtccctcctcctcccgccctgcctccccg

SEQ ID NO: 31297 - DNA, 367 bp, Homo sapiens
  misc_feature 1..367: note = chr7:55087436-55087803
  misc_feature 1..367: note = hyper
  source 1..367: mol_type = genomic DNA
cccgcacgtgcgccccgcgctgtcttcccagggcgcgacggggtcctggcgcgcacccgaggggcgggcgctgcccacccgccgagactgcactgtttagggaagctgaggaaggaacccaaaaatacagcctcccctcggaccccgcgggacaggcggctttctgagaggacctccccgcctccgccctccgcgcaggtctcaaactgaagccggcgcccgccagcctggccccggcccctctccaggtccccgcgatcctcgttccccagtgtggagtcgcagcctcgacctgggagctgggagaactcgtctaccaccacctgcggctcccggggaggggtggtgctggcggcggttagtttcc

SEQ ID NO: 31298 - DNA, 290 bp, Homo sapiens
  misc_feature 1..290: note = chr7:56183846-56184136
  misc_feature 1..290: note = hyper
  source 1..290: mol_type = genomic DNA
cgccgagtccggcccttgctgcgccctgccccgcaggccgggaagtcgcgcaggtagtagtagtccaggcagtcgtaaagctcctcctcgtagcttatgggtggcggcggccgagccagagcctgcagacgtggaagcgcccgctctgcgggcgcttccatcctgcccaggcctgtggccaccggcggccacctgcccgcgtctgggcgctcctggaagacccagcagccccgcctcgagttccgatgggctccgcgtgaaggtgggggtgccttcggcgacgccacaga

SEQ ID NO: 31299 - DNA, 44 bp, Homo sapiens
  misc_feature 1..44: note = chr7:56355700-56355744
  misc_feature 1..44: note = hyper
  source 1..44: mol_type = genomic DNA
cgtctctggcgttggcgctgcagccgtgacggaggactacggcg

SEQ ID NO: 31300 - DNA, 443 bp, Homo sapiens
  misc_feature 1..443: note = chr7:63767561-63768004
  misc_feature 1..443: note = hyper
  source 1..443: mol_type = genomic DNA
ccaaagagctgggattacaggcgaaaaccaccgcgccctgccgccctgccgccctgccgccctgcctctctttctaaagctatgcccaaaccccgagcccggagcatgccgggattgtagtcctgcagtcctgcaacctagggactgcgagaggttaagagactacatctctcagcatgtctagctaggcgcgcaccgccgtgtccccagggcttcgcaccgcccccagacttgcgcatgctgggattgtaatactgtcgccttgccaccaacgggctacgagcggttaagagactacagctcccaggatgtacggtgatggcacccgtttggactccgcccctctgcgcgtctagagctgttctcccgtgcggaggggatcctggctgttcccaaatctcgcctgcctgcgaggagccagcgtggcccgggcagctgatctc

SEQ ID NO: 31301 - DNA, 98 bp, Homo sapiens
  misc_feature 1..98: note = chr7:64349041-64349139
  misc_feature 1..98: note = hyper
  source 1..98: mol_type = genomic DNA
cgcgtcttcggcaaagtcttcggggtgagaggtccggctcctggaggacagcgggatgggagagtcccgttcacacccagccccgcagagccggatag

SEQ ID NO: 31302 - DNA, 30 bp, Homo sapiens
  misc_feature 1..30: note = chr7:64350006-64350036
  misc_feature 1..30: note = hyper
  source 1..30: mol_type = genomic DNA
gctgctgaccggagccgcctgggtctgttc

SEQ ID NO: 31303 - DNA, 289 bp, Homo sapiens
  misc_feature 1..289: note = chr7:64407780-64408069
  misc_feature 1..289: note = hyper
  source 1..289: mol_type = genomic DNA
cgcatcgctctgtccctctcatgtcaggcaagccagttccggaccgcgtggcaccaggagccgccaggagccggggcgacccagaggtctccagcgacctggcgtccggcgaggacacagcccccaggaggggttagaccacgggagccggagcccgagtcccagggccgccgagccagtttagagtggtctccaggccctagtgggaaggggctccgcgcttctgggcgtccacaggagctgcatggccctgcccgctgacgcccggtcgggacgctccacaccctgt

SEQ ID NO: 31304 - DNA, 369 bp, Homo sapiens
  misc_feature 1..369: note = chr7:64700293-64700662
  misc_feature 1..369: note = hyper
  source 1..369: mol_type = genomic DNA
gagggcggctccttacgtaggcgggcagagacagaagctggcgtggccgggctcctgctcccctattctccgacccccgccacctagcccgcgccacccagggctcctggatcgtctggctcggggcctcctccccgctgcgttccctccctggcggctgcagagccctcctgggcagcggaaacaaacttccccgagcaggaagcccgtgccccagcctcctctcggcaaggaccagcccgcggaacaccccggcccctcggcgcctgccctgtccttctggctacgggtccaggagggctggcatgagaccaatcgcgaccctgcggttccagagcctgcgtcccgcactgccgagaccacacagtc

SEQ ID NO: 31305 - DNA, 726 bp, Homo sapiens
  misc_feature 1..726: note = chr7:64712278-64713004
  misc_feature 1..726: note = hyper
  source 1..726: mol_type = genomic DNA
ttctggctgtcccaccggcgatgctgcgcttccacaccacccggcgcacaggcgttggtagatgtggaaggtaccaagagcggcaggaggaaggggcgcgcggacacccagccccttcccgcgcacccagagcaggaagagcagcgcgcacccggtcagcgacgcggcgggctccactgtggcgcgcgcactccgagcacggagggctgcaggctcacgccacctggctccgcgcccatcccaatccgcacccgccgcccaggaaccggggctcaccctccgcctgacaattgtctcggggtgccgagggtccgtggcccgttgcccgggaggtgaccactgaggagtcgcgctgggtatcggaccaggaactcactgctttcattggctgcggaggtcagaccgtcccaccctcttctccccgccgccgcggcaaggccagggcgaaagggacaagtgcgctgctggggtcctctgcgctgtgcgggtccgggactcagggttcccggctgctaacaaggctgcgtagcttccccctcccctcctccttaggtggcaacttgtggacacacccattaagcggtcaggcgtcaggtttcctcccgagaggtgggaggcgccctggccttgattcatcgtgaagctaggcaggagatttcccagccacggagggtggaaagcttgccttgacctcagcaggtcatgtcactccgtgtgcacaaggcc

SEQ ID NO: 31306 - DNA, 299 bp, Homo sapiens
  misc_feature 1..299: note = chr7:64734473-64734772
  misc_feature 1..299: note = hyper
  source 1..299: mol_type = genomic DNA
gctggttgaaaccagcggaaccggcctccccacggtcagctcccgggtccacagacctgagtccccgttggcgcagctgggccctcagtacccccggagagtggggtggggggcggtgcaagacggcagctgagccagcggactttgacccctcaccgtcctcttcccgcgccgcgacctgcctgaaactctctgggcagcgctgcacccgcagccccgactctctcccagattgttcagggatgacagagggtcattagagcagaatcccgactcggtgggtgcgtgggaggagctgc

SEQ ID NO: 31307 - DNA, 180 bp, Homo sapiens; identical to SEQ ID NO: 3050
  misc_feature 1..180: note = chr7:64974270-64974450
  misc_feature 1..180: note = hyper
  source 1..180: mol_type = genomic DNA

SEQ ID NO: 31308 - DNA, 480 bp, Homo sapiens; identical to SEQ ID NO: 3051
  misc_feature 1..480: note = chr7:64974510-64974990
  misc_feature 1..480: note = hyper
  source 1..480: mol_type = genomic DNA

SEQ ID NO: 31309 - DNA, 102 bp, Homo sapiens
  misc_feature 1..102: note = chr7:65037609-65037711
  misc_feature 1..102: note = hyper
  source 1..102: mol_type = genomic DNA
gaaaatgcaaaaagccgcagcgggcgaaaagccgcggcagcggggggccaaaagccggacgggcagaaagccgtggcagcggcgggcaaaaagccgcggcgg

SEQ ID NO: 31310 - DNA, 79 bp, Homo sapiens
  misc_feature 1..79: note = chr7:65446028-65446107
  misc_feature 1..79: note = hyper
  source 1..79: mol_type = genomic DNA
ccttctcccgatccccgggcccagctctgtgcagtgcatgccgctgtggccagagtgtgtgggtggctcatgccagtaa

SEQ ID NO: 31311 - DNA, 113 bp, Homo sapiens
  misc_feature 1..113: note = chr7:65508930-65509043
  misc_feature 1..113: note = hyper
  source 1..113: mol_type = genomic DNA
cacctactttcagggcggacagactcaggcctttacagcctgctaagtcccgggtcggataccaggctgggctccacccccgcactgtgacccagaaacgctggtaaatgaat

SEQ ID NO: 31312 - DNA, 655 bp, Homo sapiens
  misc_feature 1..655: note = chr7:69062375-69063030
  misc_feature 1..655: note = hyper
  source 1..655: mol_type = genomic DNA
gcggggcagggactgcggtttgccggtctaacgggtcctcgagctggggcggcggtcccggccccttcggccccgcccctcgcccgcggccgcctccgaggttcaagttcggcccccggctgttaggcctcgcgctcccggatctgaagccgcccgtgcgtccctaggtcccccgctggaagacgaggcgggaatcccaggggtcatccgggcgcggggtcgctcgtccacgcactgtggtgccacgtggaggaaaagtttccaactctgccagttggtgctcccactgcgcccaggcggagcaaaggcccgcgctttggcacccgctccccgttctgtctcctccagtcgcgccccctcccagggacgccccccttgtaccccttctctgaattcccttctctcctcgcagcgcaggtagccaagggaaaacacccttgggggctggtggggcttcccgagaaggcggcctcgggccggccaggggtagaggatccagggacaagtgtcccgaggaggatgtggggggcgcgcgcgcgaagtggcctgggagcaggggcccacacgcgtccccgctgcgacaggcgggatcctccggcggcttccacgccctggcgcgccaactctgcccggccgcggccgaccccacgcgggc

SEQ ID NO: 31313 - DNA, 526 bp, Homo sapiens
  misc_feature 1..526: note = chr7:69064246-69064772
  misc_feature 1..526: note = hyper
  source 1..526: mol_type = genomic DNA
ttgatcaaagcattccgctattctgatttattgcttgcttggtgagttatttttttttcctctaaaggagacctgtgtgttcagccattactttgctcggcgctgctcccaggcatctccgaccctcggtgctgtggggagccccacacttgggctcctcgcctctcgccctcgctccccgtccctcctcccctctctccgccccttcccccttttctttctcctctctttcttcccctctctcccttctttcggccgccgtctcccccgcgccctcctcggggcggagggaagccgtgaagggggagggagggctcggtgtcaatttttttttgtgtggctgcggccgtagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccggg

SEQ ID NO: 31314 - DNA, 328 bp, Homo sapiens
  misc_feature 1..328: note = chr7:69064833-69065161
  misc_feature 1..328: note = hyper
  source 1..328: mol_type = genomic DNA
cgccccgtcccggcccagacccccgcggaggaagcggagagagtccacctcggcagaagaggacatcattgatggatttgccatgaccagctttgtcacttttgaagcgctggaggtaagggggaccccccttcccccgggttccctttatgcacgaccccactcggctgcgcccggctctcctgcctccctcgccgcgctccgggctgtctgtctgtctgtctgtctgtctgtctgtctaggctgaggtcttattgttggtggggggagctgggggcgcgggcagacaggcagcaggagggagtcgcaaagccgtgcctggtctcgt

SEQ ID NO: 31315 - DNA, 269 bp, Homo sapiens
  misc_feature 1..269: note = chr7:70596147-70596416
  misc_feature 1..269: note = hyper
  source 1..269: mol_type = genomic DNA
atttgaacagagcagcgggtgggcctagaagcagtgactggggaggttagaattcttgcacgcagagaacccccccaagcccgctcacgcccggcctggctccgaaggtctcagaatccgagcctccaggccagattttccctctagccattcctggccacgcagcgcggagccgcgagcacacagaaaaggatgtcttcatcgccaaccgggatggaacgaacccgcccgctcagggagtactgagaactaaagggtccctccagcgc

SEQ ID NO: 31316 - DNA, 258 bp, Homo sapiens
  misc_feature 1..258: note = chr7:70596453-70596711
  misc_feature 1..258: note = hyper
  source 1..258: mol_type = genomic DNA
cgcggtccccactctccagaagcccccgccctgcccgggtgcgcgcgcgcacgagtcggcgaaccggggagctgtgcgctcggcagcctgcgggcggcggcggcggccgccgacagcctctcggggacagggtggcgaagagcggcggaggaggagctggcgccgccgccgctcccctcgggccgcgccccgccctccgccgccacctgcgcgtcccctccgggctcctcagctccggggctgtgtggctctcggtgc

SEQ ID NO: 31317 - DNA, 74 bp, Homo sapiens
  misc_feature 1..74: note = chr7:70598050-70598124
  misc_feature 1..74: note = hyper
  source 1..74: mol_type = genomic DNA
ggggctcgacgcgggcgggccgggcacagggtgagccccagggtccttgcgcgctgcgccctgtgcctgggagc

SEQ ID NO: 31318 - DNA, 346 bp, Homo sapiens
  misc_feature 1..346: note = chr7:70598169-70598515
  misc_feature 1..346: note = hyper
  source 1..346: mol_type = genomic DNA
cgtttcgggcagatggccggggctgctggaaagaacaacttgcctgattcttttctgtgccccacctgcaaatttggttttatcctggaaacatgtcagtacagttggctcccggtccccgcgtgcggactggaaatcattccctggcgactccagcccgagcgcagaaactagtggaggggccacatgggactggaggcgcgcgggcagacgtgtaggaggaaatagtcttagagcccagcgtttggtggggtaccagtagggaacctgggagattggagggcttggatgtctgcagacaaagtcaaggccccaggtcgcggagctaatgcgcttaggtagtata

SEQ ID NO: 31319 - DNA, 199 bp, Homo sapiens
  misc_feature 1..199: note = chr7:71217033-71217232
  misc_feature 1..199: note = hyper
  source 1..199: mol_type = genomic DNA
atgcagaagataaaacgtttcgcagcaccgggtccaaggaagtgcaatacaacagcaaaatgcaatggccgcagcagctcagtgatgggccgagactcgtcccgtgtggcggagatgctggcatcccccctgtggctccaagcgctgagcttggcggcggggacctggcggccccggctcggctcgggacaggcaggtg

SEQ ID NO: 31320 - DNA, 126 bp, Homo sapiens; identical to SEQ ID NO: 3053
  misc_feature 1..126: note = chr7:71800631-71800757
  misc_feature 1..126: note = hyper
  source 1..126: mol_type = genomic DNA

SEQ ID NO: 31321 - DNA, 172 bp, Homo sapiens
  misc_feature 1..172: note = chr7:71800933-71801105
  misc_feature 1..172: note = hyper
  source 1..172: mol_type = genomic DNA
cgctagtccggagaaactaggaacccgagtaaacccagactgtccggggaagacggatcccacccccacctgggcgccagacccatccagctgcttggagctcagagactaggtcccagccggactgcagaggcctctctggttaccccttgcaccctggcgcccccggact

SEQ ID NO: 31322 - DNA, 141 bp, Homo sapiens
  misc_feature 1..141: note = chr7:71802206-71802347
  misc_feature 1..141: note = hyper
  source 1..141: mol_type = genomic DNA
cgacagcaccacactcctcgctctgccggcgcccgcgttcaggagccgggcttctgggctcgccttggccgcctgcgccccagctcctccgagggtcggggagcccccaccccccaacctccgcctctccaatggctccct

SEQ ID NO: 31323 - DNA, 74 bp, Homo sapiens
  misc_feature 1..74: note = chr7:71802449-71802523
  misc_feature 1..74: note = hyper
  source 1..74: mol_type = genomic DNA
aggcagacacgcggggggcgagcaggcgcttggcagacggtgctccttccttcccttcccaaagaggctgccca

SEQ ID NO: 31324 - DNA, 190 bp, Homo sapiens
  misc_feature 1..190: note = chr7:71802577-71802767
  misc_feature 1..190: note = hyper
  source 1..190: mol_type = genomic DNA
cgccgccttcactacttcatcccaggtgcccacaccctagatccacgattacacctgagcccagggggaaggcggggcgccgaagtggaggggccaatggccgaaactgcggggaccagcattccgcgtgaccgcccctggagacgtccagggaggcacggctgccgcagggcatcgcccacccaccagc

SEQ ID NO: 31325 - DNA, 165 bp, Homo sapiens
  misc_feature 1..165: note = chr7:76145381-76145546
  misc_feature 1..165: note = hyper
  source 1..165: mol_type = genomic DNA
atctgtgcacaaggccggtggttcccgtcgtcgccactcggggtcgccggtgagccgcagccaggccgcctcacggccagtgtgcatgctcgctgctattcgctgccccttctgcctccgaggcggtagcagatgccacgttggcggggtcggtgaaggtcagga

SEQ ID NO: 31326 - DNA, 117 bp, Homo sapiens
  misc_feature 1..117: note = chr7:79081775-79081892
  misc_feature 1..117: note = hyper
  source 1..117: mol_type = genomic DNA
gtcccttcttttcttcgccagcggtggctcacggatccctaagggacagctggggacccaggcgcccccagcccagccccagaaacgctggacgcagttctccgctcaccccaccac

SEQ ID NO: 31327 - DNA, 420 bp, Homo sapiens
  misc_feature 1..420: note = chr7:79082159-79082579
  misc_feature 1..420: note = hyper
  source 1..420: mol_type = genomic DNA
ctttagcccccaagtcgaatccccggcgaaactcacttgcactgcgggtgctctctggcccccaccccatcatcgcgcaacacacccccttcaacatgcgcggccaccctttcattgccctgcgccccgagcggtcccaccgcccggcaaaacactgagcaagccgctgctctcaccttgcttgacacacttgagccggagggggtccttgcagtgtttgatcacggccagcacgtccctgatggtgagccccgccacgggggtctcgttcacctccagcagcagctcctccgacaccaatttgctgccgctctcataggccaccttgccgggcttcacctcccccaggtaggggaactgtccattctcggcgccccccttcagttcaaagcccagctggccctccgggttcctgccaat

SEQ ID NO: 31328 - DNA, 644 bp, Homo sapiens; identical to SEQ ID NO: 689
  misc_feature 1..644: note = chr7:79083190-79083834
  misc_feature 1..644: note = hyper
  source 1..644: mol_type = genomic DNA

SEQ ID NO: 31329 - DNA, 53 bp, Homo sapiens
  misc_feature 1..53: note = chr7:79764160-79764213
  misc_feature 1..53: note = hyper
  source 1..53: mol_type = genomic DNA
ttggcgaggctgcggcgcggccaccggcgggagtgcagcggccactgtaccca

SEQ ID NO: 31330 - DNA, 220 bp, Homo sapiens
  misc_feature 1..220: note = chr7:79764492-79764712
  misc_feature 1..220: note = hyper
  source 1..220: mol_type = genomic DNA
gcgccgaggacaaggcggcggtggagcggagtaagatgatcgaccgcaacctccgtgaggacggcgagaaggcggcgcgcgaggtcaagctgctgctgctcggtaagggcggccgggtcggggcccgggggtcggcgggggaccgggtgcggcgctgcgcggccctcggcgtttggaaacccggagggaagggggaggaagcgcccgaggaggcttctga

SEQ ID NO: 31331 - DNA, 61 bp, Homo sapiens
  misc_feature 1..61: note = chr7:79765016-79765077
  misc_feature 1..61: note = hyper
  source 1..61: mol_type = genomic DNA
gtgtaggttgtgtttcgactgtggttttctcatgcccagagtgccacgtttggtgaaatca

SEQ ID NO: 31332 - DNA, 556 bp, Homo sapiens
  misc_feature 1..556: note = chr7:82072006-82072562
  misc_feature 1..556: note = hyper
  source 1..556: mol_type = genomic DNA
ttgaagaacagggaccgcgtgtctgccgacacttagatgtttcaaataatgggttggggaggttggatcgcgtggtcccagtacctgcgagccccctgcgtggacagcacgctcggccgcggggagccagcacgcgtctaatcggaaggctgtcaagtgcatccagtaacgtgggataaaacgagtttgggcactacagcaattaaagagcatctccgaggccaagtgcgggggaagtccacgctacctcggcaagcctgaaattacctgtttgtaaattacccaaccaaaacataactttttattgaactgggttgaatcagagcgggtgagctggctggaaacttttttccccagtacggctgcactctgaagtctagagaatcccgttagagacgggctgagacgccgcgagtcgtcggcgggcgcttcccgggacagtcggcccccagtgcccggccccgtggaggcgcccgagacgccggttcgggacgcattccagcggcgagcggcgcgcaccgcctgcccggcgtctccgcatccgagcctggctccc

SEQ ID NO: 31333 - DNA, 53 bp, Homo sapiens
  misc_feature 1..53: note = chr7:82072646-82072699
  misc_feature 1..53: note = hyper
  source 1..53: mol_type = genomic DNA
cggccggcgctccctgcccggcccgccgacttacgtgacggccgaagggaacg

SEQ ID NO: 31334 - DNA, 59 bp, Homo sapiens
  misc_feature 1..59: note = chr7:82791978-82792037
  misc_feature 1..59: note = hyper
  source 1..59: mol_type = genomic DNA
gggagcagtcagagccggggtccgcctcggggcgtgcaggcagccgagtccctggactc

SEQ ID NO: 31335 - DNA, 34 bp, Homo sapiens
  misc_feature 1..34: note = chr7:83277925-83277959
  misc_feature 1..34: note = hyper
  source 1..34: mol_type = genomic DNA
tccctccaggggcagcgtgcgagaggctttgtca

SEQ ID NO: 31336 - DNA, 45 bp, Homo sapiens; identical to SEQ ID NO: 9081
  misc_feature 1..45: note = chr7:83278225-83278270
  misc_feature 1..45: note = hyper
  source 1..45: mol_type = genomic DNA

SEQ ID NO: 31337 - DNA, 71 bp, Homo sapiens
  misc_feature 1..71: note = chr7:83824239-83824310
  misc_feature 1..71: note = hyper
  source 1..71: mol_type = genomic DNA
agctcctctgatagccggtggcagtctctaatcctgctccctgcttcattcggctccggggaagcagaatg

SEQ ID NO: 31338 - DNA, 59 bp, Homo sapiens
  misc_feature 1..59: note = chr7:84814638-84814697
  misc_feature 1..59: note = hyper
  source 1..59: mol_type = genomic DNA
tccccctcgtctctgcgcgcccccaccccgccatcccccgctagcgcacacatgcagga

SEQ ID NO: 31339 - DNA, 35 bp, Homo sapiens
  misc_feature 1..35: note = chr7:84815396-84815431
  misc_feature 1..35: note = hyper
  source 1..35: mol_type = genomic DNA
cgcccattcctcttccaaaacgctacaacaaaaac

SEQ ID NO: 31340 - DNA, 102 bp, Homo sapiens; identical to SEQ ID NO: 9083
  misc_feature 1..102: note = chr7:84815744-84815846
  misc_feature 1..102: note = hyper
  source 1..102: mol_type = genomic DNA

SEQ ID NO: 31341 - DNA, 127 bp, Homo sapiens
  misc_feature 1..127: note = chr7:84816225-84816352
  misc_feature 1..127: note = hyper
  source 1..127: mol_type = genomic DNA
ccgcgctaggacaggcggagagcaaggcaccagctggagctttggggaggagagggtggcgaggaaaggcacgctccaaacaggagggcggcttttaagtttgtggtgtgaccgcagcagctgtcct

SEQ ID NO: 31342 - DNA, 510 bp, Homo sapiens; identical to SEQ ID NO: 3058
  misc_feature 1..510: note = chr7:86273208-86273718
  misc_feature 1..510: note = hyper
  source 1..510: mol_type = genomic DNA

SEQ ID NO: 31343 - DNA, 13 bp, Homo sapiens
  misc_feature 1..13: note = chr7:86273719-86273732
  misc_feature 1..13: note = hyper
  source 1..13: mol_type = genomic DNA
gcttcagcctggt

SEQ ID NO: 31344 - DNA, 47 bp, Homo sapiens
  misc_feature 1..47: note = chr7:86274070-86274117
  misc_feature 1..47: note = hyper
  source 1..47: mol_type = genomic DNA
ctacctcttttgtgtcggatgaggaggaccaaccatgagccagagcc

SEQ ID NO: 31345 - DNA, 32 bp, Homo sapiens
  misc_feature 1..32: note = chr7:86274257-86274289
  misc_feature 1..32: note = hyper
  source 1..32: mol_type = genomic DNA
cgtggggcaggcgcagccgggaaagttgaggt

SEQ ID NO: 31346 - DNA, 39 bp, Homo sapiens
  misc_feature 1..39: note = chr7:86688488-86688527
  misc_feature 1..39: note = hyper
  source 1..39: mol_type = genomic DNA
ggcaacttcacccctcgaagcaaacgaaagcccctgttc

SEQ ID NO: 31347 - DNA, 137 bp, Homo sapiens
  misc_feature 1..137: note = chr7:87104813-87104950
  misc_feature 1..137: note = hyper
  source 1..137: mol_type = genomic DNA
caagtacaccctctccggcggcccggcgcacgagtcgcggggcccgggggcactgggtggaggtccggccactcccgccccgcgccccacgtcccgggtctcccttcgaggccagacgcgcccggacctctctcacc

SEQ ID NO: 31348 - DNA, 653 bp, Homo sapiens
  misc_feature 1..653: note = chr7:87229536-87230189
  misc_feature 1..653: note = hyper
  source 1..653: mol_type = genomic DNA
tgcatgagcctcaggcgcgctggaggtgagactaacctctagtcccccgtcgaagccagagagcagtaagagggagcgcccgccgttgatgccccagctgctctggccgcgatgggcactgcaggggctttcctgtgcgcggggtctccagcatctccacgaaggcagagttgggggtctggcagcgcgttctggactttgcccgccgccagtgcgattctccctcccggttccagtcgccgcggacgatgcttcctcccacccaccgcccgcgggctcagagagcaggtccccgcaccgcgcgggctgtgcgcgctccgggcaacatggtccagtgccactacggtttgggcgctgctccaggagctcctgagtctagatctaaccccacttggtccccatggacttgccagaggacttcacactatccacgcctcaagaagcccttctcccgtgaagaccaagttcaggaaatctgaaagcctgacacttgggaactgtcccatagtagctcccagctttgcgtgcccctacctcgcgctccttggaacggccaccaagacgtgaaattttggaagaagatactccgactttagtggaaagacctaaaggaaacgaacagcggcctctgcttctttgagcttggaagagcc

SEQ ID NO: 31349 - DNA, 154 bp, Homo sapiens
  misc_feature 1..154: note = chr7:87230190-87230344
  misc_feature 1..154: note = hyper
  source 1..154: mol_type = genomic DNA
ctactcgaatgagctcaggcttcctgtggcaaagagagcgaagcggctgtgctcagcccacgccccggcgctgttcctgcccagccaatcagcctcaccacagatgactgctcccggcccggattgactgaatgctgattcctcgagaaactgc

SEQ ID NO: 31350 - DNA, 178 bp, Homo sapiens; identical to SEQ ID NO: 3062
  misc_feature 1..178: note = chr7:87230345-87230523
  misc_feature 1..178: note = hyper
  source 1..178: mol_type = genomic DNA

SEQ ID NO: 31351 - DNA, 135 bp, Homo sapiens
  misc_feature 1..135: note = chr7:87256912-87257047
  misc_feature 1..135: note = hyper
  source 1..135: mol_type = genomic DNA
ctcctgcaggtaaaacggtgggtagtgagaagctctaggaagggggcgcttccgaacacgcgcgtcgaggagggcgttccaggactctgagggagcagcccagctggaccgaggccgcgtcgttcctgggcttac

SEQ ID NO: 31352 - DNA, 413 bp, Homo sapiens
  misc_feature 1..413: note = chr7:87257327-87257740
  misc_feature 1..413: note = hyper
  source 1..413: mol_type = genomic DNA
acttaggcccaaggtcgggtgtgggagccggcgcgctgctttctaggcaggcactgaagctacggcagccacgcaaataggtatcagccgttaaagcttggctacaggcaaggggggggcaataggcccctggcgctgtggggccccgcatcccacaatccccgcggctagcctgtgtggctactggcggcagctagcgggctgcgaaagcgagcccagcgtccttgacagcagcccacgcgtcggggcggggcttgagcccgctgctttaaaaggtccgcgcggccggccccgcccctctggtgccgcgattggatccggcgggggtagcgttgatttgataggcgcagagagggtggggctgcgcacgcgaggccgggggccttgccgctgcctcccgggctggggcacga

SEQ ID NO: 31353 - DNA, 115 bp, Homo sapiens
  misc_feature 1..115: note = chr7:87258283-87258398
  misc_feature 1..115: note = hyper
  source 1..115: mol_type = genomic DNA
gaaccagcctcccgccggggctgagagctctgggcttccgcgcgggtccttgggggtcccgggcatgatgggctgccgcccagtgcccccgcctatgttgcgccagccaaatctg

SEQ ID NO: 31354 - DNA, 64 bp, Homo sapiens
  misc_feature 1..64: note = chr7:87936120-87936184
  misc_feature 1..64: note = hyper
  source 1..64: mol_type = genomic DNA
cttccaaggaggaagcgtccagcgccaacggtgcgcgccgcgggccgggcgggtagagggaagt

SEQ ID NO: 31355 - DNA, 50 bp, Homo sapiens
  misc_feature 1..50: note = chr7:88387737-88387787
  misc_feature 1..50: note = hyper
  source 1..50: mol_type = genomic DNA
gaattagcgcattggcggtagcctttcaattccagcgctgaagcaacaga

SEQ ID NO: 31356 - DNA, 30 bp, Homo sapiens
  misc_feature 1..30: note = chr7:88388001-88388031
  misc_feature 1..30: note = hyper
  source 1..30: mol_type = genomic DNA
aaacgaaataaggtccgttaaaaaccactt

SEQ ID NO: 31357 - DNA, 30 bp, Homo sapiens
  misc_feature 1..30: note = chr7:88388282-88388312
  misc_feature 1..30: note = hyper
  source 1..30: mol_type = genomic DNA
gctcattcttgcaaccggctggggagctgt

SEQ ID NO: 31358 - DNA, 40 bp, Homo sapiens; identical to SEQ ID NO: 3063
  misc_feature 1..40: note = chr7:88388606-88388646
  misc_feature 1..40: note = hyper
  source 1..40: mol_type = genomic DNA

SEQ ID NO: 31359 - DNA, 255 bp, Homo sapiens; identical to SEQ ID NO: 3064
  misc_feature 1..255: note = chr7:88388647-88388902
  misc_feature 1..255: note = hyper
  source 1..255: mol_type = genomic DNA

SEQ ID NO: 31360 - DNA, 215 bp, Homo sapiens
  misc_feature 1..215: note = chr7:88389046-88389261
  misc_feature 1..215: note = hyper
  source 1..215: mol_type = genomic DNA
cgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctggtgaggagt

SEQ ID NO: 31361 - DNA, 240 bp, Homo sapiens
  misc_feature 1..240: note = chr7:89748054-89748294
  misc_feature 1..240: note = hyper
  source 1..240: mol_type = genomic DNA
agacgtccctcatgccgggcgcaccaccggcgggccggcggttccgttggcttccctgacatacttcctacagtcatttctttcagctgagatcttcccctttaatacctcgttaattaacgtgtaaccttttggttaaaatgtcagagctaagactaaatctgaagaaaagaatgaaaccaccgtaagttcttcagactcagtcgtcagcaaggttatggcccgaagccgtgcagaggc

SEQ ID NO: 31362 - DNA, 268 bp, Homo sapiens
  misc_feature 1..268: note = chr7:89748295-89748563
  misc_feature 1..268: note = hyper
  source 1..268: mol_type = genomic DNA
gcgcgcggggaagctactggcagagctgtgcgcactgggggtgctgcaggcgctggggagagtgtggagaggctgcgtggagctgcgcgctcggggtgggggctgcactcccaatgaagcgcgtgaagggcaagcggtgatgggttctgcgccagtggggctgggagcgtgtcgggggctgtacgtggggctgcgcgcaaggtgagaactgcgcatctaggcttggggactgcgcgcaccaaaggcttgcaggcgctggggagggtgg

SEQ ID NO: 31363 - DNA, 20 bp, Homo sapiens
  misc_feature 1..20: note = chr7:89841213-89841233
  misc_feature 1..20: note = hyper
  source 1..20: mol_type = genomic DNA
cgccgcggcagccaccctgc

SEQ ID NO: 31364 - DNA, 539 bp, Homo sapiens
  misc_feature 1..539: note = chr7:89950183-89950722
  misc_feature 1..539: note = hyper
  source 1..539: mol_type = genomic DNA
tcaatttcaggctagcgcctctccctgtgcccccagccctgggtcaggtcacctgggcgcagaagagggaggccacgcgggagtcgaggacctctggtcgccgtccgaggagcgcgtcccggcgcggtgtcctgggtgcgctacgctcgttgggaggaggacggggcgcctcctgcccacgaggaaccagaggtttcagcggggacgacccctgcccagggcgccctctgcccagcggacccacttcccgaggcaggcgaactgggcgaggcagcgctgtgtcacccaccccgagcgctcaccgggcgcccaagctcgctcagcggaaccgtctcggccgcggtgcgcttcggcgctgggaggctctggctggcactggctcaccgcgggtggagctgccggttctgctgcggccacgcggggttcccgagacagacccgccgctgggaccgcgatccttttctagaggctgagtgagggggcagatcgtgggtggccgcgctctcgaggcccctccctgacctcgcccaacttcccag

SEQ ID NO: 31365 - DNA, 16 bp, Homo sapiens
  misc_feature 1..16: note = chr7:90226268-90226284
  misc_feature 1..16: note = hyper
  source 1..16: mol_type = genomic DNA
ggttctcccctcctcc

SEQ ID NO: 31366 - DNA, 278 bp, Homo sapiens
  misc_feature 1..278: note = chr7:90226285-90226563
  misc_feature 1..278: note = hyper
  source 1..278: mol_type = genomic DNA
ccactagtgctcgccctttcgcgcgcgtgggggacgggcgaggggacccctcggcccccaccgcgcaaggggctgcgcggctgcttgggccacttgttattttttgcgcacaggcttggatattgggcgtttagtcagtaatttagctttggaaattggtgaaacgttagactgtgccctggtattgtttaacgtatccaacctaaagggaagtgggacagttaccttgggacctattgttcggtacttcgggtcctggaaagcgagatttgggtgtt

SEQ ID NO: 31367 - DNA, 89 bp, Homo sapiens
  misc_feature 1..89: note = chr7:90894938-90895027
  misc_feature 1..89: note = hyper
  source 1..89: mol_type = genomic DNA
cagcaaccctcagcacggcggcggagggcaccgtggcggcttcccggggggcgccggcgcgtcggagcgaggcaagttctcctgcccgc

SEQ ID NO: 31368 - DNA, 86 bp, Homo sapiens
  misc_feature 1..86: note = chr7:90895028-90895114
  misc_feature 1..86: note = hyper
  source 1..86: mol_type = genomic DNA
cgccctcaaggtgccctcctacctcaactaccacttcctgggggagaaggactgcggcgcaccttgtgagccgaccaaggtgtatg

SEQ ID NO: 31369 - DNA, 43 bp, Homo sapiens
  misc_feature 1..43: note = chr7:91510048-91510091
  misc_feature 1..43: note = hyper
  source 1..43: mol_type = genomic DNA
gaaaagactaacttccggcctcgggtcgcgcgcagaggtgatg

SEQ ID NO: 31370 - DNA, 329 bp, Homo sapiens; identical to SEQ ID NO: 9101
  misc_feature 1..329: note = chr7:91808202-91808531
  misc_feature 1..329: note = hyper
  source 1..329: mol_type = genomic DNA

SEQ ID NO: 31371 - DNA, 166 bp, Homo sapiens
  misc_feature 1..166: note = chr7:92466315-92466481
  misc_feature 1..166: note = hyper
  source 1..166: mol_type = genomic DNA
agtagggggatcctgcgactaaaataagcggcattagtgggagagagtgggacgtgtcgtcgggagtcggcggagtttccaaacccagggtcgcccagagttggggttttgacagggtgaagcggggggcatcctcactgtgtgacgtggacggatgggaaaaaca

SEQ ID NO: 31372 - DNA, 53 bp, Homo sapiens
  misc_feature 1..53: note = chr7:93203722-93203775
  misc_feature 1..53: note = hyper
  source 1..53: mol_type = genomic DNA
ccgcagggtgaggtgcggacgtgcgcacttctccaacccgggaaggtccgcca

SEQ ID NO: 31373 - DNA, 301 bp, Homo sapiens
  misc_feature 1..301: note = chr7:93204298-93204599
  misc_feature 1..301: note = hyper
  source 1..301: mol_type = genomic DNA
cgctccagtcagggctggggctcaccctgcgagtccgggagactaaagcgccgcgtaaacacaggaagcaggcgagggacccgagttagaccttgagtagggagggagaggggggcgacagtctggactgggagacagctttctgggagccctgtcccctccccggagaatgcaaattccggagggaggtgagtttccacaagaaccttatcccagagacattgtgaccctggcttcttcagccgccactccggggacagcactagggagcctgtggagggagggtcggtagtgggctagg

SEQ ID NO: 31374 - DNA, 30 bp, Homo sapiens
  misc_feature 1..30: note = chr7:93205084-93205114
  misc_feature 1..30: note = hyper
  source 1..30: mol_type = genomic DNA
ctaactctgtttaggcggtgttggactaag

SEQ ID NO: 31375 - DNA, 562 bp, Homo sapiens
  misc_feature 1..562: note = chr7:93519204-93519766
  misc_feature 1..562: note = hyper
  source 1..562: mol_type = genomic DNA
atctttccctgagtccgcacaggcactgaattatgatcaatgtcagttgggagacaggaaatgtgttagtggttgtaaatttgtgattacttttaagaaactgaaaaccatgaggtttgcttaacacttgagaaaacccaggctaaaacttcctgtagaaagcgagacgtgggaaactggcgaagctgctaccagccgccggcgcaaggagcgcgagagtcctgggtgcgcgcagggcacttactttctatcctccagcaagcatcgtcgcaagcctcccaggtgtagaaattgttggcgttgccctcgcagcccccgtacaggaactggcggcagctctgcgtgtacctgtcgtagtagtaacggagaagtagggcccggcagggtccgtagtctaggggcaggagacagatctccgcgttatttcctgaagaaggggcagaaggagagcaaaagagagggaaagtggtcaggcgtagctcctaggaggaaagaacatcccggggagttctgtccccttccgagcggaggggcctctgcagagaaagtgcaaacttgggag

SEQ ID NO: 31376 - DNA, 170 bp, Homo sapiens; identical to SEQ ID NO: 9105
  misc_feature 1..170: note = chr7:93519854-93520024
  misc_feature 1..170: note = hyper
  source 1..170: mol_type = genomic DNA

SEQ ID NO: 31377 - DNA, 434 bp, Homo sapiens
  misc_feature 1..434: note = chr7:93520025-93520459
  misc_feature 1..434: note = hyper
  source 1..434: mol_type = genomic DNA
tccgagaaagcgcctggcgggaggaggtgcgcggctttctgctccaggcggcccgggtgcccgctttatgcggggcgagcgtccggccgacccccgccggggcggagcctgaggggtggctgattcatgcacggggactgtcaccccgccgcccccgcgctgcaaactgtgtaagagggagaggaattccccgccaagttgaaaagttgaacctgcctcccaaactttctcctgtagtccagacggggacgccctgagggagcgtttgtgtcagtaatgggaaatctgcaagctagacggaaatgacctgctagtgattgcgctgtaaagaagccggaatccacctcttgaaggcatgaagttcaggtatttgaaaggctggtggagagaaagtgcggagttcttgggtcagagcggagcgggattcgttgcaa

SEQ ID NO: 31378 - DNA, 477 bp, Homo sapiens
  misc_feature 1..477: note = chr7:93551053-93551530
  misc_feature 1..477: note = hyper
  source 1..477: mol_type = genomic DNA
cagccccagcccagccgtcccccgcgggcgtggcaggtcctgagtcagggcctgtccgtggccagcatccctgctgggcgattgagcagcgggaagctgcttggacccagtctcaaacttaaccctcatctagcacccgggcaggcctcctgggttgcagggacttgagaaaaggcagagttctcaggtcctaggaagctggggcacgctggcgtgacaagcgtcccggagaaagccaagccctcggggagctggggaccgcagcagggctgcagtcacatcctgcgcgggtgggcggcgggccaggccttcagttgtttcgggacgcgccgagcttcgccgctcttccagcggctccgctgccagagctagcccgagcccggttctggggcgaaaatgcctgcccttcacatcgaagatttgccagagaaggaaaaactgaaaatggaagttgagcagcttcgcaaagaagtgaag

SEQ ID NO: 31379 - DNA, 30 bp, Homo sapiens
  misc_feature 1..30: note = chr7:94024050-94024080
  misc_feature 1..30: note = hyper
  source 1..30: mol_type = genomic DNA
tcgctccctcctctgcgcccccgcaggctc

SEQ ID NO: 31380 - DNA, 716 bp, Homo sapiens
  misc_feature 1..716: note = chr7:94284380-94285096
  misc_feature 1..716: note = hyper
  source 1..716: mol_type = genomic DNA
gcaaatatttgtggccgaatctcggcaacccgctggaaaggattaaacgtgcggttgccgtgactaaacgcattcattcaccctacaagatttaggaaaatgtaacgttgcaagggaagcaaggtctctgtgtaaacctcgtaatcgccaccaaaagtcggtagctgggagccttcaaagcccgccaaacacactggaagcatccacagctgttttaaattggttttggtttctggaaatagcgcactcggtacggcagcatctctggcctccagccggggttaaccctgacctgaacgccctgtttagctcccagcatttcatgattccgcttccctgctccgtaaaaccgaagaaaaccgagatttccgtcaccgagaaatgcacttagcaagagggggaaattcggtgttttaaatgtcacatttttgtgttctctaccactatcaagaaaaggaaaaaagatgtgtttgtgtagcggggacgcagcttgacacccatttcctttggctcgcatcgcggtcgcagagcccaatcgcggggaaacgggccccccagaaaaacaggcaacgacccccagctctttgctacagggatcgggagaggactaccctggggctgggcggggagggggatgttgggaacaggaattggagatggaatttctgcgcccgcagagcagggaggggcccgcgggggcgcggagaggaaaaaaa

SEQ ID NO: 31381 - DNA, 153 bp, Homo sapiens
  misc_feature 1..153: note = chr7:94536847-94537000
  misc_feature 1..153: note = hyper
  source 1..153: mol_type = genomic DNA
gccggagaggcccctcgcccacggccgagggggtggggcggcctcgcctcgggccggtgcttttcgcccttccttggccgccagaggctccctctctctccctctcccgggattttgctgccgggctccctctctctgcggccctagagttaa

SEQ ID NO: 31382 - DNA, 131 bp, Homo sapiens
  misc_feature 1..131: note = chr7:95225822-95225953
  misc_feature 1..131: note = hyper
  source 1..131: mol_type = genomic DNA
agtcttcccaccagccgccgccgcccgaggttttatttgtctccccgcactctccccccgagtcccaaacaggaggagtcactggaacttggaaacgcgtcctgaactccaggtcgcgccaatcagatcag

SEQ ID NO: 31383 - DNA, 30 bp, Homo sapiens
  misc_feature 1..30: note = chr7:95226177-95226207
  misc_feature 1..30: note = hyper
  source 1..30: mol_type = genomic DNA
cccttgtttacaactcggaggctgtctcaa

SEQ ID NO: 31384 - DNA, 30 bp, Homo sapiens
  misc_feature 1..30: note = chr7:95402081-95402111
  misc_feature 1..30: note = hyper
  source 1..30: mol_type = genomic DNA
ccaggtaaactggagcgggatgtcgccgct

SEQ ID NO: 31385 - DNA, 49 bp, Homo sapiens
  misc_feature 1..49: note = chr7:95402319-95402368
  misc_feature 1..49: note = hyper
  source 1..49: mol_type = genomic DNA
cagagaaggaagggtcgtggtgtcaccacctggtcgcccaccttgtggg

SEQ ID NO: 31386 - DNA, 184 bp, Homo sapiens
  misc_feature 1..184: note = chr7:96621715-96621899
  misc_feature 1..184: note = hyper
  source 1..184: mol_type = genomic DNA
ctgtgattccaggagcgcgtgtgggcgcggtcctcgccgcgacgccgcgcgcgggtcaggctcaactgcgaaccttgccaccgagctttcccgcgggaggcttcgaatataaccttgcctatttctcgcctactgagatttctttccagaaaaggacattctcctgctccgaggagatggatcc

SEQ ID NO: 31387 - DNA, 242 bp, Homo sapiens
  misc_feature 1..242: note = chr7:96622107-96622349
  misc_feature 1..242: note = hyper
  source 1..242: mol_type = genomic DNA
attgggtttggctggcgactagctttaatgcccatcgagttcctgggacacccaagttcagcacttctgcatgaaaccgaaacggccagggaggggcggagtgggccgaggctgagggagcggcggtgttgacgccctcttcccacccaggatcgatcgatcggtagggaattttttatctttgggaaggagaggtgaggaagcggacctaaaacgaggggaaaattcgaatttaatatcct

SEQ ID NO: 31388 - DNA, 159 bp, Homo sapiens
  misc_feature 1..159: note = chr7:96625614-96625773
  misc_feature 1..159: note = hyper
  source 1..159: mol_type = genomic DNA
agctgcacgttgccccggccggcgttttcaaacaacttgaattacaggctacatcttgaatatgaattagccttccgcactggtgtgaattcgctttgaaactcaacttgtcaagtatggttttaattaaacatcttccggcctcgaaagattacatgt

SEQ ID NO: 31389 - DNA, 238 bp, Homo sapiens
  misc_feature 1..238: note = chr7:96625974-96626212
  misc_feature 1..238: note = hyper
  source 1..238: mol_type = genomic DNA
gagcctgacaggtcccgggtcccaggtcccaggcagccccggccggggcagggccaagaccgcgtgcccaggacaagtaagtaactcaaacccgacccggcaagcgtggcccaagctgcttttgcagttggggacaattgagcggacacacaagttaatcccgcactgatttgtttcggatccatctgcaggacgcctgatgcctcccccttggctgctgcagcggacacctgcctcc

SEQ ID NO: 31390 - DNA, 118 bp, Homo sapiens; identical to SEQ ID NO: 9114
  misc_feature 1..118: note = chr7:96627308-96627426
  misc_feature 1..118: note = hyper
  source 1..118: mol_type = genomic DNA

SEQ ID NO: 31391 - DNA, 267 bp, Homo sapiens
  misc_feature 1..267: note = chr7:96633233-96633500
  misc_feature 1..267: note = hyper
  source 1..267: mol_type = genomic DNA
gtgtgggcaaaggctcgcggcttaggtctctaagcagatcgaaagtcggggtccagaccgagaggatcttcaggtctcgtccacccaatctcaagcctctggaagggcgggctgccggcgacctcctccagtcccgggacccggaacccgggaccctggacgccggtgcgggcgggcctgccctcctctgtgcctggcccccagtctggccctcctacctgttgaccaggcctgaaccacgcaccggggctccgctgtctctgcttg

SEQ ID NO: 31392 - DNA, 50 bp, Homo sapiens
  misc_feature 1..50: note = chr7:96634276-96634326
  misc_feature 1..50: note = hyper
  source 1..50: mol_type = genomic DNA
aatatataagaaatacggcctgaaacggcagggaccgagccagaacaggg

SEQ ID NO: 31393 - DNA, 74 bp, Homo sapiens
  misc_feature 1..74: note = chr7:96634662-96634736
  misc_feature 1..74: note = hyper
  source 1..74: mol_type = genomic DNA
ccggccgggcagaggcgcctccctccccaacggccccgggcgccacacagcgcggcccccggctgcagctccgg

SEQ ID NO: 31394 - DNA, 248 bp, Homo sapiens
  misc_feature 1..248: note = chr7:96635204-96635452
  misc_feature 1..248: note = hyper
  source 1..248: mol_type = genomic DNA
ctgcagaggggagagcggcgcgagccaagtgggggagggtggaggaaacccgggagaaggctttctccagcccccaaagtttttgatgatgaccatgactacgatggctgacggcttggaaggccaggactcgtccaaatccgccttcatggagttcgggcagcagcagcagcagcagcagcaacagcagcagcagcagcagcagcaacagcaacagccgccgccgccgccgccgccgccgccgcagc

SEQ ID NO: 31395 - DNA, 104 bp, Homo sapiens; identical to SEQ ID NO: 9117
  misc_feature 1..104: note = chr7:96635486-96635590
  misc_feature 1..104: note = hyper
  source 1..104: mol_type = genomic DNA

SEQ ID NO: 31396 - DNA, 353 bp, Homo sapiens
  misc_feature 1..353: note = chr7:96635619-96635972
  misc_feature 1..353: note = hyper
  source 1..353: mol_type = genomic DNA
cgctcgctcgccgcctacccctacatgagccactcgcagcacagcccttacctccagtcctaccacaacagcagcgcagccgcccagacgcgaggggacgacacaggtgagaggccgctggggcagctcgcttctcccgcctcccgactgccccctaccccgcccgcccgctcacttcctcgacgcccgggcctccgccggccccctcccccaggcggccccgcgcgcccttggccgggccccgtgcgcgcccgctcgcctggcgcctgcctgccggcctctcccagccgggccccttcccgccgccgcggaccctcagcttccgacgcgcagttcgggctgagtcccgggcc

SEQ ID NO: 31397 - DNA, 774 bp, Homo sapiens
  misc_feature 1..774: note = chr7:96636033-96636807
  misc_feature 1..774: note = hyper
  source 1..774: mol_type = genomic DNA
cgcccttttccttgctccttccctccaggctgtaacccacgtttgacccggctggggacatttctgggccggaactggggagcgtgttttgcttcccagcccacgctgggcaggcagtggcctactttgcgtggggcgccccgtgctcctcagtgactcggagggaagctggcctggctttcgctctggttaaactagtaacagtcaggctctttccagtgggctttaaagtgtccctcaccttcatccctgaccgggccccctatctagcttttcgctacagtgttggctgctcctttgttcgtggaggggaagcaaagaacctcgggctgatggttctcagcacccgagggggacaaagttgccgtgagaggcgcagcctgctcgtgggctggtctgagctgttggttgtgttttgtttgaggatttggtcctcctcaggagagtcatttcaaaacatgccgaggatgcttgatgcactgagcttggagctggtgacatcaagtcaactggccgcgtaaacacctgggtggctcaagcacagcttcaggtactgttaagccgggcacaggggccccgctccgcccggacagctgccgccttgctgcgctgcgcaccccagagagcctccggcaccgcctccgctgcggcaaagcgggctgtttgtctgagggcctctggcgctcccttggcccagacgctgcacattgttcgggccagggactgggtcaaggagattacgcagacgctgggagcacacgggcagagtggacc

SEQ ID NO: 31398 - DNA, 82 bp, Homo sapiens
  misc_feature 1..82: note = chr7:96642045-96642127
  misc_feature 1..82: note = hyper
  source 1..82: mol_type = genomic DNA
gattggtaggaggggcgtgggcgaaaggcatcgcccagtggtggtgcctacgacgcctccccacgttcggacttctccagag

SEQ ID NO: 31399 - DNA, 809 bp, Homo sapiens
  misc_feature 1..809: note = chr7:96645617-96646426
  misc_feature 1..809: note = hyper
  source 1..809: mol_type = genomic DNA
agatgcaacagaaaacgctgggggttggcgcgggggggaagagacagggctgcgtagaaaatatttaaccaatcccacatgtgccaccgctatttgggctatttttaaggcccagagttcgctgcgactgggctgaggttgaaaaaaaccaagcactgtgtgcaaagaccgcgggcaacctgggagcgcgagccgaggccgagagcaagccgcagcgccccctccccaagctctggagcggcgggagcctccaccggctactgtgggagggggtgcttaagggtggaggagctgggtgaccgcaggcggatccgccggcgtggcgagcttcccagaggtgcccgagggcgtctgccctctgggtgtgcctccgggagggctagagagctctaggttggcaagatcccagtgaccattgggaggcgcgcgatccaaggggttgcagggatggggcggagaggaggggcggttgggtagcctaaaggtccctctcccagaatacaaggaagcgctaagaaggaggatgtgggggcagtgttccagcaggcatcccaggctcttccggctggagagctcaggagactgagcggtgtcaaggctggagtgagctatagggtgcgctgggaggaggtgagcgcagcctggctttggcgcgctgtgggtgactcccaggacggcgcggccaggacgccgcgagccgtggggcgtccggtgggatcaaaggaaccagaggaggccagccgacgcgtctgggattgtgggataaggggcgggagagaggagattgacatgggcggggagatcctggc

SEQ ID NO: 31400 - DNA, 685 bp, Homo sapiens
  misc_feature 1..685: note = chr7:96646652-96647337
  misc_feature 1..685: note = hyper
  source 1..685: mol_type = genomic DNA
gcacccacaggaatgcggcttctctcggatccccaggccgccccttgtcccacaaggaggtggccgccaggaaaaaggggggaaaaggggcagaaatccgcctagctcaacccgagcctcaaacaaaggccaatttatctgatctcttacaggatggcccaggaggtggtctgggcaccgaagaatcgcgctggccctgaccgcatgccccagccttcctggggtttgtgaggagctctgaaggtgggggtgaggtgttgtaagtaaggggtggggagtatgaagacgcccactgaaaagaacattaatcttagaaaggacttgattcgtcttgggagcactatactgagagctaggcaagtggaaaccggaaggggcaggcagaggggtcacccagtgcgatgtcaagagtggggccggctggtccgggaatatgctggggagtggagcacgtttatattcgacgtaggaaaaacaatggagaggaagagaaggtggaagggagggcaagggagagaaacatcacatagatatttttagactttgctgaagatctgttatttttacatccttgggctcgggacggcagggagttaaattcccctgagagaatccccatggggccagggaaagcccgctgcagactggtttaccagaatatttttgtccacggctcccagaccaa

SEQ ID NO: 31401 - DNA, 472 bp, Homo sapiens
  misc_feature 1..472: note = chr7:96647760-96648232
  misc_feature 1..472: note = hyper
  source 1..472: mol_type = genomic DNA
ggtgtgcagtgggtgcgccctcacccccaaccttcccaaacacgcaccccttggcagggagaggcgtccgcgcaggggaaagccaggcgctggcacaccgcgggcgcgggtttctcccagtcggagtcgccagaaataaagcgctagctctcggtgtaatggaaactcccgaaatccttacaagcaaagaaagaaaagcaggaagtggatatcttcatctcttccccaatccccctattctctgtgagcgcagaaaacaaaatggggcaccctttggcttcccgcccccccccccgccccccgcaaaccttcctattgccccctcttccccgcacccagtgctccttccgagaaagtacggctggagcggactggggagacggaaatattgagtcgcggccgctgggggtgccggaggaggggtgcacaggccaggctgccgggcgtagttctgcctcggagccaggctgcg

SEQ ID NO: 31402 - DNA, 16 bp, Homo sapiens
  misc_feature 1..16: note = chr7:96650421-96650437
  misc_feature 1..16: note = hyper
  source 1..16: mol_type = genomic DNA
tcgcccgcgccttccc

SEQ ID NO: 31403 - DNA, 139 bp, Homo sapiens
  misc_feature 1..139: note = chr7:96651136-96651275
  misc_feature 1..139: note = hyper
  source 1..139: mol_type = genomic DNA
cgaggaggctctacattgttaagaaaaccagatagctgctctgggctgcctaggccgccctagaaataaccctccgcttgctttcaacccgcgaaattggccccacagctccggaggcccgctacggggtgggggcggg

SEQ ID NO: 31404 - DNA, 118 bp, Homo sapiens
  misc_feature 1..118: note = chr7:96651845-96651963
  misc_feature 1..118: note = hyper
  source 1..118: mol_type = genomic DNA
ccaaatatggaaaagcgggatagcctctgattaattcctactctgttcattcagatagtttgtgcaaagcgcttcctacaacactgctttctccttggcatctgggattcagctcttg

SEQ ID NO: 31405 - DNA, 157 bp, Homo sapiens
  misc_feature 1..157: note = chr7:96652017-96652174
  misc_feature 1..157: note = hyper
  source 1..157: mol_type = genomic DNA
cgtttccgcccctccccaggcttcaagaacaccagcccctccccaggcttcaaggaggtggccctgggccgtgaccctacttctgtcggcgtctgttcgggcgcccgcagaagccagactcttgggcagggaagacgctaaccgaggtctccaaagt

SEQ ID NO: 31406 - DNA, 368 bp, Homo sapiens
  misc_feature 1..368: note = chr7:96653452-96653820
  misc_feature 1..368: note = hyper
  source 1..368: mol_type = genomic DNA
cctactcccttctgccgcgtgcgcccccactgccgtgaaccgctgtgacccccaatctaccaccccatctcgcgcccccagcgtcctagtcgccctgtatctgcccagccttccccctgtccatgtacctggctggttggtggcgcttgggacgcggttgtaggcgccgccgtactggtggtaggagctagcgtagctatagtcggcataagctttggctgggtagctcccggcggagccgttcacgccgtgatactgatactggtaggggttgagagctttgccataggaagccgaggtaggagagcagtagccgtgcggggctccccccgtagggctgtagtagtcagaatcggtagctgaagact

SEQ ID NO: 31407 - DNA, 191 bp, Homo sapiens
  misc_feature 1..191: note = chr7:96653862-96654053
  misc_feature 1..191: note = hyper
  source 1..191: mol_type = genomic DNA
cggacgtctggaacggagcttggaagtcgccggatcggatgctggggacccttctgtcaaacactcctgtcatcgctcacgggcggcggcagcggctgtccttgctgttgtggcggcggcagctgccctagttggctgtggggctgctctggtctaagcagacatggctgtgggagcgagggaggaggagg

SEQ ID NO: 31408 - DNA, 83 bp, Homo sapiens
  misc_feature 1..83: note = chr7:96656775-96656858
  misc_feature 1..83: note = hyper
  source 1..83: mol_type = genomic DNA
agctctgtgcactgccggctgctctgcgggcctgtctgcggcttcggacccacgctcaggacatacaccggccagtatcccgg

SEQ ID NO: 31409 - DNA, 418 bp, Homo sapiens
  misc_feature 1..418: note = chr7:97361005-97361423
  misc_feature 1..418: note = hyper
  source 1..418: mol_type = genomic DNA
tgcaacttatcctgacgtctcgagggacggaaaagttaccgaagtccaaggaatgagtcactttgctcaaatttgatgagtaatatcaggtgtcatgaaacccagtttcgaaggagaggggagggggcgtcagatctgcagacggaagcaggccgctccggattggatggcgagacctcgattttcctaaaattgcgtcatttagaacccaattgggtccagatgttatgggcatcgacgagttaccgtctcggaaactctcaatcacgcaagcgaaaggagaggaggcggctaattaaatattgagcagaaagtcgcgtggggagaatgtcacgtgggtctggaggctcaaggaggctgggataaataccgcaaggcactgagcaggcgaaagagcgcgctcggacctccttcccgg

SEQ ID NO: 31410 - DNA, 261 bp, Homo sapiens
  misc_feature 1..261: note = chr7:97361520-97361781
  misc_feature 1..261: note = hyper
  source 1..261: mol_type = genomic DNA
cggtgctggccgcggctgcccgggtcaccccgccccgcatctgtccgaggtggccgcgctgggggcgccgctgcggcgagggacagtggggagactggcttcccaaacgccaacgcccctctttgtcttccacctgcagagtttcctggtttgaaggtgtgggttggtgggttagggggctgggggagttgggattcagggagaagagggttggagaatctttgggacgcgattctctcgcctaaccggtacaggtgagac

SEQ ID NO: 31411 - DNA, 518 bp, Homo sapiens
  misc_feature 1..518: note = chr7:97362187-97362705
  misc_feature 1..518: note = hyper
  source 1..518: mol_type = genomic DNA
aggggcactatttcccgggttccccacgggattttgtgcccacgattcaagtttcttcccgagggctgcaccgtccggcccaggaactccctgcagtagggatgccctcccggatgagcccgagatcctcacaaggcgggaaatctcgtaagatttcatcccccaggacctgggatttcgggggctccggtccagctgcactgccctagcgtctgggcacgggcagaggagggcgcctgggtcgcgggcagcagcgggcacacgcgcgagctgcagggggattggagggccggaggctggagggaagttaatttcctgccttcacgtttgttttgcggacctgaggatgtagcttgaagtctccctttagaaactcgtaggctacaggcgctggggagcgcgcctcggaaaaacggtgaaagtcgtctgtaaagcgttgtcacccttccccaccggagccccagccccagatcccacacacctgtgtgcatttagggcggtgaggactctacaaagcc

SEQ ID NO: 31412 - DNA, 586 bp, Homo sapiens
  misc_feature 1..586: note = chr7:97362706-97363292
  misc_feature 1..586: note = hyper
  source 1..586: mol_type = genomic DNA
gcaccgagacaagacaaagtcaggtggcggcgcagcagatgagggaaggtccccgggctgggaggaaagagcggaaagcgctcgaagcttgaagacgccgagccagctgctaactcgccctggcaggcttgcggggggcgggacgcgagttcggcggggaggggcgcagagaggcagcgcctcgggagggaccccgctcagcccgagcgtggggaaggccgcctccccacgcctcggggccggagtacagcggggggaagggctcgggttgctgggtgcctcgctctggttgccttacacgccctttgtccgtgcttttgtctcccaggaggaactgccggagccctttgagcatcttctgcagagaatcgcccggagacccaagcctcagcagttctttggattaatgggcaaacgggatgctggtgagataggcgaccgtccctaggtgtcttgggcagcccgccctgtctgctcactccttcctggagtaccccagggtctctcgctctgaatagagatttccactccaagaggggtgtaattccccaggcgcgacattggcccacaccgcactaaggcacgc

SEQ ID NO: 31413 - DNA, 75 bp, Homo sapiens
  misc_feature 1..75: note = chr7:97680670-97680745
  misc_feature 1..75: note = hyper
  source 1..75: mol_type = genomic DNA
ctggaccagtcgccacgacgagctccggggcgccaccggtggcctctctgatggcccgctcggcgaggggtcccc

SEQ ID NO: 31414 - DNA, 223 bp, Homo sapiens; identical to SEQ ID NO: 695
  misc_feature 1..223: note = chr7:98245856-98246079
  misc_feature 1..223: note = hyper
  source 1..223: mol_type = genomic DNA

SEQ ID NO: 31415 - DNA, 204 bp, Homo sapiens; identical to SEQ ID NO: 696
  misc_feature 1..204: note = chr7:98246304-98246508
  misc_feature 1..204: note = hyper
  source 1..204: mol_type = genomic DNA

SEQ ID NO: 31416 - DNA, 1315 bp, Homo sapiens
  misc_feature 1..1315: note = chr7:98246533-98247848
  misc_feature 1..1315: note = hyper
  source 1..1315: mol_type = genomic DNA
cgccccacacgccggccccctccgcccctcagcttaagaaagggcgcgcggacccggcaggccagagtgccgagcagcgcggtgggtgcggctgtgagacggcaggagacttctgccccgcggtgcacgcgaccctcgagacgacagcgcggctactgccagcagcgaaggcgcctcccgcggagcgccccgacggcgcccgctcgcccatgccgagctgagcgcggcagcggcggcgggatgctggcgctgctggccgccagcgtggcgctcgccgtggccgctggggcccaggacagcccggcgcccggtagccgcttcgtgtgcacggcactgcccccagaggcggtgcacgccggctgcccgctgcccgcgatgcccatgcagggcggcgcgcagagtcccgaggaggagctgagggccgcggtgctgcagctgcgcgagaccgtcgtgcagcagaaggagacgctgggcgcgcagcgcgaggccatccgcgagctcacgggcaagctagcgcgctgcgaggggctggcgggcggcaaggcgcgcggcgcgggggccacgggcaaggacactatgggcgacctgccgcgggaccccggccacgtcgtggagcagctcagccgctcgctgcagaccctcaaggaccgcctggagagcctcgaggtagcggcccgcggggagcgcgggggacctggaatggggacgctcccgagtcgggggcggaagactcgggaggatggggaaagggggcctggccctggggagggtgtgatcgtccgtgggggtgagctggacttgagggtgaaaggcggggatctagatcctgctcgggaactcccctgcgtggtatcccttcccacaccgctgctcttgctggaaggaaacgtttaaattccacccccgcgcgtcgggactgccagcgggatccgccgagcacttcccgaggtccgggctagcgaacccagacggccaagccgcgggcgccaaatacccggggacgcggtagcctctatcctcttgcaaatctccaaatctccgcgagccgggatgcgctcccgcaggccgtgcgggttgctgcgaggctgccgcgggaggtcagctgccccgggcatgtggtgtttctttctttaaatcaggtcaggctgagctagagggggcggaagtctgggggcggaggtcgcagggaggcgagcgcagggggtcaccggcgaccccagagcgcgcattagaggggcaacctctggttaacttcaaagactcccgtgtctgcaagttggaccattttaaggtgctcttccggattgcttcaggg

SEQ ID NO: 31417 - DNA, 199 bp, Homo sapiens
  misc_feature 1..199: note = chr7:99149223-99149422
  misc_feature 1..199: note = hyper
  source 1..199: mol_type = genomic DNA
aatggcacttggtatcgtgtaagatcgccagaattttacaactcggggtacccaggaaaccagaaaagcccccaccacaagaaaaaccagtgggcacaactggggagcacagatatctgactggggtcattttgtccgcgcgtctttggggtaaaacaccaggactgggggtccagaagggacacgcagaccgcctctc

SEQ ID NO: 31418 - DNA, 15 bp, Homo sapiens
  misc_feature 1..15: note = chr7:99155799-99155814
  misc_feature 1..15: note = hyper
  source 1..15: mol_type = genomic DNA
aggccccgcaatcct

SEQ ID NO: 31419 - DNA, 195 bp, Homo sapiens; identical to SEQ ID NO: 9139
  misc_feature 1..195: note = chr7:99155931-99156126
  misc_feature 1..195: note = hyper
  source 1..195: mol_type = genomic DNA

SEQ ID NO: 31420 - DNA, 82 bp, Homo sapiens
  misc_feature 1..82: note = chr7:99156127-99156209
  misc_feature 1..82: note = hyper
  source 1..82: mol_type = genomic DNA
ggcccagctcctcctccgagttcctcatccggggccgtcactcacatccggggccctcactcacatccgggaccctcatccg

SEQ ID NO: 31421 - DNA, 128 bp, Homo sapiens
  misc_feature 1..128: note = chr7:99156472-99156600
  misc_feature 1..128: note = hyper
  source 1..128: mol_type = genomic DNA
agtagaaggaggcggcgtccggccgcggccgacggtagttcgcttccccgagagtgcgcggaggcccgggtgcgaggagggcctgtttctcttcagccctggttcattcacctcgcggaccgagggcc

SEQ ID NO: 31422 - DNA, 100 bp, Homo sapiens; identical to SEQ ID NO: 9141
  misc_feature 1..100: note = chr7:99156815-99156915
  misc_feature 1..100: note = hyper
  source 1..100: mol_type = genomic DNA

SEQ ID NO: 31423 - DNA, 589 bp, Homo sapiens
  misc_feature 1..589: note = chr7:99177694-99178283
  misc_feature 1..589: note = hyper
  source 1..589: mol_type = genomic DNA
cggaagggacagccagttagagtctaggcccacttaggcgatgaagggcaggtgaagaaatcccgttccatcttcctgcagtcctcccttggggagtccacatcctatccttctctggaccggggcggctcctggagggaccgcgatcgaaatgaggcctccgagccgcccagagactccgaagtgcgcgcagcggaccacgcggtttccatgcgccccctagggtgggtgggctagctgtgcgccccagtgcggagaacggaggaggggtcggccccgtagcggctggaaacgcagttggcggcggggcccagcttgcggggcttctgatcgcaggggcggggcccgccgccggtttctaagggcctggcagagttcctgcagtcacggtcaggggtctttgctttcgtccatcccctcctggagaaagaacgcagcttctaacgccttctcggttgggcacccttcttgggaaagctccgcctaccattgcccttgtacctgccctctctctccctttcctgaagtgactgcccgtctctagcatcgtgttgtgaatgtgtcgagattttggcgctgcagcagcatc

SEQ ID NO: 31424 - DNA, 157 bp, Homo sapiens
  misc_feature 1..157: note = chr7:99595179-99595336
  misc_feature 1..157: note = hyper
  source 1..157: mol_type = genomic DNA
ctcccttttgactcattttgaggcccccgtcgtagggtacacgccctgggaatcgggggtcttccagtatagggaaccaccgagatgcgggccctccgaagtcctagagagggcgcctcggccgccggcacccgccacacttccggcctttgtgggc

SEQ ID NO: 31425 - DNA, 30 bp, Homo sapiens
  misc_feature 1..30: note = chr7:99595608-99595638
  misc_feature 1..30: note = hyper
  source 1..30: mol_type = genomic DNA
ctgcagatttcaggccgaccccgctagcac

SEQ ID NO: 31426 - DNA, 54 bp, Homo sapiens
  misc_feature 1..54: note = chr7:100091127-100091181
  misc_feature 1..54: note = hyper
  source 1..54: mol_type = genomic DNA
ggagccagcagaggccgttggggggcaagcaaggacttgcttctgaggggagac

SEQ ID NO: 31427 - DNA, 236 bp, Homo sapiens
  misc_feature 1..236: note = chr7:100167379-100167615
  misc_feature 1..236: note = hyper
  source 1..236: mol_type = genomic DNA
actccagttcctgggcgacgtgaggattagtctcgtggggtgggggttccggagcggtcggcggagggagggaggtagtggggagcccaggccaggggcaacagtcaccgggacactcgctgtgcgcagagtccttgccccaaacttccagtcgggagcccgggagagacgctgggcatcaagacgggtggcagcctgcccggccgctgctcccggcccgccgagttcgccacctc

SEQ ID NO: 31428 - DNA, 113 bp, Homo sapiens
  misc_feature 1..113: note = chr7:100167860-100167973
  misc_feature 1..113: note = hyper
  source 1..113: mol_type = genomic DNA
aagtttcgcgcgtgccgagcgcggctccagcgcagcctgagcctggcgggtgcgtgcaccaccagcaagtgcgcagatgcgcgccagcaccacctgatcgtcctctacacccg

SEQ ID NO: 31429 - DNA, 39 bp, Homo sapiens
  misc_feature 1..39: note = chr7:100254093-100254132
  misc_feature 1..39: note = hyper
  source 1..39: mol_type = genomic DNA
gatcccccgctccaacggcgccgccgattggctgccagg

SEQ ID NO: 31430 - DNA, 269 bp, Homo sapiens
  misc_feature 1..269: note = chr7:100318466-100318735
  misc_feature 1..269: note = hyper
  source 1..269: mol_type = genomic DNA
cgcgccccctggacagccgccctctcctccaggcccgtggggctggccctgcaccgccgagcttcccgggatgagggcccccggtgtggtcacccggcgcgccccaggtcgctgagggaccccggccaggcgcggagatgggggtgcacggtgagtactcgcgggctgggcgctcccgcccgcccgggtccctgtttgagcggggatttagcgccccggctattggccaggaggtggctgggttcaaggaccggcgacttgtcaaggac

SEQ ID NO: 31431 - DNA, 30 bp, Homo sapiens
  misc_feature 1..30: note = chr7:100770176-100770206
  misc_feature 1..30: note = hyper
  source 1..30: mol_type = genomic DNA
gaatgctcttacacacgtacacacacagag

SEQ ID NO: 31432 - DNA, 169 bp, Homo sapiens
  misc_feature 1..169: note = chr7:100807589-100807758
  misc_feature 1..169: note = hyper
  source 1..169: mol_type = genomic DNA
cctgctggcgcttggcgctacttggactgaaatctcgcagttcctggagcagggacgctagcgcctcgagctcctcggagggatcgctcgcctcgggcccattctccggagtctgagggcgaggcggagccgcgggctccgggctctccggcgccgggaggctgtgggt

SEQ ID NO: 31433 - DNA, 86 bp, Homo sapiens
  misc_feature 1..86: note = chr7:100808389-100808475
  misc_feature 1..86: note = hyper
  source 1..86: mol_type = genomic DNA
ccatctcactgccatcgcccacgtactaagcagcagcaatatgggggaaaaaaaaatctctgctccctccccgtaggactccccgg

SEQ ID NO: 31434 - DNA, 176 bp, Homo sapiens
  misc_feature 1..176: note = chr7:100809363-100809539
  misc_feature 1..176: note = hyper
  source 1..176: mol_type = genomic DNA
ccgggttccccaccccgagaccacgcgcccaaggacggcgtgaacctgagtgcagagggacagatctgcacgcctgcgggcgctgtccgcgaatcggcagtgcgggtggcagccccctgacaggggcagatgggtggatcttgcggttttggtaatcccatcgggaagggtccgag

SEQ ID NO: 31435 - DNA, 30 bp, Homo sapiens
  misc_feature 1..30: note = chr7:100817707-100817737
  misc_feature 1..30: note = hyper
  source 1..30: mol_type = genomic DNA
tcttcctaagatccacgcacccgcaggtgg

SEQ ID NO: 31436 - DNA, 30 bp, Homo sapiens
  misc_feature 1..30: note = chr7:100822573-100822603
  misc_feature 1..30: note = hyper
  source 1..30: mol_type = genomic DNA
gacaggcagggaagccggaggaggcttcga

SEQ ID NO: 31437 - DNA, 259 bp, Homo sapiens
  misc_feature 1..259: note = chr7:100823092-100823351
  misc_feature 1..259: note = hyper
  source 1..259: mol_type = genomic DNA
ggggacaggtgggagcgacatggcaacagaggggggcgggggagcgcttctggacacctgaagcgcagcctctgactcagttttctgggtcttcggactgggaggggctgggcagaagggggcgcagccgcttggtccccctgaggggcggtggccttctgctgccccattctgcggtggaggagcacgctagccccctccccagtccccaggcccggccgcccccctacctcgccggagccggagctggagccagggc

SEQ ID NO: 31438 - DNA, 320 bp, Homo sapiens
  misc_feature 1..320: note = chr7:100823380-100823700
  misc_feature 1..320: note = hyper
  source 1..320: mol_type = genomic DNA
cggcgggcgcagacacccccggtgccaagagagaggtccctttggagcccccaagagtcaaaggaggatgacgcgcggggactcggccgcgctgtcggagcccgactctaacgtcggtcagcgctggggcagcgccgcagctccgttggcgacgcgggccggggcgcccatcggttcaggggttcgggtggcacgcgtggctcccccggcgacgctccggcggcagcttcgaggggcggagaccccggcgacgcggaagaaacccgggacggatccggagcggactcgtgccctgctggcggggccgggggtcggggtgc

SEQ ID NO: 31439 - DNA, 30 bp, Homo sapiens; identical to SEQ ID NO: 9151
  misc_feature 1..30: note = chr7:100845392-100845422
  misc_feature 1..30: note = hyper
  source 1..30: mol_type = genomic DNA

SEQ ID NO: 31440 - DNA, 210 bp, Homo sapiens
  misc_feature 1..210: note = chr7:100943301-100943511
  misc_feature 1..210: note = hyper
  source 1..210: mol_type = genomic DNA
tgcagctgcagcccccgccaccccgagagtccagccccgagggcagctcctgccttgcctgcggttaccgccgccgccagctgagggccaaggagggagaggggaggccaggcgctctcaggagtcccaaaggacaaataaccccgccgctgccgcgggacccagacgcgagccagctgctcgcccgccctgccccgcctgagctttccg

SEQ ID NO: 31441 - DNA, 30 bp, Homo sapiens
  misc_feature 1..30: note = chr7:100946628-100946658
  misc_feature 1..30: note = hyper
  source 1..30: mol_type = genomic DNA
cagcccttccctgtccgtcctagccagcga

SEQ ID NO: 31442 - DNA, 30 bp, Homo sapiens
  misc_feature 1..30: note = chr7:100951829-100951859
  misc_feature 1..30: note = hyper
  source 1..30: mol_type = genomic DNA
gtgagtgagagaccccggggctatgcagtt

SEQ ID NO: 31443 - DNA, 434 bp, Homo sapiens
  misc_feature 1..434: note = chr7:101006050-101006484
  misc_feature 1..434: note = hyper
  source 1..434: mol_type = genomic DNA
tcggccccggaccgccgagggttaacaaaaaagccccacgccccctttgacggcttagagcccacctcgccgaatttgaaaaggcggccccggagaggcgtgggcgccccccacacatttccagctcgcacccgggctccgaccgctcgccccgctcctctcgctgtgctcccggccggtgccgcgggttcggtccgggcgccggtgcgctcctgccggtcctcgtgcccgggactccgggtccccgcgggctgctgcgcacgatgaagctggccctgctcctgccctgggcgtgttgctgcctctgcgggtcggcgctggccaccggcttcctctatcccttctcggccgcagctctgcagcagcacggctaccccgagcccggcgccggctcccctggcagcggctacgcgagccgccggtgagtagctcgg

SEQ ID NO: 31444 - DNA, 892 bp, Homo sapiens
  misc_feature 1..892: note = chr7:103085842-103086734
  misc_feature 1..892: note = hyper
  source 1..892: mol_type = genomic DNA
gcttcgagagttcagcgtgtcagagcctctatgatggcagagcacctgccgcgatgcctgattggtagggagaaggatttcccgggagggggccaataccaaattttagggctgttaggctctgagcagtcccttcgtgaccggataagtcagagacccggggtttgagccttgcccggcgctgagcggagggcccagtttcgggaccacagccttgctccctgggagctccgggcggccaatgccgggcaagcccagcccggcacaggaggaggcagggcccgtctccggaaagagggccagaggcagaactgagggcctggttttgtgtaattcgatttggatacaaacaggccagacccaaactggaaacggcgaagggctggattagcaccgaagggattcgaggaggcaaacgggaagtaaaaatgctgtgtggagctgcagagggcaaggggacaggggttgcaaaggaaagagcttcgtgagactttctccttcccggcgtagggaccagcagagtgcgggcaggtcagccctgtcaccggttcgtttagggaaaaagcgcgacatggggcctgggagacaggggcagaggcggtgacagcgagggcccctgctcgggtgggcccgcgggcctcagctcagtcccctcccgagggaccgcgacccccggccccgcggccgcccgcgcgcactcaccagcccgggctgccctgggcggagccgccccgccgcgctccacagccgctgcctcttcgacgcgcgcgctgcctccaggtgcggctctaggaggaggcgccgcgggcagtgccggccgcgccccgcgactcccggtaacccgagcccgccccgccccgctagggccaggccccgccgccaccctccgcgc

SEQ ID NO: 31445 - DNA, 736 bp, Homo sapiens
  misc_feature 1..736: note = chr7:103629059-103629795
  misc_feature 1..736: note = hyper
  source 1..736: mol_type = genomic DNA
ctggctggtgagcagcgggaactttgcggtcgagcggcgcggggcagccacagacctgggcgcttcaatctgtcaccagcctgcccgcaaagcccagcgacagcccccaacgcccccccggggacccatctggggggaccgggagcaggacaaaggtctgaaatccaagtcctaggagtaaagaaacaaaatgcgcaggttcaatttaaagtgcctgcggtaagtacggggagtgagggggaaagacaccggcctccaagaattctcaggcgtttagcacaagcaccagctcattaccaggagatgcgttcggggagtggggacatggagaatgaatcccaacttgtgactccattctccactaactttattctcgctccctggaccaagcgcatcgctggggccagggttgtcatggttcttgtttccaaggccccttggaagaaggaaagggatgagaaaggtgcgctggcgggcgcacccggcggcggcgagcgcggaggtgctgcggtacctaccatggtattcttgtcccggaacgtagtaggtggggttgcccgcaatatgcagggaaatgagcacctcgccctgctccccatccccttccagctccccgtggtgggtgcacaggaaaaagaagggcgaaaagcgggggtaatagccagccgccgcgcgcgccctcagcgtcgcccccagcaacagcgctaggaggaaagtctgccgggcccagccactg

SEQ ID NO: 31446 - DNA, 30 bp, Homo sapiens
  misc_feature 1..30: note = chr7:103630053-103630083
  misc_feature 1..30: note = hyper
  source 1..30: mol_type = genomic DNA
cgcctccgtgcgccgccgccgcctctgcgc

SEQ ID NO: 31447 - DNA, 109 bp, Homo sapiens; identical to SEQ ID NO: 9157
  misc_feature 1..109: note = chr7:103630363-103630472
  misc_feature 1..109: note = hyper
  source 1..109: mol_type = genomic DNA

SEQ ID NO: 31448 - DNA, 279 bp, Homo sapiens
  misc_feature 1..279: note = chr7:103630739-103631018
  misc_feature 1..279: note = hyper
  source 1..279: mol_type = genomic DNA
taaaatgagattaagcgaaagtggaattggcagactcgagtggtgcctggaaatggtgatttgtgctgctcggttgtggggaattgtaaggcaggaagggctggcggagctaagatccgacaggctctcttcgccggactgttctgttattcattgcttctgggctcttcaggcagagatgggtgttgtaattttttaaatcagtgtttatttcctttaaatgtcggttatgaccaatggccctgaaatcgggggagggaaaaacgttcaggggagatg

SEQ ID NO: 31449 - DNA, 251 bp, Homo sapiens; identical to SEQ ID NO: 3084
  misc_feature 1..251: note = chr7:103968915-103969166
  misc_feature 1..251: note = hyper
  source 1..251: mol_type = genomic DNA

SEQ ID NO: 31450 - DNA, 355 bp, Homo sapiens; identical to SEQ ID NO: 3085
  misc_feature 1..355: note = chr7:103969167-103969522
  misc_feature 1..355: note = hyper
  source 1..355: mol_type = genomic DNA

SEQ ID NO: 31451 - DNA, 15 bp, Homo sapiens
  misc_feature 1..15: note = chr7:103969562-103969577
  misc_feature 1..15: note = hyper
  source 1..15: mol_type = genomic DNA
cggcctctccatgat

SEQ ID NO: 31452 - DNA, 115 bp, Homo sapiens
  misc_feature 1..115: note = chr7:103969892-103970007
  misc_feature 1..115: note = hyper
  source 1..115: mol_type = genomic DNA
cccaagtgtgggggacgcccactcagagggacgccccggaggcagggcggttgtggggccgagtccgctcagaactaaggatggtgggtggagaagtggccgcttagagagatgg

SEQ ID NO: 31453 - DNA, 82 bp, Homo sapiens
  misc_feature 1..82: note = chr7:106684832-106684914
  misc_feature 1..82: note = hyper
  source 1..82: mol_type = genomic DNA
atgacgcctgggaagcggggcgagtggccagcccgctcctggacgcgcggacaggtggacacgaaggcggcctcgctgggcc

SEQ ID NO: 31454 - DNA, 433 bp, Homo sapiens
  misc_feature 1..433: note = chr7:106685345-106685778
  misc_feature 1..433: note = hyper
  source 1..433: mol_type = genomic DNA
aggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatggtgaggaccagaccccccacttcgcgcccccggatcccctcgctgccccccaccgctccccgctgtgctctcggatcttgccgctttgcgcacccacctctccccgcattctccacctt

SEQ ID NO: 31455 - DNA, 799 bp, Homo sapiens
  misc_feature 1..799: note = chr7:107300982-107301781
  misc_feature 1..799: note = hyper
  source 1..799: mol_type = genomic DNA
ccacagggcctggcccgcccctgacctcgcaacccttgagattagtaacgggatgagtgaggatccgggtggcccctgcgtggcagccagtaagagtctcagccttcccggttcgggaaaggggaagaatgcaggaggggtaggatttctttcctgataggatcggttgggaaagaccgcagcctgtgtgtgtctttcccttcgaccaaggtgtctgttgctccgtaaataaaacgtcccactgccttctgagagcgctataaaggcagcggaagggtagtccgcggggcattccgggcggggcgcgagcagagacaggtgagttcgccctgaagatgcccacaccgcccggcccgggctccactcccggggaggcctcgagggttgcggatgggactcttaagtggtcacggatcaggtgggcagggggcagtacagctttctttctgagacgccgagagcgaacaggctgctcggaaaacaggacgaggggagagacttgctcaataagctgaaagttctgcccccgagagggctgcgacagctgctggaatgtgcctgcagcgtccgcctcttggggacccgcggagcgcgccctgacggttccacgcctggcccgggggtctgcacctctcctccagtgcgcacctggagctgcgtcccgggtcaggtgcggggagggagggaatctcagtgtccccttccagccttgcaagcgcctttggcccctgccccagcccctcggtttgggggagatttcagaacgcggacagcgccctggctgcgggccataggggac

SEQ ID NO: 31456 - DNA, 50 bp, Homo sapiens
  misc_feature 1..50: note = chr7:107642639-107642689
  misc_feature 1..50: note = hyper
  source 1..50: mol_type = genomic DNA
tgtgagcttgggaagcgagagtgcgtgtgcgtgcacgcgcgagggtcacc

SEQ ID NO: 31457 - DNA, 72 bp, Homo sapiens
  misc_feature 1..72: note = chr7:107643722-107643794
  misc_feature 1..72: note = hyper
  source 1..72: mol_type = genomic DNA
cccggtcccaccccccggggcgcctcttttgtttgaaagccgaatctgcgatcgctgcggggctggggcgct

SEQ ID NO: 31458 - DNA, 249 bp, Homo sapiens
  misc_feature 1..249: note = chr7:108095329-108095578
  misc_feature 1..249: note = hyper
  source 1..249: mol_type = genomic DNA
ctcaggacagttctgcgccggtggtagccaagggctggagcccctgatgcgaagaaaagggaaggagagaggcggggtgcgaaagaaacgccaccgctcggcgccctccctcggtgcccgcggcgcaggggccacccgccagcgtacgggggacgaagatgtggccgcgggcgcgggcgggaggggaggcgatccggggaaggaagcggcctgttcgccagccccggggcccggggagccctccagcag

SEQ ID NO: 31459 - DNA, 1108 bp, Homo sapiens
  misc_feature 1..1108: note = chr7:108095780-108096888
  misc_feature 1..1108: note = hyper
  source 1..1108: mol_type = genomic DNA
cgctgcgagatggatgctccagggcgggtaatcactcctggctcaacacagcatcccgggcggagcggatgccagatcccaccgctaagagcctgggctgggaaagcaatctttccaggcagcccccagcccggtgcgccggccccgacaagtcccagccctcggaggcagggcggggcgcagggactcccgggacccgcacctgtaaggccgacaaagcccccgcaagcgccccacccctctgtcctccgtgtctctctcgttccgcctcgattccccgagccctctccaggcagcgactggagaagcgaagtcggcctcgcccccgaactccgtggtcagcacaggtgtacgcacttccgaacaaagcccacgcccagacgtgtccgcaggggcccgaacaggcacacgcccgtgcgctcccggcccggcccccgcgctcctcgccccgccggcactgtggcgtgacgccccgcgcctccgtgtccaagcccgggaagccgccgtgccgggcccgcaggctctccatgcccaactgcccacgagcaagagctctgggcagggcttcccggaaagcgtggggtgcgggcgcggagcagaagttggccacaggctggagggggtggtgggtgccggcgctgctggatttcagctgtgccttcacccaagcgcaggtccccctgctccctctcggcgcccgcgggagtgtcgggggcctgcaggggagaagggagttggagatctgctttgcccctcctgcagcgctgccagcccggtgagcgctcggctgaaccccgcggcggtgtccaagtgacaacgcagcagcctcgcgcgtcctcctccgctccagccgtcacccccgagcaggacccagtgtcaccgccagacgcgcaaggagctacttacgttctcgcgccgcgccctccgctcagctctggcgcgactgcccaggaccctggaccgccggtgtcctccgttctcgacgaagctatcccctctggctgctccagccaggcggcccctgcgccgtcccccgcgcccgcgcgtctgaggctcggactgcggcgcgcgtccgccagcgaccctggcgaagcgaggctggccccgc

SEQ ID NO: 31460 - DNA, 369 bp, Homo sapiens
  misc_feature 1..369: note = chr7:108097139-108097508
  misc_feature 1..369: note = hyper
  source 1..369: mol_type = genomic DNA
ccgtcagcctgcgagcgcgtgtggcggcgggggtgggggtgcggggacggagggcgggagtgttccggggctaggatggctgggatttagctacaaaagatgttccagaaaatgggtagtttttgaatgccactctcatgggtttagctttctgtgggaggtctgtggtcttctagttttttcttttttaaaaagcactttcttcgaaattcatcagttggggtggttgagattgggtgagtggttttgggggttttgttttgtttttgcaaccgttctttccaaacactccccgccgccccccaccaccgcagaaaaaagagcttttagcataaggcggatgctatctatccgcggtagaaactgggt

SEQ ID NO: 31461 - DNA, 57 bp, Homo sapiens; identical to SEQ ID NO: 9167
  misc_feature 1..57: note = chr7:112726853-112726910
  misc_feature 1..57: note = hyper
  source 1..57: mol_type = genomic DNA

SEQ ID NO: 31462 - DNA, 588 bp, Homo sapiens
  misc_feature 1..588: note = chr7:113722696-113723284
  misc_feature 1..588: note = hyper
  source 1..588: mol_type = genomic DNA
ttctaatttgtcattcgcgtgcgtcgctttccttcatcttggctatacttcctctcatctgcggtgttttatttcgcgcaagatgcgctgacagaggccatttcaaacgaatttatctttcactaggaccgtactagagcagtgtctcgaattttgttgatttgtggtttcgtcgtaaaataaacttgaaatcaaataaactttcgtgaggaagctttgatgtccacttggtgaaactcctcattcacccagttgagccgttgaactttcttctggaacctctttaaatgacttttgccgatccacgtgctgcaaagaagacctgaaccgtgcctatgaccctgcgcggcgactacagggacagaatttggctttccttctctttccaatatgcagcgtttcgtttaaaggctgcctcgatccagtgggctgaccagtgacttgtgcaaaagaaaactattcgatcgctgtttgccctttcagcgttttcctcggctgcggaaacccggttttcctattattatacttcaactttttttggagtcagctagcacagagcgctaaaccccggccagttccagcagcagc

SEQ ID NO: 31463 - DNA, 245 bp, Homo sapiens
  misc_feature 1..245: note = chr7:113723338-113723583
  misc_feature 1..245: note = hyper
  source 1..245: mol_type = genomic DNA
cgagttcaaggaattgcaaataaatatattttatgaccacccatcaacaaactacgtgccaccgtggcggcccctggtagccgggccgtgtctgcagtgtggccaggggcgggggctgaaaaggaggcggccggagaggcgaagcgagctgcgagccccgggcctgaactttcacctctcgaacccgggcccagcccattggctgcagccgaggggtccaccgagggcagcggctcctgacagga

SEQ ID NO: 31464 - DNA, 717 bp, Homo sapiens
  misc_feature 1..717: note = chr7:113724755-113725472
  misc_feature 1..717: note = hyper
  source 1..717: mol_type = genomic DNA
ttagtgcggttcgcccgtctccccaaccaccaccacccctccctcttctgccaccggaggggttcaagttggccgttctttccccagggaggagggccgggaagcagccgggggccaggctctgttcaccacggcctattggccgcagctatttggaggaaagtttcagcgcctctcggaacgccacgctttgcgactgacttgcgagcaaagcagcgggctcagtctgcggcgcgcggaaaaggcggccggcgaagagtcgcccggcccgcgggcaggggagggaccggagggagacggcggggagggagcgctggcccccctctgggctggggctccggaggaagcccctcgccaagattccggtcgtgcgtcccctccggggcccgctctctcctccctcggcctttcccctgtcaccgccctgggtcccaagcaggccgcccagccgggtcacacccggtggatagaagccgggacccagggctggcggctgggcccgtgcatcccccacgcgggcgcctcggctttgaagtgcgcgcggagcaggctctgaccgtttcttctttcctttctttccggttacttttgctcccctcagtcactgataggacccttcccgaaaacctcagactctctaagtcccagcttggcggccccttccttccaagccgcgccccggtgacctgggctgcgcgaccacgaggaagcccgaga

SEQ ID NO: 31465 - DNA, 30 bp, Homo sapiens
  misc_feature 1..30: note = chr7:113725787-113725817
  misc_feature 1..30: note = hyper
  source 1..30: mol_type = genomic DNA
atacggttttgttctcgcctccctccccac

SEQ ID NO: 31466 - DNA, 430 bp, Homo sapiens
  misc_feature 1..430: note = chr7:113726087-113726517
  misc_feature 1..430: note = hyper
  source 1..430: mol_type = genomic DNA
tatcaacaacaacaacgacaataacaacgcaaagtaaaacaaaacaaacaagtggtccggcggtacttcagaatcctctgcggcgtcctgtcccccaccccgcccctccgaggagaggcagccccgcgagcagtgtgtgtacagttcgcattgccaacaacacgcgcgcgcggccgggtgcgcgcgcctgccagcgcacattcacacacacagacacacagacacacacacacacacacacacacacacagatccgggtggggggagcggctgcgcgagacagcgcgagcctccgagaaagcgcgagacacgccggcgcgtgcagctccgcggccgccgcttcgccctagctctagccccgcgccacccgcagcccgcccgcgaacgcccgccccggttatttatgcggcggccgcgtccgctggctgcg

SEQ ID NO: 31467 - DNA, 47 bp, Homo sapiens; identical to SEQ ID NO: 9171
  misc_feature 1..47: note = chr7:113726751-113726798
  misc_feature 1..47: note = hyper
  source 1..47: mol_type = genomic DNA

SEQ ID NO: 31468 - DNA, 170 bp, Homo sapiens
  misc_feature 1..170: note = chr7:113727456-113727626
  misc_feature 1..170: note = hyper
  source 1..170: mol_type = genomic DNA
ccgctttagagaggtcgcctggctgtttgtgggtgggtttggggtgaaatcgcacctcgcggcacttggtgaggggacgtgggaggagcgcagacacctttcggtgatagggagggcttctcacttggctgttacctggaagtccacagtggccccggcgggcaggcggg

SEQ ID NO: 31469 - DNA, 54 bp, Homo sapiens; identical to SEQ ID NO: 9172
  misc_feature 1..54: note = chr7:113727754-113727808
  misc_feature 1..54: note = hyper
  source 1..54: mol_type = genomic DNA

SEQ ID NO: 31470 - DNA, 92 bp, Homo sapiens
  misc_feature 1..92: note = chr7:114562185-114562277
  misc_feature 1..92: note = hyper
  source 1..92: mol_type = genomic DNA
cccgggtggggagcccgagccagcccaggccggctctggcctcctgacccagacagcgcagggcgcgagggatcgcgcggccgagcccgggt

SEQ ID NO: 31471 - DNA, 317 bp, Homo sapiens
  misc_feature 1..317: note = chr7:114562326-114562643
  misc_feature 1..317: note = hyper
  source 1..317: mol_type = genomic DNA
cgatccggatgtgatgaaaaagagcaacagagggagaagtgtttcaggattgtaggagtggaagaggggaaagagaggcagagagggggaaggccccctcgcaggggagccggctggagtgagctggctggaaagagggggcggagtgcgcggagtcagagccgccaccgctgccgcagttgccgccactgcggcgtctgggctgagccggagggaggcgggaggacgcgcaggggcggccgccgccgtcgtcaggccaccggggcgaaaatgcggccgctgccggaggctcgctaactttccggggcggaagagga

SEQ ID NO: 31472 - DNA, 440 bp, Homo sapiens
  misc_feature 1..440: note = chr7:114562960-114563400
  misc_feature 1..440: note = hyper
  source 1..440: mol_type = genomic DNA
ttttgtatatttttccgccagaagcagtcagttccctgcacccagcacctcacagcccttcctccgtgcgccctgccgggcggcgagctaggcggcagcggcgcggcgcgggctcggcggagcggcccatgtccggcgcgggcgaagccctcgctcccgggcccgtggggccgcagcgcgtggccgaggcgggcggcggccagctgggctccacagcccagggtgagtgcgcgcttgcaagtggcaagcttctttgtcattgttgcatttttcagtttgctcacaagtgcacagataggggtggggggagtgctgtgaggaggggctcccactcgtagttgagaacttttgcacagttcgcgttactcaggcaagttcttcaggatccttgccctagatcaacaaccgggtaagagggcgggaaccgttggtccctccac

SEQ ID NO: 31473 - DNA, 227 bp, Homo sapiens; identical to SEQ ID NO: 9176
  misc_feature 1..227: note = chr7:115117500-115117727
  misc_feature 1..227: note = hyper
  source 1..227: mol_type = genomic DNA

SEQ ID NO: 31474 - DNA, 30 bp, Homo sapiens
  misc_feature 1..30: note = chr7:116140161-116140191
  misc_feature 1..30: note = hyper
  source 1..30: mol_type = genomic DNA
agccaggttcctgtgcgcccaccgtgaccc

SEQ ID NO: 31475 - DNA, 16 bp, Homo sapiens
  misc_feature 1..16: note = chr7:116962550-116962566
  misc_feature 1..16: note = hyper
  source 1..16: mol_type = genomic DNA
ctgggatgggggaggc

SEQ ID NO: 31476 - DNA, 521 bp, Homo sapiens
  misc_feature 1..521: note = chr7:116962626-116963147
  misc_feature 1..521: note = hyper
  source 1..521: mol_type = genomic DNA
gtctgtgctagagctggagaccaggctagcacgtctctcaacaggataagaaattggctgattttgctgtcgctcagctggatccaaataaaccaaacatcggagctctcatttgagggggaatgtggttttatggagttgtcaaagctgaaatgatcttctgggaaaagagaaggggctcaccatggggcgataagagggcagtagccagggttcgggccagaatccgagactgctgcggccgcgggggaacgcagccaggaagggtctatgtggccaatgcggtccccattccgatctccaaaatcccccgcgcccgtgcgcgtggacttaccaccatgaagagttgacctcgggggtgagccaggtcaagagcagagggagccagagccagattccaccgagaggggcgttcatattaacccccttgcgtctgcatcaggtcagactccgtgtgcgggcgccatgcgtgcccagagcagaagcgctcagctccgggagcgcctcgtcacggccgccgg

SEQ ID NO: 31477 - DNA, 271 bp, Homo sapiens
  misc_feature 1..271: note = chr7:116963330-116963601
  misc_feature 1..271: note = hyper
  source 1..271: mol_type = genomic DNA
cgtccgctctgctcccctccgggcgcagccgagggagggggtgctgcgcctggcgggggtggggagaaacgcggggttttagacacgggtgcatgaaatgatggcaagagatgtctggggatgaggtgaggcggggaagggggaacatcgctgcatggttacgagcacacgcgaatacaggaacctttagggaagctccaggccaaagagcatccgtgggctctcggagcgtgcgttccggattgccgaggccatccgctggcaaacaagt

SEQ ID NO: 31478 - DNA, 337 bp, Homo sapiens
  misc_feature 1..337: note = chr7:116963872-116964209
  misc_feature 1..337: note = hyper
  source 1..337: mol_type = genomic DNA
agggtccatgaccctcgggacctaacccagcagtatctgccaaagcacccaggaaagatgcagtttttacgcacacccagctcctctccggagctgcggagcgcaaaagatcacatagagaggaaccgaggcagccaggcgttcgccgggggtgtgcgcccttgcacctcctgccgcctgggcgctcagcctgtgcgccttgtggaggttaagggaccctcggtcctggacctgggcccccgcccagccaagagagaggggcttgggcccgcgggtggagcattttgagcagtagctggcttgtagccgcgccgtttatcaccggaaaggaaggaag

SEQ ID NO: 31479 - DNA, 154 bp, Homo sapiens
  misc_feature 1..154: note = chr7:116964456-116964610
  misc_feature 1..154: note = hyper
  source 1..154: mol_type = genomic DNA
cggtgagaggctggacgaggcgaagctcagagacgccaaaaacctgaaagatgctgtcatcgccacccccttcccccacgctggtccctggcaggtccggcccctcccaggctgacccagatacatccccgtttgggtccggaaagggagggga

SEQ ID NO: 31480 - DNA, 779 bp, Homo sapiens
  misc_feature 1..779: note = chr7:117119492-117120271
  misc_feature 1..779: note = hyper
  source 1..779: mol_type = genomic DNA
aatgcaccttgcaaacgtaacaggaacccgactaggatcatcgggaaaaggaggaggaggaggaaggcaggctccggggaagctggtggcagcgggtcctgggtctggcggaccctgacgcgaaggagggtctaggaagctctccggggagccggttctcccgccggtggcttcttctgtcctccagcgttgccaactggacctaaagagaggccgcgactgtcgcccacctgcgggatgggcctggtgctgggcggtaaggacacggacctggaaggagcgcgcgcgagggagggaggctgggagtcagaatcgggaaagggaggtgcggggcggcgagggagcgaaggaggagaggaggaaggagcgggaggggtgctggcgggggtgcgtagtgggtggagaaagccgctagagcaaatttggggccggaccaggcagcactcggcttttaacctgggcagtgaaggcgggggaaagagcaaaaggaaggggtggtgtgcggagtaggggtgggtggggggaattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcaggtgagaaggtggccaaccgagcttcggaaagacacgtgcccacgaaagaggagggcgtgtgtatgggttg

SEQ ID NO: 31481 - DNA, 39 bp, Homo sapiens
  misc_feature 1..39: note = chr7:117512371-117512410
  misc_feature 1..39: note = hyper
  source 1..39: mol_type = genomic DNA
agaggggggcgtccacgccccgctcgctccatcccaccc

SEQ ID NO: 31482 - DNA, 46 bp, Homo sapiens
  misc_feature 1..46: note = chr7:117512808-117512854
  misc_feature 1..46: note = hyper
  source 1..46: mol_type = genomic DNA
cctcagcggcagcagcgcccacatctggacacggccctctcccagt

SEQ ID NO: 31483 - DNA, 35 bp, Homo sapiens
  misc_feature 1..35: note = chr7:117513436-117513471
  misc_feature 1..35: note = hyper
  source 1..35: mol_type = genomic DNA
gtcgggctcgcagctcgcgccgtccgtcgccatct

SEQ ID NO: 31484 - DNA, 126 bp, Homo sapiens
  misc_feature 1..126: note = chr7:119912968-119913094
  misc_feature 1..126: note = hyper
  source 1..126: mol_type = genomic DNA
ccttgaaccgggactcgagaggcagaagcaaggcacgggtcccctttctcctctcctccaccaaaccaccgcagcccagcacgtgaagcttccctttgttcatccgaggctcgcttttctccccag

SEQ ID NO: 31485 - DNA, 41 bp, Homo sapiens
  misc_feature 1..41: note = chr7:119913455-119913496
  misc_feature 1..41: note = hyper
  source 1..41: mol_type = genomic DNA
cccgcccggccgccccgcagccccgccgccccgcagccccg

SEQ ID NO: 31486 - DNA, 53 bp, Homo sapiens
  misc_feature 1..53: note = chr7:120969300-120969353
  misc_feature 1..53: note = hyper
  source 1..53: mol_type = genomic DNA
ggtgcaaaagaggagcggctgggctgggggactccatgcgggggcgatggaca

SEQ ID NO: 31487 - DNA, 201 bp, Homo sapiens
  misc_feature 1..201: note = chr7:120969650-120969851
  misc_feature 1..201: note = hyper
  source 1..201: mol_type = genomic DNA
agagaagctgggctgcgccaatttgccgctgaacagccgccagaaggagctgtgcaagaggaaaccgtacctgctgccgagcatccgagagggcgcccggctgggcattcaggagtgcgggagccagttcagacacgagagatggaactgcatgatcaccgccgccgccactaccgccccgatgggcgccagccccctctt

SEQ ID NO: 31488 - DNA, 600 bp, Homo sapiens
  misc_feature 1..600: note = chr7:120970100-120970700
  misc_feature 1..600: note = hyper
  source 1..600: mol_type = genomic DNA
tcttcctctttcctgcggtgccccgccagagttggaaaaaaaactctaattctcctaccccgccgaccccctcggaccccgtagcgcccccctacgtgggtgaccagctggagaaacatgatgtcggcagcggggaatgcggctgccgcatctgctttgatttaaccaactccgctgcgcaccaaaccccggacaagtggctaattgcagcgaagccccacctttattggctcctaggagcaccgagttgacagaataatggtgacttttaaagcgactgtccgcgaccacccaacgtgcggctaacctgagcaggaccacttgtgcgcttctcgtttctttggcttttctatctttccctcctcggcgcactcccgcggcgcgggaagctgcaggaaaacaaagttccacttccacgtgcgtagtgacttggtaaggataaaggtacagggagccaggattgttcctggaatatcaacagatccaaagaatgttaggactggggcgctgaaggatgcgctgtcgtttttcatgttcatttccgttccccctccgcctttgacccttgtccacgcagtccctgcgcgcacccccgccgag

SEQ ID NO: 31489 - DNA, 371 bp, Homo sapiens
  misc_feature 1..371: note = chr7:121513553-121513924
  misc_feature 1..371: note = hyper
  source 1..371: mol_type = genomic DNA
atgcgaatcctaaagcgtttcctcgcttgcattcagctcctctgtgtttgccgcctgggtgagtgagaagagctcggtggggtttcagctccgggatcggtgggatgagggtgggagcatttcagcgtgtccgcgacttgccgccgccgccgccatctagccaggaggaaaaagggacagccaactgggctcccacggagcgggcggccgcgcggtgcaggcagctgcgtgggatttgcgcgccccctccccgccccgcgccctcgccccttccatcggcccgcgggcattcgtgccccgggccccaggagacggagctactggagacggagggctactcggatccctgccgccaccgttcttctctcctc

SEQ ID NO: 31490 - DNA, 258 bp, Homo sapiens
  misc_feature 1..258: note = chr7:121783508-121783766
  misc_feature 1..258: note = hyper
  source 1..258: mol_type = genomic DNA
taaactgcttctccccgcgccccgtcccgcgcgagcgctcacaatgggctgcatagtcccgcaggggctgaagagttcaggaaacccagacttgcaaggcgcccaacttccacccatctccgatccttgctggagaatgggtctgtgtctcggagagtgggcagcccaagatggacaaggagagaagtttgtgatcagtttggctaagctgggcgtggggagggaagggggaaagaaccaccccgaaatctccatcca

SEQ ID NO: 31491 - DNA, 67 bp, Homo sapiens
  misc_feature 1..67: note = chr7:121784215-121784282
  misc_feature 1..67: note = hyper
  source 1..67: mol_type = genomic DNA
tcgtccgctctggggcgccgacttgtcccccgccgcctcgaatcttccgagtcgctgcaggggaggc

SEQ ID NO: 31492 - DNA, 568 bp, Homo sapiens
  misc_feature 1..568: note = chr7:121939677-121940245
  misc_feature 1..568: note = hyper
  source 1..568: mol_type = genomic DNA
ggagctacttagggccgcatagattcggaatccagccaactatggaattccaagaccctcgctccctcgctttccgaagtcaaatctaacatggatttggccccaacagtgggcaaggtcggggcatgaggtcaggaaaggagaaacatcggttttcgatctaataatggctgggctggagcttgttccctgtgtccaaagggcgtgcgtactagcacaagcgttgagaaaggtctggacccgatgtctgcaggaagtgtcaggacctccctgttctggggaccttcccagcccacaccaggtccgtgctctctagattcccccaacctcgctccacaacccggaaggagctcaggccggacttggcgtgagggtccctgcggggctgggtcacctacccgtccgcgatcaccccacaggggctgttagtaatctccctgcttcctaggccgttgagaagcactcaggtcacccactctcggtgaccagagcggtcagtctttccccgccatgaaatgtgagttcgggtggcagccgccgcgcccctgcagtgtcccctgcacatctc

SEQ ID NO: 31493 - DNA, 191 bp, Homo sapiens
  misc_feature 1..191: note = chr7:121940433-121940624
  misc_feature 1..191: note = hyper
  source 1..191: mol_type = genomic DNA
cggtgtggaccgatggtggattctccgcgacaacagccctggagggagagagtgggccgggggaggggccacggggcccctgaggcctgcggggctggccgcactggccccgggcctggcggggtggtggagtccgaagcggcgaggcgaggaccccggggcccgctccccccagtcgccctcccgggatg

SEQ ID NO: 31494 - DNA, 187 bp, Homo sapiens
  misc_feature 1..187: note = chr7:121940903-121941090
  misc_feature 1..187: note = hyper
  source 1..187: mol_type = genomic DNA
gaatggaagtatattcgtctataaacatacatacacatgtaaaaacacggaggctccgtttgccagctgtgtacaagtcagtatgtgccgtcaggatgcaaacaatagatacctgtctatctatgattgtaatgcgtttgaggagatgtacattgcatacagctactggatacgttgttcccattta

SEQ ID NO: 31495 - DNA, 320 bp, Homo sapiens
  misc_feature 1..320: note = chr7:121941881-121942201
  misc_feature 1..320: note = hyper
  source 1..320: mol_type = genomic DNA
ggtgcatgcaagaggcgaaaggccaggggatgcagaggcttctggtcggccctgaagtgtggggcccaacatgccctggggtctgcagacgaactcggaccaggagctctagtctgccgctgcctcagcgtgggggcacggctgaggctgggaggacccttagcctcgatcactggtggccctggtggagcccgggctgcaggggccccggggttggcagcggcggctgcagaggaggcagcgtcatcggcggctgctgcggtagcgggggcggcggttcagtgcctggttcgccagctggcgtgcgggccagccccagg

SEQ ID NO: 31496 - DNA, 15 bp, Homo sapiens
  misc_feature 1..15: note = chr7:121943974-121943989
  misc_feature 1..15: note = hyper
  source 1..15: mol_type = genomic DNA
ccgggtggcatgggc

SEQ ID NO: 31497 - DNA, 123 bp, Homo sapiens; identical to SEQ ID NO: 706
  misc_feature 1..123: note = chr7:121944176-121944299
  misc_feature 1..123: note = hyper
  source 1..123: mol_type = genomic DNA

SEQ ID NO: 31498 - DNA, 30 bp, Homo sapiens
  misc_feature 1..30: note = chr7:121944621-121944651
  misc_feature 1..30: note = hyper
  source 1..30: mol_type = genomic DNA
cccagcatcaccagccgaacctgcctgccc

SEQ ID NO: 31499 - DNA, 142 bp, Homo sapiens
  misc_feature 1..142: note = chr7:121945611-121945753
  misc_feature 1..142: note = hyper
  source 1..142: mol_type = genomic DNA
caggatacacacagacgcgcgcgcgcgcacgcttccgagtttccattgagagtctggaaagagcatttctttcttaagtacctgcgctcagctagagctctcccggagcattttaaatactgaatgccgagcggagaaggga

SEQ ID NO: 31500 - DNA, 46 bp, Homo sapiens; identical to SEQ ID NO: 9197
  misc_feature 1..46: note = chr7:121946080-121946126
  misc_feature 1..46: note = hyper
  source 1..46: mol_type = genomic DNA

SEQ ID NO: 31501 - DNA, 505 bp, Homo sapiens
  misc_feature 1..505: note = chr7:121946478-121946983
  misc_feature 1..505: note = hyper
  source 1..505: mol_type = genomic DNA
tttcactcaaagatgcgaaactggaccttaaacgaaggaaattgacgtcaaagtattccctcctctctaccccattctcaacacatgccaggcaagctacccgggtccctccgccccactctaactttccgcgaaaatcagttccgcctctgccccaagagccaagaggggtggaaaggaagagagcttgggctgggaacgcgcctgatgtctaacagaaaggcagtggcagctgggtgagtggtgggaaagctcacaggctgaagaaatgggggagggggagtgagtcttattggaagttgaggacagccaaggggcaagatggggggagaggtctggctgaatacgacgggcttcagcagctaggcctgggagtgcctcgtttcaggcctcgaggtggcttcaggctgggacaactgatgcagcagagaagggcagagcgcccggggggagaaagcaaagaggcgctacactccaaggcggccctttggaaccgtccttggcc

SEQ ID NO: 31502 - DNA, 309 bp, Homo sapiens
  misc_feature 1..309: note = chr7:121947097-121947406
  misc_feature 1..309: note = hyper
  source 1..309: mol_type = genomic DNA
cgcttcgtagttgtccttggaccgggcgcagacactcagtattggtcagcgctggaaattttctttccttttgctgttggggccgcagaaccagtctcctcctttcccctgctcagacaaagggcacgggaagggctttgctggggcaaaggggggtggggggttctctgtcccacgacagatgggtcgcggttaagactttaattgctgacttttgggccggatcagattccttttcctacctgccacttcccagcagcgaaaaatccccctcctgctgcactcctccgccaccgggctaggttgaaa

SEQ ID NO: 31503 - DNA, 163 bp, Homo sapiens
  misc_feature 1..163: note = chr7:121950102-121950265
  misc_feature 1..163: note = hyper
  source 1..163: mol_type = genomic DNA
ccatgaaataaaagtcgataatagaaattaaaacaacacagagcaaagaacgagcttagtgaaatggagaagcagtagaggtaaataaaaatcctcgagctagaaagctctaagaaccgcttataaattcagttacctcctgaactccggccgatggccactc

SEQ ID NO: 31504 - DNA, 125 bp, Homo sapiens; identical to SEQ ID NO: 710
  misc_feature 1..125: note = chr7:121950428-121950553
  misc_feature 1..125: note = hyper
  source 1..125: mol_type = genomic DNA

SEQ ID NO: 31505 - DNA, 148 bp, Homo sapiens; identical to SEQ ID NO: 711
  misc_feature 1..148: note = chr7:121951863-121952011
  misc_feature 1..148: note = hyper
  source 1..148: mol_type = genomic DNA

SEQ ID NO: 31506 - DNA, 104 bp, Homo sapiens
  misc_feature 1..104: note = chr7:121952043-121952147
  misc_feature 1..104: note = hyper
  source 1..104: mol_type = genomic DNA
cgagggtgggaagggaagttgaggtctggggtaaaaagccggaaaaagaaaggaacaaggctgagaatcattcaaagattaaatggggtcggctcccgttgctt

SEQ ID NO: 31507 - DNA, 40 bp, Homo sapiens
  misc_feature 1..40: note = chr7:121955281-121955321
  misc_feature 1..40: note = hyper
  source 1..40: mol_type = genomic DNA
actccgggcaggagtcggtgctggcagtcgccctaagcgc

SEQ ID NO: 31508 - DNA, 459 bp, Homo sapiens
  misc_feature 1..459: note = chr7:121955381-121955840
  misc_feature 1..459: note = hyper
  source 1..459: mol_type = genomic DNA
tttccgcagctggggccaccttgaagggtgtggacccctctgcctttctctctctgttccgcttgcagtttgcaagtgtatccttctgttgcatccctgaattgggacgcaggacatcgttctaggctcccataagccttggaaaatattaatgaacaccatttgcacctgaaattcccttgaactcaacgcactgaccacaacagccgaggcctgagattcctcgcttgtgatctggcacctcctggatcatccccgtcccatttcagagcccttgaccaacataatctgcaagtggactcaataacacatctccagctacctcccttcccaaccgcagccacaggggctgctgttagcgatgctggccctttctgagaccagagttcccttgcccctccccgtctcctcctctcctcccatcgggctggccatatatataaccggagaactggacaa

SEQ ID NO: 31509 - DNA, 30 bp, Homo sapiens
  misc_feature 1..30: note = chr7:121956177-121956207
  misc_feature 1..30: note = hyper
  source 1..30: mol_type = genomic DNA
aagcttggggctctgcggttgtccaagctg

SEQ ID NO: 31510 - DNA, 124 bp, Homo sapiens; identical to SEQ ID NO: 713
  misc_feature 1..124: note = chr7:121956458-121956582
  misc_feature 1..124: note = hyper
  source 1..124: mol_type = genomic DNA

SEQ ID NO: 31511 - DNA, 123 bp, Homo sapiens; identical to SEQ ID NO: 714
  misc_feature 1..123: note = chr7:121956954-121957077
  misc_feature 1..123: note = hyper
  source 1..123: mol_type = genomic DNA

SEQ ID NO: 31512 - skipped

SEQ ID NO: 31513 - DNA, 57 bp, Homo sapiens
  misc_feature 1..57: note = chr7:121957255-121957312
  misc_feature 1..57: note = hyper
  source 1..57: mol_type = genomic DNA
gctgagtgacctctttccctctcaagcacaccttcaaggagccggtggaccctctca

SEQ ID NO: 31514 - DNA, 305 bp, Homo sapiens
  misc_feature 1..305: note = chr7:123172939-123173244
  misc_feature 1..305: note = hyper
  source 1..305: mol_type = genomic DNA
gcttggcgcggaaggcgccgccagtgaccggctgcggctgggggcggaggccggcagttgctcggagctccggcgggtcaggaggtgacgggaggaggaggaggcaggaggaagaaaggggggttgggaggtagcgtccggtaggtctgcgcagacagcgctgccagacctctgactcccccagtcctgccgccgccgatagccccacaaggcgacatgggaagtccgccggagcagaggggagaaaattcaaaacgagtctactcaacctcgtcttggctccgaggccccgccatgcagacccc

SEQ ID NO: 31515 - DNA, 505 bp, Homo sapiens
  misc_feature 1..505: note = chr7:123672016-123672521
  misc_feature 1..505: note = hyper
  source 1..505: mol_type = genomic DNA
gcccataaaattgagcgggtagtgagaatagtcccaggaacaagccccgcacgtgcggagtcccagaccccaggacagctcccacacgtagatgaagatcacgtagatgggcacccgcttccaagtgccccaaccgcggctgtagtggaggtggaagtagagcttttccaccacgaaactgcagctgccgtacataaagaaggaccagagcgacgtgtggccgctggttgtcccgtccccctgccccagtacgttgaagaagaaggtgaagaagatctcatccagaaagccgtgcattccgaagaaaagaaagcggggtaggtcgggcagcccctggctgggggctcccccggcgcccctggggccacggggtcgtcgccgccgggctccggccgcagtagggacccgggcgccgggagggacggggagcgcgcccctccgctgctgctgctgctgctgctgctgctgttgctgctgccgccgcctctgtcgcccgtaccgcaag

SEQ ID NO: 31516 - DNA, 56 bp, Homo sapiens; identical to SEQ ID NO: 9209
  misc_feature 1..56: note = chr7:123672928-123672984
  misc_feature 1..56: note = hyper
  source 1..56: mol_type = genomic DNA

SEQ ID NO: 31517 - DNA, 157 bp, Homo sapiens
  misc_feature 1..157: note = chr7:123673226-123673383
  misc_feature 1..157: note = hyper
  source 1..157: mol_type = genomic DNA
tgcactcaggggactcgcgggccgcccggctagcggaatccccccgccgtggccccgctgcgccctcccttccagtcccgggcgaggtgccgcccgcccgcgcccgctctagctctcaccctgcgcggcctaacgggcaccgcggcccagccagggg

SEQ ID NO: 31518 - DNA, 137 bp, Homo sapiens
  misc_feature 1..137: note = chr7:124404361-124404498
  misc_feature 1..137: note = hyper
  source 1..137: mol_type = genomic DNA
tccattctgggccagcgcccggcccgggagtgcaattgtccacccttcgtgccccgccagtccattggccgtcttggacaggggcttgtggtgggaaccctggagtttcccggctctccttggccagtaaaaaagat

SEQ ID NO: 31519 - DNA, 226 bp, Homo sapiens
  misc_feature 1..226: note = chr7:124404734-124404960
  misc_feature 1..226: note = hyper
  source 1..226: mol_type = genomic DNA
cctgcagccgggtcacggcccggggccgccggcaggtcccaggagggtcccgcaagaaacgctgccccctgctcctccctgggtgctcgggctcgcagaacgtctcttgcagaatttcccggtccccaggcgtccctgccgcggcgctggatcactgtaggtgcacagctctcccccagacaagtttcgtttctggacgcaggggcgaccccgagggcagaagagg

SEQ ID NO: 31520 - DNA, 30 bp, Homo sapiens
  misc_feature 1..30: note = chr7:124405187-124405217
  misc_feature 1..30: note = hyper
  source 1..30: mol_type = genomic DNA
tgggggtcacacacacgccccctataatcc

SEQ ID NO: 31521 - DNA, 671 bp, Homo sapiens
  misc_feature 1..671: note = chr7:124405556-124406227
  misc_feature 1..671: note = hyper
  source 1..671: mol_type = genomic DNA
agctcgctggaaacacgttgcaaacagtccgaagcagcgctgatgcgccggcgaaactcttgccccacctaaccccagcgacttgcgagcctactgctgccgaggagaagcgggattccaaccccgcggccactgccaaagttgcttctcctccagctcaaagttgacgacggggcgaagcaggctgctggacggcgtgccgccgcagagaaggaaatcgtggggagaagggggagaagagggcgccgctcgtcggtggacagtgccgctagccgcgggagctagtcactgccacagcgggctcagcccggacgggaagggtggtgcctggaaccgccgcgggccaggcagtgcgcggccgggaaggggaggtggcccggcctcgcccccgcgctccagccgctgcgcgcgcccgcgaagctcgactctcggctcgttgcctcctcccactccttcgcctcctcctcggagagatactggtttgtggggagacgggatcccctggtggttcaccactcactaaacccacacacgtttcattcaagccatttgtagcggcttccactcggaggagctgggagggaacaagggcggaggcgcggagcctgcgcggctcgaggctagggatgggcgggacaggttaattccccagctgtcgaaaccagcctgac

SEQ ID NO: 31522 - DNA, 44 bp, Homo sapiens; identical to SEQ ID NO: 9215
  misc_feature 1..44: note = chr7:126891206-126891250
  misc_feature 1..44: note = hyper
  source 1..44: mol_type = genomic DNA

SEQ ID NO: 31523 - DNA, 1050 bp, Homo sapiens
  misc_feature 1..1050: note = chr7:126891563-126892613
  misc_feature 1..1050: note = hyper
  source 1..1050: mol_type = genomic DNA
gcccctgtttcccagcgcaggttcctttttcttctcagttccttgggctgttgaagccgggttctgggtagatagagactggggccgtggggagagcgccaggctgcttttgcctttcccgcgccccggggcattccggcgcgctggggatgcagcctccgcccccgccgcacctggccgcccgagcgcccgcgcccacgccccgcgcggggccgcccgaaactggggccgcgccagccgcgggagctaccgaggagctgttggggtgcgtttgcctttgctttttaaacaagatccccgagaccttttctccatccccccaacccccagcaggacacggaactccggcgtttctcgaaagccacaaaagaggggcacggaaatcccaagctcgccgtgctaactcggagaacgcaaactcgaggcagagcgtgcgccgtgcggggatgtgggtgtcgaggaccccgaagcgcccggcttcccccgcgacccccatcctccctagatcctggttagacatccatccagcccacgctcagagggcgggggttaccccgactcatcccggaagccgctaacttcagaaatccctcctgttaggttcgcgaaacgaaggtacctcgtcatctcggcggggcaagtccggattccaccagggcaggtccgggaggtcacccagggcagacgatccgaggcagagcgctttaaaatcctgccgccgcacgcccagtcagagcgccgagcgcgcctgcccccttcccgtcacccttcagtctcccattcgccgactaaacttttgggggatcacatctccaagccttgggagttccgggtaaagtctccctcttttctgaacctctttactgtaatgtaatcatgggcagacaagaggggtggctgccttgttctttgcaacgtaaaatcaacagacacccaatcaagctccaatgcccggccagcccctcgccccctggtgcccactctccttctccccccattcccgtcacctccgcccgctatttctctcacagactacggacatgcagggcc

SEQ ID NO: 31524 - DNA, 212 bp, Homo sapiens
  misc_feature 1..212: note = chr7:126892895-126893107
  misc_feature 1..212: note = hyper
  source 1..212: mol_type = genomic DNA
gcagctccatgtcagcgccgccgccgccgccgccgccgccgcgtgaggcgagcacagcggccgcacttgtggctgatctctgggctgagggggctgagctggcctagcaggcgccaagtctcttccatgtgaataacaaatactcccaccggcggccgcgattggtctgcgcccggcgcctcccgatcctccgcccgcggccattcacccgg

SEQ ID NO: 31525 - DNA, 69 bp, Homo sapiens
  misc_feature 1..69: note = chr7:126987771-126987840
  misc_feature 1..69: note = hyper
  source 1..69: mol_type = genomic DNA
gaaaggggtttgaggcgaggcagaggactcaggggtctgcggacggctggtcggcccgtggagacggcc

SEQ ID NO: 31526 - DNA, 43 bp, Homo sapiens
  misc_feature 1..43: note = chr7:126988163-126988206
  misc_feature 1..43: note = hyper
  source 1..43: mol_type = genomic DNA
aggaaagagcgccgacgcctctcagccccgcaagagctgcaga

SEQ ID NO: 31527 - DNA, 47 bp, Homo sapiens
  misc_feature 1..47: note = chr7:127260538-127260585
  misc_feature 1..47: note = hyper
  source 1..47: mol_type = genomic DNA
tttccagagcgcacgcgccacctgtccaaaaccgttctctggcggcc

SEQ ID NO: 31528 - DNA, 153 bp, Homo sapiens; identical to SEQ ID NO: 715
  misc_feature 1..153: note = chr7:127744057-127744210
  misc_feature 1..153: note = hyper
  source 1..153: mol_type = genomic DNA

SEQ ID NO: 31529 - DNA, 459 bp, Homo sapiens; identical to SEQ ID NO: 716
  misc_feature 1..459: note = chr7:127744211-127744670
  misc_feature 1..459: note = hyper
  source 1..459: mol_type = genomic DNA

SEQ ID NO: 31530 - DNA, 46 bp, Homo sapiens
  misc_feature 1..46: note = chr7:127806561-127806607
  misc_feature 1..46: note = hyper
  source 1..46: mol_type = genomic DNA
tgggaggaaggggaacgccaatgcccgggagcggcctttgggagga

SEQ ID NO: 31531 - DNA, 50 bp, Homo sapiens
  misc_feature 1..50: note = chr7:127807004-127807054
  misc_feature 1..50: note = hyper
  source 1..50: mol_type = genomic DNA
cgggggcgcggcaggcgggcttggcccaccccagccgaggagcttgtggg

SEQ ID NO: 31532 - DNA, 131 bp, Homo sapiens
  misc_feature 1..131: note = chr7:127807478-127807609
  misc_feature 1..131: note = hyper
  source 1..131: mol_type = genomic DNA
tctcaaaatagtaggcgagcgcggccggcgctgccctggcgaggggtgggggctccgcgctcgctcgcgcgagccgagttagctgcagggttacaaacagtatctccctgctcccccggcctgaattaatg

SEQ ID NO: 31533 - DNA, 864 bp, Homo sapiens
  misc_feature 1..864: note = chr7:127807816-127808680
  misc_feature 1..864: note = hyper
  source 1..864: mol_type = genomic DNA
ggcgccccctcccagcgcccgaacccaggcaacttcccgccgcccgggcaggagtttctccgtagcccacggacatccgggaggcttgtggagggcaggcgggtaacccccactcccaccccacctttatccaggggcagccagaggagccagcaggtcgggactcgctgagggggctccacgcggggcctcccacgcacaggtacgcgctggtcctcggggtgtccccagtttgggagggagacacgcacagtcgctcccgtccacactcctctcgtgtcctggctccatgactgggagtctggggaaagaagaatgggtgtctgagacctacccctccgccggtgtcgccccgctctttctgggcgtaggagcgggctgcctgcccctctcccgcaccttcctggtctcgggctagaactggggcttcccatcggccgcgcttcccttaggggcgccatctgaggtcggaagcaaagctggaggggcgtccaggccagaggacgcgggctggggcgggagcctcggcagcctggtgggagctggtgcccactgcagggtgcgtgtacggggctgcctgcgtgtgcttggtgtgtgtcacttctgggagcgtaccccgtgtgtccacggggtgtgtatgcgcccacggaagtcctctgtgcatgcgtgtctgtgccataggcgtgggaacacctcgtgcacccatggtacttgcccggagagtaggaagccagcgagggagcggccctgctccagggtctcttccctgctcatccctccagctggcccagattacaccctactcacacccgggtcgcggcccactttccccatagccgcagcttccggcggctgcacacttct

SEQ ID NO: 31534 - DNA, 159 bp, Homo sapiens; identical to SEQ ID NO: 3109
  misc_feature 1..159: note = chr7:127841338-127841497
  misc_feature 1..159: note = hyper
  source 1..159: mol_type = genomic DNA

SEQ ID NO: 31535 - DNA, 192 bp, Homo sapiens
  misc_feature 1..192: note = chr7:127841625-127841817
  misc_feature 1..192: note = hyper
  source 1..192: mol_type = genomic DNA
cgcctccttcctccgccggcttctctgtctgcctcccactgtccctattctgcccttcacagatcgttgtcattatcaagtcctacactttgagagcagaaaacgaccccgtacgtggtgggtctccgacatctgtttattacgttggaccgcatgctgcatatgatccagccacctcgctctactcctgtg

SEQ ID NO: 31536 - DNA, 34 bp, Homo sapiens
  misc_feature 1..34: note = chr7:127991709-127991743
  misc_feature 1..34: note = hyper
  source 1..34: mol_type = genomic DNA
agcagcgcggcggcacgcgaggactgcagagcgc

SEQ ID NO: 31537 - DNA, 136 bp, Homo sapiens
  misc_feature 1..136: note = chr7:127991787-127991923
  misc_feature 1..136: note = hyper
  source 1..136: mol_type = genomic DNA
cgcccaggcgcaggcctagctggaaggcccaccagggccagggcccttccaggccggattggccgccgtagcccagggcgtgcagcacctcatagccctgcagggctccgctcagcagcccgaaggtgcccgccac

SEQ ID NO: 31538 - DNA, 275 bp, Homo sapiens
  misc_feature 1..275: note = chr7:127992044-127992319
  misc_feature 1..275: note = hyper
  source 1..275: mol_type = genomic DNA
cgcccgccccagcaggagagcgccagcagcagcccggaaaggaaagcggcgagaaaggcgtgcagcccgcgcgaggcgagccgcaggggccgcagcgggcgatgcgcggcgctcccgagggcggcggcggccgccagccccagccccaggagcagcagcgcagccaggccggtggggcaccgcggcgggcgcggccgggccagcagcaggcaggccagccccaggccggcagccaagcagggcagcggaaggtcctgcagcagcagccaggcgag

SEQ ID NO: 31539 - DNA, 154 bp, Homo sapiens
  misc_feature 1..154: note = chr7:127992371-127992525
  misc_feature 1..154: note = hyper
  source 1..154: mol_type = genomic DNA
cgcgtggtcccggccgacagcagcagcaggtccagcagcgccaggcagggggcgccgggcgggcaccgccagggcaagagggccagagccagcagcgccagcaaggcaaccaggccgaagagcgcgcctaccccgtacacgtgggcctcccagg

SEQ ID NO: 31540 - DNA, 115 bp, Homo sapiens
  misc_feature 1..115: note = chr7:128002255-128002370
  misc_feature 1..115: note = hyper
  source 1..115: mol_type = genomic DNA
agcttggtagaaactcgaaccgtctccctgccggccctctccaccacctggtggttttcaacagttgcactgctacacagcagtgcctccaacacttcaccggtgaactgccaaa

SEQ ID NO: 31541 - DNA, 138 bp, Homo sapiens
  misc_feature 1..138: note = chr7:128337405-128337543
  misc_feature 1..138: note = hyper
  source 1..138: mol_type = genomic DNA
ctcaatttcttcacccggccatgtaagcagagcggacaactctgagggcgtggctgggcggggttcttggggcagcccggcgccactgccggcatctacgcaccctgaacgcgcccgatctggtctcatctcggaagc

SEQ ID NO: 31542 - DNA, 134 bp, Homo sapiens; identical to SEQ ID NO: 719
  misc_feature 1..134: note = chr7:128337787-128337921
  misc_feature 1..134: note = hyper
  source 1..134: mol_type = genomic DNA

SEQ ID NO: 31543 - DNA, 142 bp, Homo sapiens
  misc_feature 1..142: note = chr7:128430740-128430882
  misc_feature 1..142: note = hyper
  source 1..142: mol_type = genomic DNA
gggctactgtgggggcgtggctcgcagcccaccgggtgtgggaccggaagggaagacagggcggaggagagggggtcttccggccctgaggcttgatggggccaccggagggctcctcctaagagggtccttggccctggct

SEQ ID NO: 31544 - DNA, 19 bp, Homo sapiens
  misc_feature 1..19: note = chr7:128430922-128430941
  misc_feature 1..19: note = hyper
  source 1..19: mol_type = genomic DNA
cgttcgcccatccgggcct

SEQ ID NO: 31545 - DNA, 564 bp, Homo sapiens
  misc_feature 1..564: note = chr7:128470493-128471057
  misc_feature 1..564: note = hyper
  source 1..564: mol_type = genomic DNA
gagagagccagagagcggccgagcgcctaggaggcccgccgagcctcgccgagccccgccagccccggcgcgagagaagttggagaggagagcagcgcagcgcagcgagtcccgtggtcgcgccccaacagcgcccgacagcccccgatagcccaaaccgcggccctagccccggccgcacccccagcccgcgccagcatgatgaacaacagcggctactcagacgccggcctcggcctgggcgatgagacagacgagatgccgtccacggagaaggacctggcggaggacgcgccgtggaagaagatccagcagaacacattcacgcgctggtgcaatgagcacctcaagtgcgtgggcaagcgcctgaccgacctgcagcgcgacctcagcgacgggctccggctcatcgcgctgctcgaggtgctcagccagaagcgcatgtaccgcaagttccatccgcgccccaacttccgccaaatgaagctggagaacgtgtccgtggccctcgagttcctcgagcgcgagcacatcaagctcgtgtccataggtcagtgccggggg

SEQ ID NO: 31546 - DNA, 134 bp, Homo sapiens
  misc_feature 1..134: note = chr7:128471125-128471259
  misc_feature 1..134: note = hyper
  source 1..134: mol_type = genomic DNA
cggggagctgagagacagggcggagggcaccccccggtatagagagaagaccctggccccggccctcccacccatcgacaagggccatgggcactgcctgcacacccctctggggacagcgagcactccctggg

SEQ ID NO: 31547 - DNA, 101 bp, Homo sapiens
  misc_feature 1..101: note = chr7:128510097-128510198
  misc_feature 1..101: note = hyper
  source 1..101: mol_type = genomic DNA
gcccacgccccctcccgggcggcccccagctttgccaccgccggtgccgacctttgtggctcgcctttgatcatgctctgcgtcagcgtggtagtccttct

SEQ ID NO: 31548 - DNA, 374 bp, Homo sapiens
  misc_feature 1..374: note = chr7:128828130-128828504
  misc_feature 1..374: note = hyper
  source 1..374: mol_type = genomic DNA
tggaacagaagtccccgttgacttcaggcatcccctgtctttcccatcctgagccaggagaaaagtccgcttcctgcagacgacctcagaccaagcaaggtgcccgccgagtctctccttgcaggtccggcccacgatttccactcatctctttcccccgggcgcggggcggcggcaggcggggtcaccagatccccctagcccgggcccctccaggcgccagggacgctgacgctcgcgctcttcctctctcgcctcccctccccacctctccgctccttcgtccagtccctcccccagcctcggcgcaggggggccgggcttggctccgcgaggcccgtgcattccagagagcccagcgagctagagcaaca

SEQ ID NO: 31549 - DNA, 475 bp, Homo sapiens
  misc_feature 1..475: note = chr7:128828904-128829379
  misc_feature 1..475: note = hyper
  source 1..475: mol_type = genomic DNA
cgcggccgccgaggtcgtgcgtgtggccggggggctccgaggagcaggcgggggcgccggggcttttgctgagttggcggggttggccatggccgctgcccgcccagcgcgggggccggagctcccgctcctggggctgctgctgctgctgctgctgggggacccgggccggggggcggcctcgagcgggaacgcgaccgggcctgggcctcggagcgcgggcgggagcgcgaggaggagcgcggcggtgactggccctccgccgccgctgagccactgcggccgggctgccccctgcgagccgctgcgctacaacgtgtgcctgggctcggtgctgccctacggggccacctccacactgctggccggagactcggactcccaggaggaagcgcacggcaagctcgtgctctggtcgggtaagtgcggcggagccgggtctggggggcgggaggtgccgcggtaagatgggggc

SEQ ID NO: 31550 - DNA, 30 bp, Homo sapiens
  misc_feature 1..30: note = chr7:129142850-129142880
  misc_feature 1..30: note = hyper
  source 1..30: mol_type = genomic DNA
cggagtcaggccagccgtctttccaggttt

SEQ ID NO: 31551 - DNA, 300 bp, Homo sapiens
  misc_feature 1..300: note = chr7:129418271-129418571
  misc_feature 1..300: note = hyper
  source 1..300: mol_type = genomic DNA
attttctcttctttgcgtaaggccgactccagaggtcccgctaactcccccgcaggagcatgaaggggcggccttgagcggtaaagaaacgagcagtggtggaggctgccgctccgagcccaggtccgaaccgagagccgcgcggggaatgtgggggtcgaggctgagagctgggcttggggcaggttcctttgcgttcgctcaggccacgatgaggccactaggacagatttctccgaaggctcggcctcggatcagagatccgccgactcggtgcccatcggtcgggctcactgggtg

SEQ ID NO: 31552 - DNA, 79 bp, Homo sapiens
  misc_feature 1..79: note = chr7:129421630-129421709
  misc_feature 1..79: note = hyper
  source 1..79: mol_type = genomic DNA
ggctgtctctgcacccgcgccctacctggtcctcagacccatgcgatgctgggcaacccgggccgggtgtgcccaggac

SEQ ID NO: 31553 - DNA, 854 bp, Homo sapiens; identical to SEQ ID NO: 721
  misc_feature 1..854: note = chr7:129422115-129422969
  misc_feature 1..854: note = hyper
  source 1..854: mol_type = genomic DNA

SEQ ID NO: 31554 - DNA, 299 bp, Homo sapiens; identical to SEQ ID NO: 722
  misc_feature 1..299: note = chr7:129423125-129423424
  misc_feature 1..299: note = hyper
  source 1..299: mol_type = genomic DNA

SEQ ID NO: 31555 - DNA, 1391 bp, Homo sapiens
  misc_feature 1..1391: note = chr7:129424555-129425946
  misc_feature 1..1391: note = hyper
  source 1..1391: mol_type = genomic DNA
taccaggcgacaccccggtcgactttgacccccgagcaggtgaaacataagcgtccaccccagaggggtcccctacccaagtcagaggagaaggtggcctgccaggttaaaggatcgagtccagcctcggtttcctcatctgtaaaataagccgagaacatccgcgcctctttctggagaaggctgggaggatgccagagagaaactgcgcgcaggccctggcgaggagcccctccggcccatgcggaactctgcacaggctgggtccctccagggttagaaacccagcttccccacccctacccagcagggacccgcgctgcatcccctaacgccccccaaccctctgcacccagacccaagagccggccttcgacgcaccacatgcgtggagcccgggtcccagccctgaggaccaggtttcagggctcagaagactccagcgaggttccctcgcagattgtgtctgcggtcgttgggggaggggccccgcagccttcagcagattatccaaaggtcagtgacccagatatggttttggccacgggccatgtttcacttcctgtgccccaagcagaatttagctgaataattcggaccccaaaccaaacaaaacgctcttatttccgtttggggattcttcggagttgggatttttctgtctcaaattagaataatctgcattattaaccacttaacagttatttgttggttggctgcctgacctttctgagcctcagtttcttcgtctgtaaattgggagcttacccaggtcggaggactgttggaattggaaatattcgaataaggaagtgtttttgcaagtgctttgtaagcagcaaagcgcttcttcaggggtcaatttttttttagctctgcagtcaccacccaaattcggaagatcgttgtgcctttcttggatgagaatgcccggctccagcccggggatgggacggtcttttccttgctaggagtccgctgtggagggggcgatgcgctctgtccaggacctaggagtccctttctccctccaccctcggctcacagcgggcagctcccccgacgcgtaccgcctctttgcccccagcctgaggtgcgctcttccccaggacgcctcctctgtcctctgcacgccgccggccctgctggggttgctttctgccgcggcgtcttcgcgaatatcccctcttgctgtctgcctgggcgtccctccgggttaccgcacaccgcctccgaccctcccagggcgcgggaggaggggcagggcatccgcgttcgtgtctgggccctggcggggagtcgcgtggtccaacccctcgtttttaagaggagggatctgaagcccagctaggcttctaattccagacagagccctacggagcccagttctc

SEQ ID NO: 31556 - DNA, 202 bp, Homo sapiens
  misc_feature 1..202: note = chr7:131242762-131242964
  misc_feature 1..202: note = hyper
  source 1..202: mol_type = genomic DNA
attaaccttggaacccgggtacggcgtaaatttggctcacgtgactccggggttgctaatctggagtctatctgccagatggggctgggtggaggggttttctccaggatctagccgcgtcccgggcacaggggactccgtgagcccctcaagtcggctgcaagcaggcgatgcctgcagggcactgcgtccctggagccgc

SEQ ID NO: 31557 - DNA, 195 bp, Homo sapiens
  misc_feature 1..195: note = chr7:131514739-131514934
  misc_feature 1..195: note = hyper
  source 1..195: mol_type = genomic DNA
cctgggcttggatcccgctgtgaggccgggggcaggtgatcatggcaggcggtaggactcctctcactctctgccccagaccccgcctgggagcctctgccgccctctcctgctccagcaggcaaggccaggaagccgggagtgcttgctgtcaatatcacatgtggagctgcttgtggccggccaggactctca

SEQ ID NO: 31558 - DNA, 286 bp, Homo sapiens
  misc_feature 1..286: note = chr7:132260280-132260566
  misc_feature 1..286: note = hyper
  source 1..286: mol_type = genomic DNA
caggtgttcgccagccggaggcaccggggaaggcagccccatgtgcccagggagggtagggaggtgagaggggacccaagtcctgtgtctccaagtcctgtctgcttgctgctaagcaggcactgaggctgtgaataaggtcttaccttttaaggaggatctgacccccgtaccttccctagacaagcaacatacgcggcgatgctttaagccgctttctgcctgaaatctcggcgcattcccggggaagcagtgccacgcttcagaaaggcgtttgtgctgcctc

SEQ ID NO: 31559 - DNA, 89 bp, Homo sapiens; identical to SEQ ID NO: 9241
  misc_feature 1..89: note = chr7:132260852-132260941
  misc_feature 1..89: note = hyper
  source 1..89: mol_type = genomic DNA

SEQ ID NO: 31560 - DNA, 62 bp, Homo sapiens
  misc_feature 1..62: note = chr7:132261146-132261208
  misc_feature 1..62: note = hyper
  source 1..62: mol_type = genomic DNA
cccggccccactccccggcgggccggctccttacctggacgcgccgcgtttccctccttcag

SEQ ID NO: 31561 - DNA, 249 bp, Homo sapiens
  misc_feature 1..249: note = chr7:132261256-132261505
  misc_feature 1..249: note = hyper
  source 1..249: mol_type = genomic DNA
cgccctcctctgaacgtgtgcgtgtgcgcgcgtgtggctgcctcctccagccccagccccgaacgcaaatactccaccgaggcacagggaagccgggagcagccgaggaacgcggagggcgccgaatcagagcctgcggggcttgacagcttctcttgcggcgtccaaggtgggcgtaatgtccaacaaaaaggtcggaaaatggggatcgattccgaacacccctttcctccacccagccccggagcc

SEQ ID NO: 31562 - DNA, 27 bp, Homo sapiens
  misc_feature 1..27: note = chr7:132261534-132261561
  misc_feature 1..27: note = hyper
  source 1..27: mol_type = genomic DNA
cggtggcgacgccgggctgcccccctt

SEQ ID NO: 31563 - DNA, 151 bp, Homo sapiens
  misc_feature 1..151: note = chr7:132261835-132261986
  misc_feature 1..151: note = hyper
  source 1..151: mol_type = genomic DNA
ccgccggctgctccccggggaggcgcggggctgcggcggtggtggctgcggcggctggcgctgcggcggcggagagctcggccgcgggccgagccgggcctcccgggcgcgcccccggccccccgggcgggctgctcgcaaagtttgcagg

SEQ ID NO: 31564 - DNA, 168 bp, Homo sapiens
  misc_feature 1..168: note = chr7:132262214-132262382
  misc_feature 1..168: note = hyper
  source 1..168: mol_type = genomic DNA
gctccctctctggctcgctctcgctggctcggagctcgcggctgacatctagagcgagggagagcggccggcagagggggcagggggcgcctccctacatgctcccacccgccgccgcccggcttgccggctctcctccgcaccaacgtttgccgacacccccctggg

SEQ ID NO: 31565 - DNA, 30 bp, Homo sapiens
  misc_feature 1..30: note = chr7:132299615-132299645
  misc_feature 1..30: note = hyper
  source 1..30: mol_type = genomic DNA
agatgtgcagagaggcggagatggaggagt

SEQ ID NO: 31566 - DNA, 52 bp, Homo sapiens
  misc_feature 1..52: note = chr7:133812094-133812146
  misc_feature 1..52: note = hyper
  source 1..52: mol_type = genomic DNA
tctcctaggcaaccccgctaaacaagatggcgacctccgagagggctctcct

SEQ ID NO: 31567 - DNA, 601 bp, Homo sapiens
  misc_feature 1..601: note = chr7:134142986-134143587
  misc_feature 1..601: note = hyper
  source 1..601: mol_type = genomic DNA
ggcacttctcggggacgctgtgtggtgttgaggttttacagggaaaatgctaaccttggcgcctcctgaattatcaactagctacggggtgcccagatttttctcccgagttccagacccagggcaccccgaggcggcgcctggccgaggagctccgcactgcgccttgttaacagctgggtccgggcaaactcgcgccacctaattctctgccctctaccggcttgagatgcttattcctcagggagggcaagaatcgaaacgattgagaccaactatttacaagtgaggcaaccgggctacaggtgcctcgagggaaaggaggctgggtctgcgctcccacaccttgccgacggctccacgtccctgtctgcgcccgaggtccaccggtctgtgaagcccactttccccgcctccctctcgcgttgtgccgcttggggcgcccgctaggacccaaaatgcggactggtgggccgcccatcaagggttgcccgcggtagggcgggggctcccgtgagctgctcccaaaccccactcgcaggatgctgccctgacgcccagggccaacccggggagccaaggcccccggtctctgcaaggc

SEQ ID NO: 31568 - DNA, 271 bp, Homo sapiens
  misc_feature 1..271: note = chr7:134143700-134143971
  misc_feature 1..271: note = hyper
  source 1..271: mol_type = genomic DNA
cggagagtgtgaggcgagccccgggcccgcgcccccacgagcacctaccttccaggtacccaaccccaggatgggcatcttggcgccgttgttgagcaggagacggcttgccatggctgctgcgctccccagacccccgcccagtacggtgcggccttggccgcggcgcgtacctttaaatagcccgtgaggtcggcagaaagggcgcctgcggttggcgcgccgctgcgcgaaggagccttctgattggttgcgctgggggtgccgcggc

SEQ ID NO: 31569 - DNA, 83 bp, Homo sapiens; identical to SEQ ID NO: 3121
  misc_feature 1..83: note = chr7:134143972-134144055
  misc_feature 1..83: note = hyper
  source 1..83: mol_type = genomic DNA

SEQ ID NO: 31570 - DNA, 76 bp, Homo sapiens; identical to SEQ ID NO: 3122
  misc_feature 1..76: note = chr7:134144056-134144132
  misc_feature 1..76: note = hyper
  source 1..76: mol_type = genomic DNA

SEQ ID NO: 31571 - DNA, 36 bp, Homo sapiens
  misc_feature 1..36: note = chr7:136553443-136553479
  misc_feature 1..36: note = hyper
  source 1..36: mol_type = genomic DNA
ctgctgtactaaaggcgccagggcgcaaagacctag

SEQ ID NO: 31572 - DNA, 487 bp, Homo sapiens
  misc_feature 1..487: note = chr7:136553539-136554026
  misc_feature 1..487: note = hyper
  source 1..487: mol_type = genomic DNA
cactccaggctgcgggttggccagagcctggaaatcgcagatttcaccaggaaatcgccgaggtacccgaataggtgttgcctcccaaaactaattcctacttccccaagcactttggtgaagaaatgaatccagcccagctcgccgaggcatccaggtctccattctattttggtctccaggctcttcgtgaaagccaggtttgaaagtcttgtttgcttctcctttagtggtttggcgtggagggcgggggcagcgtcaatttaactccagtctaaaccacgaacaggtcacagactagccaagtggctgagacgagtgtggggtgcgtgactctgcctgcgcgcgcgccagccccgcagctctcgccagagccttggggtcggttctctcccgcctctcccgcctctcccgccccacccctacagtgtctcggcatcaactaatcttttccttttcttttgcaagatcaagggagaaagagaac

SEQ ID NO: 31573 - DNA, 311 bp, Homo sapiens
  misc_feature 1..311: note = chr7:136554103-136554414
  misc_feature 1..311: note = hyper
  source 1..311: mol_type = genomic DNA
cgctccttcaagcctccaccacctcgcagccggggaggcaactggagcgaaaccagcgacaggtaagggccccgcgctgtgcagctctccgcttacccactccaagggccctggcaccagggggtctctcccttcatatccccccaagccggaggctcaggggtcggggcttgggggaattggagggaggtcctccccacgtgcagattctcaaacggaaactttggatcctggggcttggagggttgcgagcagtgatggcgggtctgaaaggaaggggcaaacgaggcacagcgcgaggcgaggtaccc

SEQ ID NO: 31574 - DNA, 283 bp, Homo sapiens
  misc_feature 1..283: note = chr7:136554694-136554977
  misc_feature 1..283: note = hyper
  source 1..283: mol_type = genomic DNA
ggagcagcccttgggcgctggagaggtttcccattgcggtctccaggtcatggccaaggaggagaagcaattagaatgggggaaagggtcccaagacaaaggagagggaagcattctgcaatcccatcctatttgagccccgcgcaggagctggactgtccgccgtggctgggggacaaggtctcagcccgaagctcatgaggtaccagacagtgcctgggcttcgccacctaactcacaatgggtcctgaaccgcccgggcagtccccggggtcgtagactg

SEQ ID NO: 31575 - DNA, 645 bp, Homo sapiens
  misc_feature 1..645: note = chr7:136555197-136555842
  misc_feature 1..645: note = hyper
  source 1..645: mol_type = genomic DNA
aattattgacacacacggcggcacaccctttgcctccgtccgcctccagcatccgcatccctttctctatcttcctgcccattgccgtcctcgaggctgccctgagatacagaattgtcccaggctgagtccaccgacccgccagtccctggcgatgatgccaaggctcttgcatgtacggaaataccagcagggaggttcgccaggggcagagaggctggaggagaacagagaattggaggtaaacgcgtaaagccagcagaactgtcggtggacatttcacccaggccgccctcccgcgtctttaagtcagttcaccgccacagcacgtctgtgactgcggccacccagggctccaagtctgccagcccaggcgccgcgagccaagaagagcgcggcgcctcccactcctcaagctccggaatcccccacatcgactttctatttccctgtcttcttttcttttttgtttgttttgcttttcctgctcttttcttagcgctgggtggcagtgggtatgcggcagccgtgtgatttgcccatcccctagtacacgcagccagcgacacaagcacacagcgaccagtccccacgctgtgccacacaccctccagcggtccggcgcgcagcccctgctccacagcc

SEQ ID NO: 31576 - DNA, 54 bp, Homo sapiens
  misc_feature 1..54: note = chr7:137028481-137028535
  misc_feature 1..54: note = hyper
  source 1..54: mol_type = genomic DNA
gagggatgagaggagcgggccaggaggacgaaggctgggcgagggagggagagc

SEQ ID NO: 31577 - DNA, 627 bp, Homo sapiens; identical to SEQ ID NO: 724
  misc_feature 1..627: note = chr7:137531262-137531889
  misc_feature 1..627: note = hyper
  source 1..627: mol_type = genomic DNA

SEQ ID NO: 31578 - DNA, 280 bp, Homo sapiens
  misc_feature 1..280: note = chr7:137531908-137532188
  misc_feature 1..280: note = hyper
  source 1..280: mol_type = genomic DNA
cgccctgggtcctgcaccgtgaggctggggggaccaggaccggcgggcgcccaccttggtcctgagcccagctgccgacgctgggccagcaccctctccaccgccgccctccagtgagcagagctgggctcaggcagcagcccctgggcgcgggaaggtagcgggagctgcatttaggggaggggggaggtagcaggagctccgccagtgggaaccttggagtgaattcgtcggcgggtgccaagtcgaagcgccgacctcctgtctctggactggggcc

SEQ ID NO: 31579 - DNA, 68 bp, Homo sapiens
  misc_feature 1..68: note = chr7:137532373-137532441
  misc_feature 1..68: note = hyper
  source 1..68: mol_type = genomic DNA
cgttgttcgtataagaagaggcatcccggaaggggcttcaaaccacttaggaccgactgctgaaacga

SEQ ID NO: 31580 - DNA, 281 bp, Homo sapiens
  misc_feature 1..281: note = chr7:139167546-139167827
  misc_feature 1..281: note = hyper
  source 1..281: mol_type = genomic DNA
cggtccagggctgggcgggtgtgggggtttcggctacgtccacccgacctggcggcgtcggctgccggcgcaggtgagcactcacccgtaagcgttacggcccggggcagcttctcgtcgccgtccaaccccgcgcggggcaacagcgccgcatcctccttctccagccccagctccttgcagcggcagcacgtgggggagcccggggagccggcgcttccttccgcggggctggcccggccctctgcgtcgcagccgctctccgtccgggctgcagccag

SEQ ID NO: 31581 - DNA, 500 bp, Homo sapiens
  misc_feature 1..500: note = chr7:139168114-139168614
  misc_feature 1..500: note = hyper
  source 1..500: mol_type = genomic DNA
cggggcagaccccgtagcccaggctgagcggcggcacgcgcggggacccggggcgaggcgaaggcggctttttcttgctcgagggctccaggcctgcgcccgccgccttctccacggccccggccggacttgggctgctttcgggaccttcaggttgtcgcaccttcgcgggcacctgcggctgctccagcgtggggaccaggcttcccacgggctccattgggagctctgccccggcttggcctccgggcgcagcctcccaagactcctccatcccgcgcgccccgccacccggagacgctgaggagcgcacctgggcccagtgcagaggagcttcgctctcctccgtccggattggtccagccgcgtcgccgaagttgtcaggccacgcccctccccgaaggaccccgctgtgattggctgtggctgaggttctgctgccccgacccccttcgggacacagccccggcctccaccaggcactgggagggagctgagaa

SEQ ID NO: 31582 - DNA, 37 bp, Homo sapiens
  misc_feature 1..37: note = chr7:139168658-139168695
  misc_feature 1..37: note = hyper
  source 1..37: mol_type = genomic DNA
cgggagaaaagcagaacaccagcggaggcttgtggca

SEQ ID NO: 31583 - DNA, 325 bp, Homo sapiens
  misc_feature 1..325: note = chr7:139208245-139208570
  misc_feature 1..325: note = hyper
  source 1..325: mol_type = genomic DNA
tagaaccaggtctcccggctccaagactgcgctcccagctcgacagcatccagcctccagcccaggtggcggggtcggggagccggctgtccccgctcctccgcgcctcctccctctccgcccctgccccgccccgcccgggtccacggctcccggctcccgcgcgccgcctcgcgctcctccccagcccggctgtgcgtggaggctgcggctcggcggggcaggcgctgagcgcaccgcggcggcacccggcgcagaggctccagcgcggggagccgggctcagccccggcctgccagcgccgcggtcctagcccacccgaggc

SEQ ID NO: 31584 - DNA, 196 bp, Homo sapiens
  misc_feature 1..196: note = chr7:139208614-139208810
  misc_feature 1..196: note = hyper
  source 1..196: mol_type = genomic DNA
cgggctgggccccgcaccccggtgcaggagcgcgggcgcggcgcggcggagcgccccgcatggagccggcccgggagcccccctcgcgggcccggccgccgccgcccctcgccgcgcgccccgcgcccgcccccgccgcccccaggccgcgttcgcccgcagaggctgaggcccgcggccccgaggggctgctgcg

SEQ ID NO: 31585 - DNA, 125 bp, Homo sapiens
  misc_feature 1..125: note = chr7:139930151-139930276
  misc_feature 1..125: note = hyper
  source 1..125: mol_type = genomic DNA
agggatagagacaggcggagaccgctggggagtttcccggtgctcagccatcgcataggggggaacggacccttttgtgggccctcgggtccccccgtggtccccgctggcgcgctcgtcctctg

SEQ ID NO: 31586 - DNA, 43 bp, Homo sapiens
  misc_feature 1..43: note = chr7:140339825-140339868
  misc_feature 1..43: note = hyper
  source 1..43: mol_type = genomic DNA
actgcaaatgctgaccgctgtgaggggggcccggctgctcagc

SEQ ID NO: 31587 - DNA, 202 bp, Homo sapiens
  misc_feature 1..202: note = chr7:140339967-140340169
  misc_feature 1..202: note = hyper
  source 1..202: mol_type = genomic DNA
cgcgcgcgcggacacacacacactcacactcgcgccccgagggacccagcacggcgcagggcgggggtctaccggctttctgcaggtccccgaggcgcgagacggcggcgtccgggctcagtcctgggagtcagcccgagcccgggaggaacgcctggatcgcgctctgcacagtcccgggaccaggcgggaactcagactc

SEQ ID NO: 31588 - DNA, 38 bp, Homo sapiens
  misc_feature 1..38: note = chr7:140340747-140340785
  misc_feature 1..38: note = hyper
  source 1..38: mol_type = genomic DNA
accttctgccggactcgccccctcgcctctcggggtgg

SEQ ID NO: 31589 - DNA, 203 bp, Homo sapiens
  misc_feature 1..203: note = chr7:140771347-140771550
  misc_feature 1..203: note = hyper
  source 1..203: mol_type = genomic DNA
ttggctcacaagccccgttgtgcaaagcagggtgtcagagactctctttttccccagggcaactctttacccggcaatgccggacctcgactttggggtgagggtgaaaacgaggggtgagcattagagtgaaaaacccagcgtttgatgccgggagggagggtcccagcctttgcggcgccgtctcacgtgagcagagcagg

SEQ ID NO: 31590 - DNA, 72 bp, Homo sapiens
  misc_feature 1..72: note = chr7:140771769-140771841
  misc_feature 1..72: note = hyper
  source 1..72: mol_type = genomic DNA
ccattaaatttctctcgtcttgagtcgatcagccaaatttcttctttctgttcctgccgaggagggagggca

SEQ ID NO: 31591 - DNA, 308 bp, Homo sapiens
  misc_feature 1..308: note = chr7:140772281-140772589
  misc_feature 1..308: note = hyper
  source 1..308: mol_type = genomic DNA
aagacttagacatttcgtgcctgggaaatggtgcagtttatctttaaggagactagaaaaataagagatgaggctcacgttgcacggatgacatcactagcttttggctgcgcgctcggtgttctcgtctgtgggttttagccaaggctgcagctacccgcgccggacgagagagcgcggcagcagcttcctccggcgcccgcacccgggcaatgcgatttccccagtcccctgggcgcagcctgggctctcgcgcctcccgggcaccagccgagcctgcgaggcctcggagccgccgcggctagagg

SEQ ID NO: 31592 - DNA, 1526 bp, Homo sapiens
  misc_feature 1..1526: note = chr7:140772883-140774409
  misc_feature 1..1526: note = hyper
  source 1..1526: mol_type = genomic DNA
tttcttcggtgcctgcggcattttctttgcacctgggcggcaggctcccggggctcccgggtgccagatgaagtgaggcggaggcgtcgcgggagagccgggtccggaggcggtcgggtggacactccaggcagaagacggcgctgggaagagctgcgtgacgctcgggggctggcggctgggccggcagcgcgccgtggcggcgtgacctgtccatggtgttgaaggcgcggtgggccgagcccctagcgccgcgcgcagtgagcgctgcctggtgcaccctccgccgcgcagcccgcccctcgcgtccgccagcagccgcccagtctccgcagatcccaggccgggtctcgtccggtaacgccgcccgggtgaacacgctgtcggcccgaggggccgcctgaatggcgatgccagaggcagggcaccggggagctcgcggggaaaggtcggccgagagcgtgcgtccgcggggagtgcgcctctgagcgcagcacgcgggtcagaaggagcaaccgacctgctggtgaccagagaacggagattttaagaggacccgacccaaagaggaagaacatttctgggtgcgcgccccaggtctttgcttgcagacggggagggggagaggctctgagccagagacccaggagggactccgagaagccggccccagcacctggaggtttctttcgcccgccggccgcatccggggcgttctacttcacccggtggtccagtggcgcctcctgacagcaccccccgtccccctcagagagacaggcgagttctgtcccgtcaccatcctgcacaaagaagccccaccgcagccgaggacacttggcatttagtttccggcccgagggcagcggcgcccgaagccgggctgggagccgaggcggctgcttcggggcagtcgcttcctgcggggcggggagggggcgggaggcggccgcgctgggttcgccgccgccggaggctgcacctgcctcagaggatgcccaggagcccgcgggagcctctccggatcagaactttttaggccgcccgcccccatccccgcagtccccgggccgtgctccggtaggcgggggccgagggggcgccgcggcgcgagtccctctcctgccccctcccccagctcggccgcccgccgctttgttccgggtgcggcgagggaaggcgaggctgcggcggatcatgcccatggtgtagccgccaagcggaggcatggctgccggaaggttactgctctacactggcctctcgctagcgctctgcgccctcggcatgctggccgtggccatctgctcggaccactggtacgagacggacgccaggaagcacagggacaggtgcaaggccttcaacacccgccgggtcgaccccggcttcatttacaacaataacaacaacttgccgctccgggcgagccgctcgcgcctggaccgctgggagggcaaactcctccgggcccggaatcgccggcagctgttcgccatgagccccgcggacgagtgcagccggca

SEQ ID NO: 31593 - DNA, 60 bp, Homo sapiens
  misc_feature 1..60: note = chr7:141211539-141211599
  misc_feature 1..60: note = hyper
  source 1..60: mol_type = genomic DNA
ccagaccctccaccccgccaggcattcctgggtcggtgtcccagtcggtcacagtcatcg

SEQ ID NO: 31594 - DNA, 42 bp, Homo sapiens
  misc_feature 1..42: note = chr7:143042619-143042661
  misc_feature 1..42: note = hyper
  source 1..42: mol_type = genomic DNA
tgatcctgctgggctcggtggagcggtcggaactgcaggccc

SEQ ID NO: 31595 - DNA, 16 bp, Homo sapiens
  misc_feature 1..16: note = chr7:143579649-143579665
  misc_feature 1..16: note = hyper
  source 1..16: mol_type = genomic DNA
gggattctctgtcccc

SEQ ID NO: 31596 - DNA, 285 bp, Homo sapiens
  misc_feature 1..285: note = chr7:143579666-143579951
  misc_feature 1..285: note = hyper
  source 1..285: mol_type = genomic DNA
atgatttctgatttcggcacacccagacccacggcgcacccatcgcgccccgcacccccgccccggcctcccgccctgccctcccccccgcagcacccaggccgagtccaccgttgctggccccttctccagcctgccaggcttttggagagggccactcaccaggtcaccctgcgatttccacgggggcaggtgggagcgggcagagcctggcgcagagaggaatgcacagggaagaggcttccctgtaccagtgactgggcgaccgagccgggatttgggagc

SEQ ID NO: 31597 - DNA, 143 bp, Homo sapiens; identical to SEQ ID NO: 9262
  misc_feature 1..143: note = chr7:143579952-143580095
  misc_feature 1..143: note = hyper
  source 1..143: mol_type = genomic DNA

SEQ ID NO: 31598 - DNA, 290 bp, Homo sapiens
  misc_feature 1..290: note = chr7:145812718-145813008
  misc_feature 1..290: note = hyper
  source 1..290: mol_type = genomic DNA
gaattaattacatatcgaaaacatgtgcattaacggcatctgcagtcctccctccctgctccagtcagtcgggatgtttagcaccgtcacttggtgttaggaccactcggaagacctgcctgtcggacgcctgactgtggttcccggggggccggagctccaggagcctgtaccatctttatctgaaggggaggagagaaggaaaggagaaggcatccgagcgagggtgttctccttcctgcagccgggtagggggcagccaggtttggagcagggttctaggattacac

SEQ ID NO: 31599 - DNA, 382 bp, Homo sapiens
  misc_feature 1..382: note = chr7:145813009-145813391
  misc_feature 1..382: note = hyper
  source 1..382: mol_type = genomic DNA
gcaaatccccaacttcagcaccgcggacagcatcacctcccgcccagggagaggcgcgcgcctccttgctccgcccccgccccagctgatggaccccggccggtcggctcagtctcccttttgctttcaaacgaggccagggcagggcagaagggttttgacagccagaggggtacggtaaggaggaggaagaggaggaggaggcggaggaggaggaggagccgaggagggaaccgagaagggaagagaagggagggcttccctccgcctcgctcgccgcccgggctcacaggagctggcggcggcggcggcggcggcggcgtctcctgctctccgcggctgttgctgctgctcgcgctccgccgcccgggagatgcttcct

SEQ ID NO: 31600 - DNA, 277 bp, Homo sapiens
  misc_feature 1..277: note = chr7:145813403-145813680
  misc_feature 1..277: note = hyper
  source 1..277: mol_type = genomic DNA
cgctgaggccgtgcgtgcgccccggctgcgctgcgcgctccccacatacacaagctctccatgtgagctgacaggcgagtggaaacccctcgagtcacgctgcccggcggcggagggagcgctcgcccgcagtggcaacagctgcaccaccgtccccgtcgctctgccttcctcttctgcagcctctgctcttctgattacctccctcccccgtcctttggtgatttttttttttcaagaaggagagggcggggtaggtgtccgttccctcccctct

SEQ ID NO: 31601 - DNA, 211 bp, Homo sapiens
  misc_feature 1..211: note = chr7:145813945-145814156
  misc_feature 1..211: note = hyper
  source 1..211: mol_type = genomic DNA
cgccgccggccgggaggcgaaggatgcaggcggctccgcgcgccggctgcggggcagcgctcctgctgtggattgtcagcagctgcctctgcagagcctggacggctccctccacgtcccgtaagtagccgtctcctcgctctgctctggagcagtttcagtgcggcattgatgtttggcaccagggtatcaactccgaagtgcatcgcag

SEQ ID NO: 31602 - DNA, 202 bp, Homo sapiens
  misc_feature 1..202: note = chr7:149112012-149112214
  misc_feature 1..202: note = hyper
  source 1..202: mol_type = genomic DNA
gtgtgaaggtaaagacggtcctatatttcagttccagtggggctgcagggtcttttgctatcggtgtgctatgtatgcaggtcttgctagagactgagaacctctaaaagtcattgcgcagagggaacgcggatttacccggcatggtctttggaaatcagtgtgctgtggaagcaggtcttgctagagccaagaaacctct

SEQ ID NO: 31603 - DNA, 80 bp, Homo sapiens
  misc_feature 1..80: note = chr7:149119916-149119996
  misc_feature 1..80: note = hyper
  source 1..80: mol_type = genomic DNA
gccccatcccacaggcgccaaatggagggcgcagggttttaggagctcgcgtagggcctctcgggcggcagcaatggagc

SEQ ID NO: 31604 - DNA, 367 bp, Homo sapiens
  misc_feature 1..367: note = chr7:149411361-149411728
  misc_feature 1..367: note = hyper
  source 1..367: mol_type = genomic DNA
ccttcccgcatcacacgtttatttgaggcctactatgtgccaggaacaactggggttaccaccccagcaaacaggcacgcaaaatgtgacacgaaggtaggtcatggctgcggcgagcgggggcgcgggcgaaagacgtgaggatgtacgggggcctggcagctgctctgtcccacccacgcccggccggaccctcgacccctttcactccaggtcgggtttccccgaccgcggcctctgggaaagatgggtccctcttcatccccaccatcagcccctggcacatgggacgcgctgagtggtggctgcgggaatgaatgagtgataagcggcgcgtacccgcgggcttgcacgcccacagccgccc

SEQ ID NO: 31605 - DNA, 575 bp, Homo sapiens
  misc_feature 1..575: note = chr7:149411834-149412409
  misc_feature 1..575: note = hyper
  source 1..575: mol_type = genomic DNA
cgcttccgagccggcgccgcggcgccttctgggaagtgtagtccgcgtctgcgccggccggccgggccgccgaagccgggggctccgggcggaaacggcaccacccaccaagggatgcgaggcgctcggggcgggctcaacgaggccgggggcgggcccgggcgcgcccacccccgcccctccccctcggcccaggcccccggccccgccttctcctgcgcggacctgggccgccgccgacgagggtcgcgtgcgcccgcgccagggcccgcgccggaaaccgaggagtggcggggaggctgagcccggggatggcgcgccaggtaaggcaggcggacgcgcggacccctcggcgcagtgcggccccgaaggcggtagggcgagaaagagctgggacccccccgcaacttcgggatcggctgggtgaggctgggcaggcctgatgctcaggggttcgtgccgggaagttcaggtcctcggacaacctctctccagctctccgccgccggtacccacggcccagtctccacctggggaaacccccttggcgtggcttgtttcgttacaagttatcc

SEQ ID NO: 31606 - DNA, 338 bp, Homo sapiens
  misc_feature 1..338: note = chr7:149744461-149744799
  misc_feature 1..338: note = hyper
  source 1..338: mol_type = genomic DNA
cgctctctccagccaccaactcccggccgccgcggctgcagacacagacccgctccctccgggacggcgatgaccgcgatctggcgccacggagcctgtctgggggcgcccggagagtcgtgggctgggggagggcgcctgattcccccccccacagatgcccccggccgacgcgtctcgctgcgcgctcagcccggagcccccgccgccgtcccccgcccccgagaagctcttacgtcctccttgtcaccatcgctccgcgcctggtactggaaccggggccggccatccgcgccgccgccgccgccgccgccgcgctcccggggcgccgccgcctg

SEQ ID NO: 31607 - DNA, 137 bp, Homo sapiens
  misc_feature 1..137: note = chr7:149744950-149745087
  misc_feature 1..137: note = hyper
  source 1..137: mol_type = genomic DNA
cgcgctcctgctggctgtctttagggctttttaatattttgctttctctccggttcccactccccaccccgctccagattaaaaaaaaggcggtggggaggcagcagcagcagcaaggcaagcccagcgccggcgac

SEQ ID NO: 31608 - DNA, 15 bp, Homo sapiens
  misc_feature 1..15: note = chr7:149745575-149745590
  misc_feature 1..15: note = hyper
  source 1..15: mol_type = genomic DNA
gcggtgggggagtcc

SEQ ID NO: 31609 - DNA, 35 bp, Homo sapiens
  misc_feature 1..35: note = chr7:149917112-149917147
  misc_feature 1..35: note = hyper
  source 1..35: mol_type = genomic DNA
ccctgctgctggccgcgggtctacaaaacagcata

SEQ ID NO: 31610 - DNA, 74 bp, Homo sapiens
  misc_feature 1..74: note = chr7:149917321-149917395
  misc_feature 1..74: note = hyper
  source 1..74: mol_type = genomic DNA
cgggtctcttaccttgtggcctttccccgggggatacctgacgctattggagactcctgcggtttgattcatgt

SEQ ID NO: 31611 - DNA, 72 bp, Homo sapiens
  misc_feature 1..72: note = chr7:149918119-149918191
  misc_feature 1..72: note = hyper
  source 1..72: mol_type = genomic DNA
agacagtggagtgggcggaggaggagctgggacggcacccgggctcgttagcccaggctgcacgagctacag

SEQ ID NO: 31612 - DNA, 30 bp, Homo sapiens
  misc_feature 1..30: note = chr7:150715080-150715110
  misc_feature 1..30: note = hyper
  source 1..30: mol_type = genomic DNA
gaaaagcagaaacagcggggtgaggagcgg

SEQ ID NO: 31613 - DNA, 443 bp, Homo sapiens
  misc_feature 1..443: note = chr7:150715917-150716360
  misc_feature 1..443: note = hyper
  source 1..443: mol_type = genomic DNA
ggcgcgcgcgcagctcgtgcggcagctcgttgaagtggcgcagctgcaagcgcgccaggcgggaccagccgcgcgcccccagcgcgccaggctcgcgccgcagcagctccacgtggctatagaagacgtgcagaacctgccaggccagcaccagcgggctcagcgccaggttcagggcggccagcagcagcactgtgcgcccccagcgcgctgctagggcgccccgctggtcgctgcgcttgtaggcgtgcggcagctcccagcccccgcggaagagcgagaagggaccgcggaagagcagcaggtcgacattgagcgccaggccgcggctgaggaaagccgcactgcctccccagggcagcgggcagcgggccggcagcaggcctttgttggccagcgccacctggtagttggtgtagcgcaggatgcggtggtggatgtcc

SEQ ID NO: 31614 - DNA, 459 bp, Homo sapiens
  misc_feature 1..459: note = chr7:150748098-150748557
  misc_feature 1..459: note = hyper
  source 1..459: mol_type = genomic DNA
ctaaagccatctccccggtacccgcaggcgacgtgccagtgtgcagcccccagcagtacaagaactgtgcccacccggccataggtaagggcgagcctcccccacctcccgtccgccccgctccgcccgcgggcgtctgacgcggcccggtggcccgcagatgccatgcttcgcaaggactcgtgcgcctgccccaacccgtgcgccagcacgcgctacgccaaggagctctccatggtgcggatcccgagccgcgccgccgcgcgcttcctggcccggaagctcaaccgcagcgaggcctacatcgcgtgagctgcgcggggcgggcgggctcctccgagccgggggctcccgacggggcggaacggggcaggccaggccgtagccctagtgcgcacagcccgggcggaggcagcctccgcagcctcactggctctggggctccgtgctggttgctta

SEQ ID NO: 31615 - DNA, 165 bp, Homo sapiens; identical to SEQ ID NO: 9276
  misc_feature 1..165: note = chr7:150864232-150864397
  misc_feature 1..165: note = hyper
  source 1..165: mol_type = genomic DNA

SEQ ID NO: 31616 - DNA, 68 bp, Homo sapiens
  misc_feature 1..68: note = chr7:150864610-150864678
  misc_feature 1..68: note = hyper
  source 1..68: mol_type = genomic DNA
cgctaccgcctccggcccgctgcatcttgttcggagctgcggccgccccggggcgctcctctctgggc

SEQ ID NO: 31617 - DNA, 148 bp, Homo sapiens; identical to SEQ ID NO: 3134
  misc_feature 1..148: note = chr7:151106418-151106566
  misc_feature 1..148: note = hyper
  source 1..148: mol_type = genomic DNA

SEQ ID NO: 31618 - DNA, 400 bp, Homo sapiens; identical to SEQ ID NO: 3135
  misc_feature 1..400: note = chr7:151106589-151106989
  misc_feature 1..400: note = hyper
  source 1..400: mol_type = genomic DNA

SEQ ID NO: 31619 - DNA, 242 bp, Homo sapiens
  misc_feature 1..242: note = chr7:151107395-151107637
  misc_feature 1..242: note = hyper
  source 1..242: mol_type = genomic DNA
cgcgcgccgggaactcatttggggcgcagctccaccgacccctcggctactcgcctccaccaggcaagccaggtcctcccatgctctgagccctaaggactctgcccgaggggctctcggggacttgggggcggtcccccaatggagggtgcgacagggaaagccccgagtccgccctccctgggaaatcacgcgcacacccaggattctactttggtctggccggagtggggatgaggtgc

SEQ ID NO: 31620 - DNA, 205 bp, Homo sapiens
  misc_feature 1..205: note = chr7:151107638-151107843
  misc_feature 1..205: note = hyper
  source 1..205: mol_type = genomic DNA
agccgctgcggggtcggtggagccgggatgtcaagttcaccttccagccgccgcgggctccctcggcctggggcgcctctaatggaccccggggtcggcctgagccctcccggagcgcccggcggctggtttccattagggcagttccggcgccgacttcgctggggacggggaaggtgacccccctactcggatcccccaggtc

SEQ ID NO: 31621 - DNA, 348 bp, Homo sapiens
  misc_feature 1..348: note = chr7:151145538-151145886
  misc_feature 1..348: note = hyper
  source 1..348: mol_type = genomic DNA
cggttccaggagcctcgccccctgctggggacccagcttgtgccctggcgtcgtggccgccggcaggcagcaaggaagggggtgtaaagagcccggttaggctgagtccctgcccttccgagggagcccgtctgcgagtgagcccgtctgcaagtgagcccgtctgcaagtgagctgggcctgggcctctgcaggggtcgccccgccagcccgggccccctggctgcgccccgtttccagccggcgtcagggagggggctgcagtgctccgggggtcatcggattcgggcggggaaggaaaggcgggacgtctgcgccccagaagacagtccccgggtctcccaccct

SEQ ID NO: 31622 - DNA, 61 bp, Homo sapiens
  misc_feature 1..61: note = chr7:151574953-151575014
  misc_feature 1..61: note = hyper
  source 1..61: mol_type = genomic DNA
aagtgcgtgtccccacgccgcgggaaacgtggggctcctgagactgcggaaagaattggga

SEQ ID NO: 31623 - DNA, 18 bp, Homo sapiens
  misc_feature 1..18: note = chr7:152622496-152622514
  misc_feature 1..18: note = hyper
  source 1..18: mol_type = genomic DNA
gggaacggtggaggccgc

SEQ ID NO: 31624 - DNA, 216 bp, Homo sapiens
  misc_feature 1..216: note = chr7:152622545-152622761
  misc_feature 1..216: note = hyper
  source 1..216: mol_type = genomic DNA
cggcggggatcgcagggccgaggggccgggcgcgcgcgggggagggacccaggccaggggccgctcgcctcggggcggggtctctggagagcgcgcagaggggacgcttcgtgaatgcctgccggcctgaaggatgtcgctgatctctgcccccttcgccaaggccgggccaggcgagtaggggcgcggcctgagcccctgcggtgattccccagg

SEQ ID NO: 31625 - DNA, 30 bp, Homo sapiens
  misc_feature 1..30: note = chr7:153445126-153445156
  misc_feature 1..30: note = hyper
  source 1..30: mol_type = genomic DNA
cccttccccaaataccgccctggtcaagcc

SEQ ID NO: 31626 - DNA, 117 bp, Homo sapiens; identical to SEQ ID NO: 9283
  misc_feature 1..117: note = chr7:153446175-153446292
  misc_feature 1..117: note = hyper
  source 1..117: mol_type = genomic DNA

SEQ ID NO: 31627 - DNA, 181 bp, Homo sapiens
  misc_feature 1..181: note = chr7:153583349-153583530
  misc_feature 1..181: note = hyper
  source 1..181: mol_type = genomic DNA
gtccagggagccaaccgcgtttgtgaatggatgattgatgggaacagcgcccaggggcagcaggtggagacgggaacccaggtcgcggtcactggtcaacccgcctcttggggtggaggttagagaaatgggcgctgggatttggccccggccagtgctggggttccagggtagggagagc

SEQ ID NO: 31628 - DNA, 395 bp, Homo sapiens
  misc_feature 1..395: note = chr7:153583631-153584026
  misc_feature 1..395: note = hyper
  source 1..395: mol_type = genomic DNA
cggaggcccggagggaagtggaggccgggaagccaggtgtgcggcggggagagcggcccctgccacccgcgctggtagccgggcgctgccattcactgcaaggtcctctgcgccctggaattgccgcggcggcggatgcagaggccaacccagagtgcaaccatggagacgcgacgtgtgtcccatagtaacctgttacaacattatttataagctgccatccctagccttcccccgcttcccctccgctccctcgccagacttgcgggcgacgggcacagccgcgtctggctcttcccggcctctcccttctctcgcgggcgcagccgatcaatagttaacacccggctgcggacggcggctccatccgcggcaatcaccgtagtgcttgtttg

SEQ ID NO: 31629 - DNA, 169 bp, Homo sapiens
  misc_feature 1..169: note = chr7:153584301-153584470
  misc_feature 1..169: note = hyper
  source 1..169: mol_type = genomic DNA
tgctggaggagcccccggagccggggccgagccgccggcgtccccgagtgcgccccctgtgcgtgccgccgcgctgttgctcgcagtgtgctggcgccgagctcggtggacacgcgcgcagtcagagctgcctctcgccctcgctagctgggctcgcagcctcttcctc

SEQ ID NO: 31630 - DNA, 320 bp, Homo sapiens
  misc_feature 1..320: note = chr7:153584797-153585117
  misc_feature 1..320: note = hyper
  source 1..320: mol_type = genomic DNA
taagatgcaggggaacgtgatggtgagtgccacggacagggcgcgcgctgggtcggggggacccaccgtgaggagcgatgctgggggaggtctgtccttctcagtcccgaacctccctggaaggacagcgaccccatgcccgcgcgcggcggcgcttctcccacttcccacccgagcccacccagcggcagggggatgcggaggagcaggcatttctttgcaaattgcaactttgcggctccgcggcccctctccttcgggcatgtggctttgtgttttgggcgcgggatgggaggaaggggctgcggggagccctcgct

SEQ ID NO: 31631 - DNA, 340 bp, Homo sapiens
  misc_feature 1..340: note = chr7:153749703-153750043
  misc_feature 1..340: note = hyper
  source 1..340: mol_type = genomic DNA
aggcagagtcgccagcggagactcgcgagtggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccg

SEQ ID NO: 31632 - DNA, 76 bp, Homo sapiens
  misc_feature 1..76: note = chr7:153750249-153750325
  misc_feature 1..76: note = hyper
  source 1..76: mol_type = genomic DNA
cgccctccccccgcccacgactctccgggcgcccccagacaggctccgtggcgccagatcgcggtcaccgcgtccc

SEQ ID NO: 31633 - DNA, 10 bp, Homo sapiens
  misc_feature 1..10: note = chr7:154002083-154002093
  misc_feature 1..10: note = hyper
  source 1..10: mol_type = genomic DNA
cgctgcctcc

SEQ ID NO: 31634 - DNA, 318 bp, Homo sapiens
  misc_feature 1..318: note = chr7:154861712-154862030
  misc_feature 1..318: note = hyper
  source 1..318: mol_type = genomic DNA
gggtggctaggggaacgttttgaggaaagttcattggtcaacttgttcaacgtggcaaactcatttcaggcaagagaggcagcaccgtggacagcgccaaccctcctgctcccgggcggggcgaggtggcagcaccgcggacagcaccacatgtggtggcgcacactgggagccgccaggcgcggggagcgcagcagcaccgcggacagccccaaagccgcgcgctctgagccaggaggcggggagagatggccttatcagctgatggcttacgtagggctagatctccacttggataaggcaggtctcggtgggcgc

SEQ ID NO: 31635 - DNA, 359 bp, Homo sapiens
  misc_feature 1..359: note = chr7:154862031-154862390
  misc_feature 1..359: note = hyper
  source 1..359: mol_type = genomic DNA
ccagcattcgctctccggagctgcagcctccgaaggggtggcgggggcaacagggacagaaggcaggtcccagaaagcaggttcccccaaaactggcttccctagcacggagttaaggctgcagccggctgcctagagagaagggtgggcagggagacaacgcggtgagagcgactgctctgacgcaccagcccctctcctgcacccacacgctgctggccgcccagcttctccccgatctgggagatgctcggctctgggcggccaaacagcctttccaccaaggcgaggagccctgggctcctgacagcttaggcgggccctggctgcgacacgcagcccctcgcctctgcttcctt

SEQ ID NO: 31636 - DNA, 2593 bp, Homo sapiens; identical to SEQ ID NO: 727
  misc_feature 1..2593: note = chr7:155164445-155167038
  misc_feature 1..2593: note = hyper
  source 1..2593: mol_type = genomic DNA

SEQ ID NO: 31637 - DNA, 51 bp, Homo sapiens; identical to SEQ ID NO: 728
  misc_feature 1..51: note = chr7:155167039-155167090
  misc_feature 1..51: note = hyper
  source 1..51: mol_type = genomic DNA

SEQ ID NO: 31638 - DNA, 487 bp, Homo sapiens; identical to SEQ ID NO: 729
  misc_feature 1..487: note = chr7:155167174-155167661
  misc_feature 1..487: note = hyper
  source 1..487: mol_type = genomic DNA

SEQ ID NO: 31639 - DNA, 11 bp, Homo sapiens
  misc_feature 1..11: note = chr7:155167833-155167844
  misc_feature 1..11: note = hyper
  source 1..11: mol_type = genomic DNA
cgcccagggcc

SEQ ID NO: 31640 - DNA, 64 bp, Homo sapiens
  misc_feature 1..64: note = chr7:155167845-155167909
  misc_feature 1..64: note = hyper
  source 1..64: mol_type = genomic DNA
gcgtccacgtgagggcagcaccctaggtcgggtcagtcaaaccccacagcggggtttcaaacag

SEQ ID NO: 31641 - DNA, 85 bp, Homo sapiens
  misc_feature 1..85: note = chr7:155168529-155168614
  misc_feature 1..85: note = hyper
  source 1..85: mol_type = genomic DNA
aatcaggctgccaggcgacgtttcgtggttgtatttggcccactaaatcctaggtcgctcttcctatgtacgactgtagactcac

SEQ ID NO: 31642 - DNA, 743 bp, Homo sapiens
  misc_feature 1..743: note = chr7:155170182-155170925
  misc_feature 1..743: note = hyper
  source 1..743: mol_type = genomic DNA
ggtgggctcctaaagcgtcccatttctccctttagatttggggccccccagctgataaaggagttgtgattgcaggtggatttgatctgatttcccctgaacaggctggcggtgggaagcaggcattggagtcccacggctcactggactgcagcagcgagcccttcacggttgcaaaggaaggaaattcctagcggggcaactcttcagcgtccgccccacagacctagcacgatgtccttttctgtctcaagatacatctggctgggcttccctaaaaccgggcttagttggactccttggacctggggatgaattcttgccaactatctccaaatatttcccctacaccatgccagtgcaattcatgtctccaaaccccctctcctccacaaaaacgaaacaaaacaaaaccccaggtccaggagctcaggcccaggccggatccaagacgcggcagccaggcagccccgccgcgagcctgtgcgggcttgagccggcttggcccccggaagccccagccccgcgctcggcagcgtgcgcccagcgcccagaagaagcagctccaggcggccgcgctccccgtcccgccgcggtgcggtcggatgcccagctcgcgtccagacccgcgggatgcagacccggatcagtcaggcttgagggctgctccgcatagaccaacgtccggggaaggcacacagtggccgagggcccgcgcgcttgggctacggctgtgatggtat

SEQ ID NO: 31643 - DNA, 98 bp, Homo sapiens
  misc_feature 1..98: note = chr7:155173869-155173967
  misc_feature 1..98: note = hyper
  source 1..98: mol_type = genomic DNA
cttcaccttccaaaccgcagtccctggtgatcctgacttttgcagcctggctctgggtccacacggggctggagaaggggattcggtctgaatgggtt

SEQ ID NO: 31644 - DNA, 756 bp, Homo sapiens
  misc_feature 1..756: note = chr7:155174224-155174980
  misc_feature 1..756: note = hyper
  source 1..756: mol_type = genomic DNA
ctttatcccacagaacggctctgtctgaccgggtcagacaaaagccaacttgcatcttccgctccgaggggatctgggcagagcccgggtacagccctgcgcggccccagggagaggggggagagggcgcgtgtccccagccctgccaagtggcgtggggagcgcgaggccctcctcggtcagagccaccaactctggtctccgtggacatcccccttcccccgcccgctcccgaggctctagggcggcctcctggccgctgccttctcgcacccagggtcttcggcctgggctccacacctcaggcccctcaagtaatcggcctcttggtggccgggcactgcctttccggctgctctctgcacccgtctgcccctccggcctcccctggcggctacaggcgtccggggccctcgctccccagctccaggcgtcccgggagccaggcgcgcagcggggcgagttctcgtgtccgtgtgagcgcgggcgtgtgtatgcgtgcgcgtgcacgagcgtgagtgtgcgtgagcgtgagtttgagtgtgcatgcgggtgtgaatgtgtacatgtacacgaatgtgagtgtgagtgtgcatgagcgtgagcgtgcgtgtgcgtgcgagtgtgcacgagcgtgactgtgagtgtgcgtgcgtggaagcgcggcggggagcctggctgaaggcctgctgcctgcatggctgtcagagaaaaacagaagtgggagcctgctgcgggctccgagaggacttgatg

SEQ ID NO: 31645 - DNA, 120 bp, Homo sapiens
  misc_feature 1..120: note = chr7:155241370-155241490
  misc_feature 1..120: note = hyper
  source 1..120: mol_type = genomic DNA
ctcttccccagcaagcgggagggaggcgccgggctgaggctgcgctgagctcgagctcgccgcccgggtggacccgccctgttcaagcgcggaggggcggaggcctggttgggttgtagc

SEQ ID NO: 31646 - DNA, 818 bp, Homo sapiens
  misc_feature 1..818: note = chr7:155241491-155242309
  misc_feature 1..818: note = hyper
  source 1..818: mol_type = genomic DNA
tggtgcggagcaggacgccgcctcgtgccatggtcactggagacgcacgcccatcttccctcccgggcccgtcgatcctgccatcttccgctcccggccgctcgtgggtgttcgtcatttagaccttccccgtgcttcatgggacgcaagccctcccccagagttcggttttgcaaaagaggtctggagccctcgctacagatcccctccctgggccacggaggatgagaagggtcaccgagccgagccgtaatcctgcgtaacccctgacctctctccttccctgcccccacggcaccccatcgtcccctccccgtctccgaggtcctccagaaaacagcgcagaattgtgcagatgtttaggagatgtgaagatgctggagatgcttaggaggcgacggttacgcgaggagaattgcttccaggtgcgcttctggaacgcacggagatcccccggcggggaaggggccggggctcgcgtcacttagtgtctgctcaccgatttccctctgaagagggggcccagggcctctgctgagggagcggggaggcggtgcgggcccctcccgggcacacatgggtgtccgctccttcctccccctcccctcccctcgcacggagagcggagagcggagagcggagagcgacagggaggcagccgaagacttgaattttgaaaggggagctggcggcgaatggtgaatgagacagctacttaggaagcgagtccagccagcccgggaggcggtggagacccacgcccggaagtaaccggattaggtctcagaatgtgatcgccccccgggtcccgggggaga

SEQ ID NO: 31647 - DNA, 140 bp, Homo sapiens
  misc_feature 1..140: note = chr7:155242379-155242519
  misc_feature 1..140: note = hyper
  source 1..140: mol_type = genomic DNA
cgcctctgggcgttccgacggggtggcggtgggggtcgggggaggcccttgagaaccgtgcggcccggggagagcccacccattgctgagccccgacacaggctttgaagttgctgcagtggctcagcccctcccccgtc

SEQ ID NO: 31648 - DNA, 810 bp, Homo sapiens
  misc_feature 1..810: note = chr7:155242699-155243509
  misc_feature 1..810: note = hyper
  source 1..810: mol_type = genomic DNA
cgagccacgtcccgggacccggagagcccggggcgttgggcgctgcggaggaggcccggcttctgtcgctcccttcacctcccagcccgcgagggacttgggggaagggggagcaagctttcgctccggaagaaacgttcggaaccaaggagtctgactcctggatccgggtgcctgttggatccaggctcccactcccgggccctccggtcgaaccaagggtcccgacagggcccgaggcacccgcattcctaggagacaggagctcggccagggcgcatcaccgggtcctgctccgagccagaggatgtagtgtagacacccacccccacaccgcccctccacagagctcctctccccttggggcgtcgctgggcacagggcaggtcgctaggaatccccagtaaaaccacgctcgctcagaggttcgcggcttcctcagagggcgctggggaaagagaggggacctgatttcttcgaccctcggaggaaaagtgctcggggcctcctagggacacagccctggaagctcacctcatcttagcttaggccgcggcgaggtggggaggagagttaggagagggggagaggggctctgcgccctgcagaggcctttaattctggaggaaaaagactgggacacacccaagcgagccaaggcccgagccccacgcacctccacccacccggggcggcgcacagccagctcctgccgggcgtgagcactcgatcaagggagcaagtggaatgaaaatccagctgggggggtccccatcgacacaactgtcccgcagtcgagcttctggattc

SEQ ID NO: 31649 - DNA, 591 bp, Homo sapiens
  misc_feature 1..591: note = chr7:155243755-155244346
  misc_feature 1..591: note = hyper
  source 1..591: mol_type = genomic DNA
cggttttgttttccaggggtagtttctgcagaaaggagattctcctccgggccgaagggctaccagcctgcagtcagttcagccccggaccctgggagatgctcaccactctgcggatcttgatccgaaatcctttctggccgcccactgcggagagtgtcctcgtagagaggttttcaatcgaaggagcctgggctccacattttgtcttcaagcctgagctttcagggctgctttgcacgaggtgcagatgaacttgtgtctgcaaacaagacagaaaaccctaagtgccgcccgaccttcctcttttggggaacccgcactttgtcctgggagcgtgcccagcgccttagtaccaaactttctggccggggctggcagagctcagagtcccgcttccccctaggcgcggccccctaacatctgtaacccaaatgttgcgccgcggccaaaattagccctggcagtgcgaacagagaactaaaagcaggcagtgaatgagaacagctcgcatttctccttcctggtagacggggaggtgtaaatcccgaggaattctagggcattcgctccaaacgtgggaaatcttcg

SEQ ID NO: 31650 - DNA, 119 bp, Homo sapiens
  misc_feature 1..119: note = chr7:155246406-155246525
  misc_feature 1..119: note = hyper
  source 1..119: mol_type = genomic DNA
ggggcagaaccaggacgtgcaatgcgactgcccccccctccccgctccccggcagagcttctgtccgcgccaacccacccaccaggctctgcccgcgccacgcgcgcccctggcaggcc

SEQ ID NO: 31651 - DNA, 491 bp, Homo sapiens; identical to SEQ ID NO: 732
  misc_feature 1..491: note = chr7:155246989-155247480
  misc_feature 1..491: note = hyper
  source 1..491: mol_type = genomic DNA

SEQ ID NO: 31652 - DNA, 372 bp, Homo sapiens
  misc_feature 1..372: note = chr7:155247839-155248211
  misc_feature 1..372: note = hyper
  source 1..372: mol_type = genomic DNA
ccactctggggggcccggtaccctctagttatctctctcttcatttatttctctttctcctattcctccctccacctctcaccttcctcctttccaggagagcgacccacgaattcctcttcctccagccaaccccagggcccagcccgcagaccctgcgagggcaggtctctgcccaccggcccgccaggcgccctggaggtgacgctctgcttcccagagtctctgttgcagccacgaattggggtctgggtcgcaggaaagcacagggctgaagcccagcgtcttggggccatttatactgaggcagtcagaggcaaagagtcccaagaattcagaaaatacttctcaggaagccgcctaattggcttt

SEQ ID NO: 31653 - DNA, 773 bp, Homo sapiens
  misc_feature 1..773: note = chr7:155248792-155249565
  misc_feature 1..773: note = hyper
  source 1..773: mol_type = genomic DNA
ctggggaaggagcttcgcaaggccagggtgcaaccttcaggccccaggtggcctggcaggccacgctgcctcggagatgcttgccagactccccaagttcactcagggcctggcagcaacctgctggctgcctctgcgggggtctgggttgctgagcacggtgcagctgcccagggccaatcagccctagggtgtccgtgccaggctgcggcctccccgcctcccccgcactgagggtactcatggcgtgcaaatgctcccgcacccccagagctgccctatcggatgtttccaggaattcacacatttccataaaaatgcattttaaatgatggacaggcgagcctggggtaacaacgggtgtttggtgggtagacaagagcaaatgggaaggagcccgagggaggagggggaagagaagaggaaacagaacttccagttggacattctgacaacagctggaaggaaagtctagaaaagatgaagagagaggaggggagaaaccaactggggctcccacccttgccgttggattcctaattctcgtttcaaatgggccctgctctccggcaaaattagtttaaaggattttaaaacaaagaaaacgagatgaccggtctgggagctcctcaatcagagtagagaagttagaggggggcgggcgacttggttttgaagtcttagctgaacagtcacccctcctctccttggcaaaaaggattcctttagaacctccgaggctcctggatttctcccttcgcaaatggagccgc

SEQ ID NO: 31654 - DNA, 190 bp, Homo sapiens
  misc_feature 1..190: note = chr7:155249863-155250053
  misc_feature 1..190: note = hyper
  source 1..190: mol_type = genomic DNA
ggaattgtgggatttcgccccacggtaaacaatatggaaatcttaaaaatagcgatcttcctgtgcgtgtccacctacgcgccccggggtgacctggcggggctgtcgccgggtgactcacacccctgaaccgcgaagcgacagggaaagcgcgggcgagcgcaggagacgcggtcgggggtctctccgg

SEQ ID NO: 31655 - DNA, 21 bp, Homo sapiens
  misc_feature 1..21: note = chr7:155250283-155250304
  misc_feature 1..21: note = hyper
  source 1..21: mol_type = genomic DNA
tggcctggaaatttccgagcc

SEQ ID NO: 31656 - DNA, 566 bp, Homo sapiens
  misc_feature 1..566: note = chr7:155250323-155250889
  misc_feature 1..566: note = hyper
  source 1..566: mol_type = genomic DNA
cgagggcggcggacggccggggagcgcgggcggcccagcccggcccggccgggccctggcctcgcgtctctcacccatgcgactcgggccgcggagctctgcggggctcggcgggggcgcggccgcacgccggtggggcgccccggcccgcagcggggcggcggccgcgaggagggggcctccatgtgcgtgcgggcggtggcgggcgcgctgaccgcgggcgcccggcaccctcgagggccggctagggcgtgcgggcggggacggccgggcggcggcggcggccggagccggcccgggcgggcgtgagcgccggggaacgcgctgcctgcatgcgcgcagctctcgccccgggcggcccaggcggcggcgccggagcccgaggcggccggacgcggagaggagcggggagcccgggaggcggcccgcgtccccgccggaccactgcgactgtctagaccccggctgcgcggcgaagtcgaggacttggctctgttgaatctctcatcgtctgggcgagcggggcggctcgtggtgtttctaacccagttcgtggattcaaaggt

SEQ ID NO: 31657 - DNA, 89 bp, Homo sapiens
  misc_feature 1..89: note = chr7:155251170-155251259
  misc_feature 1..89: note = hyper
  source 1..89: mol_type = genomic DNA
cggtagcagcccgggcgaagcggacaccgggcgccggcgggctctgatgctgcccgcggtcctgcaggcgcccggcaaccaccagcacc

SEQ ID NO: 31658 - DNA, 204 bp, Homo sapiens
  misc_feature 1..204: note = chr7:155251346-155251550
  misc_feature 1..204: note = hyper
  source 1..204: mol_type = genomic DNA
cgggaggaggaaggggcggcggagccggcggcgaaggcggcgcgagcggtgcggagggaggcggcggcgcgggcggctcggagcagctcttgggctcgggctcccgagagccccggcagaacccgccatgtgcgcccggcgcgggcgggccgctcccagccgccggcagcgactctccgggtgacggggaaggcggctccaaga

SEQ ID NO: 31659 - DNA, 48 bp, Homo sapiens
  misc_feature 1..48: note = chr7:155251661-155251709
  misc_feature 1..48: note = hyper
  source 1..48: mol_type = genomic DNA
cggacagctcgcaagccggcgccaacctgggcgcgcagcccatgctct

SEQ ID NO: 31660 - DNA, 100 bp, Homo sapiens; identical to SEQ ID NO: 3149
  misc_feature 1..100: note = chr7:155252162-155252262
  misc_feature 1..100: note = hyper
  source 1..100: mol_type = genomic DNA

SEQ ID NO: 31661 - DNA, 812 bp, Homo sapiens
  misc_feature 1..812: note = chr7:155252316-155253128
  misc_feature 1..812: note = hyper
  source 1..812: mol_type = genomic DNA
cgctgaccggtgggactcaggaggatgcacacagggaaggaggaaaataaaggcgccctttccccttggctccactttgtttgccagcgccagcccgcagtggtggggctcagcccccttcctgcacacagcgaggacaagggaggcagccgtccctcccggcacctgccatccccaaatagaaaggaccttctctcagggtttcctgggggctgctgatgggaaagaggcagcattcgcaggggccctgcagagatgctggatatattttttcatagatctgcgattttaaaaaactaagtccatgtccttgtagaaatcatcaactgcattccatgcgggtctgcggctgggaaccgccattagaagtggactgtttgaccccgagctggcagcggatccccgctgcccccaaaccctcaactattttgcgggggtcatttgcccagatcacagcaggagtgagccaacccttgggccgccatcccgcagaactatgcgtgcatatttctgatgaaattcagatttctcagctagatctgaaatttgctccattgttctcgtcttcctcctttgttaatatttaattaacatacaggctcacaatgccgggcgaggagactcggccgggctttgtgcggcgcgggagttcgctgagccagcccccaacggcccgggagctgggcagcaccgcccggcccggcctggcccggcccagctcagcccagcccaagtcgcctatcttcatgggctttaaaatatccctgcaagataatgtttctgttctttggtttctccgaaagaaaggggag

SEQ ID NO: 31662 - DNA, 520 bp, Homo sapiens
  misc_feature 1..520: note = chr7:155254879-155255399
  misc_feature 1..520: note = hyper
  source 1..520: mol_type = genomic DNA
caagtggtggaggtccgcgttgagcccatgcccagtccgaagtctagccccacatctggcggttcagcctcgagtggccttgggcgagtcacttccctcttggggccccagaatccttacccggtgcctattgggtggcacacctctgggtaacctgacttctctctgtccaccgtatctacccaggtcccaggtctcgaaaaccaaagaagaagaacccgaacaaagaggacaagcggccgcgcacggcctttaccgccgagcagctgcagaggctcaaggccgagttccagaccaacaggtacctgacggagcagcggcgccagagcctggcgcaggagctgagcctcaacgagtcacagatcaagatttggttccagaacaagcgcgccaagatcaagaaggccacgggcaacaagaacacgctggccgtgcacctcatggcacagggcttgtacaaccactccaccacagccaaggagggcaagtcggacagcgagtagggcggggggcatggagg

SEQ ID NO: 31663 - DNA, 15 bp, Homo sapiens
  misc_feature 1..15: note = chr7:155256218-155256233
  misc_feature 1..15: note = hyper
  source 1..15: mol_type = genomic DNA
caccaagggcccaac

SEQ ID NO: 31664 - DNA, 151 bp, Homo sapiens
  misc_feature 1..151: note = chr7:155256268-155256419
  misc_feature 1..151: note = hyper
  source 1..151: mol_type = genomic DNA
cgctgtccccagtcccaccgcagtcctgccgcaggcctaaccctcctgccctgggcactgcctccatgcagaagcgcttcgaggttctggggctaaaggcctggggtgtgtggcctaaagcccaagagcggtggggcgaccctccttttgg

SEQ ID NO: 31665 - DNA, 1008 bp, Homo sapiens
  misc_feature 1..1008: note = chr7:155257856-155258864
  misc_feature 1..1008: note = hyper
  source 1..1008: mol_type = genomic DNA
ccacccgtgctggaccgaggcgctttcccctggggacaggaactttttactccactgagacaaagagactctccttttcaaagtgtcatttttgtttaccttttgttgtttcccccccaaaacaaaagactttgtacaacttcctaagcaggattgggggagggatcagcttcgcctgtgctgaccgcgcctctggattccgctcatcaggaagtgtttggggtctttgagcgagtgatctacgcgttgaattgctgtttttccaaactttcatggcttaaaaattttttttcttctccctgtaaaagaaactcagagactggtgatctgttaccgaagacgactttttaggcgttttctgtttccccaggcagctgggccgttggcgttcccaggcggaagcggggcctctgggctgggcctctgccctgccaggaagcggtctgggggctgcccctcgggattttcagaaccctggaaggagagagctggggtctcaccgcggagactcccgagttctcgttgcctgggcccgagctgcgccccagggtcatcgctgatggcgcgagaccacgcattccccgcgaaccccgacttctgaacagttcagaaagttcgtagattaaaaaccaaacaaaaaatactggcacaacttctattgccgtattggcctctctcttattttaataaaaatacggtaacatgaagcgatcatttttttaaaaatctgttttcaaagtataacactgaaaaggggcaaggcacagctttgtaaggtaatgagttccccgtcctcagaggtgttcaagcagacgctaggcttacagtggcatggagagtgttctttctctttggaactggatgagtcctcagacccttgaaacgctgagtttttttttttttttttactcctatgtttattacattttaatccaacagcatataatctaagctgctccctcatggagagccgcggctgtgccacctgcctgctttcgccatggagac

SEQ ID NO: 31666 - DNA, 164 bp, Homo sapiens; identical to SEQ ID NO: 735
  misc_feature 1..164: note = chr7:155258914-155259078
  misc_feature 1..164: note = hyper
  source 1..164: mol_type = genomic DNA

SEQ ID NO: 31667 - DNA, 504 bp, Homo sapiens; identical to SEQ ID NO: 736
  misc_feature 1..504: note = chr7:155259119-155259623
  misc_feature 1..504: note = hyper
  source 1..504: mol_type = genomic DNA

SEQ ID NO: 31668 - DNA, 12 bp, Homo sapiens
  misc_feature 1..12: note = chr7:155259833-155259845
  misc_feature 1..12: note = hyper
  source 1..12: mol_type = genomic DNA
cggggattcgcc

SEQ ID NO: 31669 - DNA, 112 bp, Homo sapiens; identical to SEQ ID NO: 738
  misc_feature 1..112: note = chr7:155259846-155259958
  misc_feature 1..112: note = hyper
  source 1..112: mol_type = genomic DNA

SEQ ID NO: 31670 - DNA, 99 bp, Homo sapiens; identical to SEQ ID NO: 739
  misc_feature 1..99: note = chr7:155260038-155260137
  misc_feature 1..99: note = hyper
  source 1..99: mol_type = genomic DNA

SEQ ID NO: 31671 - DNA, 116 bp, Homo sapiens
  misc_feature 1..116: note = chr7:155260458-155260574
  misc_feature 1..116: note = hyper
  source 1..116: mol_type = genomic DNA
agggatggggttccccggaacgactccgaagtcccggagaccaggcgcggcccaggccctctgcccttctccagccccagccccagccccagccccagccccgggcaaactcttcc

SEQ ID NO: 31672 - DNA, 106 bp, Homo sapiens; identical to SEQ ID NO: 3160
  misc_feature 1..106: note = chr7:155260785-155260891
  misc_feature 1..106: note = hyper
  source 1..106: mol_type = genomic DNA

SEQ ID NO: 31673 - DNA, 307 bp, Homo sapiens
  misc_feature 1..307: note = chr7:155261070-155261377
  misc_feature 1..307: note = hyper
  source 1..307: mol_type = genomic DNA
cgcggtccgggcgcgcgctgcctgcgcggaaggagccgcctccctcctttcagcgaacgcattcggggttcccccctcccgccaagtcctttgtctggaaggggactggcaggctctgtcgtcgccgtgtgcccccctcctttccccagcctctaccccctccaactaactttcctttcttcccttctcttttcttccctctctggatgggtaatcacaggctccgctgccaagcgcgctgcgaggagccgctgcccgttcccgtcggtgcccctccccgcggcagcctggccgagtccgcccagcc

SEQ ID NO: 31674 - DNA, 125 bp, Homo sapiens
  misc_feature 1..125: note = chr7:155262418-155262543
  misc_feature 1..125: note = hyper
  source 1..125: mol_type = genomic DNA
tccacagcccaggtgcggttttcagtagggcccttacaccttcttgcttttcccagccaatgaggcatccacgctgctgcttaggagtaggggaaaggatgtaatgcacgcgagaggcagtgtcc

SEQ ID NO: 31675 - DNA, 215 bp, Homo sapiens; identical to SEQ ID NO: 9326
  misc_feature 1..215: note = chr7:155264127-155264342
  misc_feature 1..215: note = hyper
  source 1..215: mol_type = genomic DNA

SEQ ID NO: 31676 - DNA, 252 bp, Homo sapiens
  misc_feature 1..252: note = chr7:155301753-155302005
  misc_feature 1..252: note = hyper
  source 1..252: mol_type = genomic DNA
aagatccgttaggaacgcctccgactgagctagggggatctaagaagaaagacagggcgaggaaacttgtcttaatgttaatgttacttcaaagaccttccggcgagtccacatggaaacgccacactctccctgaatgcaaacgtgtgccacttccctagcacgggcccagaagacggtaccgcagattgttattacaatgtaacaacgacctgctttacatcattacggggctagcgtaaattccagttt

SEQ ID NO: 31677 - DNA, 570 bp, Homo sapiens
  misc_feature 1..570: note = chr7:155302326-155302896
  misc_feature 1..570: note = hyper
  source 1..570: mol_type = genomic DNA
ggctgcccttggctgcgcgtcccccacgctgcagccgcgcgatggcccgggctggggtggacgtggggctgggagaggaaggggctcacggacgggcgccccatctcccaggcgggctcctcggctgctttctttgggaacagctggtgcacgtccccgcgcgcccctctccctccggaattcggcgaggattcagctggaccctttggccaccacctccgccccgggcgcgggtcaaagagcacccctcgcccttggtaacggagacaaaacgttcggggccgtctagacaggtcaaggtgcaggatgcggcgtccccgcggctccttccggaagggggcgtggagccgccaagggcgccggaccgcgccgcagcccgggcctttgcgggctttttccctctccaccctctgctgatcaaagtaggaagtttgcatgacaaccgcagtgaaaggggctgaatcacaaatgaactcgatttctgcagtgttgatctatccagcctccattgtcccctttcaggcgcagtatgaacccttccggtgccagcggccgcgctacattcacagg

SEQ ID NO: 31678 - DNA, 400 bp, Homo sapiens
  misc_feature 1..400: note = chr7:155302963-155303363
  misc_feature 1..400: note = hyper
  source 1..400: mol_type = genomic DNA
cggcggcgtccccttgaaagcgcgggcggagggtgcgcttgtgttcttgagacccaggttccattacaaaccacccagcatcgccaccggcgccccccgtttcaataaggaagccactttgtcaaaacattctaaaagaaacttgggaagaggacgcgtcagagaaataccgccgccgattaactatcagctgcgcctcccctgtgcacaggtaacatccctccttctcccccacgactcggctggagcttgattttgagctgctctcaaggcccaggcactcgaatcggaagttaaatagcttatggactatttaatagaatataccaccacacgtatctaatcactcaaataccacgcttttaaaactcatgaatgttttaatcgctaaaaatgtcta

SEQ ID NO: 31679 - DNA, 745 bp, Homo sapiens
  misc_feature 1..745: note = chr7:155325796-155326541
  misc_feature 1..745: note = hyper
  source 1..745: mol_type = genomic DNA
gagtaaccaagcatacgccgtacagtgacaacatctgcgtggctcacaccacacaggcagccgcagaaacagcgcctcccaaacggcgcggcctcgctcaccctcaaaacccactccgcgcccgacgggaacggctggagggaggaaagagccaggcacctctcgttcggggtctgacattgtcacctggcagataagtgagtctgctcggatgtgccggctcggaacatgcccgttcgtcaaagagggaggggaaacaaaacgagcttgtgcctcattcccggtggctctccacgcaaagttaacgtttgtttactctaagcatatgcccaggtgaggcctgcacagccacctcgccgcgggtgcagggcgcgcctcagaatgacagcgaggtgcacgctccggcccgcgcagagcggggccagctccgccacccagcgcgcgggaagccccgcagcaccagcagggcccgtcgcttcgctccgtcccggtccggcgtgaaacccccgaggggaaaagcgggtatcaaatgtgaattccactcgtccacagcgccgggcgttatgaaaatctgagcacctttgaccggagaagcaatagctatgggattaaggcgaatttcttacggagaggagaaagatgtgcagtttgtaattacctgctccctgtagtacagtccgtccttcacgcctggatctaacgggacaaactctcagcggctttgctctcccggcattgtttcagc

SEQ ID NO: 31680 - DNA, 25 bp, Homo sapiens
  misc_feature 1..25: note = chr7:155579904-155579929
  misc_feature 1..25: note = hyper
  source 1..25: mol_type = genomic DNA
ccccaaggtaagccccgaggcgtcc

SEQ ID NO: 31681 - DNA, 93 bp, Homo sapiens
  misc_feature 1..93: note = chr7:155580181-155580274
  misc_feature 1..93: note = hyper
  source 1..93: mol_type = genomic DNA
gggccgcccctgtctcgggccctgccgcgccgcccgcccgctgcaggccaggactgcgctctgtctgcccacggcccccgcctggcacacacg

SEQ ID NO: 31682 - DNA, 156 bp, Homo sapiens
  misc_feature 1..156: note = chr7:155600567-155600723
  misc_feature 1..156: note = hyper
  source 1..156: mol_type = genomic DNA
ttggagtctggttgtcgccatggagggacagcttctatccagggccctaactgtagcgtgggttggggggactctttcgagagggtggggcgaggacgctggccccactgctgcggcgctttaaggggacgtgacaaattgcgcaacaggaaaagt

SEQ ID NO: 31683 - DNA, 257 bp, Homo sapiens
  misc_feature 1..257: note = chr7:155601133-155601390
  misc_feature 1..257: note = hyper
  source 1..257: mol_type = genomic DNA
cagctctgtgagctgcgccacttgggcaggcatggaggaccccgggcagggagacccgggtccagccgggccgcgacgggaggtggctgcgcgagtgaggggcggaggccgagggttgctggagttggcgcccccgccccttgcgccctcctccggcccgggctccgcgcggcctcggctggcggcctctcctccgcccgcgctgggcgggattgtcgcaggcaaagccgggaagcccaggccggttattaattcat

SEQ ID NO: 31684 - DNA, 30 bp, Homo sapiens
  misc_feature 1..30: note = chr7:155601921-155601951
  misc_feature 1..30: note = hyper
  source 1..30: mol_type = genomic DNA
aagttccactggggacgatctcgccatggt

SEQ ID NO: 31685 - DNA, 325 bp, Homo sapiens
  misc_feature 1..325: note = chr7:155602802-155603127
  misc_feature 1..325: note = hyper
  source 1..325: mol_type = genomic DNA
ctagccgcgggggatcgataacccgggagtaagtggggctgcaggcgtctgcctcgctgcgcggctctgtgcgcttgcagctttgcagcagggctgcaaggcccaagccctgggaaggtgtgcgagcccaggaccccttctgcggtattggcctcccgcagagcagggcagaagctgacccactctggctctgggacctcgggtatccacgcccccgccgctctctccgcagtgcctccctcctctcgggttccgagggaccctggcaaggcccctcctccgcggggagtgagggtgacgagaggatgggcgcctcgggctagcc

SEQ ID NO: 31686 - DNA, 41 bp, Homo sapiens
  misc_feature 1..41: note = chr7:155604978-155605019
  misc_feature 1..41: note = hyper
  source 1..41: mol_type = genomic DNA
ctatataaccttgcccgccgcggctgcgggggactctccac

SEQ ID NO: 31687 - DNA, 203 bp, Homo sapiens
  misc_feature 1..203: note = chr7:156409310-156409513
  misc_feature 1..203: note = hyper
  source 1..203: mol_type = genomic DNA
ctgcagaaaagtcaccgtcacacgcagagtccaaaactcccctttccccgctggaaccactttctccaaggagctccgccccgcgctctccccgaccccgtgcgcccccagacctcgcgtcccccgcgctctcccccgccgcgccctcctgccccgcgcccctcctcgccccgaccccgcgcccctgcgcccgggctccagcc

SEQ ID NO: 31688 - DNA, 108 bp, Homo sapiens
  misc_feature 1..108: note = chr7:156409727-156409835
  misc_feature 1..108: note = hyper
  source 1..108: mol_type = genomic DNA
cgcgctcagccgggtgaacctggaactgtgttcctggcccagcgctttcataaaagggcgcggaatagtaagtcctagttcaaggaataaacacggatccccactggc

SEQ ID NO: 31689 - DNA, 237 bp, Homo sapiens
  misc_feature 1..237: note = chr7:156432918-156433155
  misc_feature 1..237: note = hyper
  source 1..237: mol_type = genomic DNA
ccagaaaactgccctcgactaacagcgcagcgaaggggcggtgcgctcgagaccctggaacgggaacgaccacagccaccgcagggaaacaaccggggcccaggcccaggtgggcgggcggctgaggagcgtggctgcgcccacaaagccgccgggggctgcggactacagcgaagccggcgcggggctcggccctcactacacgaggcctgggcgcctgcacgcccccgtgcttca

SEQ ID NO: 31690 - DNA, 87 bp, Homo sapiens
  misc_feature 1..87: note = chr7:156794072-156794159
  misc_feature 1..87: note = hyper
  source 1..87: mol_type = genomic DNA
gtgctgcaatgaactcgggtgtgcaaatgtctctttgagatctttttgttttttccaattcttttggatatatacccagaactgaga

SEQ ID NO: 31691 - DNA, 26 bp, Homo sapiens
  misc_feature 1..26: note = chr7:156794459-156794485
  misc_feature 1..26: note = hyper
  source 1..26: mol_type = genomic DNA
gtaagccactgcgcccagcctgattt

SEQ ID NO: 31692 - DNA, 320 bp, Homo sapiens
  misc_feature 1..320: note = chr7:156795035-156795355
  misc_feature 1..320: note = hyper
  source 1..320: mol_type = genomic DNA
acaccagggattaaccggggtctcctggctgcctctcacctggcagccggagctccaggaggggctggaaaggagccccctgggcctccgtctggggggcgtgtgtgaactgttttctcccgtcacaaaaaaggcttcctccacatgcgtttgcacgcccggcagaattcgcccacagcaaggcccccctttctaagaagggaggagaacccacattggagcaaagaaaacggtggccaagaggtgggggcctcggtagggcaaggaggcaaggctgggttccaggggacagggtcagctttgggtggggcccagagccc

SEQ ID NO: 31693 - DNA, 235 bp, Homo sapiens; identical to SEQ ID NO: 745
  misc_feature 1..235: note = chr7:156795401-156795636
  misc_feature 1..235: note = hyper
  source 1..235: mol_type = genomic DNA

SEQ ID NO: 31694 - DNA, 205 bp, Homo sapiens
  misc_feature 1..205: note = chr7:156795899-156796104
  misc_feature 1..205: note = hyper
  source 1..205: mol_type = genomic DNA
cggcctgctggaggcgcaggggccggcgcaggtccggggcctggctctgctggaggacgggggaggggcggccctattaacagcgtcttcctttgatgtcgctcttccccgcgtcccagaggaagcgcctgtcccctgggggtagagggacagaccctccgcggaggcctggggcaccccagctccaggccgagcccccactctt

SEQ ID NO: 31695 - DNA, 246 bp, Homo sapiens; identical to SEQ ID NO: 747
  misc_feature 1..246: note = chr7:156796494-156796740
  misc_feature 1..246: note = hyper
  source 1..246: mol_type = genomic DNA

SEQ ID NO: 31696 - DNA, 1430 bp, Homo sapiens
  misc_feature 1..1430: note = chr7:156797005-156798435
  misc_feature 1..1430: note = hyper
  source 1..1430: mol_type = genomic DNA
cggacttgtttgcacagagccaagaagaccgatcctggccagccaaggaaggttctgctaacagagagggccggggtcgaggagagagagaagcaccgcgcaattcggtgcgttccgggaaatgtgcctcagtagcgcctgaggtcacagggaccccacatgctactaacgcctagtcgttttaagcttattttctgaaacgtccaaatagcgtatttccacttctggagtgccaacgaagcaacagctagcaaggaaataggaaaataaatagagtccacagctccgcttccgagggacacgtgtcccgggacaggtgtgcaccaggcagccgggcatgcgctgacacctggccacaggtatttttgccaacacttcacattgcgactccccagtagcaggcgcggaggtggtcctgacacccacttgagactccgattttcaccctcagctgccaaccgccgagtagacaccctccccatcatttctacaagcaaattgtaatgccgcgggcataatcccccaaaactcgtgcacgctgatccagtacaaaaccaatttattttacattccatcgtgggcgatgggagaagctaaataataatttagcatgcatacgtagacgtttctttttatatataaatacaatatacaaaaataaagacagtacagttttgagatttccagcagtttgaacgctcgtgacataatccccccgaccccagagacgtaagcataaacccttttttctttttccaaatactctgcagaatggcggctccagaggcggtttcaagtttcataagtcaggtaacactgtgggtttccgccttctcggacgcggggaaaggggagacaggaggcttccccttgcgcggggtgggtcggttcttctcacacgcactcgcgcctcccccaacaccaaccaaaattaattttaaaagaaccagagttcaagtttcagccccctgggtctccctctcgctgtttcttgaagagcaggtgaggcgcccttgcttaaaagggaagcgcccaggaccggagccgcggccgaatccctccagccccggcctgggcgaggggtccatggggcggcggtcgagcctgctctcggggccgggccgggtgggtgcgggcgccggggcctccgggagaagccgccggccggggcgctccgtgcgcgccgcacctgctgggccgcggggctcctactggggcgcgggctggtggctgggccgcgggggcggcgagtcgtcctccgaggagcagtcggaggaggcggcgtggacgctggcgccgttgctgtaggggaaatggtcctcgtcgtcctcgtcctcgtcctcctcggggtcactgtccctcaagtcccgcaggcggcgtccgctgcccttgtctccgggcgctggcggccccagcagctcctcggctcc

SEQ ID NO: 31697 - DNA, 621 bp, Homo sapiens; identical to SEQ ID NO: 750
  misc_feature 1..621: note = chr7:156798526-156799147
  misc_feature 1..621: note = hyper
  source 1..621: mol_type = genomic DNA

SEQ ID NO: 31698 - DNA, 220 bp, Homo sapiens
  misc_feature 1..220: note = chr7:156799290-156799510
  misc_feature 1..220: note = hyper
  source 1..220: mol_type = genomic DNA
cgcggccggcggcacttccccaggaggttcgactgcgcctgggctggggaccaaagggcagtgaggcccacagccggctccggtcctcgccccagcccctcccgttgctgcttgtaccactacactcaaggccccagcgccaaggcctggccctgcagagggcggggctgttccctcactatcagtgcccactccccaaggaatgcggactcaggaccac

SEQ ID NO: 31699 - DNA, 145 bp, Homo sapiens
  misc_feature 1..145: note = chr7:156800933-156801078
  misc_feature 1..145: note = hyper
  source 1..145: mol_type = genomic DNA
ccgtgggcaacttagcgtccttggctctgggaaatgcaggtcatattggtggctttctatcagaagggatgggccctgggtcggcaccctgggtttaagcccaggctggcaggggattcgcagacgcagacgtgtctgaggtgag

SEQ ID NO: 31700 - DNA, 469 bp, Homo sapiens
  misc_feature 1..469: note = chr7:156801403-156801872
  misc_feature 1..469: note = hyper
  source 1..469: mol_type = genomic DNA
ctttgtttgggtgttcggcggctgaaagcgttgagccatatacatctgctcggcccgactcataagtagctgaccccgatggggcgagcggggagagccagagccccagagagccagagccccggagccccagcccggagagtccgcgtgtgccaggaaagcctgaggggcccaggcctctggcgaggtgtcccgcccggatggagaggaagctgcccgaagcccagcggctctggggtggggagaacaggggctccctcggccccaccttggaggggcattcgttaccttgttgggcgcccaggattccagggcaggcacctactgttgagagtccccccatagctggttcaagccaggccacctgcctcggccatcgcaccccggatccaacgcccttccagaggagggcagcgccctggtaagagccgggggttccctgggccttggccttgcctccccgggcctc

SEQ ID NO: 31701 - DNA, 365 bp, Homo sapiens
  misc_feature 1..365: note = chr7:156808858-156809223
  misc_feature 1..365: note = hyper
  source 1..365: mol_type = genomic DNA
tagcattggcctgggcgcccaggcactcctttagaacccacctgttccccccacccaccctagtgggaggaggagagggttacactgacagataccggcagctctgcaacccgggaacaacgcagacaacatacaactcgacagagtcacagaaggtggcgtccatcgcgcctggatggtgactactgccctgcgggctgctgggtgggtgaaacacacagggaagaagcacaaatacacacacagatgtggctcagggacatttgaatgcttcagtgtgtgaattttttagcgcattctgactcgaaattatggctgaatagtggcgcactaatgtccaagtccatgttcgataatggcaggaa

SEQ ID NO: 31702 - DNA, 485 bp, Homo sapiens
  misc_feature 1..485: note = chr7:156810037-156810522
  misc_feature 1..485: note = hyper
  source 1..485: mol_type = genomic DNA
gggagcagcatgggccgccctctgcctcaccgaggggcaaaccggctgaggacccaggcacgaagagtgtcaccagctctgaccacaagccccgtagaccagggctgcgtccataatcggggttgatggcattagttattatattataacctccttgttgcgtgattctagtaatttattttcccacttggcctttgactgggctgggctcctcccagtggaacaacagggggtgtcgtgtttgcagcagaaacgcacactgggatcctttcttgcaacagctgggccggctgggtcttttctcttgtcttctgtacacaggcccctctccgctgtttctgcagagaccgaggtgggagggagaaagaccctccagccctctgctcccaccctccccgcagtctccggggccctgtgctgcaggcaagataatttggctaatgaactcgttaaagggcccctggtgacccgccccggcttcccct

SEQ ID NO: 31703 - DNA, 204 bp, Homo sapiens; identical to SEQ ID NO: 754
  misc_feature 1..204: note = chr7:156810597-156810801
  misc_feature 1..204: note = hyper
  source 1..204: mol_type = genomic DNA

SEQ ID NO: 31704 - DNA, 415 bp, Homo sapiens
  misc_feature 1..415: note = chr7:156811302-156811717
  misc_feature 1..415: note = hyper
  source 1..415: mol_type = genomic DNA
cgacattctgtaaatgagataatgatccataaacccggatgatagatgtggcgtgcctgcgatgtcttctctaaatgagctgctcgcatcgactgctaataatggtgagtttatggaagcgatttcagcgcaaactgcgagagggtcttcttactctaatcagcctgcctgagctaatggacgagggggtcaggctgagagttattgacacgcccgtgcccttaacctgtttcccaataaagctgattagtttttgtcaattcatcagctaaccactcttgctggaactgcatcaaagccttatttgctcaggggaaatcaacaagtcacagatcagctccattaaggggcccggcccggcaaggacagtcctggagccgagggacgccccgacggacctcgggcctcccccgag

SEQ ID NO: 31705 - DNA, 105 bp, Homo sapiens
  misc_feature 1..105: note = chr7:156811921-156812026
  misc_feature 1..105: note = hyper
  source 1..105: mol_type = genomic DNA
cagggcggtggagagcgagggcatgagggagggagctgggaaccgcgcagtgtccgcggccacgaatctctcctacgcgtccccatgaggcgacctaaggggaag

SEQ ID NO: 31706 - DNA, 37 bp, Homo sapiens
  misc_feature 1..37: note = chr7:156812242-156812279
  misc_feature 1..37: note = hyper
  source 1..37: mol_type = genomic DNA
ctcccaggtatccctcggctcccgctggcaggagtga

SEQ ID NO: 31707 - DNA, 1038 bp, Homo sapiens
  misc_feature 1..1038: note = chr7:156812788-156813826
  misc_feature 1..1038: note = hyper
  source 1..1038: mol_type = genomic DNA
taaggatattgtatacgcggggggtatgctttattgacaatttcattttccaattagtaattttgttgtaatatatctgcgaaccggggactcccgggcagggaggcaggattctcccggctggggcggtctgagtagctgggtctgagcctcgggctgagaagagtaaattctgcagaaagggccgcgtccgatcggcgcaaacgttcggttcgtagcaggagcttctccaggcggccaccgaacccaggtccaggactcggcactcctggagccctcctccccacgcagaccgcgggggctgatttaatagaatgtcgatagaatcattcgatgccttttagcttgtgatctttataaatgtccctctattaaattagaaaatgattctcttctcgtttaattgtattctttcgtttcttatttccaattaattagtcctatcgacgttgcaatattttaagtgacttgagtccgtttccagttagaatatatgggtcagcacatgcaattttatacccgacaggactatataatgtgggttttaactactcgttcctcatctgtcttaaacatctggccaggatgcgccacccggcctcctcgcagatccttcctggggcaggtgggcaccacgcgggaccctcccgggggctcccgcaggcgcctcttgctgcccggggccaagggtcgggcagcccatagcgtccggcctgggcctttacttggaattctttctgttgaagacttggtcccagcccagtggttctgggataagaagaccccgcagaggggcccagcgccgcgttcctacgagacacctgagctgcactgtgtttccacgggctaggagagcggtgactccccagcctccccgtaggcctcgctcgcaccgcagagggatggctggcccgtgccgctccgcggttcccctccccgggcggatccgcgcagggagagcccggcgggcctgggcttgggcctgggcctggttcgggggtgcaggccaagaggggcgccaggccgggctcccctacc

SEQ ID NO: 31708 - DNA, 244 bp, Homo sapiens; identical to SEQ ID NO: 757
  misc_feature 1..244: note = chr7:156813986-156814230
  misc_feature 1..244: note = hyper
  source 1..244: mol_type = genomic DNA

SEQ ID NO: 31709 - DNA, 114 bp, Homo sapiens
  misc_feature 1..114: note = chr7:156871039-156871153
  misc_feature 1..114: note = hyper
  source 1..114: mol_type = genomic DNA
ctgccctcccttcctcgcgtggcttcccgggcgcgctctgcctgtctgcggggactccaggcgtccttgtgttttcagctcccggctcttgcccgcgcgtgtggcccggctggg

SEQ ID NO: 31710 - DNA, 28 bp, Homo sapiens
  misc_feature 1..28: note = chr7:156871282-156871310
  misc_feature 1..28: note = hyper
  source 1..28: mol_type = genomic DNA
cgagctccagaggcgggggatctgaaca

SEQ ID NO: 31711 - DNA, 138 bp, Homo sapiens
  misc_feature 1..138: note = chr7:157129147-157129285
  misc_feature 1..138: note = hyper
  source 1..138: mol_type = genomic DNA
ttgacaagcgggggccggcgccttcgcccgccttcgctggccgccgcttggtttgttcttcttctccttcggggacttctccgcccgcgcccgcgcccgcgccccagctttcgtcccgctgtgcggagatgccaccca

SEQ ID NO: 31712 - DNA, 49 bp, Homo sapiens
  misc_feature 1..49: note = chr7:157130967-157131016
  misc_feature 1..49: note = hyper
  source 1..49: mol_type = genomic DNA
gccgccttactcctccgccagtccacccgtcccgcgttctctctgggtt

SEQ ID NO: 31713 - DNA, 34 bp, Homo sapiens
  misc_feature 1..34: note = chr7:157476555-157476589
  misc_feature 1..34: note = hyper
  source 1..34: mol_type = genomic DNA
gtgaatgggggagcacgcccggccttggtcctgg

SEQ ID NO: 31714 - DNA, 95 bp, Homo sapiens
  misc_feature 1..95: note = chr7:157476879-157476974
  misc_feature 1..95: note = hyper
  source 1..95: mol_type = genomic DNA
ttgccttcggtgcagcggattagctggtgccgggactgagttaatggaaacgcgggttaaatgagaaaagacgcccggattttcctgcctggatg

SEQ ID NO: 31715 - DNA, 495 bp, Homo sapiens
  misc_feature 1..495: note = chr7:157476994-157477489
  misc_feature 1..495: note = hyper
  source 1..495: mol_type = genomic DNA
cgaggttctccagcggcgggaggcggtggagccgccgcggagagggagggaggctttggagagggagggaaggaaagggggagggagagggaaaggggggagagggagaggaggcgcggggtgggggaggggagtgagcagggagccgggagagggaggaggggcgggaaccaggggagcggcccgaaccccgtttggtccggaccccgcagccaccgctgggtctcgccgccgggtcgcccttcgcgtggagatccggtccgcgccccctccccggtctcctcccctcccctcccctccgcccccctccctccggcccacacagcctcttccagaaagaagtcactctagagccgcgcgacccagccccagagtccgccggggtccgcccaccgggtctcctgcgcgcccctccccgcccctccccgggcacagcccgttcacgaaacctaaggcgccggccacgcgccacctcccccgggccggggtctcctc

SEQ ID NO: 31716 - DNA, 110 bp, Homo sapiens
  misc_feature 1..110: note = chr7:157477710-157477820
  misc_feature 1..110: note = hyper
  source 1..110: mol_type = genomic DNA
ggagccatacctgggcgggagggcttttcccgggggcccggcctgcgcccctcgccgcccctcgcccctcgcctctcgcctcccgcgggtcccgcctggccttggccgac

SEQ ID NO: 31717 - DNA, 17 bp, Homo sapiens
  misc_feature 1..17: note = chr7:157481533-157481550
  misc_feature 1..17: note = hyper
  source 1..17: mol_type = genomic DNA
cgtccctcccccctcgc

SEQ ID NO: 31718 - DNA, 315 bp, Homo sapiens
  misc_feature 1..315: note = chr7:157481759-157482074
  misc_feature 1..315: note = hyper
  source 1..315: mol_type = genomic DNA
ggcgctcgcagcccccgggcggcgcagccgccaccgccgccgtcttctctggagcgcagaggggtgtgcttgggagggggcgggagggcactttcctctgtgtcggtgaaaggaagagcttccagctccctcctccgcacaaaccttcacttcctctcttgttcgatcgcgtcctaaaatctgggatcggcgacgcaaggacagcctggtttggcgaagacccctcggacaccctgcgctccggactccaggcgggtggctccacggtgccggccgggacgcgcagctcggggggcgggaccacgtccgggaccc

SEQ ID NO: 31719 - DNA, 131 bp, Homo sapiens
  misc_feature 1..131: note = chr7:157482200-157482331
  misc_feature 1..131: note = hyper
  source 1..131: mol_type = genomic DNA
cgggagactctctccggccctaaaaggcaattgtgctgagattttaactctaacttgggggttcgcccgattccctggagcaacgcttctctaaaaccacggagcaggccagtgttcggaactgcacaggt

SEQ ID NO: 31720 - DNA, 244 bp, Homo sapiens
  misc_feature 1..244: note = chr7:157482557-157482801
  misc_feature 1..244: note = hyper
  source 1..244: mol_type = genomic DNA
gatactcccatggctcggaggcgcgctcccggaccctggtgaggagggtgaagagcgccccaaaatgggctgagaggaaaatgcgcccacactggcgcctctccatcctggctgctcgccccttccctcctcctttcccacacgcctcccatctccgtgcctgcacccccccacccccagcaccctgcaatggtcggaactgcagggagtggggagcaacgcgaaaggccgagagaagagcgct

SEQ ID NO: 31721 - DNA, 1188 bp, Homo sapiens
  misc_feature 1..1188: note = chr7:157483055-157484243
  misc_feature 1..1188: note = hyper
  source 1..1188: mol_type = genomic DNA
gttagagcccccatgcgcgccctccagccttcgaaagctctcttcctcgccccaccacctacgcgcctggtgatgctctcgtgggcccttcctgctccctccgcccccatcccagcctctctcgcctcttccagggcccacccaaccgcactacgagcgcccgcgccccgcccggcacccctggttacctgcagctgggccggcgcccagcgcccgcgcgggaggaggtgggggcgtgcgccgggccgagcggcctcggggcgcagcagctgcgggtagcggcagcgccatcatcacagccagctgcttccctgcgctggagccacagactagcggggtcatccgcttctgaccacaaacttctagggcggccggaggagacaaaggtgccgcgcgtcgctgctccagcagcagcggctgcgcggcggcacgggctcggagcccgcaggcgccggagctctgcgcggccgctcggcccagctccgcgtgctccgccccggcccggcccccgggctaggcacgctgggccggggcgcggcgcgggcgggctcagggcgggctccggacggtcccggtagggccgccggccgcgcgcgtagcaccaaccagcgcggccgccgcgccccgccttatatccggcccggcgcgcacccggccggcggcggcgcggctcgcggcccagccaccggttgctatagcgatgtccccccccccccccacatgttgctgacagcaattggctaaggggccgcggctctccaaacaccctctcccgcccgagactatgaatggacatcagctttgtcagtcattggtacaacgccgaagccagggccttcgccttttctttcttttcagtgtttctccctttcatcgttcatactgggcaagttcagggtagcaccgaggggagagagacctcggccagaaaagtcaaggcgcgcggctctgctgtgacctttgtcctgggaggggtgggtggggtgcgtcgccactcttggcaagagaaaattgcacggcatatcgttcttcccagttaccttttccagtgttgccgttcgggcctttttgctccctttccaaatggaagcaggccaatgattcagggcgagtagacgagagcccctctgctcactttaccagggtcctcccgagtgtttaggtcccgatgcgcgtagaaagtgtctt

SEQ ID NO: 31722 - DNA, 25 bp, Homo sapiens
  misc_feature 1..25: note = chr7:157484461-157484486
  misc_feature 1..25: note = hyper
  source 1..25: mol_type = genomic DNA
tgcccacataacccccggcccctgg

SEQ ID NO: 31723 - DNA, 598 bp, Homo sapiens
  misc_feature 1..598: note = chr7:157484507-157485105
  misc_feature 1..598: note = hyper
  source 1..598: mol_type = genomic DNA
cgagaagagctagggtctcggggcgactaggaccactgagcacctcccccccgcgcctcccgcccatgctctctctccccaggccctggaccccgggccacagccacaggttggggcaccccggtgcgcggcgcccccgcggagctggcgagagccggagagctgaaacccaacatctgtgtgtacaatgcgctctccgaggcccacagctgcaggaacaaggagaagaaaggaagaggggggcgcagatcttgtcacacgcagatgacagtctgcggagggctctttagtttctccttttctggaaaccccagcggccccctcctaggcccccctctcccaccgcctggccattgttccctgcgcccgggacagctggagacggcggcccgcgccactcgacgcccctcccgccgcacacccggctgcccgcggcgcccgctcccggcccctccggggccaactcctccacaccccccacctccccaggccaggcccaggcggcgcttccacagtctcccctcccctcccttgcactctggcgctgcccctagacctgctcggtgcagagggccttgcctggcgcttttctctcaca

SEQ ID NO: 31724 - DNA, 99 bp, Homo sapiens; identical to SEQ ID NO: 3186
  misc_feature 1..99: note = chr7:157485503-157485602
  misc_feature 1..99: note = hyper
  source 1..99: mol_type = genomic DNA

SEQ ID NO: 31725 - DNA, 433 bp, Homo sapiens
  misc_feature 1..433: note = chr7:157485649-157486082
  misc_feature 1..433: note = hyper
  source 1..433: mol_type = genomic DNA
cggttcctgtccctccccgccaccctcctccggtgcctcggcgtccccagccaggctccagggcgaccccaggcccggccctgggcagagacagaggaggggaggggaggtggcgctggggggcggggggccggagacggcgggaggaggactcgggagccggggcgggaagaggggaagacagcggagagaagggacggggaggggagggggctcggaggaggggacctgctgccctcagcctggctggtaaccggcctctccatagcaacggccagcgcgcgcgtctgtgtgtgcgcgcgtgtctgatgtgtgtgtgcccgtggtgttcccgggactccccgcgggggctgggaggggatcgcagaaccctagggtggcgacagagcaaacccctccaggactggaggcccgacctccgcggtgctgggag

SEQ ID NO: 31726 - DNA, 211 bp, Homo sapiens; identical to SEQ ID NO: 3189
  misc_feature 1..211: note = chr7:157486204-157486415
  misc_feature 1..211: note = hyper
  source 1..211: mol_type = genomic DNA

SEQ ID NO: 31727 - DNA, 128 bp, Homo sapiens
  misc_feature 1..128: note = chr7:157486475-157486603
  misc_feature 1..128: note = hyper
  source 1..128: mol_type = genomic DNA
cgccctggatcgccggagcctcatccaggctggggtctccagcaggcggccgggagctctccgaggtggccaggagtggccggtagccgtctccctcggccaggccgtgtccagcccctcagtctcca

SEQ ID NO: 31728 - DNA, 144 bp, Homo sapiens
  misc_feature 1..144: note = chr7:158379278-158379422
  misc_feature 1..144: note = hyper
  source 1..144: mol_type = genomic DNA
caggaaaggaggtgccggggactggaggttttatgggtttaaaacaggggcgtccgcctgggaaagcagcggcttccactccctcgctgccgtgaagctgccgccctccctttcctcccgcggctgccacggaggaaaaatgtc

SEQ ID NO: 31729 - DNA, 36 bp, Homo sapiens
  misc_feature 1..36: note = chr7:158380360-158380396
  misc_feature 1..36: note = hyper
  source 1..36: mol_type = genomic DNA
tccccgcggcctggccggcggcgctcagtccatggc

SEQ ID NO: 31730 - DNA, 236 bp, Homo sapiens
  misc_feature 1..236: note = chr7:158380974-158381210
  misc_feature 1..236: note = hyper
  source 1..236: mol_type = genomic DNA
ttaacgccttccaaccgtttctttaatttaaacgtaacgggccacttgcgcatcggggcgcgcggaggtggacccagtcgacctcccctgcagcgcgggcggcgcccaggctcggtcccaggaaagctcccggagggcccagggcgtgggctggggccaggcgggctctggggcagagcagggtgaggcctgttgcgggcctggtctcctcgccgccgtcccgcccggggtcctgg

SEQ ID NO: 31731 - DNA, 336 bp, Homo sapiens
  misc_feature 1..336: note = chr7:158823329-158823665
  misc_feature 1..336: note = hyper
  source 1..336: mol_type = genomic DNA
gcaggaaggactgggcgcgggagccgcggtggaactgcagggcgccctccgagccgttgcgggagaaggaggaaccgcagaccctgtaatcccggctcgcggacggggtcgggcaccggcttcgccattttcgcttcagctcgcactgcacctgggaggtgagggcagcgggaacgcccgtgagcctgggcaggtgcgggcggctgctatgggaagcgcggcccgcgagcctccagctctccctcccgcctgctcccgtatctgtgttgccagcagatggacagaaacagaaacggccttgggggcagaggctggagggagcgggaactggacggc

SEQ ID NO: 31732 - DNA, 235 bp, Homo sapiens
  misc_feature 1..235: note = chr7:158936522-158936757
  misc_feature 1..235: note = hyper
  source 1..235: mol_type = genomic DNA
tactttccaaggacccgctccgcaaagcgcccaccctcgagggaggaaagccgagctgcgcctccgcgcaaggccagggagtgtggctcgagccccgctgcagaccgggcgtcgccggttaatcaatgacactgtcgggtcagcagcgcagcctcccagctgcggaggggccgcggatcgatccagacctgcctcggctgcgacgcgcacgaaaaccgcgcgcaccgcaaacccg

SEQ ID NO: 31733 - DNA, 173 bp, Homo sapiens
  misc_feature 1..173: note = chr7:158937202-158937375
  misc_feature 1..173: note = hyper
  source 1..173: mol_type = genomic DNA
cgagtcccgcaacccggcgggaccggagctcagcgcttcacgctctccgggaggaagctccggaccccgggcgaccccgctccctctcccggaccccgcccgcgctccagcacccgggaggaaggcgaagaccggcgggaggagcgctcttctcggaaggggagaaccgggtc

SEQ ID NO: 31734 - DNA, 40 bp, Homo sapiens
  misc_feature 1..40: note = chr7:158937902-158937942
  misc_feature 1..40: note = hyper
  source 1..40: mol_type = genomic DNA
cgcccccctcccggccgcgcctccccgatctgtgggcgga

SEQ ID NO: 31735 - DNA, 208 bp, Homo sapiens
  misc_feature 1..208: note = chr7:158938210-158938418
  misc_feature 1..208: note = hyper
  source 1..208: mol_type = genomic DNA
tttggtggggatccccgcagcctcaaagaggacatcaggtcgaacagaaagctggagaaaaacgcagacgggggtataggtgggtcccagcctcagctgggtggcgggttttgtgtcctgcgtttgcaaaacgggggtcattctctccccgcaaacgcggcggcgggtggggaacgctgggcggggactcacgcggtgccactggggc

SEQ ID NO: 31736 - DNA, 143 bp, Homo sapiens
  misc_feature 1..143: note = chr8:495720-495863
  misc_feature 1..143: note = hyper
  source 1..143: mol_type = genomic DNA
cccagccctggtgggcggtggggccgctggggcctggggcgccgcgggctcggcccggactgacggcggtggggggcggggatggggccgtggtgccgggccgcgcagaacccttgggacccccgcggcgcccaggttggggc

SEQ ID NO: 31737 - DNA, 171 bp, Homo sapiens
  misc_feature 1..171: note = chr8:686714-686885
  misc_feature 1..171: note = hyper
  source 1..171: mol_type = genomic DNA
tatgcggtttgttttcgcatcttttacctcatttaaatgccgtagccatgcaggtggaaagcagaaatccatttctgcgtttatgttaaactggggctgagagacttgcccagggtcggtgaccgcccagggatccccataccagcgcgtctagctcccgcgttccgatcc

SEQ ID NO: 31738 - DNA, 56 bp, Homo sapiens; identical to SEQ ID NO: 3192
  misc_feature 1..56: note = chr8:687162-687218
  misc_feature 1..56: note = hyper
  source 1..56: mol_type = genomic DNA

SEQ ID NO: 31739 - DNA, 129 bp, Homo sapiens; identical to SEQ ID NO: 3193
  misc_feature 1..129: note = chr8:687513-687642
  misc_feature 1..129: note = hyper
  source 1..129: mol_type = genomic DNA

SEQ ID NO: 31740 - DNA, 139 bp, Homo sapiens; identical to SEQ ID NO: 3194
  misc_feature 1..139: note = chr8:687837-687976
  misc_feature 1..139: note = hyper
  source 1..139: mol_type = genomic DNA

SEQ ID NO: 31741 - DNA, 43 bp, Homo sapiens
  misc_feature 1..43: note = chr8:688697-688740
  misc_feature 1..43: note = hyper
  source 1..43: mol_type = genomic DNA
ctgggctggactggacgcctctccccgcccggccctccctcag

SEQ ID NO: 31742 - DNA, 35 bp, Homo sapiens
  misc_feature 1..35: note = chr8:1772635-1772670
  misc_feature 1..35: note = hyper
  source 1..35: mol_type = genomic DNA
taaaggagaagaatgcggtccgcctcaggatgcag

SEQ ID NO: 31743 - DNA, 122 bp, Homo sapiens
  misc_feature 1..122: note = chr8:4849141-4849263
  misc_feature 1..122: note = hyper
  source 1..122: mol_type = genomic DNA
cctgctgcttgcaagcgcctccggtgggccctggagcgcgctgccgagccccggggcccagcgccgacgcccccggggggaggcccgaccttggtcacccgggctttgctaggcaaggggaa

SEQ ID NO: 31744 - DNA, 495 bp, Homo sapiens
  misc_feature 1..495: note = chr8:4849296-4849791
  misc_feature 1..495: note = hyper
  source 1..495: mol_type = genomic DNA
cggcgactccggcgctggcgtcaccagcccccttcctgcctgcagccccttcccaggccggtacaggagctcgcacttgaccccgcaggcgtggaggagacacggtccctggtccctgtggggttaatgaaggagctccacggacccactgcctcgtgggccagacaatagcgcagtgagagctacgtccgagcgtcctggaccccctccgcgcgcacacacttgcgcacagcacctctccagctccatgcacgccaggggcctgggaccctgggctccacttctcggcttctacagccaggttctgggacctgcagcgcgcaagaggagctctcttccacggggctgccccgcagggcccgaggcgcccaggactttgcaacccctgccctgttcgccccagaatcatccagagcagcccccgcccactacctggccctccacaccctccctcccgcctccgcctcagcctcatcctagcgctgcagcccaccc

SEQ ID NO: 31745 - DNA, 91 bp, Homo sapiens
  misc_feature 1..91: note = chr8:4850232-4850323
  misc_feature 1..91: note = hyper
  source 1..91: mol_type = genomic DNA
gccctgctcagcaggcgctgcctccgcagccggcaatgtcagaggcaccggccaaggcatccggactgagccgggcgggtgggcagagggt

SEQ ID NO: 31746 - DNA, 281 bp, Homo sapiens
  misc_feature 1..281: note = chr8:4850418-4850699
  misc_feature 1..281: note = hyper
  source 1..281: mol_type = genomic DNA
cgcagacacccccttgtgagggtggatgccggtgaggaggagctggtgctgagcggtcagctttcacggagccctggacgccccgtggaggcaagtgcagggaggggaagcccaggcggcacgtctctcccccgctctccaggcagatctggagtttcctaatgaaccagatacagtcctccttcgccctgccaatcactcttccatctggaccactggaggaaaaggaaatgggtggaaaagaagatggaagaatctagagaggacggggaaatattatg

SEQ ID NO: 31747 - DNA, 33 bp, Homo sapiens
  misc_feature 1..33: note = chr8:4851342-4851375
  misc_feature 1..33: note = hyper
  source 1..33: mol_type = genomic DNA
gcgaggaggccgggccggcggagacctttgcct

SEQ ID NO: 31748 - DNA, 30 bp, Homo sapiens
  misc_feature 1..30: note = chr8:4851581-4851611
  misc_feature 1..30: note = hyper
  source 1..30: mol_type = genomic DNA
gacaccctgtactgccgagaaaaagagatc

SEQ ID NO: 31749 - DNA, 336 bp, Homo sapiens
  misc_feature 1..336: note = chr8:4851862-4852198
  misc_feature 1..336: note = hyper
  source 1..336: mol_type = genomic DNA
cagtgaggagcctcgcgcacagcaccagcagcccgagaagcaggagcagcgactggaatctcctccacgcagtcatgtctgcagatactccacacgcacgcgacaccgatggctcctccgaggaaggcagggctatgagcggagccaaataatcacccgagggcaaggcgagccggagagagagcccggtcccaagacccgccgcgcatccgacgcctcctgaaggtctgggcgcccggctcgcttccctctcatagcatcgggtcccgagccactgcagggctgagctgctccgagcgcggagacccgggctggcggggccggggccggggacga

SEQ ID NO: 31750 - DNA, 77 bp, Homo sapiens
  misc_feature 1..77: note = chr8:4852501-4852578
  misc_feature 1..77: note = hyper
  source 1..77: mol_type = genomic DNA
gacagagcccagcctcggggcctcgggctgcccgcaccgtgctgcgcttcattcggcctcagcgcagcagcgcgcag

SEQ ID NO: 31751 - DNA, 182 bp, Homo sapiens
  misc_feature 1..182: note = chr8:6692272-6692454
  misc_feature 1..182: note = hyper
  source 1..182: mol_type = genomic DNA
gcactgaaggagttacgcgttcaaaccagaagggcgcgaaaaatggggccatcttgctccgccgcggctggcgggctctgggttccccctgcgacggaggtggcctcgaagggccgcgtcccgccccgtcctaaaccccgaagcggagtcgccgtcctacagggccgcgtggatgcggagcc

SEQ ID NO: 31752 - DNA, 468 bp, Homo sapiens
  misc_feature 1..468: note = chr8:6692702-6693170
  misc_feature 1..468: note = hyper
  source 1..468: mol_type = genomic DNA
gggaggggggggaaccgagcatgggtggaggaaaatcatgcatccttggggggatggtgcatgcgtgggcatctactaaggacgggaggacgtgctctgcaggtgggatggccaccaccgtgcgtcaccggcgcgcagtgctgggcgcaggctggggcagtgcccgcccgggcataggcagcctgtgcggctcccggcgccggggtggggttaggggctgcaggggtgagcacagcctcgggctgccgcactcacgcgcgctctgctcggccgcctgcagcagggccgagagccccaggagcctcgcgtgcatcttccgtgccgaccccgcagcctgcgcccgccccttcccctgcacgcggccccgcgtcggggaggtttccggcccggggcccgactgcgggtggcatttctggctaagccgttaggcgcgaattgtatgtctggtttattcgtagtggccagcag

SEQ ID NO: 31753 - DNA, 233 bp, Homo sapiens
  misc_feature 1..233: note = chr8:9756051-9756284
  misc_feature 1..233: note = hyper
  source 1..233: mol_type = genomic DNA
gaggatgcactgagacggaccccccactccagcaaataaaacccaacccccaagcgctttcgcggcggggtcctcttcccaggctgcacctgccagcccctctttcttgcaagttctgaggctttccgggatgcacggtggggtcctcgaggccgcaggtactgaagtggatcagagagaggcccggagccgcactgcgggcgccgggcgcacaggctgaccggctgcacggc

SEQ ID NO: 31754 - DNA, 29 bp, Homo sapiens
  misc_feature 1..29: note = chr8:9756486-9756515
  misc_feature 1..29: note = hyper
  source 1..29: mol_type = genomic DNA
cgctagagtgaaatcgatgtgcatggaaa

SEQ ID NO: 31755 - DNA, 247 bp, Homo sapiens
  misc_feature 1..247: note = chr8:9760735-9760982
  misc_feature 1..247: note = hyper
  source 1..247: mol_type = genomic DNA
cacctccccaccccacgggctccggtgcgggacaggcagccggagggagctccagacccctcccctcgcgcccgcggccgctgcgcggaggtctgcggagggcgcctggctcggtcggtcgctccttccttggcgggccctcgccgacccacggtgctcagccagccccattcttggcattcaccgcgtgccttaattgtatggacatttaaatcaaggtccgctgtgaacacggagagagaggcct

SEQ ID NO: 31756 - DNA, 272 bp, Homo sapiens
  misc_feature 1..272: note = chr8:9761450-9761722
  misc_feature 1..272: note = hyper
  source 1..272: mol_type = genomic DNA
tgtcgccctctgcttcgcccaggaaactgaaggggactaggaggaggaagaagagagcgaaggacaaggagagcagcggggactcggcagcggcagccggggcagggcgcgcggccgccgcctctttacctccatcgctgagtgggggcgcagccgggccgggcgtgccgcaggggcgagttgccgcggtccggggctgggacctggggattcagccttccggaactcgcctgctgcagtcctctcgctcaggtcccaagtggtggaggggg

SEQ ID NO: 31757 - DNA, 42 bp, Homo sapiens
  misc_feature 1..42: note = chr8:9761782-9761824
  misc_feature 1..42: note = hyper
  source 1..42: mol_type = genomic DNA
aagaagaagaaaaaaaaaccataagagcgaggcccatctggc

SEQ ID NO: 31758 - DNA, 253 bp, Homo sapiens
  misc_feature 1..253: note = chr8:9762041-9762294
  misc_feature 1..253: note = hyper
  source 1..253: mol_type = genomic DNA
caggtaaagggtggacgtagatttaaaaggtcactcgtgtataatgcggctggatccccgggtcaaaaaaagggggcgagacagaggatgagagtccctaaagccaaaaggacaataagacatcattttaagcccccacccccatgccctcctccacctctccacactgtttacacacaaatcctgtcgccgcctcatgcatgtgcacggacatgtcaatttctcatcaatttctcagcgctcctatcgacag

SEQ ID NO: 31759 - DNA, 104 bp, Homo sapiens; identical to SEQ ID NO: 3195
  misc_feature 1..104: note = chr8:9762586-9762690
  misc_feature 1..104: note = hyper
  source 1..104: mol_type = genomic DNA

SEQ ID NO: 31760 - DNA, 566 bp, Homo sapiens
  misc_feature 1..566: note = chr8:9762751-9763317
  misc_feature 1..566: note = hyper
  source 1..566: mol_type = genomic DNA
cgccgaacccaaggtgctttgtcccggcggccacacaaggtcttcggctttttgttctccttttttaagagactggccgcagtccccagcgattcagccggcccaaccaaaggcagtggatctactgaaatgaaaaggatcgagataatacacaggcagatgaataaggggggggatgctggaggtgcaggaagcatcctgggagcggccgccacggccaagcccgaactgcttgctgccttcgctggggaaggcgcaggaggcgagccggcgctggtggtcgctccacctggcaggaggaaatgataaccatgataaggaacgtgatgatgatgatgatgatgatgatgatgatgatgagcatgatttaaaaaaaatcagtctccctcttggtgaaccagagcatgcgtgccggagggactgcactgctggcggcggcggccgggggaaggagagcggcgcaggaggcaaaggttgaggaggcagcaccctcggatgaataataacaccgcgccgcgcaagttgcggagccgcctggaaatccagcccttcgcgtgaactcgcgt

SEQ ID NO: 31761 - DNA, 226 bp, Homo sapiens
  misc_feature 1..226: note = chr8:9763536-9763762
  misc_feature 1..226: note = hyper
  source 1..226: mol_type = genomic DNA
agccgcatctgctgacggttccgaaaacaagaggattaggagcccgtccacagatccaggcccgcagacccccaccccctctgcaccagcacacgtcattctcactgcccccgggtacctccctctccttcgtgctcggggagagctgtgccaaggaaaatgcggatttggggaaagtgagaagtgggagagctcggaagagcgggaaagccaaggccggaggtgg

SEQ ID NO: 31762 - DNA, 263 bp, Homo sapiens; identical to SEQ ID NO: 3198
  misc_feature 1..263: note = chr8:9763787-9764050
  misc_feature 1..263: note = hyper
  source 1..263: mol_type = genomic DNA

SEQ ID NO: 31763 - DNA, 757 bp, Homo sapiens
  misc_feature 1..757: note = chr8:9764195-9764952
  misc_feature 1..757: note = hyper
  source 1..757: mol_type = genomic DNA
gggccgctgcggcgacctgagcgccggtgcagcctcccccaccccgcctgggcgggcgtctgggcaggacagctgcggggggttgggagaggagtcggggagagggggacgatcgccccatcccccgcccccccgcagtcaaggtgaacatgaaggagagccggcgcgcgtgcccgcgcctgggaggcgcgcggccccgcccctcccggagccctccagcgcgcccgggccagatggacgcccgagattagaggcgcagaagtgcgctccacgacgggcccacccgtcccgcggacatcagacctacttcggggaggcgccttttgttgtggtggccgtggcggtgtttgtgtctttccgggagcacagggtgagcttggccttcaggaatgactcagaatgaatccgcctataagagccaaactaaagacgaccccccgccccagccccccaaccataacccaacgcctgccatgagaaaccttcggactttccaaggggtcagtgcctcagccacgaggggcagccctgacccgcgcggttcacgcacacgcagggcccatctgcttcccctactccggcttttcttctctgatgacttaaaagagagtgagtgagggagagagggagagagagagagaggtctaagtgtttcttgggcactgctggattcagggcaactagagatggggagaacaagccccgccagctaaaagcagccctgctgaaaccacacagcccgcgagggtcgcagcag

SEQ ID NO: 31764 - DNA, 181 bp, Homo sapiens
  misc_feature 1..181: note = chr8:10587422-10587603
  misc_feature 1..181: note = hyper
  source 1..181: mol_type = genomic DNA
ccccgccccctggggcgccgatctccgctcctgtcccagcagaggagcctccctgcccgccgcgcggtttcactttggaccgcgccaagtgcccccgctctgaatcctgggcaccgcgagcacccacgctcgcgcagatggccagccacgcgggcacgaagagggccctcgtcccgcgtgc

SEQ ID NO: 31765 - DNA, 115 bp, Homo sapiens
  misc_feature 1..115: note = chr8:10587893-10588008
  misc_feature 1..115: note = hyper
  source 1..115: mol_type = genomic DNA
gggcactcgagaccctcgggccaagggtaggctcccagcagcgaagccatggccgcacgcgggtcgcctcgcttcgcctggcggggcaggcgcggacctggccctcgcacgggtc

SEQ ID NO: 31766 - DNA, 109 bp, Homo sapiens
  misc_feature 1..109: note = chr8:10588184-10588293
  misc_feature 1..109: note = hyper
  source 1..109: mol_type = genomic DNA
cggagggagggagtgagggagggcctcctccccgcgcctgcccccggcccgcccctccgccgccagggcccgcccggggatctgcgcccggctgccccgggccgcctcc

SEQ ID NO: 31767 - DNA, 30 bp, Homo sapiens
  misc_feature 1..30: note = chr8:10590903-10590933
  misc_feature 1..30: note = hyper
  source 1..30: mol_type = genomic DNA
ctggaggagaaaggtcgaggcccagggcta

SEQ ID NO: 31768 - DNA, 39 bp, Homo sapiens
  misc_feature 1..39: note = chr8:10916999-10917038
  misc_feature 1..39: note = hyper
  source 1..39: mol_type = genomic DNA
cggagccatctgctgcgcgggcggcgccgctccagtgtt

SEQ ID NO: 31769 - DNA, 283 bp, Homo sapiens
  misc_feature 1..283: note = chr8:11058266-11058549
  misc_feature 1..283: note = hyper
  source 1..283: mol_type = genomic DNA
gcccagcccgccgcccgtgtagtcctgcacgaaccagcggaagctcaggctctgcaccagcagcgacggcaccagcacgaagaagagggtcagcccgaagtagacgtagtcccccttgcggtagtagtcgagggccagccacaggtcggtgcccacgtccccgaagaacaccagcagcgccagcacgatccacaggcagtcgagccacggccgctccacctgcggcggcggcggctccggccgcgcggccgagggcgtcgggggttggcggccggcgccgggg

SEQ ID NO: 31770 - DNA, 35 bp, Homo sapiens
  misc_feature 1..35: note = chr8:11058764-11058799
  misc_feature 1..35: note = hyper
  source 1..35: mol_type = genomic DNA
gccgccgctgcccaccgcctcgtccaggttgtgca

SEQ ID NO: 31771 - DNA, 47 bp, Homo sapiens
  misc_feature 1..47: note = chr8:11204479-11204526
  misc_feature 1..47: note = hyper
  source 1..47: mol_type = genomic DNA
gattgcaatatgcagcggagtttgagaaccagcgccttggacccagc

SEQ ID NO: 31772 - DNA, 383 bp, Homo sapiens
  misc_feature 1..383: note = chr8:11204783-11205166
  misc_feature 1..383: note = hyper
  source 1..383: mol_type = genomic DNA
ctgggccagctacaccgcaaacctttccagctgtctctcctgcgccctgcgtttcttccccacgtcacttgccagggagccgctaaacagcaagaccgcgcgctctgcggctccagagtgcggatttcggtcgcgtgcggctctgaccgcgtcgccccatccctggcggggccacgcacggacgccatggctggcgccgcggagccgggcgatgcgcgcggactctcccggggccctgactgtccctgagtcctccctgcggggggcgtgcgcggcccgccccccgcggcgccacgcggcccctcctcggccggggattggtgcgccgggcggggcggggcggggcgggataaaggcgcggggtctggctgcgcggggtctgc

SEQ ID NO: 31773 - DNA, 255 bp, Homo sapiens
  misc_feature 1..255: note = chr8:11205167-11205422
  misc_feature 1..255: note = hyper
  source 1..255: mol_type = genomic DNA
ggcagctccaactctgggttcgtagtttgcgctgggtgcgcaggaaggtcagtgtgggggtcgcccgacatttcccccccgcggaggtgggagccgagccacatcttggagtggggactggccgcggagcgggttgcccagggccggccgaggtcggggcgagccctgcgcggcgctggagactctgcattcccgggcgcgcgcagggtccccggccgtggtcgcagagtcaggaggggcggctccggagcccgg

SEQ ID NO: 31774 - DNA, 257 bp, Homo sapiens
  misc_feature 1..257: note = chr8:11205445-11205702
  misc_feature 1..257: note = hyper
  source 1..257: mol_type = genomic DNA
cggggttggcagggcgcgacactcgctcccctccacttttgaaagggcttcccacgccgagaagaggggcgggcatggccggcccggcgaaaccggtttgtacagactttgggaagccatcgcctgcggagggtgggaccccacagcttgtccacctgcccaggctgagacctcgtgtcctagtcctggatgccccacgggtttctcgtcccgggcagcggcgcacgggaggagaagactcccggtctgcagtcaga

SEQ ID NO: 31775 - DNA, 61 bp, Homo sapiens; identical to SEQ ID NO: 9392
  misc_feature 1..61: note = chr8:11206007-11206068
  misc_feature 1..61: note = hyper
  source 1..61: mol_type = genomic DNA

SEQ ID NO: 31776 - DNA, 52 bp, Homo sapiens
  misc_feature 1..52: note = chr8:11536805-11536857
  misc_feature 1..52: note = hyper
  source 1..52: mol_type = genomic DNA
gaaggttctcagactcggggatgggggaggaaggggacgtttctagaagaaa

SEQ ID NO: 31777 - DNA, 127 bp, Homo sapiens
  misc_feature 1..127: note = chr8:11537156-11537283
  misc_feature 1..127: note = hyper
  source 1..127: mol_type = genomic DNA
cgcggccttaaaagtatcccggcgagccctgagtgggccgggtgctgggcgaacagtcctagccctgcactgaggttggaaaagcgaacggaaagtgacatttttacaggggcgaggttgggatcgg

SEQ ID NO: 31778 - DNA, 30 bp, Homo sapiens
  misc_feature 1..30: note = chr8:11540426-11540456
  misc_feature 1..30: note = hyper
  source 1..30: mol_type = genomic DNA
agctagtttccacaccggggacctgctttg

SEQ ID NO: 31779 - DNA, 46 bp, Homo sapiens
  misc_feature 1..46: note = chr8:11550050-11550096
  misc_feature 1..46: note = hyper
  source 1..46: mol_type = genomic DNA
ttgaatctgatccttcgggccgcggcggctccgcctgggagggcgt

SEQ ID NO: 31780 - DNA, 50 bp, Homo sapiens; identical to SEQ ID NO: 9395
  misc_feature 1..50: note = chr8:11550672-11550722
  misc_feature 1..50: note = hyper
  source 1..50: mol_type = genomic DNA

SEQ ID NO: 31781 - DNA, 15 bp, Homo sapiens
  misc_feature 1..15: note = chr8:11555152-11555167
  misc_feature 1..15: note = hyper
  source 1..15: mol_type = genomic DNA
cctttcagaggaccc

SEQ ID NO: 31782 - DNA, 17 bp, Homo sapiens
  misc_feature 1..17: note = chr8:11555473-11555490
  misc_feature 1..17: note = hyper
  source 1..17: mol_type = genomic DNA
cgcgggtgtccctacca

SEQ ID NO: 31783 - DNA, 180 bp, Homo sapiens
  misc_feature 1..180: note = chr8:11560067-11560247
  misc_feature 1..180: note = hyper
  source 1..180: mol_type = genomic DNA
gtgctccggagaccgcttttccgcagcgccggcctccgagatccccagcaccccttcagccttaagttcccacgtttcgggtccgtggcgccaattctgctaagtagcaggctaggaattgggggaagtcggagaagaaaccctaagtgtgtcgcccccagcttccgggatgcaggcccg

SEQ ID NO: 31784 - DNA, 43 bp, Homo sapiens
  misc_feature 1..43: note = chr8:11560468-11560511
  misc_feature 1..43: note = hyper
  source 1..43: mol_type = genomic DNA
ccttctacccagccccgcgtcctggcctcgtccttaacccccg

SEQ ID NO: 31785 - DNA, 184 bp, Homo sapiens
  misc_feature 1..184: note = chr8:11560711-11560895
  misc_feature 1..184: note = hyper
  source 1..184: mol_type = genomic DNA
agcgtgagagccacccgccggctgttatctggggctgaaggctgcggtaatcgatgggttatttttacgcggtaatagggccctgtgattgctctattaacctttagacctgtctgagggactctccggctcgcagccccgctgcgctggggcctccaggctctgacgccgactcccaactcag

SEQ ID NO: 31786 - DNA, 30 bp, Homo sapiens; identical to SEQ ID NO: 9400
  misc_feature 1..30: note = chr8:11561116-11561146
  misc_feature 1..30: note = hyper
  source 1..30: mol_type = genomic DNA

SEQ ID NO: 31787 - DNA, 333 bp, Homo sapiens
  misc_feature 1..333: note = chr8:11561391-11561724
  misc_feature 1..333: note = hyper
  source 1..333: mol_type = genomic DNA
cacaggaagggggggcggggagggagaaagggaactcattaataaagctgaccctgggcaccacagcgaacccaatcgacctccggctgggttgcgggtgattccccgctccctggcggtagcacttgggcattttccgcggagaccccagagcctggactttgcctgctgggggagctttccgcacagtcccgcagcctgcgcccagcggaggtgtagccggggccgcgcacccccgccccgcccttgcacgtgactcccacaggccagtcagcgccctagggccgagttgctgggccggggacccgagccgcgagctggggacttggaggc

SEQ ID NO: 31788 - DNA, 471 bp, Homo sapiens; identical to SEQ ID NO: 3202
  misc_feature 1..471: note = chr8:11561725-11562196
  misc_feature 1..471: note = hyper
  source 1..471: mol_type = genomic DNA

SEQ ID NO: 31789 - DNA, 682 bp, Homo sapiens
  misc_feature 1..682: note = chr8:11562235-11562917
  misc_feature 1..682: note = hyper
  source 1..682: mol_type = genomic DNA
cgcccaccagcgactccggggacgcagggtggcagtgccaggcagctccgctgggcctcaggggcccccgggagccgctctgaggtgcggagaggctgctgagtggcggaactattcatgccctttctggccggcctcctcgccctcggggctggggtccagggactgaatgctcctctggaagctcaccaccccacctgcccgcgctgcttctacctgaaactggccaagggcccgagcccggaccggagccgtgacttccctccgccggccacggggctgcccggatccgccgggttatgtcgcttggctttgggctcaggggtcaccgtgggcagaggggggtgccggggtcgcggactgccaccaggttgaggaaaggaggggccttttggctggggaaagagcgtggtgggggacccgcggccgatggaatccctggggcagcgcggcccgcaccgtggaggttggggaagcgcctcggggaagtgtttcctgtgttcccagaaaaggaagacaaccgagagcaggtttcaggcttttaaagaaagcctggggtgtggaggtgatgctccgcacacgtctgtgtctcctcccctgctgcggccggcttggttgtgccggctagcgtgcgaccgtcctcctcgctgcaggccgagagcggaggcgtaaacccaggcca

SEQ ID NO: 31790 - DNA, 53 bp, Homo sapiens
  misc_feature 1..53: note = chr8:12808858-12808911
  misc_feature 1..53: note = hyper
  source 1..53: mol_type = genomic DNA
cgcgctaaagccaagcgtcgtcgtcacccaaggtactgcgctgatgcgctgcg

SEQ ID NO: 31791 - DNA, 59 bp, Homo sapiens
  misc_feature 1..59: note = chr8:12809671-12809730
  misc_feature 1..59: note = hyper
  source 1..59: mol_type = genomic DNA
agagctgctgccagtcgccacaccgtgcggaaagcgccggcgaccggagcactgacaat

SEQ ID NO: 31792 - DNA, 267 bp, Homo sapiens
  misc_feature 1..267: note = chr8:12989381-12989648
  misc_feature 1..267: note = hyper
  source 1..267: mol_type = genomic DNA
gccccaggggctgtgcgctgaaggacgctcgcggacgcagcaaactacacgcagcagggtgctgcagagaggaggggtgcacctccttcggagggatcaaaggctcgccccaggactctggaggtggggacagcgacatggagtgggggcaggcttccaagaagctgtcgccttgttacgaaaatagtcgggtcgggaggcgagcttccttcctctctccggcccaggaactcgctcctcggcctccttgtccgggtcaagggggtg

SEQ ID NO: 31793 - DNA, 73 bp, Homo sapiens
  misc_feature 1..73: note = chr8:12990075-12990148
  misc_feature 1..73: note = hyper
  source 1..73: mol_type = genomic DNA
aaggaaggtagaaggcggtgtcgccgcgcccctcgagccagagccgcgagcccccgcccggctcaaggaggaa

SEQ ID NO: 31794 - DNA, 176 bp, Homo sapiens
  misc_feature 1..176: note = chr8:12990659-12990835
  misc_feature 1..176: note = hyper
  source 1..176: mol_type = genomic DNA
gggttttctaaagatcgaaacgagggagcgctcagggagttgggcgagaagtccgtgagccggcgctcctgatgcggagaggtgcggccatgtcctggctgggagcgaagcgccctcgctcgggcagtcggagcgaactgtctcccgcgcgctccgccagccgggccctcccgctg

SEQ ID NO: 31795 - DNA, 262 bp, Homo sapiens
  misc_feature 1..262: note = chr8:12991064-12991326
  misc_feature 1..262: note = hyper
  source 1..262: mol_type = genomic DNA
gccccgcgcctcctccgccgaaggctggaatgtttcccccacgggcctccacgttcccagcgggaagcgccgaaaagtcgccaactattggccccgggtgcaaaggcaaaggtcacaaggcatttacttggcggaggtgtccggcctggaccctagtgtgccttgagcgtcccttctttttcttggtagctctgcgtactttttacctgtcttttatcctggcgggaaccacgtaaatttgcgggaacggaggggaagcgga

SEQ ID NO: 31796 - DNA, 67 bp, Homo sapiens
  misc_feature 1..67: note = chr8:13133827-13133894
  misc_feature 1..67: note = hyper
  source 1..67: mol_type = genomic DNA
agtccctgatgtgatcgctaaaggacctccggagaggggctcgcagggggcgcgccatcacgtgggc

SEQ ID NO: 31797 - DNA, 42 bp, Homo sapiens
  misc_feature 1..42: note = chr8:13134283-13134325
  misc_feature 1..42: note = hyper
  source 1..42: mol_type = genomic DNA
agggaaacgcagcgccgcaggcaagcacgcaggggaggtggg

SEQ ID NO: 31798 - DNA, 85 bp, Homo sapiens
  misc_feature 1..85: note = chr8:13424168-13424253
  misc_feature 1..85: note = hyper
  source 1..85: mol_type = genomic DNA
tttgcaaggttttcccgttgactactcgactttagcaccaaagagaagcaggagtgcagaagacagggcaaaatcgccaacccgg

SEQ ID NO: 31799 - skipped

SEQ ID NO: 31800 - DNA, 201 bp, Homo sapiens
  misc_feature 1..201: note = chr8:15094366-15094567
  misc_feature 1..201: note = hyper
  source 1..201: mol_type = genomic DNA
cggccggagcctccgcagatgccgcccctaccagcccggctcccgcctccccgccccctgcccgagtccccggacctgctcccgcgcctggggctagggcaggctagccgtccccggcagcgggggtacctctccagcccctgcactgcaactgcgggaggaaacactgcccgcgggcggtgggagggaaaaggggtctca

SEQ ID NO: 31801 - DNA, 42 bp, Homo sapiens
  misc_feature 1..42: note = chr8:15094645-15094687
  misc_feature 1..42: note = hyper
  source 1..42: mol_type = genomic DNA
cgtgccgggctggggcacaggcgggatcggagccgggaagag

SEQ ID NO: 31802 - DNA, 51 bp, Homo sapiens
  misc_feature 1..51: note = chr8:15095356-15095407
  misc_feature 1..51: note = hyper
  source 1..51: mol_type = genomic DNA
acaggtgatctctaccgcggtgcaacacagctgagtcgattgaaacagggg

SEQ ID NO: 31803 - DNA, 102 bp, Homo sapiens
  misc_feature 1..102: note = chr8:16859352-16859454
  misc_feature 1..102: note = hyper
  source 1..102: mol_type = genomic DNA
gatgccgtgcaggtgcgccagctgcgcagcccccggcccgccgcgcgcgctccgctccgccgcgctcctgcgctcgcccagcagcggcggccgctccccggc

SEQ ID NO: 31804 - DNA, 41 bp, Homo sapiens
  misc_feature 1..41: note = chr8:16884323-16884364
  misc_feature 1..41: note = hyper
  source 1..41: mol_type = genomic DNA
ctgaggtcaggagaccgttagggaatgtgagtgtcccagac

SEQ ID NO: 31805 - DNA, 322 bp, Homo sapiens
  misc_feature 1..322: note = chr8:16884365-16884687
  misc_feature 1..322: note = hyper
  source 1..322: mol_type = genomic DNA
ggcgctgagcccagctcggagacccaccccgcccgtagcagcggcgcgggccccagagagccccgcactcggccgcgcctcagttacgctgactcggctgtgcccgcagtgtcgcgctgtcgcgtagccaggtgtcgccgggctggcgcggttatttatgactgcgtggttgggctgggggttcggggccggggagcagccgggatccgccgcctcttccatgatcttcccgggccgaaccacgggaccgctacgctgaaggtggcgtcgcgggtccccggggccgcgcgagtgtaggggtcgctctcggccggccgcgaag

SEQ ID NO: 31806 - DNA, 81 bp, Homo sapiens
  misc_feature 1..81: note = chr8:16884908-16884989
  misc_feature 1..81: note = hyper
  source 1..81: mol_type = genomic DNA
cggcccttctcctcccgagaggatgaggagagggctgtggcggaggcggcatggaggcggcggcggcgctggggggagctg

SEQ ID NO: 31807 - DNA, 30 bp, Homo sapiens
  misc_feature 1..30: note = chr8:16885322-16885352
  misc_feature 1..30: note = hyper
  source 1..30: mol_type = genomic DNA
ggatccggtcacccacgtattgggaagacc

SEQ ID NO: 31808 - DNA, 450 bp, Homo sapiens
  misc_feature 1..450: note = chr8:19614007-19614457
  misc_feature 1..450: note = hyper
  source 1..450: mol_type = genomic DNA
caggtgcaggaagtgcgacggaaacaaacaactttgcctccgcttcctacagctttcctctcctccccgcccttctagcccccatcccaccccaagatcatgccctcgaacagcttctgcccaccgatcgcacgtcccctgggcatgttcgggcagcggtgaccctcagccacatcccccactagcccggtcccgggcaggcgagcgcgctgcccaccggccaccctcgtcacgccccctccaccctctccatcccagccacaataatacaataaccgcagtcatcgcgcggcacgtggaaaggctacttttcagtgggttttgcagaaagcaatcagacagcggaaggccacgagaaacgctggtgaagccaaaccgaccccgggagcgcagcggccccggaccctccctggaagctccctccgcgtccccgcgcgcccacctggaggc

SEQ ID NO: 31809 - DNA, 277 bp, Homo sapiens
  misc_feature 1..277: note = chr8:19614987-19615264
  misc_feature 1..277: note = hyper
  source 1..277: mol_type = genomic DNA
gtgcgtccctgcgcccgtcggagcggcgccctggccgaagcctgtcactctcggaaggggccgcgctcggacaccaggggcggtttacgcgtgactggacaccaagagccggagaagtttagagactaggacactgtggcgtggcccgagttgcaggagagaggtgtccaatctccatggggtccttactcttgcaggacagagttccccatccccctgctccacccgctctgttcccttggctgccctccccgccgagcgccgacttccatgcaaa

SEQ ID NO: 31810 - DNA, 34 bp, Homo sapiens
  misc_feature 1..34: note = chr8:19797566-19797600
  misc_feature 1..34: note = hyper
  source 1..34: mol_type = genomic DNA
cagccgcacggggtacgctcgccctcggcggggc

SEQ ID NO: 31811 - DNA, 213 bp, Homo sapiens
  misc_feature 1..213: note = chr8:19797806-19798019
  misc_feature 1..213: note = hyper
  source 1..213: mol_type = genomic DNA
ctgtggtcgccgactcggggggttgccaggtctgcgtttggccaccctttctgtcctgggggctgaggtcagctccgggcgcccggccccgccgcgcggctgcgagcacgtggggttgacgggcgccgcgtggaggcagcgagcacaacggtggtcaccgccgccagggaaccgcccgctcgctggggtccaggcgttcggggccaaatgaga

SEQ ID NO: 31812 - DNA, 661 bp, Homo sapiens
  misc_feature 1..661: note = chr8:20160990-20161651
  misc_feature 1..661: note = hyper
  source 1..661: mol_type = genomic DNA
cgaagacaaagacaggaggacagacgcacagtcacctcctctgggccgggccggagaagcggcgcccaccctgcagaggggagaccctgacagctccacgcggagacaaagacacctcgacagccacggacacagacagacaaagaccgacggacgcgcggacgcacggacggtccggcccggcgaggggaaagcggtttcccgcagccagggcagcagaccctccaggggcgaggagatccccggccaccgcaccttacctgccccctgcgcctcgggcgcacttgagactttttttttttcccagtgtttcccggtgtgttcccgtctctctttttccagagctgctgagcgggccgggccggtcccactgcgcgggatgcagctcccggctcccactcactggccgaggcgggcagagaaactttcggcctccccgcccggccgctgccaacccgccagctccaggcgcgccggcctctgcgcgggtcccggagccggggcggggcggggcggggcggggcggggcggggccggcccggggcggggccagagccggcgccgctgattggcagcgagctgccggcagcctggtctgtgccgctcggcggcctttgttccgggctgacagctggggctgctcgcgacctcgcggctcctt

SEQ ID NO: 31813 - DNA, 32 bp, Homo sapiens; identical to SEQ ID NO: 9415
  misc_feature 1..32: note = chr8:20161666-20161698
  misc_feature 1..32: note = hyper
  source 1..32: mol_type = genomic DNA

SEQ ID NO: 31814 - DNA, 260 bp, Homo sapiens
  misc_feature 1..260: note = chr8:21881767-21882027
  misc_feature 1..260: note = hyper
  source 1..260: mol_type = genomic DNA
ggtaggctggaagaacgggctgtctgggccttaggaaaggcccatgctgtataaggcatggggaaaggaaaggaagaaaggcaacgaacaagaaggagggcttccaactgcagcttcctgccggctgcaggcctcccttcctaagctgagctgaggcttcctctccatgggctggggagggggcgccaggaggcctcggcgggtccgcaattggccgggacagcttctcacgaaaggtcctgggccggcatcatcagcct

SEQ ID NO: 31815 - DNA, 30 bp, Homo sapiens; identical to SEQ ID NO: 9416
  misc_feature 1..30: note = chr8:22613837-22613867
  misc_feature 1..30: note = hyper
  source 1..30: mol_type = genomic DNA

SEQ ID NO: 31816 - DNA, 208 bp, Homo sapiens
  misc_feature 1..208: note = chr8:22722223-22722431
  misc_feature 1..208: note = hyper
  source 1..208: mol_type = genomic DNA
tgtgtagcaccttctcggcagagctcaggaaagggcggaaggggtgagaaaataggtagccagaggtggaagtagctgaccaagtcctagcgggtagtacgcaccacagtaaaacaccacgggggccgctgggcaccgccgagcgccaggctggtgaactgacccgcagcgcaccccatctgtgtgggaaggtcggggcaggggaccc

SEQ ID NO: 31817 - DNA, 36 bp, Homo sapiens
  misc_feature 1..36: note = chr8:22723325-22723361
  misc_feature 1..36: note = hyper
  source 1..36: mol_type = genomic DNA
gagggacccccaccccgggctcgaactcccgacaag

SEQ ID NO: 31818 - DNA, 263 bp, Homo sapiens
  misc_feature 1..263: note = chr8:22960583-22960846
  misc_feature 1..263: note = hyper
  source 1..263: mol_type = genomic DNA
ggccgaggcagggtgcgacccaggacccaggacggcgtcgggaaccataccatggcccggatccccaagaccctaaagttcgtcgtcgtcatcgtcgcggtcctgctgccagtgagtcccggccgcggtccctggctggggaagagcgcacctggcgccgggagggggcagggagacggggacacggcagggatgcctggccctggtcacctgcggccgggcatgtccgggcaggacgaactcgccgtcggagtcaggggaag

SEQ ID NO: 31819 - DNA, 323 bp, Homo sapiens
  misc_feature 1..323: note = chr8:23021267-23021590
  misc_feature 1..323: note = hyper
  source 1..323: mol_type = genomic DNA
tccccagccagggaccgcggcggagactcaccggcagcagaaccgcgacgatgaagacgacgaacttaaggatcttggggtccaggagccatggtctggttcccgacgctgtcctggctcctggatagcgccctgctcgagcgctcgaggcggtcgggacgctttgtccccaaagtcccatgagaagggaggagggtggatcgaaagcgccaaaaatcaatcagaaatcgtccccgtagtttgtgcgcgtgcaaaggttctcgcagctacactgccagaatagaacgtgctcctccgcttttataccccggaaaaaaggcgtg

SEQ ID NO: 31820 - DNA, 175 bp, Homo sapiens
  misc_feature 1..175: note = chr8:23260829-23261004
  misc_feature 1..175: note = hyper
  source 1..175: mol_type = genomic DNA
ggagtgcatacctggcgtgccgagagcgcctctgctcccgcaggactcacggcgctcccgcgctcccaacagcctttcgagcaggctgggggttgaaccgggttcaagcagtggacgctacagctcccgggcgcagcccccggggtccccgcccccactccgtcccagcccagca

SEQ ID NO: 31821 - DNA, 415 bp, Homo sapiens
  misc_feature 1..415: note = chr8:23261393-23261808
  misc_feature 1..415: note = hyper
  source 1..415: mol_type = genomic DNA
gagaccccatagggacgctcccgctttctcgcgaaccgcttcggggagggggtggcgcgggaagcgctcttacttggtttcagggatccgcagtggccgggctgggaccgcgctctccacggtggtccccctccgcttccgccgccgctgagcccctttctcgagcagagggggcggctctggtctccgatggctggagaaagcaagcaccaagcgtaggtagccgcgcgctggagtcgcgcgtttactcttttcccccttacttttaactagaggaggatggcaaacccctccccggacccacccccttccccgaaggcggccgccgcagcaggcccggcctccggcctcttttgttgtaattcgagagcggccactcccagggccagagggagctccgcgggggaggccaagg

SEQ ID NO: 31822 - DNA, 50 bp, Homo sapiens; identical to SEQ ID NO: 760
  misc_feature 1..50: note = chr8:23559552-23559602
  misc_feature 1..50: note = hyper
  source 1..50: mol_type = genomic DNA

SEQ ID NO: 31823 - DNA, 1238 bp, Homo sapiens
  misc_feature 1..1238: note = chr8:23559665-23560903
  misc_feature 1..1238: note = hyper
  source 1..1238: mol_type = genomic DNA
cgcgccttagtactgctcccacaccccaaactgccagccagccttggtgttcttcagtccctgtgttgcttggtgggtgaccggtggaggggtcttcttttgggggaagaacgtcccaggcggggcctttaactgggtgactgtggtgcagatcgcagtttcagagatccctccggaaagaagcgccgttgggtagcagcttccttccagcgccgcgtcccctccttgtcacgacctgcgggcggaggggaagggaacgagcatctggccctggttggcagagtcaagccgaggagcctcaccaggccctgacaccctgcagcgtggctgccagatggccctgcggggtggcattctggccaccgtgtccgaagcccgcgctggccagtggtgtgtgtggcgcaggacccgagggcgcgcccgcgtagcaggtgccgtagcctgcgccgtagggtgctccgctgtagcctccgtagcaagagtagggcgacactgctgcactgtaggggctggggaaggcaggtgcgccgggcccggggcccaggcagggcttgccatcgcgcaccaggacgggcacagctactcggcgcggcgttagagggtggccagccagttccagcgacttgtcctggcgctgtctcttgcatttgtagcgtcggttctggaaccagatcttgacctgcgtggacgtgagctgcagcgcgctggccaggtgctcgcgctcgggcgctgacaggtaccgctgctgcttgaagcgccgctccagggccagcacctgcgcctgcgaaaagagcacgcgcggcttccgtcgttgccgcgccttgggctgctccgagcggccaccccgcacgctgtcgccgctgttgccaacgccgcgctctggcaccctggtcccgccgccgaggggcgaggccgcgttcaggccgggctctaaaagcacaggaagggacacatcagcgcccagcctaaggctcacctgagcggttcctacttagttttcaagactttcctctccctggcagccttcactctgcgcaggctcctcctccctcctactgcccccgaaccctgtcccaggacgaaccctgtcccaggactgtctccatgttttttccctccaagctctgtcacctttatatgttactgctggaacataaattgtgacaacctatggtccctcgtgtgtgcgtccttttcctaaaggtagactctagataaagagttaaggcagctccatt

SEQ ID NO: 31824 - DNA, 15 bp, Homo sapiens
  misc_feature 1..15: note = chr8:23564009-23564024
  misc_feature 1..15: note = hyper
  source 1..15: mol_type = genomic DNA
cacccgcggatgtgg

SEQ ID NO: 31825 - DNA, 193 bp, Homo sapiens
  misc_feature 1..193: note = chr8:23564192-23564385
  misc_feature 1..193: note = hyper
  source 1..193: mol_type = genomic DNA
cgcagacagacccaagctctgggacagacgcccagcgtcccagacagcgccttcctctgggccatgctggtaggcccgggtccagggccgggtgacgagaccgtagccccccattggttctcgcagaaaccacgtgctagctctgcaccttcctcccccagcgctttcttcccgcgcccgtcgaatcctctcc

SEQ ID NO: 31826 - DNA, 293 bp, Homo sapiens
  misc_feature 1..293: note = chr8:23564781-23565074
  misc_feature 1..293: note = hyper
  source 1..293: mol_type = genomic DNA
cagaatccaggtctgcggagtcccgacccgccacttcctaggagcagcttctcagccccaggaccgaggaatgggtgtgggggctacatgtggggagccctcgacctcttaaagggctccgcgaatggtgggggagactggaaggcaatctctgcggcccgcgcaaagtggtcagaggcgggagtgggggtgggggggggtgggcttccgtcgcccttggcgtccccacgttctttttcttcctctcctttatcctccttaaagcggattgcctggagcgtgccagcttgtgt

SEQ ID NO: 31827 - DNA, 15 bp, Homo sapiens
  misc_feature 1..15: note = chr8:23566840-23566855
  misc_feature 1..15: note = hyper
  source 1..15: mol_type = genomic DNA
aacttagaatatttc

SEQ ID NO: 31828 - DNA, 308 bp, Homo sapiens
  misc_feature 1..308: note = chr8:23566900-23567208
  misc_feature 1..308: note = hyper
  source 1..308: mol_type = genomic DNA
cgctgggttctcgccttccaagtgctggaggggggaagtagggccacccggggtagaaacctaacgccagaaaccttccagcgccttatcagttggtggaattttcgtggcagacagtcgcgctctacctaagtcgtagaagaaaagacaccttgtgggggacttggcgtcggaagccttgagttcaaatcgtagccctaggtccccagccttgcccttcctggcttgctgcgaggatgaaatgagatttttgtacgtgaaaatgctttctaacccctctcgaggggtggaaacgtctccattcgacc

SEQ ID NO: 31829 - DNA, 147 bp, Homo sapiens
  misc_feature 1..147: note = chr8:23567436-23567583
  misc_feature 1..147: note = hyper
  source 1..147: mol_type = genomic DNA
ttcagcttcttcgctcgcttgggtctctctcggtcacctctcggaggggcctggagtccctcctccctcctcctacttcagcgccagaagcattgaaagccgcccgcccgccgagagtggaaccggtacctcgaatctcgctcattc

SEQ ID NO: 31830 - DNA, 58 bp, Homo sapiens
  misc_feature 1..58: note = chr8:23567657-23567715
  misc_feature 1..58: note = hyper
  source 1..58: mol_type = genomic DNA
cgctggcgcccaggaaagccggggaggaaactaggaagggaggcgacagcagaaaagc

SEQ ID NO: 31831 - DNA, 353 bp, Homo sapiens
  misc_feature 1..353: note = chr8:23571643-23571996
  misc_feature 1..353: note = hyper
  source 1..353: mol_type = genomic DNA
attaaggatctgatacgatcttttcctaaattgctatgctgaggcctttttgacggtttgtccgccatcactttcagaggcgctccgcgcgaaccccgaaaatctgtgcaaaattctcagggttaggggaagagcatgggtggagagtaaagtgaagcgggccgagagatttcttgcattaaatgtttagaagaaccaaccagttaaaggaaataaaaatctgccggtatgtaaccgctgggtgggcttctccatttctccgtgtcaccctcccccagccggcctcttagcttctcggctttgggtggcggagaccgtttagttctgggacagaccgtcgggggctgactccg

SEQ ID NO: 31832 - DNA, 249 bp, Homo sapiens
  misc_feature 1..249: note = chr8:23572413-23572662
  misc_feature 1..249: note = hyper
  source 1..249: mol_type = genomic DNA
ctctctgtcccactgcgcggcgggatggcagctgctcttttaataaactagcagtcggcggtctgagccctacaatatccccaaagcctggtgtgcgatggaacacatggctgcgtccccagaccccgagaggggagttgcacacacattgctgaccttgagggtcagacagaccctttctcgtctagtttttagcatcagatgtaacctcagcttgggcttctatgatctcatcgatgtccttttgag

SEQ ID NO: 31833 - DNA, 46 bp, Homo sapiens; identical to SEQ ID NO: 3213
  misc_feature 1..46: note = chr8:23583971-23584017
  misc_feature 1..46: note = hyper
  source 1..46: mol_type = genomic DNA

SEQ ID NO: 31834 - DNA, 308 bp, Homo sapiens; identical to SEQ ID NO: 3214
  misc_feature 1..308: note = chr8:23584093-23584401
  misc_feature 1..308: note = hyper
  source 1..308: mol_type = genomic DNA

SEQ ID NO: 31835 - DNA, 236 bp, Homo sapiens
  misc_feature 1..236: note = chr8:23584581-23584817
  misc_feature 1..236: note = hyper
  source 1..236: mol_type = genomic DNA
cggcgccagggcgggtggtggagctccgcgcaggccggggggaaccgcaagaggagccggggcgggcggcggccccgggcgggtcaggggcggcgcgagcccacacagagcggtgaaactaccaggggccctcccactcttcccggactccggaggagctaagccggcagggatcgctcgcccaccctgagcactttacctgcatggtggccaagacccttcgtccggaccctact

SEQ ID NO: 31836 - DNA, 41 bp, Homo sapiens
  misc_feature 1..41: note = chr8:23585244-23585285
  misc_feature 1..41: note = hyper
  source 1..41: mol_type = genomic DNA
ccacacccggctgcgcgtgcctttctcgcttggatccctgg

SEQ ID NO: 31837 - DNA, 69 bp, Homo sapiens; identical to SEQ ID NO: 9432
  misc_feature 1..69: note = chr8:24770293-24770362
  misc_feature 1..69: note = hyper
  source 1..69: mol_type = genomic DNA

SEQ ID NO: 31838 - DNA, 168 bp, Homo sapiens
  misc_feature 1..168: note = chr8:24770413-24770581
  misc_feature 1..168: note = hyper
  source 1..168: mol_type = genomic DNA
cgtcccccaaacgttaaaaacgccatatcccactttttatacaaataactaccccggcctgttctctttgtccccttcccgaagccttcaggcagaccgttccgcaaagtctttttttttgttttgttttgtcttctagacccagctcctcggcgctcatctccagct

SEQ ID NO: 31839 - DNA, 232 bp, Homo sapiens
  misc_feature 1..232: note = chr8:24770893-24771125
  misc_feature 1..232: note = hyper
  source 1..232: mol_type = genomic DNA
aggggaccactgggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggc

SEQ ID NO: 31840 - DNA, 226 bp, Homo sapiens
  misc_feature 1..226: note = chr8:24771349-24771575
  misc_feature 1..226: note = hyper
  source 1..226: mol_type = genomic DNA
ggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacc

SEQ ID NO: 31841 - DNA, 41 bp, Homo sapiens
  misc_feature 1..41: note = chr8:24799514-24799555
  misc_feature 1..41: note = hyper
  source 1..41: mol_type = genomic DNA
cgcctcccggtggcctggtgctgggccgccctccccctctt

SEQ ID NO: 31842 - DNA, 324 bp, Homo sapiens
  misc_feature 1..324: note = chr8:24813140-24813464
  misc_feature 1..324: note = hyper
  source 1..324: mol_type = genomic DNA
cgtcggtgttcttggcggcgctctcggtcagcacggtgaagcggctcttgaaccattcctcagcgttctgcatgttcttggcggccagcttctcgtactgcgcgcggatgtccttgagcgcggcggaaaggtcgggcttggtcacgtccatctccacggagatctgcgcgtactggatctgcgcctgcagttcggcgatctcctcttcgtgcactttcttcagaaaagagatttcgtccatcaagctgtcgatgcgcttctcgagctcggcgcgagcgagcgccgcctcgtcggcgcctttgcgcgcttccatcagccggccct

SEQ ID NO: 31843 - DNA, 276 bp, Homo sapiens; identical to SEQ ID NO: 3219
  misc_feature 1..276: note = chr8:24813618-24813894
  misc_feature 1..276: note = hyper
  source 1..276: mol_type = genomic DNA

SEQ ID NO: 31844 - DNA, 418 bp, Homo sapiens; identical to SEQ ID NO: 3220
  misc_feature 1..418: note = chr8:24814010-24814428
  misc_feature 1..418: note = hyper
  source 1..418: mol_type = genomic DNA

SEQ ID NO: 31845 - DNA, 353 bp, Homo sapiens
  misc_feature 1..353: note = chr8:24815060-24815413
  misc_feature 1..353: note = hyper
  source 1..353: mol_type = genomic DNA
cttgctaccaccaaccgcagcacatttaaagtccgctttcctctttttacacatgtgtagcacacgacctgatgatttcgataagccttgcagttggctgattttcagggaagccgctgcggccagccctgagcgctgggtgtggtctctggggaggagaactcggcacccaggcttcttcaggaacggatagaaaatagccatagccgcgtgactcttcccccgatacaatgtaataacccgaaaacagatgcagtcaggaatgcatggatttccttcaggaagcacccagatgcttgaaactggcgcacgcggtagcgcacgtggatacaaccctacggtttgcagggcat

SEQ ID NO: 31846 - DNA, 16 bp, Homo sapiens
  misc_feature 1..16: note = chr8:24816379-24816395
  misc_feature 1..16: note = hyper
  source 1..16: mol_type = genomic DNA
gcggctcctccctgaa

SEQ ID NO: 31847 - DNA, 15 bp, Homo sapiens
  misc_feature 1..15: note = chr8:24816694-24816709
  misc_feature 1..15: note = hyper
  source 1..15: mol_type = genomic DNA
cgaatccagccgggg

SEQ ID NO: 31848 - DNA, 609 bp, Homo sapiens
  misc_feature 1..609: note = chr8:24857431-24858040
  misc_feature 1..609: note = hyper
  source 1..609: mol_type = genomic DNA
cgagaaacagctacacgtctccagggcctttcttctggaaaaacttttctggtcccctcttccctgaactggtgcaggcgtgcaaagaaagctccgtgccacgcccggcagcctccattctttggtagaacgcagcgcagcaatagccgccaagtcccctcctgggtacagtacagctccacagcgcccctgctggtggcttgggaagggcgcgcaagcagagaaagcaagtgtcagagccgggactggcctcccagggcatcgcctacagcttgtgctctgagagtcggggtcatcatagctgcgctcttcgatggacactaaatgcgggacatctgttttacactcaccctccctccccgcgtggcaggagacctacactctcccgctatgcgcgctccgcggcagctgccgctgcaccattcattctctcctgcagaagttcaatattgctgcaaatatcgagaaaaaaaaaaaaagcgctgagagggggagggagggagggaggaagggagggacagcgagccagcggccactgcaaaggggcgaagggcagtcccgcggtcagtaagggccactgaactttctgcccaccggtcatccggagct

SEQ ID NO: 31849 - DNA, 1240 bp, Homo sapiens
  misc_feature 1..1240: note = chr8:24858286-24859526
  misc_feature 1..1240: note = hyper
  source 1..1240: mol_type = genomic DNA
ctgctgagtcactcccgcctgagccacggccgcccccagccagccacgcgattggcgggttagcccgggcgcagcgccctcttcccagctcccgcacccccagggcttcccgcaggcagagggtgggagccccggcgagcgaccagttggggcttggtaggaaccccctaaaaatgcgccccacttgtgcattcgtgcatgggcgcattttgggagtaaacaatacataaccttcttcgcattcaaagggtctggactcaaaagagggctcagccttgctcctcgggagcaacccctgttttaaatctgggaaatggtgatgccagtggggaaagggcttctccgggcccggggctcccgagctcctggtgccagccgtgttgctctggcttttgtattttaactccgtgggcttctgtccccatccccatgtaaggccagtgcccccttccgcgttttgccgaaagtatcttcaatgcccgtttaaaaaactatgtctgcgatttctccatctctgctctttcccagttcctctcttttctcttcttcaggccccctcctgtccttcctcatcctttcactgagcgggttcaggccctagttactaccgcaggcaccagccacacccggggagatgtgtgctgttttgtgcaagacgctgcggtcacccagtccggaattctgctggtctacaccgagtgccgcaacaccaccaccacctccgcacacatacgccctccttgaacctcttccccatgaatgctttggcttttaaggaactttgtggcgtttctgctctttcggaggcagctgcccgaggcagcttcccaaggcagaacagggactgactgctgaggttccgcggggtcggggaggtggagaagccagttcccaagtggctcgtcgcgggtgttagagtccctcgttactaaggacgccgccgcccgcgcgccaggcttggggaccagggtgactctgccctttctgggcggaatacgggtgaaggctgtctttggggatccacaggtgatctgtgccgttctcattgtattctcaactctcatcccttccaggttagcccgatccctttaatgcaaggatcggtgccgggaggaaagagagcgtgggccactctggaacggaggctggtgttttgggggagcggggagagcctgtagcccacacatctccacggctctggcccaatttctccactttttcacttcgatctaattggtct

SEQ ID NO: 31850 - DNA, 175 bp, Homo sapiens
  misc_feature 1..175: note = chr8:25041746-25041921
  misc_feature 1..175: note = hyper
  source 1..175: mol_type = genomic DNA
aacaaatatttattgcgcgcccgcttagtgccaggcaccggaggtgccccgagcaagaagccgctctcgctgatccgtttccgctccccaagtgtccggcgcgcgccgtgggagcgcagcccgcatccctcgcccaccggccgcccggcctgggcgtgcccggctcctccagcgc

SEQ ID NO: 31851 - DNA, 43 bp, Homo sapiens
  misc_feature 1..43: note = chr8:25042737-25042780
  misc_feature 1..43: note = hyper
  source 1..43: mol_type = genomic DNA
ccagggaaatgtcaacgcgaggggggcgcgcctgctgctcttt

SEQ ID NO: 31852 - DNA, 100 bp, Homo sapiens
  misc_feature 1..100: note = chr8:25899320-25899420
  misc_feature 1..100: note = hyper
  source 1..100: mol_type = genomic DNA
aactagtccaaggggcgtttgctccgccgtcagtccataaccaggcgctactaaggcctccaggctcggtgcgcagagccgggagcgctcctccagctcc

SEQ ID NO: 31853 - DNA, 285 bp, Homo sapiens
  misc_feature 1..285: note = chr8:25900408-25900693
  misc_feature 1..285: note = hyper
  source 1..285: mol_type = genomic DNA
gggacagagacagggcggaatcctcgcgaccagccccggggatcgctggccaccacaaatgagatgaccgacatagggggccctccctcccagaggtgctaggtggggaaaagccaaactgttaaaaggcgagaacctcctttcctggggccaacgcgatccccactcatgctgcgttttctggcggcgccagccgaacccagtgactgtgaaacccaagttgggggacccggaaggcgccctcgagcgtgctgagtgtgtgcacacgcttcccagccaaccggt

SEQ ID NO: 31854 - DNA, 237 bp, Homo sapiens; identical to SEQ ID NO: 3223
  misc_feature 1..237: note = chr8:25900780-25901017
  misc_feature 1..237: note = hyper
  source 1..237: mol_type = genomic DNA

SEQ ID NO: 31855 - DNA, 187 bp, Homo sapiens
  misc_feature 1..187: note = chr8:25901018-25901205
  misc_feature 1..187: note = hyper
  source 1..187: mol_type = genomic DNA
ggccagtcccgaagcgctgcggaaagccgcggccgccgcgctgtgcggtctgccggagggaaatccgcgctccccgggccacaggagggagggaaccgccgccggcccaagtcccggagcgataaaacttctgctttctccgctccaagggtagaggccggttcgctctacccgggacacctggcca

SEQ ID NO: 31856 - DNA, 645 bp, Homo sapiens
  misc_feature 1..645: note = chr8:25901540-25902185
  misc_feature 1..645: note = hyper
  source 1..645: mol_type = genomic DNA
gcctctttcttcttccgcaactctttctactgtgactcagtattttctcttcttttaaatctcttcttttctccagttccctagctccgttcgtctggctcactgttttatctttgagccgggaccctccagcctgtcccccctcccagagctcccggccgcctcgtcttcccgggcagccgctccggcttttcccgctcccctcgccgccgccaccctctggccgccggcctcccaggctccaggaatcgcccagcaagatgcgggaggtaggcgctcgcaggcggcgtggcgaagccaagagtggccaggaagccggctttcctcccgcgccgccactgccagcgccggtgttcacgctccgttcggggccaggccggctcggcttgcaggactaggggctgagctgggagatgttgggggctactttatttttccttgcaaagagtggactgtggtaaaggagagggagagaaacgcctacgacccaggcagttcaggaactcgagtgccggctgccgggtgagcgttcgcctgactgcagcgatctgcttgcccgagggcgagccccagcgcgcagggcctgggcgacagatggggggacagggagagagaaaggcacggggtgcgcggggggggtgcaca

SEQ ID NO: 31857 - DNA, 50 bp, Homo sapiens
  misc_feature 1..50: note = chr8:25902919-25902969
  misc_feature 1..50: note = hyper
  source 1..50: mol_type = genomic DNA
ctacggccctggctgcgggaggcggagctgcggcccgataaggagcctca

SEQ ID NO: 31858 - DNA, 235 bp, Homo sapiens
  misc_feature 1..235: note = chr8:25903631-25903866
  misc_feature 1..235: note = hyper
  source 1..235: mol_type = genomic DNA
gccggggagtattcccgcgggtcctccggttccctccccacctctccgttcccgaagcccccggtagtgggcggggagggacgggggagtcgtggaaacttcgcccaccgcgcgcggtcgccgcggtgctggccgcgggctggtggccggcaggcggtggcagcagcctcaccgaacagctgaaaccctagacggttttttaactgcgcggggctgctcgcggtgcctattaaac

SEQ ID NO: 31859 - DNA, 210 bp, Homo sapiens
  misc_feature 1..210: note = chr8:25904157-25904367
  misc_feature 1..210: note = hyper
  source 1..210: mol_type = genomic DNA
ttaggtgtaggtgagcgctcgcaaatgaactgctagagtttgccgctagaggacacagcgccttgcaactggtttgcctaggctgacaggaagcttgcacttcaagaaaactcggctctctcgagaaagggaccggtgcgcgcctccacctccccaagggacaaaccgcggcaccacgctgcgtgcgcgggattgcgactaggaagtgct

SEQ ID NO: 31860 - DNA, 122 bp, Homo sapiens
  misc_feature 1..122: note = chr8:25904898-25905020
  misc_feature 1..122: note = hyper
  source 1..122: mol_type = genomic DNA
agagtgtggaacagccgtgagcccttcaagacatgcctatgagcccggtgatttttttttcaagggggctttgatcagctgtacctccacgttgccccggaaaggtgcgcagggcacccgga

SEQ ID NO: 31861 - DNA, 378 bp, Homo sapiens
  misc_feature 1..378: note = chr8:25905251-25905629
  misc_feature 1..378: note = hyper
  source 1..378: mol_type = genomic DNA
tcccagccaaccccccgagacgcgctcaggggcctcggtgccccgctgggaggcaatttgggggagccgtggtcccgaactttgacagagtggggcttccccactacttgccggctgcgctaagggcgccccccgcggcagtgctgctgggagctccagggatggctgtgtggctcgctgcgggcgttgaagttccctgttggccaggctgaagtgcctgcgcgagcgtgaggggacaaggactgccttgggcccagcgtggcggcgtttcggccaacccagttggggttaattgcgtctgtataggttttgggtaggaatgctcgcggagtccgccacccgcgcgaaacatgcgttggttgggggaatgagcagcgg

SEQ ID NO: 31862 - DNA, 130 bp, Homo sapiens
  misc_feature 1..130: note = chr8:25905695-25905825
  misc_feature 1..130: note = hyper
  source 1..130: mol_type = genomic DNA
cgatctcgtgcaacacaaaacctgccccgagctgtgcgggggcctggcaagcgcagctgcggccccgggaagcccaatcccgcgggactgcggagcccacgcgctcctcaggctccggccaactagctcg

SEQ ID NO: 31863 - DNA, 57 bp, Homo sapiens
  misc_feature 1..57: note = chr8:25907271-25907328
  misc_feature 1..57: note = hyper
  source 1..57: mol_type = genomic DNA
tgtcatcactatttacggtgcagcgatcagggcaagttgacccgcattaaaaggcct

SEQ ID NO: 31864 - DNA, 10 bp, Homo sapiens
  misc_feature 1..10: note = chr8:25908415-25908425
  misc_feature 1..10: note = hyper
  source 1..10: mol_type = genomic DNA
gcaatcattt

SEQ ID NO: 31865 - DNA, 402 bp, Homo sapiens
  misc_feature 1..402: note = chr8:25909197-25909599
  misc_feature 1..402: note = hyper
  source 1..402: mol_type = genomic DNA
gcacagggactggatcgctcagtgggtgataagctttttgtttgttccgcatggaattgcatgtgagaaaagcgctttggaagctgtttggtgcacgcgggcgtcagagggcaccgtaggtcactgagcggggtctcacccagggagagaatgcgacttcattcctaggaggctgtgctgggggctccgcgctgcgcgcggcagtgagtagggcgcaccccgaatgcaagtgcggttcgctgcgtggccgcgtgctgggatggatcgcggaactcgctagataattgaagatctcgaggagctctgaaatggatcttcggtttctacgacaaacccccgtcgatgagtggttcacagagagcttggggagcccctccccgccctgcgccctcaggaagagac

SEQ ID NO: 31866 - DNA, 47 bp, Homo sapiens
  misc_feature 1..47: note = chr8:25909600-25909647
  misc_feature 1..47: note = hyper
  source 1..47: mol_type = genomic DNA
cggctcgcctgacactactggtctctgtctcccgagagccagagccg

SEQ ID NO: 31867 - DNA, 36 bp, Homo sapiens
  misc_feature 1..36: note = chr8:26306055-26306091
  misc_feature 1..36: note = hyper
  source 1..36: mol_type = genomic DNA
gctgcgcgcttccagcgccgtcggtctggggtttct

SEQ ID NO: 31868 - DNA, 145 bp, Homo sapiens
  misc_feature 1..145: note = chr8:26370760-26370905
  misc_feature 1..145: note = hyper
  source 1..145: mol_type = genomic DNA
accccgtctttaagtcgtggccctgggctggaattcccgactgcactctttgctacacccccatagaccgcagacctgcgtctctctctatattcctctcccatctgctacgcccctctgaatttcttcccgccatgttgtgtgc

SEQ ID NO: 31869 - DNA, 159 bp, Homo sapiens
  misc_feature 1..159: note = chr8:26372761-26372920
  misc_feature 1..159: note = hyper
  source 1..159: mol_type = genomic DNA
cccttgactcctgctcgcagcgtgagaagagccaggaaggctgtggagtcacccgaggaaaccgagacgctcctaaatagcctatgtggggaacaaagttccaataagtgtctcagccggggcttcacagagcgctccccaaaccgctatgtgggaggc

SEQ ID NO: 31870 - DNA, 74 bp, Homo sapiens
  misc_feature 1..74: note = chr8:26723005-26723079
  misc_feature 1..74: note = hyper
  source 1..74: mol_type = genomic DNA
gcgctacaggttgggcgctgctcctggcccgcagttacctacattttgagctgccccaccgaaggctcctgctc

SEQ ID NO: 31871 - DNA, 264 bp, Homo sapiens
  misc_feature 1..264: note = chr8:26723320-26723584
  misc_feature 1..264: note = hyper
  source 1..264: mol_type = genomic DNA
cttcggagctcatctcgcgcccccaccactgggaacctgcctagcgcactctactgagtcacctctgcccgagttcaggatccgaagcgaaaaacaaacaaaaaaacaaatccccaaaaccccaggctccagcgctcgaagtctggatttcgagcgcaggtaccacgaaattaaaatcctcgaagccccggaggggcgactgcggctggcgagtgtgtcgcacggatcctagccggggaattctggaggatgtactcggtttcc

SEQ ID NO: 31872 - DNA, 855 bp, Homo sapiens
  misc_feature 1..855: note = chr8:26723585-26724440
  misc_feature 1..855: note = hyper
  source 1..855: mol_type = genomic DNA
ttagaacaggttgcctcgcagtcacctggagggggcggcctgggagagggaacagctgcgacccagggacctcagggccaggaccacgagcacgctcactctcacgccggtggaattcgcactcgggtgtgcagagcgcaccggtctgtccaccagccaagctggcttgagagccaggtcccgagcgaagccgggagggacccgaagacagaaagcgacccaggtctgtccacgacgcctttccaagcctcactgttggccacccgaggggctccagctgccagccgtagcgggactggcgggggacggggtggggaggacgtccctctgcagagggagctttgcaagtgacagtcactgcggattttgcaggcgtaaacattaagccggcatgccagcgggcaggggccgccttcgattttctgggctgggggccaccatctgcgtaagaaacctgggtttccacaactgcgaacctaccgcagggactcggcaggacagcgcggcgtgaggaagtgcccaccttgccttctggggttgggccctgaggtgggacctcgggcaaagactcttgttaaaatcgcaagttggagacctcacaggtggtattaaaaacgtgccactgcagaaacccttttcctcctacctcgagggtgataaacacagggttaaaaagacacttgttcagtagaaggcaacttcgcagaagatgtaagggaatcgggggtggggtagaggggccggtataaaacctggtggaaaaagcgggaggcgctgggaaaagtgggggttccgtctcaccagacggcgggggaggtctgccctcacccactcggccctgcgggacgccggccc

SEQ ID NO: 31873 - DNA, 169 bp, Homo sapiens
  misc_feature 1..169: note = chr8:26724484-26724653
  misc_feature 1..169: note = hyper
  source 1..169: mol_type = genomic DNA
cgcgggggatgtggacccggcttcggtcccgggagctgcctgcctgctcttctctggaggcggagaggggaccgtgtctccgaggcaccaaatccttgtccttttgcacccgctgactcacccctccaccactgatgtctttaagctcctgaaccgctgtcactttacc

SEQ ID NO: 31874 - DNA, 77 bp, Homo sapiens
  misc_feature 1..77: note = chr8:29209803-29209880
  misc_feature 1..77: note = hyper
  source 1..77: mol_type = genomic DNA
tcccccactgggccccgaatgcctcgacccccgggccctactcggatgagctgtaggggcaccgcttgggcaaggtg

SEQ ID NO: 31875 - DNA, 33 bp, Homo sapiens
  misc_feature 1..33: note = chr8:29387334-29387367
  misc_feature 1..33: note = hyper
  source 1..33: mol_type = genomic DNA
aaacaacaaaccacgcggcgttctctggtggct

SEQ ID NO: 31876 - DNA, 30 bp, Homo sapiens
  misc_feature 1..30: note = chr8:29387658-29387688
  misc_feature 1..30: note = hyper
  source 1..30: mol_type = genomic DNA
ttcattatttatctccgaaagccctgtctg

SEQ ID NO: 31877 - DNA, 35 bp, Homo sapiens
  misc_feature 1..35: note = chr8:30243388-30243423
  misc_feature 1..35: note = hyper
  source 1..35: mol_type = genomic DNA
aaagttttgtgactgcggagcgttccttcggtgga

SEQ ID NO: 31878 - DNA, 572 bp, Homo sapiens
  misc_feature 1..572: note = chr8:30769168-30769740
  misc_feature 1..572: note = hyper
  source 1..572: mol_type = genomic DNA
aaacttgaagggaaccgtggtatcttcaaagtctccgagttgccagcgacctcagcctctccactttctcgaacatcatccctgggcactgtctcccgacacagccagcgcggtggccatgcgcctcaaaccgagcattccaaacgcggaaactcaaccccgagcgcggagaggatggaaactgcctgaaaggatctgtgcagggctgggcttgggacgcggctcacacgaaactgaggcaggagtctcttcctgcacccgcaccacgccgggacccgaggggtttcactcccttcactgagccgagccaggaagccaagagccaccagggcgaagcagccctgcaaaacctccactcagccttacaacagccacagcgccgggacacgcggcaccgcatcccgggcgcgccagtcctcctgcagtcgggggacgctcccctcaggcgcccgcgtcggagcccagctacccccgcgccgccctcacctaccgaggctcccccgcgtccaccggctcctgcagcgagacagccggcgcaggcgggcatggtccgagcgcgggctctgcagggg

SEQ ID NO: 31879 - DNA, 59 bp, Homo sapiens
  misc_feature 1..59: note = chr8:30769987-30770046
  misc_feature 1..59: note = hyper
  source 1..59: mol_type = genomic DNA
accaccaagttgtggcgctctctcctctcgctgcctcagagcagcgagtttctcctcag

SEQ ID NO: 31880 - DNA, 129 bp, Homo sapiens
  misc_feature 1..129: note = chr8:30890252-30890381
  misc_feature 1..129: note = hyper
  source 1..129: mol_type = genomic DNA
cgcggccgcggccgccgccgcctccccttcgcctggctctttccatcttcagctgcaagtaacaaacagacacacgggatggggtgggggaggggtgttgagaacaatcgcagacgcccctcggcctga

SEQ ID NO: 31881 - DNA, 411 bp, Homo sapiens
  misc_feature 1..411: note = chr8:31496433-31496844
  misc_feature 1..411: note = hyper
  source 1..411: mol_type = genomic DNA
cagtaaaagaaaaggcgggggtcatgaagaccgaaggatcaaaggagcatggagtagaggaggcgtcacatctgaagtgcacactgtgtgtgcgcgctgcaaggagagagagcgttataaagttgttgttttaatcgctgcttgtcgcctgcgaacatgttgctcccttttaagtgtcaagcaacgggttcacccaaaacttttctgcaccgaggacccgcacgcccggggtcccacctgcccctctctgcctgcctcccaccggcgcctgggcatcctgcgccggctacaggtccttgctcactgaagcgtcacctctcactccccagtaagcctccgcagcccactcggactgcagcctgtttgccgcccgtcctcccattgcagcactcggggcgacagagagggagg

SEQ ID NO: 31882 - DNA, 513 bp, Homo sapiens
  misc_feature 1..513: note = chr8:31497448-31497961
  misc_feature 1..513: note = hyper
  source 1..513: mol_type = genomic DNA
gagccgggcagagtccgaaccgacagccagaagcccgcacgcacctcgcaccatgagatggcgacgcgccccgcgccgctccgggcgtcccggcccccgggcccagcgccccggctccgccgcccgctcgtcgccgccgctgccgctgctgccactactgctgctgctggggaccgcggccctggcgccgggggcggcggccggcaacgaggcggctcccgcgggggcctcggtgtgctactcgtccccgcccagcgtgggatcggtgcaggagctagctcagcgcgccgcggtggtgatcgagggaaaggtgcacccgcagcggcggcagcagggggcactcgacaggaaggcggcggcggcggcgggcgaggcaggggcgtggggcggcgatcgcgagccgccagccgcgggcccacgggcgctggggccgcccgccgaggagccgctgctcgccgccaacgggaccgtgccctcttggcccaccgccccggtgcccagcgccggcgagcc

SEQ ID NO: 31883 - DNA, 158 bp, Homo sapiens
  misc_feature 1..158: note = chr8:32404798-32404956
  misc_feature 1..158: note = hyper
  source 1..158: mol_type = genomic DNA
aaggagtaggtttcacgcgcagttctgagtaaagtttgaatctgagaaaccccacattcacgaattaaggatctccagttctgtgtctttattctacccctccctgcctgcttttccactcggcagaactgagtgactttcagcggctgcagtaattt

SEQ ID NO: 31884 - DNA, 60 bp, Homo sapiens
  misc_feature 1..60: note = chr8:32405453-32405513
  misc_feature 1..60: note = hyper
  source 1..60: mol_type = genomic DNA
agcagccctcccaggcgctgcctggctgcggaggggagcgggcagcgagagcctcgggtc

SEQ ID NO: 31885 - DNA, 30 bp, Homo sapiens
  misc_feature 1..30: note = chr8:32405729-32405759
  misc_feature 1..30: note = hyper
  source 1..30: mol_type = genomic DNA
ggccaggggagggtgcgaaggaggcgcctg

SEQ ID NO: 31886 - DNA, 217 bp, Homo sapiens
  misc_feature 1..217: note = chr8:32406020-32406237
  misc_feature 1..217: note = hyper
  source 1..217: mol_type = genomic DNA
gagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctc

SEQ ID NO: 31887 - DNA, 419 bp, Homo sapiens
  misc_feature 1..419: note = chr8:32406509-32406928
  misc_feature 1..419: note = hyper
  source 1..419: mol_type = genomic DNA
cgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctac

SEQ ID NO: 31888 - DNA, 53 bp, Homo sapiens; identical to SEQ ID NO: 9466
  misc_feature 1..53: note = chr8:32406929-32406982
  misc_feature 1..53: note = hyper
  source 1..53: mol_type = genomic DNA

SEQ ID NO: 31889 - DNA, 213 bp, Homo sapiens
  misc_feature 1..213: note = chr8:33371806-33372019
  misc_feature 1..213: note = hyper
  source 1..213: mol_type = genomic DNA
gcctgtagccacaagcgtttgaaaattcaaattctagcgtcaaggtagaagcccccagctggcgtctggggcagccctgagggaggtgggtcgtcgggttggcggatccggcttgggcccgccccgccagtgtcggcgccgggtgcgcagggacagcagagcgctgtcttgggcatgggtcgcaggcggcgcccggaacgggccaggggagct

SEQ ID NO: 31890 - DNA, 272 bp, Homo sapiens
  misc_feature 1..272: note = chr8:33457107-33457379
  misc_feature 1..272: note = hyper
  source 1..272: mol_type = genomic DNA
tcgcccctagctgggcgcctctccccagcgtggagagccagctgaaaaggcgaaggcccgccgcagcccctctacctctttgcaagcgctgcgctgggcctcagtccgaaaggcggatcgccggcgcagacagcgccacggccatgacgctcctgctgctgtcgccgccgctgtttctgcccaagacaggttgacagattagcagctatttttaagccatgacacacacgtcgaagcagggttcaaatcagcgtgtgcgctggtgacataaa

SEQ ID NO: 31891 - DNA, 30 bp, Homo sapiens
  misc_feature 1..30: note = chr8:35092643-35092673
  misc_feature 1..30: note = hyper
  source 1..30: mol_type = genomic DNA
actgagttaggcaaccgagatgcccacata

SEQ ID NO: 31892 - DNA, 124 bp, Homo sapiens
  misc_feature 1..124: note = chr8:35093036-35093160
  misc_feature 1..124: note = hyper
  source 1..124: mol_type = genomic DNA
cggcggggactgcgggcgactccggcatccgcgctggcggcagcggtcgccgcgccgtgggaagctatggggacgcgccctttctcggggtgcccattcagcggcggctcggagctccctgccc

SEQ ID NO: 31893 - DNA, 79 bp, Homo sapiens
  misc_feature 1..79: note = chr8:35093225-35093304
  misc_feature 1..79: note = hyper
  source 1..79: mol_type = genomic DNA
cgggaccctcatcgccgaccctttcccgggctcccggagcgtgaagaagagccgccctccggaacgcggcgaggagcat

SEQ ID NO: 31894 - DNA, 23 bp, Homo sapiens
  misc_feature 1..23: note = chr8:35093951-35093974
  misc_feature 1..23: note = hyper
  source 1..23: mol_type = genomic DNA
gccagccctggagctcgggagag

SEQ ID NO: 31895 - DNA, 278 bp, Homo sapiens
  misc_feature 1..278: note = chr8:37552317-37552595
  misc_feature 1..278: note = hyper
  source 1..278: mol_type = genomic DNA
aagtgctttttcccccggagtgagaaggatgggggggcggaggggttgtgttgccgagcagcgcttagagagagatccccctccagggacacccgcctcgcccgtgatctcggtctctcctcgtagcagctgggcgcggtacagtgaggaacttcacgcccctcagcaggacacggtaagaagcctgtaacacaccagacaccgagcctctaacgcagggcgcaggcacagcgcgcacagcctggggtcccgcgcttggtcgccgaccatgtcactcc

SEQ ID NO: 31896 - DNA, 63 bp, Homo sapiens
  misc_feature 1..63: note = chr8:37655313-37655376
  misc_feature 1..63: note = hyper
  source 1..63: mol_type = genomic DNA
gtgaagtggagagcacgcctgcagggcacccacgccccggatttccagcctggactagggttg

SEQ ID NO: 31897 - DNA, 516 bp, Homo sapiens
  misc_feature 1..516: note = chr8:37655475-37655991
  misc_feature 1..516: note = hyper
  source 1..516: mol_type = genomic DNA
cgtcccggactgggctggaggagtctccggatttacctggctggccttgtcccttcaattggggtcatcccatccttgccccctggcctgccagcgccgcttccagccggtctccttagggcaaggggaggctgggctcagaaaagtcggcccttggaataccggcgctcctgggctgcaggagaccctggcgtccccatccctctagaggcccctctcccacggcgccgtttgtgcagtgagctctgtgctgggtcccgcgtccttgcctctcctttgcctctcctggaagtaactcgagctttggctgtttctccattgacttcgcgcaaagattgcgaagaaagaaacgcggctggggaagcggggttccctcaccgcagcccacccgggcctccttccgcgacttccctcttagtcagggcctcagtacgcctttgctttgctggcagcgagcgctgcagcgccgcagcccgaccccaagcctcctacaagggggtcgcaagtcccagcagc

SEQ ID NO: 31898 - DNA, 165 bp, Homo sapiens
  misc_feature 1..165: note = chr8:37656049-37656214
  misc_feature 1..165: note = hyper
  source 1..165: mol_type = genomic DNA
cgcagctccacgcacgccgtggatttgagggtcgggcccccgcggccgccgcttcctttcctgtcccaaatccagcctaagagccgcttccctttccctgtcctcctgaccccagtggcaaccgtttctccaccgccccttgcccgcagtcggggctggcccagt

SEQ ID NO: 31899 - DNA, 692 bp, Homo sapiens
  misc_feature 1..692: note = chr8:37822717-37823409
  misc_feature 1..692: note = hyper
  source 1..692: mol_type = genomic DNA
gacccacggacacatcgcatgcttcccgaccctgagccgccggtccctctgccccggttacctacccgtcgagccgttggcaaagcctgggctgcgctgggctgctccgggccgcaggaacgcccgaggggaagagggccgggcgggcggcggcgcagggctccggaggcaggcgacggccgcagcggcacagaagacggcggaaggcgctgcgaaagtccgggctgcggcagtagatgagcgggttgaaggcagaattggcataacctagccagttcagggcaaggaaagccgggcccgggactagagaggggccccccagggcgcgcagcacgttggccagaaagaagggcaaccagcagagagtgaaggtgcccatgatgagacccaaggtgcacagggcccggtgttcccggagaggcaggaggcgcgcgggccgccggccgcaggcgggcaccccttcgggcggagcgcacgtccccaccggggccggggccagagagcgcgacggcgccggcggagactcctcgggcggaaagcggcccagctccccgcgcagcaagcgcagctggcgcgtagccaccacgaaaacccgcgcgtagacgaagagcatcacgagaagaggaaggtagaaggagacggaggaggacagcagcacgtagggcatgttggaggcgaaggcacagcagcgc

SEQ ID NO: 31900 - DNA, 65 bp, Homo sapiens
  misc_feature 1..65: note = chr8:37823410-37823475
  misc_feature 1..65: note = hyper
  source 1..65: mol_type = genomic DNA
ggttggagtggcagcgctgcgcctcggcgtcggcccctacgcgccaccactggctcatgatgggc

SEQ ID NO: 31901 - DNA, 56 bp, Homo sapiens
  misc_feature 1..56: note = chr8:37823476-37823532
  misc_feature 1..56: note = hyper
  source 1..56: mol_type = genomic DNA
caaacgacaccgcggccgacacgacccacaccaggaccacagctgtccgggcgcag

SEQ ID NO: 31902 - DNA, 389 bp, Homo sapiens; identical to SEQ ID NO: 769
  misc_feature 1..389: note = chr8:38008209-38008598
  misc_feature 1..389: note = hyper
  source 1..389: mol_type = genomic DNA

SEQ ID NO: 31903 - DNA, 328 bp, Homo sapiens
  misc_feature 1..328: note = chr8:38323407-38323735
  misc_feature 1..328: note = hyper
  source 1..328: mol_type = genomic DNA
tcaccttaattaccacgtctagagaaagtgcgatttcattacagcctccaaaactaccgcccaaagaaggaaaccagagaagtgttttcaatttgaaagaggctggaaagaagcgggtaagacaccgactctccccaccctcccggcaactttggaccacaaggcgctttcctgcctcaaagactattaccaaacacaactcgaaaatccaaccccgctttcaaacctgtagccgttatttaaacggtaaaacaccccactttagtttccgggggatgcggcccaaatcagtccttaaaaacacacagagagcgcctctggcagcagc

SEQ ID NO: 31904 - DNA, 400 bp, Homo sapiens
  misc_feature 1..400: note = chr8:38323755-38324155
  misc_feature 1..400: note = hyper
  source 1..400: mol_type = genomic DNA
cgcaccgggcttgctccgggaggggcgcgtgacgccaccgcggggcagccgagaggggaccgcgggctccgggcagggcaggcgctcccgcagctccagctataacacaagggagagaaagcaacgctttggttccagaaacttccatcgtcaaggccagttctggccagacgcacagccaaagagcccccctagtctagcggatgaaccgttcgcgagtggcaccccctaaaaccttggccccatctcccaagatgcctctttactgcgcaatccagaaagcacccggaccgccgccacccaccagcggcggcgaataacttggtgagatcttaaataactcgggatccaagggaactttcttttctcccccgaatctcaacgccgcatctccaagtct

SEQ ID NO: 31905 - DNA, 61 bp, Homo sapiens
  misc_feature 1..61: note = chr8:38324661-38324722
  misc_feature 1..61: note = hyper
  source 1..61: mol_type = genomic DNA
gaaccagattgggaccgaacggtccttccgcccccatcccacacctcggcttaacgaccgt

SEQ ID NO: 31906 - DNA, 279 bp, Homo sapiens
  misc_feature 1..279: note = chr8:38325771-38326050
  misc_feature 1..279: note = hyper
  source 1..279: mol_type = genomic DNA
ccccctcctccagaacgcagcggcggcgcctcactttccttgcagaccgggctccatcgccctgcggaggccccggcgccgcggcgtgcccgactgcagcacgggtaccgtgcgccctgcggggcgccccgagctcggaccggagaaaagtccttgggttccgcggcttttcaagcagcggcgcgctcgcggccggggaaggcgaggtcgccgcaatgcgctacgaggggtctcggtcccgtccggacgtggccgcccagctcccggcacacccgggtt

SEQ ID NO: 31907 - DNA, 33 bp, Homo sapiens
  misc_feature 1..33: note = chr8:38326276-38326309
  misc_feature 1..33: note = hyper
  source 1..33: mol_type = genomic DNA
gcgggccgagctgtccggcgctctgcccttctc

SEQ ID NO: 31908 - DNA, 45 bp, Homo sapiens
  misc_feature 1..45: note = chr8:38614816-38614861
  misc_feature 1..45: note = hyper
  source 1..45: mol_type = genomic DNA
aggagggtgcagccccggccccaagttctgcgccatgggaggctc

SEQ ID NO: 31909 - DNA, 26 bp, Homo sapiens
  misc_feature 1..26: note = chr8:41165893-41165919
  misc_feature 1..26: note = hyper
  source 1..26: mol_type = genomic DNA
cagagctgccgctcccgggccagccc

SEQ ID NO: 31910 - DNA, 152 bp, Homo sapiens; identical to SEQ ID NO: 3231
  misc_feature 1..152: note = chr8:41166000-41166152
  misc_feature 1..152: note = hyper
  source 1..152: mol_type = genomic DNA

SEQ ID NO: 31911 - DNA, 414 bp, Homo sapiens; identical to SEQ ID NO: 3232
  misc_feature 1..414: note = chr8:41166266-41166680
  misc_feature 1..414: note = hyper
  source 1..414: mol_type = genomic DNA

SEQ ID NO: 31912 - DNA, 244 bp, Homo sapiens; identical to SEQ ID NO: 3233
  misc_feature 1..244: note = chr8:41166745-41166989
  misc_feature 1..244: note = hyper
  source 1..244: mol_type = genomic DNA

SEQ ID NO: 31913 - DNA, 332 bp, Homo sapiens
  misc_feature 1..332: note = chr8:41167025-41167357
  misc_feature 1..332: note = hyper
  source 1..332: mol_type = genomic DNA
cgcgcagccaatcagctcccggcggggcgagccgcactcgttaccacgtccgtcaccggcgcgggagccaatcgcctccctcgcgagcgggttcggtttactagaaccagacgcggctcaacaccccttaaaaaacaaaaccaaaaatacataaataaaagggggaggaggaaagagacaaggggagaaaaagaaggggaatggatcacggcgtggggtggagagagaccagggcggacgctgtaattaactcgcattggcttgcagagaagcggggagcctggatcatacttgcaaacccatgaaattatgaagactttttttttttgaga

SEQ ID NO: 31914 - DNA, 197 bp, Homo sapiens
  misc_feature 1..197: note = chr8:41424669-41424866
  misc_feature 1..197: note = hyper
  source 1..197: mol_type = genomic DNA
ctacctctgctgcagcgtacctcttccgcagccctagcggcctccccgaggggcgccgcggcctcggctgtccctcccctgcctggcacgaccacctgacccccagcgacccaagaagcaagttgtgtttgcagacgcaaaggggctgtcgttggtatcggtgcactggtttgaagccactgcgggcacagcctgaa

SEQ ID NO: 31915 - DNA, 467 bp, Homo sapiens
  misc_feature 1..467: note = chr8:41503858-41504325
  misc_feature 1..467: note = hyper
  source 1..467: mol_type = genomic DNA
aagactcagtccctgcgcccccaggagcgtggggaaggggaggggaaggtaggctcctcggcgtccccccgcaggctgcagccaggatcccgggcctggacggcgggcgtcagacgctgtgcgctcccaggctgagcaccgagaaggcggcgcggtgcttgcgcagcagcaggcggatcttctcgtcgtccgagtcggggtccagcggcttgttgtactcgtcgtcctcgttctccgagggtgcgcggtccccgcctgcgcctgcacccgcgccgcccggggcccggggcgtggaggacgagggctccagggcgctcttcttccgccacttggtcctgcggttctggaaccacacctgcgatgagaaagaatgtgaagggcacaggggcacagcgcgcacgggacgcgagaacagccatcctgcttttacagctaaacaaatggctcaacaacggagtgactgtcac

SEQ ID NO: 31916 - DNA, 55 bp, Homo sapiens
  misc_feature 1..55: note = chr8:41511052-41511107
  misc_feature 1..55: note = hyper
  source 1..55: mol_type = genomic DNA
tggagctgcggggtccgcgggggcgctaagggggctactgggttggctgcagcag

SEQ ID NO: 31917 - DNA, 84 bp, Homo sapiens
  misc_feature 1..84: note = chr8:41511147-41511231
  misc_feature 1..84: note = hyper
  source 1..84: mol_type = genomic DNA
cgagccctgagcccagcttccttgggccgtcaccgaatcggtcccagccgcgctgtgcggcccccctgccgtggcccccgggat

SEQ ID NO: 31918 - DNA, 63 bp, Homo sapiens
  misc_feature 1..63: note = chr8:41511489-41511552
  misc_feature 1..63: note = hyper
  source 1..63: mol_type = genomic DNA
agcagggcccctctccgctcacaggccccgcggccagggggcctctgacgtggagggggcttc

SEQ ID NO: 31919 - DNA, 15 bp, Homo sapiens
  misc_feature 1..15: note = chr8:41624546-41624561
  misc_feature 1..15: note = hyper
  source 1..15: mol_type = genomic DNA
gcggctccacgctcc

SEQ ID NO: 31920 - DNA, 451 bp, Homo sapiens
  misc_feature 1..451: note = chr8:41624633-41625084
  misc_feature 1..451: note = hyper
  source 1..451: mol_type = genomic DNA
cgcagccttcaggccagaggaattttcctctggatcctgctagaagcctcggcagcagaagggcagccccagcgcgcgcacccgcacccgccggggaaagttggcgccgggcagccgggcgcggagccacaacccgcaggacggacgcagagccccggccccggccccggccccgatccccgcgccccggccccggccgggcaaccgcgacagctcgtgcactcaccgcagggtctggcccggacctgccctgtcgcgctgccatcgtccggcgcccgcgctgaaatccgagcccggctcccgctccccctcccggttatctgctgggcggcgcggggagcgccagcaagttacgcggcatctggctaaaaatacaggcgccctccactcgccccggcccggccctggccctgcgctctcccgcccgccagcctgccgctaatgggatctc

SEQ ID NO: 31921 - DNA, 30 bp, Homo sapiens
  misc_feature 1..30: note = chr8:41625311-41625341
  misc_feature 1..30: note = hyper
  source 1..30: mol_type = genomic DNA
tccctccctgcctcccgcctccccgaatgc

SEQ ID NO: 31922 - DNA, 30 bp, Homo sapiens
  misc_feature 1..30: note = chr8:41655464-41655494
  misc_feature 1..30: note = hyper
  source 1..30: mol_type = genomic DNA
tgcttgtctaaaagtcgctgggtgcagggg

SEQ ID NO: 31923 - DNA, 144 bp, Homo sapiens; identical to SEQ ID NO: 9488
  misc_feature 1..144: note = chr8:41686308-41686452
  misc_feature 1..144: note = hyper
  source 1..144: mol_type = genomic DNA

SEQ ID NO: 31924 - DNA, 239 bp, Homo sapiens
  misc_feature 1..239: note = chr8:41733415-41733654
  misc_feature 1..239: note = hyper
  source 1..239: mol_type = genomic DNA
ttgccttcatttctccggctgcatccgaggctccccagaggggccggcgcgcgcccgggcgcacactcgcacacctgcccgcgcgcacacacccgcgcctggccccgcgcgcgcacgtcccgcgacctcgcaggttcgcggcccgcaaccggcagggcaggagcttccaccaatcccctcgcctcacgcctcctgcccaaatatagaaaccgacttccttgtcctagagctcggagcgg

SEQ ID NO: 31925 - DNA, 92 bp, Homo sapiens; identical to SEQ ID NO: 9490
  misc_feature 1..92: note = chr8:41733684-41733776
  misc_feature 1..92: note = hyper
  source 1..92: mol_type = genomic DNA

SEQ ID NO: 31926 - DNA, 428 bp, Homo sapiens; identical to SEQ ID NO: 3235
  misc_feature 1..428: note = chr8:41753325-41753753
  misc_feature 1..428: note = hyper
  source 1..428: mol_type = genomic DNA

SEQ ID NO: 31927 - DNA, 411 bp, Homo sapiens; identical to SEQ ID NO: 3236
  misc_feature 1..411: note = chr8:41753770-41754181
  misc_feature 1..411: note = hyper
  source 1..411: mol_type = genomic DNA

SEQ ID NO: 31928 - DNA, 1026 bp, Homo sapiens; identical to SEQ ID NO: 3237
  misc_feature 1..1026: note = chr8:41754182-41755208
  misc_feature 1..1026: note = hyper
  source 1..1026: mol_type = genomic DNA

SEQ ID NO: 31929 - DNA, 30 bp, Homo sapiens
  misc_feature 1..30: note = chr8:41755524-41755554
  misc_feature 1..30: note = hyper
  source 1..30: mol_type = genomic DNA
cacaggacctccccccgccgccccccccaa

SEQ ID NO: 31930 - DNA, 129 bp, Homo sapiens
  misc_feature 1..129: note = chr8:42009878-42010007
  misc_feature 1..129: note = hyper
  source 1..129: mol_type = genomic DNA
gggaccactcaaaagcgtatccaagtcctgaggtctccaaagcggtggagagacccgcccagcccctcactccccggctgggaactgagattgtggagggtgggcgccctgccgcggcccagtggggct

SEQ ID NO: 31931 - DNA, 88 bp, Homo sapiens
  misc_feature 1..88: note = chr8:43102486-43102574
  misc_feature 1..88: note = hyper
  source 1..88: mol_type = genomic DNA
cgccgcagaggtcgagcgccgccagatgcgcagaagccgggacttgtacgcccgcgacaggaaagacaggcagcggggcctcagctcc

SEQ ID NO: 31932 - DNA, 527 bp, Homo sapiens
  misc_feature 1..527: note = chr8:48100170-48100697
  misc_feature 1..527: note = hyper
  source 1..527: mol_type = genomic DNA
gctgcagccgctgcacgctgcacacacacggcacagtccctgggtccgggagccagagcagcgccactcggagacgggatggttccgtgggttgtgtaggagcacaggaaagcggaggccgggccacacagcaccgcgaacccagcagcccaagcccagcggaccaagcagccacccccgggagccgccactgcctggagcagtcaccggcgggagcctccatttccaggagccgccaccgctgggagctgccacagccgggagccgccaccgccagaagcctccatctcccgggagccgccatcgctgggagccgccacctccaggagccgccacggccaccgggagccgtcaccgcagggaacctccatctcctggagccaccaccgctgggagctgccacctcaggagcagcggcagcactgggacccgccgggccccctcgcacccagcggctctgcaggtgccctacacccgggaggggccgagggagcccacgccgccggcgggaccgcagggatttgctg

SEQ ID NO: 31933 - DNA, 659 bp, Homo sapiens
  misc_feature 1..659: note = chr8:49292866-49293525
  misc_feature 1..659: note = hyper
  source 1..659: mol_type = genomic DNA
aaaggttgacaagagcggggctgggctccggcatgggcgcaaaaacaccagtgcggaggagttctcgggaccccccggggctgcggggccttgcggggacagccccaggcccggagctgcagaaacacccagaccccgcgcctcccggaaccacgcgtctctgtgcacagacattcctgggggcaggctcctgtcctttaacacagtctcaaaggagtcttcaaaaacaaaaagtttacaagcactgatagggaaaacagaaggatgataacaccaagagggactttcccgggagaggacggcttccagggactgagaaaggatgggcaagtgggcggggcccggcgccgtgcgggcagggctggcgccgggagtccccagactcccccgcagtgggaagcacctctcccattcacgccgggcaggacacctggccgggcgggggaggcagcgcaagggccggccggggagtacgggactcgagccggggacctgaggcaggagccaagcatcgtcgcagggcaaccagcagaacggagagggaggcgcgggggcgaaggctggcgggagccgcgctgagggcaggagcccggagccccctagggcagcgccgatccgcccgccccgtcccgccgagctgggcctccgtctgtggcctg

SEQ ID NO: 31934 - DNA, 37 bp, Homo sapiens; identical to SEQ ID NO: 3239
  misc_feature 1..37: note = chr8:49293580-49293617
  misc_feature 1..37: note = hyper
  source 1..37: mol_type = genomic DNA

SEQ ID NO: 31935 - DNA, 99 bp, Homo sapiens
  misc_feature 1..99: note = chr8:49309361-49309460
  misc_feature 1..99: note = hyper
  source 1..99: mol_type = genomic DNA
ttgggtgagagtctccgggtgactccccgcagctccccctgctctcacctccaccggcctccccccgccgtggttcccgcggtgcgccctccccaagtc

SEQ ID NO: 31936 - DNA, 160 bp, Homo sapiens; identical to SEQ ID NO: 770
  misc_feature 1..160: note = chr8:49468668-49468828
  misc_feature 1..160: note = hyper
  source 1..160: mol_type = genomic DNA

SEQ ID NO: 31937 - DNA, 362 bp, Homo sapiens; identical to SEQ ID NO: 771
  misc_feature 1..362: note = chr8:49468829-49469191
  misc_feature 1..362: note = hyper
  source 1..362: mol_type = genomic DNA

SEQ ID NO: 31938 - DNA, 36 bp, Homo sapiens
  misc_feature 1..36: note = chr8:49647817-49647853
  misc_feature 1..36: note = hyper
  source 1..36: mol_type = genomic DNA
ctcagttactgatctcgtgcgcggccctaacagacg

SEQ ID NO: 31939 - DNA, 189 bp, Homo sapiens; identical to SEQ ID NO: 9502
  misc_feature 1..189: note = chr8:49782697-49782886
  misc_feature 1..189: note = hyper
  source 1..189: mol_type = genomic DNA

SEQ ID NO: 31940 - DNA, 148 bp, Homo sapiens
  misc_feature 1..148: note = chr8:49782922-49783070
  misc_feature 1..148: note = hyper
  source 1..148: mol_type = genomic DNA
cgacgggcatcctgccctgcggaacacccacccgagccctgcgcgggaggggcggccgggaggcgcgcgggcatgcggaggggaaacagggctgcagcttcaagcccaggcaggacgcccttagtcaccttatcggaaagtgggcagc

SEQ ID NO: 31941 - DNA, 185 bp, Homo sapiens
  misc_feature 1..185: note = chr8:49833801-49833986
  misc_feature 1..185: note = hyper
  source 1..185: mol_type = genomic DNA
ttgaccaggaaggagcgcggcatcttgccagcgggtctggcgggcgcccggcgcggataacggtccggcgggaggacacggcggtccctacagcatcgcggcgggccaggctcgggcaggggccgtgctcaggtgcggcagacggacgggccggcgcctctgaagtcacccggctcctttacgaa

SEQ ID NO: 31942 - DNA, 49 bp, Homo sapiens
  misc_feature 1..49: note = chr8:49834319-49834368
  misc_feature 1..49: note = hyper
  source 1..49: mol_type = genomic DNA
cggggacacagtgtccgccaggagaaggaagggccgccctgcaccacac

SEQ ID NO: 31943 - DNA, 88 bp, Homo sapiens
  misc_feature 1..88: note = chr8:49834627-49834715
  misc_feature 1..88: note = hyper
  source 1..88: mol_type = genomic DNA
aagtactcatgtcaccgtgttagctatggtggcttgaaagaaatgctttgtagccctctaaaggcaggctgatcggaagaactggaag

SEQ ID NO: 31944 - DNA, 281 bp, Homo sapiens
  misc_feature 1..281: note = chr8:50822066-50822347
  misc_feature 1..281: note = hyper
  source 1..281: mol_type = genomic DNA
cataaccttaagcaacgttttcacatggactgaaaagcaaaagacccccttaaaaattagcctcaagcagcagatactctctttttaggtttgtgtgtctccgtgaggtcagatggattccccaaacacggttttagagagaatcacaacctttaatagatcctctgttaaaaaagactgttagagaaagttgaccaagggcttcgttccacggcgaccgtttcctgcgtgtgcagctccacacagcgaccgcggcctgcaatgtgcggagcacagcgcgg

SEQ ID NO: 31945 - DNA, 30 bp, Homo sapiens; identical to SEQ ID NO: 9506
  misc_feature 1..30: note = chr8:50822561-50822591
  misc_feature 1..30: note = hyper
  source 1..30: mol_type = genomic DNA

SEQ ID NO: 31946 - DNA, 323 bp, Homo sapiens
  misc_feature 1..323: note = chr8:50822821-50823144
  misc_feature 1..323: note = hyper
  source 1..323: mol_type = genomic DNA
gagaaattagtgttgcgccccgcccctcccggacccccgtccccaccacacacaccagcgcccctcaccagtctttctcgaatttcctctcatgtctatcaataacctccttgtgcagaaatctacactgcacaagttaggagtctgcaagggcgggcggtgttacagtctcgctctttccattttccccttttactccacatagtttcaaaggtccacatggccctggttttgaccagttttccaacagtttcaacgttatgtatttcaacttcccgtctcagttcactggcgtctgcacccgttgccgagtgtgggtggct

SEQ ID NO: 31947 - DNA, 126 bp, Homo sapiens
  misc_feature 1..126: note = chr8:50823361-50823487
  misc_feature 1..126: note = hyper
  source 1..126: mol_type = genomic DNA
aaaggcagagattgtcgagccctctgactgtctttgtgccttctttatcccgtcctttgtgaaataagccgttttctgcccccactgcaggagcctaggctgtgggcgactcgctagcactgccct

SEQ ID NO: 31948 - DNA, 174 bp, Homo sapiens
  misc_feature 1..174: note = chr8:50824134-50824308
  misc_feature 1..174: note = hyper
  source 1..174: mol_type = genomic DNA
gaaaaaaaaaagaaccggaggggagaaggctagggcggaagacaaggaagctgctgcttggattcgctggtggaggaaagtgcgacctggacctgcgcttaggggctcccgtccccttacttcagcaccagaggggatggacagcgtctccggactgagctgcagccacaggga

SEQ ID NO: 31949 - DNA, 20 bp, Homo sapiens
  misc_feature 1..20: note = chr8:50824352-50824372
  misc_feature 1..20: note = hyper
  source 1..20: mol_type = genomic DNA
cgccacgggcagctgggcta

SEQ ID NO: 31950 - DNA, 49 bp, Homo sapiens; identical to SEQ ID NO: 9511
  misc_feature 1..49: note = chr8:53477121-53477170
  misc_feature 1..49: note = hyper
  source 1..49: mol_type = genomic DNA

SEQ ID NO: 31951 - DNA, 304 bp, Homo sapiens
  misc_feature 1..304: note = chr8:53477433-53477737
  misc_feature 1..304: note = hyper
  source 1..304: mol_type = genomic DNA
tacttaactctcaaccgtggtaaatctaattcgcttacgacctctttccgagagctgggaatctgcagagatgctctgttttctgctgtactaatctcaggcttcccaaagcgagtgcctcgcccagctcctaggggaatccacggagccccaggcgcagggcaaaggatggggcgggatggggacatcgtacctgcgctccgggagccgctgggagtccggccggccccggccgcggggaggaaaagcaacggcttgggctccttatccgtgacgcgcgctcccctgcgcccccggggcctcc

SEQ ID NO: 31952 - DNA, 301 bp, Homo sapiens
  misc_feature 1..301: note = chr8:53477944-53478245
  misc_feature 1..301: note = hyper
  source 1..301: mol_type = genomic DNA
cgcgcctgcccttgtctacgtcccgggggtcggctggagctgcactgggactcggtcctcagtgtgccgaagcctaagcgctgcggggcgcggggcgggaacgggaggcggtgcctggggccacggggtcgtcccccaggatgagggcgtgtcccagcgcgcgggaccctcggaagtccgcgctgggccgggcgggcaccagcctcggactcagcgggtctcagggctccctgcgcaacgcctgcctcggatccggaccccgggctcgctctctggtcgccgtccccgggaggacccagta

SEQ ID NO: 31953 - skipped

SEQ ID NO: 31954 - DNA, 185 bp, Homo sapiens
  misc_feature 1..185: note = chr8:53478455-53478640
  misc_feature 1..185: note = hyper
  source 1..185: mol_type = genomic DNA
ctctgctgccgagcccctgctcgctcaggaacactggccacgccgtcacgccagccgcccctgccccaggtctggaggcccgacctgctctcctaggcgcagcaccgcgttctcttccgcgtgggggagcggcgggcggaagaggtctggggctgggcaccggggacacgcgcccagctcccctg

SEQ ID NO: 31955 - DNA, 48 bp, Homo sapiens
  misc_feature 1..48: note = chr8:53852136-53852184
  misc_feature 1..48: note = hyper
  source 1..48: mol_type = genomic DNA
acaggtagcagagagcgctcacgtggaggaggtttggggcgccgcggc

SEQ ID NO: 31956 - DNA, 715 bp, Homo sapiens
  misc_feature 1..715: note = chr8:53853744-53854459
  misc_feature 1..715: note = hyper
  source 1..715: mol_type = genomic DNA
ggtattgctgggaaccgccccctccctgccctgctccctgctgccccacccgagccctggcagtctggaacctggctggagtcggaactctccgcgccttcgaagggaggcccgaggacgctgccggcgcccccaggcgtcggctccgcgcggcccctgctgtagctggcgcacagccccggcgggtccccttgtcctccgcgcgctctgggaagacggtcaggcgcgcgcgtttggcgcccacccctgtgagacccgcttggcctggcgccgcgggcggggaccgctgccgaggccgccagcgcctcttcaactggggaaaacacaacaactcgggatgccccatcggagtgtgtatacacctgtgtgtgtgtgtgtgtggtgtgcgcgcgtttgcggaggcatgaaatgcggggaaagaggctggcgcttggcagtgactgcctagaatatgatacgaatagtgatccttctttctgtctgcccctactccttttctttgccttttccctttcctatccgtgatctcccctgaaaatgtcagactcccggagcaaggaacccggagtagcccgggcgcgcggttccggcgccccctggaggagccagcggccgagtgcttagcgtcggaggatcgcggggctttgtggtggagcactccggctgagcgcgcttcacagcgctgtggcacactggtcatcgttgcttatagagg

SEQ ID NO: 31957 - DNA, 15 bp, Homo sapiens
  misc_feature 1..15: note = chr8:54163335-54163350
  misc_feature 1..15: note = hyper
  source 1..15: mol_type = genomic DNA
ctcaccggatgatca

SEQ ID NO: 31958 - DNA, 185 bp, Homo sapiens
  misc_feature 1..185: note = chr8:54163673-54163858
  misc_feature 1..185: note = hyper
  source 1..185: mol_type = genomic DNA
cggagaggcaaactttgcccgcgccctggccagcggcgctggggacccggagcctgcggactcccacccgggccgcaagtcgccgggggcaggacagggagaacggacttctcgctgcctttccggccagcaggcgcgccgctgggtgccagagaggggcgaagagcgctcgctccttctccccc

SEQ ID NO: 31959 - skipped

SEQ ID NO: 31960 - DNA, 30 bp, Homo sapiens
  misc_feature 1..30: note = chr8:54164557-54164587
  misc_feature 1..30: note = hyper
  source 1..30: mol_type = genomic DNA
cttatctgcatagttcgcagtcaggaacta

SEQ ID NO: 31961 - DNA, 39 bp, Homo sapiens
  misc_feature 1..39: note = chr8:54570523-54570562
  misc_feature 1..39: note = hyper
  source 1..39: mol_type = genomic DNA
atcagaaagagaaagcgctcagcgcgtgttgcttagcag

SEQ ID NO: 31962 - DNA, 211 bp, Homo sapiens
  misc_feature 1..211: note = chr8:54789099-54789310
  misc_feature 1..211: note = hyper
  source 1..211: mol_type = genomic DNA
tgaagtgcagcccttcgggcagctgaaggtctttctgcagataacttttctcagatcgaattttttggctacattgatactcttcggctctgtccttgccagaagttcggaaggattccagcgccccacaccttgcttgattcaccctcatcccctcccctaactggagaagccgctgggtcccgcgccaggctcgcggtggcttcagagt

SEQ ID NO: 31963 - DNA, 240 bp, Homo sapiens
  misc_feature 1..240: note = chr8:54789566-54789806
  misc_feature 1..240: note = hyper
  source 1..240: mol_type = genomic DNA
ggagaaaggaggttacgagttcgcacgttctcacaaaaccatttgaaaacatgagctggagacgccaaattctgggacccacgaaaggctttggagctcgctcgggctcctcgaagttgggcgtgcgtcgcagaacagtgctgggcgctctctttcagcattttcggcttttttcaagcccttgcgtagggtcgggaaggccgtgggtgggctcagtcaggctttaggtcgccaggaacc

SEQ ID NO: 31964 - DNA, 785 bp, Homo sapiens
  misc_feature 1..785: note = chr8:54790022-54790807
  misc_feature 1..785: note = hyper
  source 1..785: mol_type = genomic DNA
ggaggggcgcgtcccctgtcctcctcccgagcgagacgaacgctcagcagctcgttccctgggcgccaagaccgatttccaagtcgcccactttccccctcgagggagctgttggcgcttctccagaagcctcctcggctcccagctccagcccctaaaataaaagcaccttgccagagagcgggggaggggagcagctgaacgaggagaatgaaaatactgggagaacgaccccattctccaggaaaaggtaatgaggggaagtgaaacagtgtgaacttactcggaaatgcaaaccgagttcaactcacccaggagcaaacaaacgacagcaagacaaatcagccaccgcactcgcggcttcccagaaagggcctcatgaatgagaatgggttgctaggtttccttccctctctcctgacaatcgcttcccacaagacttccaccgccgaaagaatacaggccgggcctggtgactgcggagtgagggaaccgcgccaggcccacgaggccgctcgcgaccgctcccgccttcaggaccctggagagcggccgccgcgcccctgggacccacgcccaacccagaacacccgcgctcgcctcccgcgcctcaccaccccagcactttattcgctgcttcccgcctccaccttcattttttttggcaaccaccgctcttgtttttcacagacagattaaattgttttttgtttggcatgagggggtgtttggattggccgagctacattccggtttgtaactacactaaacgttagtgtaccaag

SEQ ID NO: 31965 - DNA, 15 bp, Homo sapiens
  misc_feature 1..15: note = chr8:54791767-54791782
  misc_feature 1..15: note = hyper
  source 1..15: mol_type = genomic DNA
ggacaccacagtaac

SEQ ID NO: 31966 - DNA, 49 bp, Homo sapiens; identical to SEQ ID NO: 774
  misc_feature 1..49: note = chr8:54791897-54791946
  misc_feature 1..49: note = hyper
  source 1..49: mol_type = genomic DNA

SEQ ID NO: 31967 - DNA, 487 bp, Homo sapiens; identical to SEQ ID NO: 775
  misc_feature 1..487: note = chr8:54792184-54792671
  misc_feature 1..487: note = hyper
  source 1..487: mol_type = genomic DNA

SEQ ID NO: 31968 - DNA, 427 bp, Homo sapiens; identical to SEQ ID NO: 776
  misc_feature 1..427: note = chr8:54792701-54793128
  misc_feature 1..427: note = hyper
  source 1..427: mol_type = genomic DNA

SEQ ID NO: 31969 - DNA, 1432 bp, Homo sapiens
  misc_feature 1..1432: note = chr8:54793349-54794781
  misc_feature 1..1432: note = hyper
  source 1..1432: mol_type = genomic DNA
ggtggagtgcgccgccgctggagggaggcgagacgtgggattgcccggccgggtaaaaggagtgagggggcggggaggaggcagagcaaggggaggaagaggccgggagaagagggctagagcaaagaccgagagccggagaaaggcgaaaggcgcggtgagcaatcgccgacgtagagagggcagccctccgcgctgcaatattgagaaggcacccgcgggacgcatgcgcacggcggacggaggcgagccggccggggcttcctccccggccggcagggtggacggtgggctcgtgagtatcccagttcctcgaactctctttcttcgtctcgggctcgccctgaggcttcgtgctggaaagtggccgaggctgggaggggcgcgccgctcgtccggacctcagggtgtcgccgttgctgcggggcgggagccggtgcgagtcgggggttccttcccgcagtgcgagtttgggggagtggggctgcgagtgcgtccgcgtgcgaagaggggcatcgcgccaccaggatcaatatgtcccgggcctgccagggcgtccgcgattccacctctgcggcttcgcgtcggtgtcttggtggggaacgcgggagtctagtctttagaccctagaaatcgcattgaccacccgaagcgtatttcggaaagaccaggcgggtggaagcgtcggctttctcacgggatagggagaggacaaggaaggggttgggcgcccggggctggtggtttgagcgccgctgggaagggtaaggagacagagcctcctggaatcgtagcgcctccttttaggagaagtgcaaccagggcaggggcaccgaggggcagggtgaggaagtggacgccccacgcgtggaccctagaagaccgactaggtatgggcgttcactcggagcctctgttcacgctcttgaaaaccgaatgaacagagaagtgccctccacccttcgcctgcgccagggcagttaacgtgcaggcgccgccgggattttcctggaacaaacccgggcacttgatcttccgcaccctcggagctgccctgggaagtcgaaacaagtctgggcgcccggactgcggagactggaaagcagggggcggagggcgggagactgggggcgggaagtggaggtgcaggctgcagctggggaccgcggtgggcgttggaggggagggtctgtgtgcgcggctgtcctccagcgctgggggagcggacgggccaggggcctctagggaagcggcgctccgggaccggggtggctttcccgtctctgtgtgcgcggcgatccccacacccagctcgggcggaggagccctgagagaagcggctagctgagagtggggtgggcgttttggggaaaggtttgcgtgcgctgcggccctaccgctgctagagaagtggaagagagagagtgggcgc

SEQ ID NO: 31970 - DNA, 124 bp, Homo sapiens; identical to SEQ ID NO: 9528
  misc_feature 1..124: note = chr8:54794826-54794950
  misc_feature 1..124: note = hyper
  source 1..124: mol_type = genomic DNA

SEQ ID NO: 31971 - DNA, 42 bp, Homo sapiens
  misc_feature 1..42: note = chr8:54795139-54795181
  misc_feature 1..42: note = hyper
  source 1..42: mol_type = genomic DNA
cgtaacttggcaaaagctcgcgccactgccctccggcctggg

SEQ ID NO: 31972 - DNA, 232 bp, Homo sapiens
  misc_feature 1..232: note = chr8:55366136-55366368
  misc_feature 1..232: note = hyper
  source 1..232: mol_type = genomic DNA
ctaagaaacactccacggatgagtttctgaagagggaagtggaccgggaacagcgcatttcctgcttcgcctgtgcaaatcccaggcggggccaagcgggaacggggacacggtctaagagtcgcccgctgccagggaggggttggggggcagcctcgaggggacaccgcggaaccagggagggatgcgcatggagggagtgggagaaggcgtccaagtaaaatgcatgctc

SEQ ID NO: 31973 - DNA, 690 bp, Homo sapiens
  misc_feature 1..690: note = chr8:55366951-55367641
  misc_feature 1..690: note = hyper
  source 1..690: mol_type = genomic DNA
cgcccccacagacttgctctccagcgccaacccggatctgcctaggtgcccacgggtccttcccgatcgacttgagtgtccttcctccagcccctgctttcccagcatcgaaaacacaaaagcctgccggaaatcacccagcctttgcctggtcactcaggggcccacggataagcgtggctctgattcctccaggtcagccccacggttcgccacctacccgagttaatttctgcgcccgctgaccaaaggccccaactggcaacgggcacagcttcttggtgcgctagtcgcttccttgcccagcctttagagcctcgggtccggcccaaggacccggggacgtgagcgcaattagtagccaggagccctgcgaccctggaccgtgcagtgctaacgcacccgaacggctatgcgagcggtgtactcggctcttacttgtgaaagttgtttcccccaaccccctgcgtaaatctcttgtgttgagaaaagcaaggcttgcaggaagccactccggatgtttgctgctttacatgtggcatctgtggctggctctgataacgtcccggggcaccacgtattaaagtgaagagactgaaatagaaggctccacacaccgcgcgcgggtcagcgacgtcgccgccctccacactgccccccgaaatataagacaagcgaatgatcagaaga

SEQ ID NO: 31974 - DNA, 223 bp, Homo sapiens; identical to SEQ ID NO: 777
  misc_feature 1..223: note = chr8:55370113-55370336
  misc_feature 1..223: note = hyper
  source 1..223: mol_type = genomic DNA

SEQ ID NO: 31975 - DNA, 86 bp, Homo sapiens; identical to SEQ ID NO: 778
  misc_feature 1..86: note = chr8:55370337-55370423
  misc_feature 1..86: note = hyper
  source 1..86: mol_type = genomic DNA

SEQ ID NO: 31976 - skipped

SEQ ID NO: 31977 - DNA, 147 bp, Homo sapiens
  misc_feature 1..147: note = chr8:55370567-55370714
  misc_feature 1..147: note = hyper
  source 1..147: mol_type = genomic DNA
cggcttcgggccgggagacccgcgcagccctcggggcatctcagtgcctcactccccaccccctcccccgggtcgggggaggcggcgcgtccggcggagggttgaggggagcggggcaggcctggagcgccatgagcagcccggatg

SEQ ID NO: 31978 - DNA, 198 bp, Homo sapiens
  misc_feature 1..198: note = chr8:55370835-55371033
  misc_feature 1..198: note = hyper
  source 1..198: mol_type = genomic DNA
cgaggcgccggcgaacagcggagcaccggccggggccgcgggccgagccaagggcgagtcccgtatccggcggccgatgaacgctttcatggtgtgggctaaggacgagcgcaagcggctggcgcagcagaatccagacctgcacaacgccgagttgagcaagatgctgggtgagtccgagtcgcagacccaggcggc

SEQ ID NO: 31979 - DNA, 204 bp, Homo sapiens; identical to SEQ ID NO: 781
  misc_feature 1..204: note = chr8:55371172-55371376
  misc_feature 1..204: note = hyper
  source 1..204: mol_type = genomic DNA

SEQ ID NO: 31980 - DNA, 286 bp, Homo sapiens; identical to SEQ ID NO: 782
  misc_feature 1..286: note = chr8:55371439-55371725
  misc_feature 1..286: note = hyper
  source 1..286: mol_type = genomic DNA

SEQ ID NO: 31981 - DNA, 75 bp, Homo sapiens; identical to SEQ ID NO: 783
  misc_feature 1..75: note = chr8:55371993-55372068
  misc_feature 1..75: note = hyper
  source 1..75: mol_type = genomic DNA

SEQ ID NO: 31982 - DNA, 122 bp, Homo sapiens
  misc_feature 1..122: note = chr8:55372416-55372538
  misc_feature 1..122: note = hyper
  source 1..122: mol_type = genomic DNA
cgtgtgcaagcctgagatgggcctcccctaccaggggcatgactccggtgtgaatctccccgacagccacggggccatttcctcggtggtgtccgacgccagctccgcggtatattactgca

SEQ ID NO: 31983 - DNA, 29 bp, Homo sapiens
  misc_feature 1..29: note = chr8:55379202-55379231
  misc_feature 1..29: note = hyper
  source 1..29: mol_type = genomic DNA
ctcttagcttggtgccggggcccgcccgg

SEQ ID NO: 31984 - DNA, 162 bp, Homo sapiens; identical to SEQ ID NO: 3261
  misc_feature 1..162: note = chr8:55379295-55379457
  misc_feature 1..162: note = hyper
  source 1..162: mol_type = genomic DNA

SEQ ID NO: 31985 - DNA, 108 bp, Homo sapiens; identical to SEQ ID NO: 3262
  misc_feature 1..108: note = chr8:55380036-55380144
  misc_feature 1..108: note = hyper
  source 1..108: mol_type = genomic DNA

SEQ ID NO: 31986 - DNA, 24 bp, Homo sapiens
  misc_feature 1..24: note = chr8:55380175-55380199
  misc_feature 1..24: note = hyper
  source 1..24: mol_type = genomic DNA
cgtgtttagcgattctcatattta

SEQ ID NO: 31987 - DNA, 14 bp, Homo sapiens
  misc_feature 1..14: note = chr8:55383182-55383196
  misc_feature 1..14: note = hyper
  source 1..14: mol_type = genomic DNA
ggtgccgacttcaa

SEQ ID NO: 31988 - DNA, 252 bp, Homo sapiens
  misc_feature 1..252: note = chr8:56013641-56013893
  misc_feature 1..252: note = hyper
  source 1..252: mol_type = genomic DNA
gagtaagggaggtggcgcctgctccgggctccgccactccccgcccgcgggccgggggtggggtggcactcggtttcccgcggctgccggccgcgccccgcgccgccgccaggggtgctgcgcttcccacctgccgcaggacgcctcgagggccggtgcggtgcccactgggctgccgctcctcccggctcagagctttccagccgccgagaacgtgcgagggaccccggcgtcgggcaggggcctgggccg

SEQ ID NO: 31989 - DNA, 58 bp, Homo sapiens
  misc_feature 1..58: note = chr8:56014127-56014185
  misc_feature 1..58: note = hyper
  source 1..58: mol_type = genomic DNA
gcctccgagcccgggcgcccgagttacacccattctccccaccatcgtcggccagagc

SEQ ID NO: 31990 - DNA, 368 bp, Homo sapiens; identical to SEQ ID NO: 3264
  misc_feature 1..368: note = chr8:56014376-56014744
  misc_feature 1..368: note = hyper
  source 1..368: mol_type = genomic DNA

SEQ ID NO: 31991 - DNA, 19 bp, Homo sapiens
  misc_feature 1..19: note = chr8:56015034-56015053
  misc_feature 1..19: note = hyper
  source 1..19: mol_type = genomic DNA
ggtgtggaggcatcatggc

SEQ ID NO: 31992 - DNA, 172 bp, Homo sapiens
  misc_feature 1..172: note = chr8:56015185-56015357
  misc_feature 1..172: note = hyper
  source 1..172: mol_type = genomic DNA
cgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcctgggcagggag

SEQ ID NO: 31993 - DNA, 102 bp, Homo sapiens
  misc_feature 1..102: note = chr8:56015560-56015662
  misc_feature 1..102: note = hyper
  source 1..102: mol_type = genomic DNA
cagcaccgaggacagcgccacggccgctgctgcctccagctgcccgcagcctggagccgattgcaagacggtggtcggcggtgggtctgcagccggggaagg

SEQ ID NO: 31994 - DNA, 50 bp, Homo sapiens
  misc_feature 1..50: note = chr8:56015749-56015799
  misc_feature 1..50: note = hyper
  source 1..50: mol_type = genomic DNA
cggggctacccgggccagtggcaagcacaggtctgcgtcctgctccttct

SEQ ID NO: 31995 - DNA, 30 bp, Homo sapiens
  misc_feature 1..30: note = chr8:56792024-56792054
  misc_feature 1..30: note = hyper
  source 1..30: mol_type = genomic DNA
tggaagggatcagagcgcacctcctccgct

SEQ ID NO: 31996 - DNA, 22 bp, Homo sapiens
  misc_feature 1..22: note = chr8:57025598-57025620
  misc_feature 1..22: note = hyper
  source 1..22: mol_type = genomic DNA
ccccaaggcgctgcccggggag

SEQ ID NO: 31997 - DNA, 547 bp, Homo sapiens
  misc_feature 1..547: note = chr8:57025775-57026322
  misc_feature 1..547: note = hyper
  source 1..547: mol_type = genomic DNA
cgccctctcctttcaggagctccggggcgcggtgggtgtatgtgcctcctagagggtaagagggtgtctggaagcacagcagatcttccaacttctcagagcaaccgaagtcactaattttacagacatcctgctcactgatcaagatgttcgcgggcttcaggtccaagtgcacaatgctttgcgagtggaggaagagcaggccgttcacaacatctagtgagtacttgagacactttcccaaacttaactgtcctccagtgcggcagtgaggctcccctgcgtccccctcagggtggccggcggcgccatagatgacttggtgtaaagtgacgttgccaccgaactccatgatgatggtccctaggctattggaccctgcgggcgtgcgcgtgctggcagccaccacgcgcacgatgttatcgtggcgcagccttgctacgttgagctcagcccagaaactccgccgagatgctagtcggttcttggtgcacttgttcacttgctttatggccacaggaacaccgcggtaagtcgccttgtacac

SEQ ID NO: 31998 - DNA, 55 bp, Homo sapiens; identical to SEQ ID NO: 3269
  misc_feature 1..55: note = chr8:57026501-57026556
  misc_feature 1..55: note = hyper
  source 1..55: mol_type = genomic DNA

SEQ ID NO: 31999 - DNA, 185 bp, Homo sapiens
  misc_feature 1..185: note = chr8:57069553-57069738
  misc_feature 1..185: note = hyper
  source 1..185: mol_type = genomic DNA
aaaaacctatgtggacgcatcaacagatgctgaaaaggcatttcctagaagtcggcagccaaacttggtaattcttgcgtgtgataaaggcagccgtctgttctgctcagaaggggtttcctaacaggaggggccgaatgcaggcgtcacatccacgccgccccaggtcgtacacctaggccgtc

SEQ ID NO: 32000 - DNA, 163 bp, Homo sapiens; identical to SEQ ID NO: 789
  misc_feature 1..163: note = chr8:57069850-57070013
  misc_feature 1..163: note = hyper
  source 1..163: mol_type = genomic DNA

SEQ ID NO: 32001 - DNA, 143 bp, Homo sapiens; identical to SEQ ID NO: 790
  misc_feature 1..143: note = chr8:57070014-57070157
  misc_feature 1..143: note = hyper
  source 1..143: mol_type = genomic DNA

SEQ ID NO: 32002 - DNA, 275 bp, Homo sapiens
  misc_feature 1..275: note = chr8:57232591-57232866
  misc_feature 1..275: note = hyper
  source 1..275: mol_type = genomic DNA
caggaccgacgacctcggcaacttacccaggacactctccctagctgtccgcggagaagccggcctcgtctgccccaggcacccgagtccctggctcggagctcagtcaggttcaggtgtttatccaggcgccgcccaagtccaagggcgggactgccgcggcagcgccaggggtggggccggccgtagccccagtgcgcgacgtgggcagcactcccatcttctttttctggacctgcagatttaagaagctggaaattcggtggtggaaactg

SEQ ID NO: 32003 - DNA, 70 bp, Homo sapiens
  misc_feature 1..70: note = chr8:57358077-57358147
  misc_feature 1..70: note = hyper
  source 1..70: mol_type = genomic DNA
acttctcggggttcccgaattcccagggttaaaacaaacttggtttgtgcggcgacaccgctacccttac

SEQ ID NO: 32004 - DNA, 198 bp, Homo sapiens
  misc_feature 1..198: note = chr8:57358464-57358662
  misc_feature 1..198: note = hyper
  source 1..198: mol_type = genomic DNA
ggggccgagcaacagcagccaagtgcaaagtgtcaggaaccgcgccatggactgcgaggagagagggacgcgtgcttcgagcctgcctgggcgcagaacggggtccctcggcaggaccctcgccgcgacagcctcagcaggggatcgtcgagcaaaagcccgcaggaatgctcctttctggggccccgccctcccggc

SEQ ID NO: 32005 - DNA, 286 bp, Homo sapiens; identical to SEQ ID NO: 791
  misc_feature 1..286: note = chr8:57358806-57359092
  misc_feature 1..286: note = hyper
  source 1..286: mol_type = genomic DNA

SEQ ID NO: 32006 - DNA, 408 bp, Homo sapiens
  misc_feature 1..408: note = chr8:57359259-57359667
  misc_feature 1..408: note = hyper
  source 1..408: mol_type = genomic DNA
cgccccaatcgccggcgggctgcagctgacgcaggccctacgccagccccgcgccgacgccttcgcgggaggggtcggtcccccagcacccgcgcgccgctccccccgccgagctcgggtgggggccacagggggcgctcggtggctccccacacggccaggtgacaaacccaaggcagttaggaagtttggggagagtgagataggatcaagtttctccgcataaagtcactgaaattgcaccgtgggatgcgggctccagggagggaagcgaggtgggggcgtttggaaggatagatggactggcttagacttctggaatgtgctggagacccagcgggccggtgaacctgcccctttcccgcctcctccctgggccccctcgcgggtccccgtgggcaccaagca

SEQ ID NO: 32007 - DNA, 86 bp, Homo sapiens; identical to SEQ ID NO: 793
  misc_feature 1..86: note = chr8:57360540-57360626
  misc_feature 1..86: note = hyper
  source 1..86: mol_type = genomic DNA

SEQ ID NO: 32008 - DNA, 37 bp, Homo sapiens; identical to SEQ ID NO: 794
  misc_feature 1..37: note = chr8:57360769-57360806
  misc_feature 1..37: note = hyper
  source 1..37: mol_type = genomic DNA

SEQ ID NO: 32009 - DNA, 270 bp, Homo sapiens
  misc_feature 1..270: note = chr8:58907149-58907419
  misc_feature 1..270: note = hyper
  source 1..270: mol_type = genomic DNA
cgggcccttcgcggccgcgcgtcctgggcccgttccgccagccccgtctgctctctacccgcggccccgcggcggcgaccgtgaacactcggcggcccctacagcccgctctcggcccttcgtccctcgcgggccccgactctccctccttgcagtcccccggagcctggctcccggctcgggccgcaccgccagggactggggtgagcggcccaggtaagactgggccgtgggggccgggagagagactgctgggcgggggttgggatt

SEQ ID NO: 32010 - DNA, 338 bp, Homo sapiens; identical to SEQ ID NO: 9561
  misc_feature 1..338: note = chr8:58907483-58907821
  misc_feature 1..338: note = hyper
  source 1..338: mol_type = genomic DNA

SEQ ID NO: 32011 - DNA, 119 bp, Homo sapiens; identical to SEQ ID NO: 9562
  misc_feature 1..119: note = chr8:58907822-58907941
  misc_feature 1..119: note = hyper
  source 1..119: mol_type = genomic DNA

SEQ ID NO: 32012 - DNA, 561 bp, Homo sapiens
  misc_feature 1..561: note = chr8:60030202-60030763
  misc_feature 1..561: note = hyper
  source 1..561: mol_type = genomic DNA
atcaggtaaaaaagccgtttggtgatgactcgccaccaggcaaatgttgggagtcccaacgatttttcccgtggaatgcaccgagggtcgccatggatgtgcctgcaggggctgtgagtatcaggcagatttatcaccaagcgagagttgggcgtctaaaaggcccgcccagcgttttagagaactcaattctctctgccaacgttcatccaacgggactgcttagacacgtccaactagccctaggcgtgggcagtcgtgcccctgcgaccactctgggggaccggtccctgcgtgtcctccctctctgggatgagagagttcgagaagccgggagagtaaccccctccctcgtaccccctgactgtcctataggtggacccagccgaactccgcagcagcccaggccagcgccccacctccgggtcaccggcatgatccgcctctccccgggcccccgcggccctggcacccgaggtcagcgggccgtgggtacagctcagccgcggaccctgctccgcgagtgcgggagctttggacttgaacgcgacgtgctcgccc

SEQ ID NO: 32013 - DNA, 144 bp, Homo sapiens
  misc_feature 1..144: note = chr8:60030764-60030908
  misc_feature 1..144: note = hyper
  source 1..144: mol_type = genomic DNA
gctcccaacaaacttgcaatttccgcgcgcaccccttaaacaggaactgttccccaaaccttgacccagctaccccgctgtgctctggcccgcggacctgtgtccgaacccgggctcggctgccggaaccggtttgagaaaaca

SEQ ID NO: 32014 - DNA, 548 bp, Homo sapiens
  misc_feature 1..548: note = chr8:60031146-60031694
  misc_feature 1..548: note = hyper
  source 1..548: mol_type = genomic DNA
tattatttttttaaacgccccccggcaaacctaggcagggatccttagccgcgaacagcaggaaggaaagaatccgagcaaatcgtgtcactttccgcacaatcgcggtgtttggcaagcccccggagctactccacaatatttactacccaagcgcacgcaggctgcagcgggctgcgagccgagcgcgcccgggaccggcctccgccaagccggccccgccgcggcccggccaccgccgctcccctcccaggatcaagcagcaagaacacggtggaaacaaaagcagagcgttcaccttgttgcaatagtaggggtccaggcagggagaaggtcccagacagggagcgtcgggcgcagcggcgggctgggctggaggtggataaaatcttacgtccatttcactctcacatcaagcaactccttttctttttccttttttaaaaaaaagtgttcagcaaaacaagcttagacggaacagagtgaggtgtctgggctcaggagtaaaagaaacaccttccttccctcacatccgtttgtggtttgtt

SEQ ID NO: 32015 - DNA, 125 bp, Homo sapiens
  misc_feature 1..125: note = chr8:60032140-60032265
  misc_feature 1..125: note = hyper
  source 1..125: mol_type = genomic DNA
ccagaggccggggaccggagaaaggaggagcggagaaggagaaggaggagagcacggcctggctgggacagaagcggtgggaccctgggaggcctccgctgtgcccgtgccgcgctcctcgggac

SEQ ID NO: 32016 - DNA, 269 bp, Homo sapiens
  misc_feature 1..269: note = chr8:60032490-60032759
  misc_feature 1..269: note = hyper
  source 1..269: mol_type = genomic DNA
tcccctccctactcccggcccgtagtggaggtgactttcctgcgcagcgccgcttctgagggcggagaacccacagggagtgcgacccctttgcacgctgtgagtgggcaactgtccgagggactcgagccgatcgaagggtgaggaccagctcgcctgggggtggacggcctggaaaagccgcccctctttggcttccctctgccgcctgcagcccgcacccctccgagattcgtgccccactggacggtttgcgaaggctgaggctg

SEQ ID NO: 32017 - DNA, 512 bp, Homo sapiens
  misc_feature 1..512: note = chr8:61193203-61193715
  misc_feature 1..512: note = hyper
  source 1..512: mol_type = genomic DNA
tctccaagccaaaaacgaattcttcacgctaacactgtcttcctcaggtgtttagtaaaatgtaccgctgctcttcttgactactcagaagacataaaaggtacagccacggcttggaggctagcccgccctccggaccgcagcaggtgcgaacgccagccctgcggaaggctcccgggtgagagcgcaggcggcggaagagcgcaggcggcgagcacgcctccctggagcgcctcccgcccgaaacgcaccaggggagtgggaaagtggcagagacccccgtgggaaagagggggcgtgggggtgctcggagcgcgcagcggcagcaggactcgagtcccgcgctcggcgagacactgacgccgccgcgggaccccggacaccccgactcgcggccacttaccttcctcgtagccccactccacaccctcctcttcttcctcctcatcctcttccttctcggggaaggcgacggtatcttcgatgaagctcaggtccgccatgggaaggcc

SEQ ID NO: 32018 - DNA, 49 bp, Homo sapiens
  misc_feature 1..49: note = chr8:61193716-61193765
  misc_feature 1..49: note = hyper
  source 1..49: mol_type = genomic DNA
cggggcccctcggcgctctcggcagcagtgcctgcgccttcgctgggcg

SEQ ID NO: 32019 - DNA, 44 bp, Homo sapiens
  misc_feature 1..44: note = chr8:61573279-61573323
  misc_feature 1..44: note = hyper
  source 1..44: mol_type = genomic DNA
cccggtgtcagttgacgcccttctccaatcgcccaagagaagat

SEQ ID NO: 32020 - DNA, 292 bp, Homo sapiens
  misc_feature 1..292: note = chr8:61822378-61822670
  misc_feature 1..292: note = hyper
  source 1..292: mol_type = genomic DNA
ttggcgggctgggggcggcgtgcgccgagctgggcgcgagtggaggggccggcggctttgtgcgcccccgccagtgcccgcccgcagccccgccgcagcgtttaaccttgacttctccctcctcgcttctggcacgggaggaaagcctgtccagatgggcgtcctgagtgtgacgacgtcccctcccgcccccgcgctctcgcgcagatgtcgcacgctgccctgggtcccgccacaccgcccaccaaggccgcgggccctgcgcgcccggggcaggcgggcacatcccgca

SEQ ID NO: 32021 - DNA, 224 bp, Homo sapiens
  misc_feature 1..224: note = chr8:62200760-62200984
  misc_feature 1..224: note = hyper
  source 1..224: mol_type = genomic DNA
tcgatgccatggctgcggcgtttcagcacttcggtatgtggacagctcccatctgcaatccctctgcactccatccctcccgcaccgcaccccgctccccgccgcctccgcggtccatcctcctcccggcgcccgctcagcctgcgcccccttacacatcagcacccccatctccaccatcaccgtcatcatagccaccatcaccagcgcggtaactatagtca

SEQ ID NO: 32022 - DNA, 793 bp, Homo sapiens
  misc_feature 1..793: note = chr8:63160462-63161255
  misc_feature 1..793: note = hyper
  source 1..793: mol_type = genomic DNA
tatttatacctattccggaaaccttctccatttctagaaaaagctacgcatcttcttcttcctcgacttctcttttctccctcccggtgaggatttcaaagggtatgtgagaaaagaaccttaagccaggtctccccgcggcgtcctggctagtcccggcgccctgggcgggtgcatcgctccgccgcagcgccccttgccacccaactctgtccaactttccctttcagactccagcaggggcgccctccaggcaaccggctgtggcgggcagaagcaagctcggatgggagacccccgagctgcgtgcccagcgccggctcaacagacttgcccgcgcagcgcccgcgggccccctcgcatccgggcaggttccggagctgggccttgcgctccccggcgcccgcccaccctgggtgtctcgcgtcccggcccttcctccccggaacccaagctaacccaactcccatcctcgccacctctggggcagctcaactaagccgtgtcccctcccttgcaaacgcgtccgaccaccctcccaacccccagcacaaccctcagcaagaaagcccagctgggtctacccagttacaccggtcaacgagggtctccatcgccgccggccgccctaattcacgctcattcatattcattctcttttctctctgtccctcttcctttctccccaaagactcttaactagacaggccgatcctccccagcggcactccctttcattcttcccttcccaccacacacacacacacacacacacacccggacccagacagcc

SEQ ID NO: 32023 - DNA, 258 bp, Homo sapiens
  misc_feature 1..258: note = chr8:63161631-63161889
  misc_feature 1..258: note = hyper
  source 1..258: mol_type = genomic DNA
catgggctgctgcaccggacgctgctcgctcatctgcctctgcgcgctgcagttggtgagtgccccgagggcccctgccccaggacaggtccctgctccaggaccggcctctgcgactccctctgcggttccgcagctcccggcaaggggcgaacgggtgaacagggcgctccgcccgcctcccaccctccccaccgcctggctgggctcgcactgctctccagccgcgggcactcgccaggtcgcccctgccctgca

SEQ ID NO: 32024 - DNA, 51 bp, Homo sapiens
  misc_feature 1..51: note = chr8:63998517-63998568
  misc_feature 1..51: note = hyper
  source 1..51: mol_type = genomic DNA
agagtggtccggtagcgcgttgagctgcggccccgccgagggctgggatcg

SEQ ID NO: 32025 - DNA, 448 bp, Homo sapiens
  misc_feature 1..448: note = chr8:65281329-65281777
  misc_feature 1..448: note = hyper
  source 1..448: mol_type = genomic DNA
ggggcctctggtcagcgctgattaataagtgttttttgttgtgaagtgttgaataatagaggatggccggtgacccagtaaggactaaaccttgcgctggtttattgtggcaagctgagaaaggggctttaggcccgggaccccaggcactgacccgcacacatcccgcggatcgcctattcattcgcacagccctccagtcgcccaggctcccattgtttgctgagcaacaatggagatttcgcagggaaagtaaagctcttttcagattcctctctgatgttttgcatttagggaaacaccgacctccactttttcccccgacattttccctcctggcatttaaagctgttcgttttcggggaaacttctgtgagtttcgcgcttgttcgaccaacaccagtgttaggaggaggcgagaccggtggaaaaaggagagccccagaga

SEQ ID NO: 32026 - DNA, 168 bp, Homo sapiens
  misc_feature 1..168: note = chr8:65281837-65282005
  misc_feature 1..168: note = hyper
  source 1..168: mol_type = genomic DNA
tttagaggacgggagctgcctctagggagaaaggggaggggggaggggagaagaaaaaggaaagagcgcgtttcctcgccggggttaccggggtggcgcgggcttcgcggccgaggggctgccggcccggcccgcagctcctcgcggccggctgggaagtggcgggtc

SEQ ID NO: 32027 - DNA, 109 bp, Homo sapiens; identical to SEQ ID NO: 3277
  misc_feature 1..109: note = chr8:65282332-65282441
  misc_feature 1..109: note = hyper
  source 1..109: mol_type = genomic DNA

SEQ ID NO: 32028 - DNA, 282 bp, Homo sapiens
  misc_feature 1..282: note = chr8:65283799-65284081
  misc_feature 1..282: note = hyper
  source 1..282: mol_type = genomic DNA
ggtaaagtgcccacccggggtggtctaaagtcgtcaccccacagagcagattctgctgctaaccagagcagagagccgcaccttcccagcggcgggccccagtgcgcacagcgtgactttgcctcccccaggctcagcaagtcgttgacgatctttagcagtcccgcatcccaggtcaataaactggaaacggatagaatgagaatcatggatgagagataaagggcagcggggtgatgcgcatttcttgtagtgcctccaaaaaaccgtggtctctcgccg

SEQ ID NO: 32029 - DNA, 765 bp, Homo sapiens
  misc_feature 1..765: note = chr8:65286370-65287135
  misc_feature 1..765: note = hyper
  source 1..765: mol_type = genomic DNA
cgtcgcgagcatgcttgagagccgccggctcagctccgggctgtaaggttggttcctggcaatggatggaaatcaggtcacagagatccctaagcttgccaggctctcagacacgcttgggagacagaatggaattggaaggagggatctgaagaggagggaggggatccgtgttcccccaccccgggcctagaatggagccccggccagccgcgggccgggccccttggttttcaggacttattcttgccggggttggctcgcacgccagcatcgcgccttcggtgcgtcttttatctccatctcaaatatgggatcttcttgggacgaggactgaatgagggtgggagagagggtgtgtctcacggcgcccaggagggagaaattgtggttctgagaaggtattttttggcctcttgaaaatgtgcaagaattccgcgggcccaggctttctttgtgtggcgggcagcgccaagcgctttgtgcttcacaaggagaaaatggcgagtcctattgtgtttaggccattttcttccggtactaggattttcccaagttcgaaatacttcttgagaaagtagccttctcgtgcccaagaaagtgtgaatcgctgaggctcggccccatggcctggcgtgggtgctgacctcagtttaaaaccaagggcctgttttcttaccgttggggtacttgtatcaaagcacagatatgaccggtttgtgcggatcggtgtcctccaaagatcaacagcggctcttggggttt

SEQ ID NO: 32030 - DNA, 304 bp, Homo sapiens; identical to SEQ ID NO: 9581
  misc_feature 1..304: note = chr8:65289049-65289353
  misc_feature 1..304: note = hyper
  source 1..304: mol_type = genomic DNA

SEQ ID NO: 32031 - DNA, 759 bp, Homo sapiens
  misc_feature 1..759: note = chr8:65289592-65290351
  misc_feature 1..759: note = hyper
  source 1..759: mol_type = genomic DNA
gagaggctggaagctcgacgtcttagggagctgcctgcgggcactgggttgacgccaagaggttgtcggcaagggcagggctcttgccctctgctgtacctaggctctgcaactgggggctgcgagccttctgcggctctttggtttcaaggacacagcgagctgctcaggactttgggagccaacatctgtctgactggtgacgtcagcagcccgtgtaatcctcttgtgctgaaggcagatgccttatttgtttggctggagcgagccattaatccctaattctggatcagcaagcgagggggaaagaccggaccgctccgacccaccccctccctacccccacctcccaccttaaagcaccttataccacggaaggctctcagcctcttctttcctctgcgaacgcgctgagcagcgattgaaaacgttttggtcctctgcaggtttgaacagggctagcaggtctctctccggatttctagggctatgggtatatgtaattctttctctcatcgatcgtttcgattctcttgccggtcttgcagtttgcagggtcctaaacgaagaggggtggagattcgagagtgcgggtctggcgtgtggtccaagggagggggtgaggctgggaaagggggtgcagaatgcgggaacggctgggactgcacagaaggaccatctgcggactcgttttcactgctccagctcccgaaatcgtttctctggacgcggcagtatccgcagcgcatgcaccctcct

SEQ ID NO: 32032 - DNA, 27 bp, Homo sapiens
  misc_feature 1..27: note = chr8:65290655-65290682
  misc_feature 1..27: note = hyper
  source 1..27: mol_type = genomic DNA
tctctctcctttcctcggactctggag

SEQ ID NO: 32033 - DNA, 185 bp, Homo sapiens
  misc_feature 1..185: note = chr8:65290897-65291082
  misc_feature 1..185: note = hyper
  source 1..185: mol_type = genomic DNA
cgctgccctgagcctaatccctcttccgggcccagacccgaggtccgcgctcctgggcagtggggaagctttagtgagcaggcttttctctccgcagcaaacttgtagccagaccagatgggccgcccagctctctcgggactaggcaggtgcggatgagttaatttttccgcattacaaagaaa

SEQ ID NO: 32034 - DNA, 33 bp, Homo sapiens
  misc_feature 1..33: note = chr8:65291410-65291443
  misc_feature 1..33: note = hyper
  source 1..33: mol_type = genomic DNA
attaacttggatccacgccgtcatttgaaaact

SEQ ID NO: 32035 - DNA, 254 bp, Homo sapiens
  misc_feature 1..254: note = chr8:65291758-65292012
  misc_feature 1..254: note = hyper
  source 1..254: mol_type = genomic DNA
catacaattaaggcacgcggtgaatgccaagagcggagcctacggctgcacttgaaggacaccaaagcatctcagggtcagaaaggggaaaaagcaattgcagggaatttagggggtagtaaaaggaacccatctcttgccgcataaatgccccccacccccacccaggactgattctggaagcaacctagtgttcgaaagggaaaggctcctacttttccattacagccgcggaaatccgcaggcaaatctcc

SEQ ID NO: 32036 - DNA, 268 bp, Homo sapiens
  misc_feature 1..268: note = chr8:65292608-65292876
  misc_feature 1..268: note = hyper
  source 1..268: mol_type = genomic DNA
atgcaccaaagtagccgcgccctccctgcctggcgctgtccgcggtgctgaccgtggcccttttctctctccgtaatcaaactggaaaagcaataggaccgtcccgtccctactcaaaagaagagtaggatattaggtaatttgaaaaataacatttaaaaagagaaaaaggtcacatacagcaaaacaatattttactgaaatcgttccctcaagctggttgctacccttgcctgacactttttggtcttcacgtaggaatgcacac

SEQ ID NO: 32037 - DNA, 15 bp, Homo sapiens
  misc_feature 1..15: note = chr8:65293179-65293194
  misc_feature 1..15: note = hyper
  source 1..15: mol_type = genomic DNA
ccaggccttgcagcc

SEQ ID NO: 32038 - DNA, 108 bp, Homo sapiens
  misc_feature 1..108: note = chr8:65293265-65293373
  misc_feature 1..108: note = hyper
  source 1..108: mol_type = genomic DNA
cgcatcccagccggcgggaggcactggagggccaggaggcctgaaacccgcactgcggaaaaaccgacctcagccacatcctcatagctcacgcgacggaaagaggca

SEQ ID NO: 32039 - DNA, 152 bp, Homo sapiens
  misc_feature 1..152: note = chr8:65488217-65488369
  misc_feature 1..152: note = hyper
  source 1..152: mol_type = genomic DNA
agtggggaaagaccacgcaggagccaggtgagaccctcgcggtgggctcggggacttgtgtgtgcacctcgcgctgagaaggctgcctcccggggctcagggtttgtcttcaaggtctgttcaaatttaggctaactcgtccccaaacagta

SEQ ID NO: 32040 - DNA, 43 bp, Homo sapiens
  misc_feature 1..43: note = chr8:65488704-65488747
  misc_feature 1..43: note = hyper
  source 1..43: mol_type = genomic DNA
taatctctctgcctccgagtagatcccgcgctcccaaatccgg

SEQ ID NO: 32041 - DNA, 16 bp, Homo sapiens
  misc_feature 1..16: note = chr8:65489049-65489065
  misc_feature 1..16: note = hyper
  source 1..16: mol_type = genomic DNA
ggttggattcttcctc

SEQ ID NO: 32042 - DNA, 63 bp, Homo sapiens
  misc_feature 1..63: note = chr8:65489066-65489129
  misc_feature 1..63: note = hyper
  source 1..63: mol_type = genomic DNA
gttggggaagcacagctggcggagaattcccacggctctcagtggattcgcttttccagagct

SEQ ID NO: 32043 - DNA, 30 bp, Homo sapiens
  misc_feature 1..30: note = chr8:65490463-65490493
  misc_feature 1..30: note = hyper
  source 1..30: mol_type = genomic DNA
gcttttggctcctaccgagtaaaatgaagt

SEQ ID NO: 32044 - DNA, 803 bp, Homo sapiens
  misc_feature 1..803: note = chr8:65492776-65493579
  misc_feature 1..803: note = hyper
  source 1..803: mol_type = genomic DNA
aactattcagacttgcggccagatagcgcctgcgattgtttgttaccgttttaatcctattaattaaaacgttaacctgattgggtagaaagcgctgtcccaacaggcgagtcttcttcataataacctactcagagataatgatgtaaaagactcccccgtctgtggcggcggctgtttgatgggtccggaaatctcttgaaggtgaatccaagcaagataaacggtgcggagaggaggcgcggggctgggctcagagcggcggcggcggcggctccactccctccgcgcccaccctcccaccatgcggggccgcggcccatggtgagccccagcagccagcaccatcggctggagacgaagaagaagaagaagaggaggcggcgagcgcgggggaaggcgaaaaagaaaaagaaagaaggggagagggctcccggcagcaccaggaccgacgcgcgcaccagctccggagcccagctcgcgcgcgtctgtggggccgcctgactccggggccgaggcggcggcggcggcagcgggcgcggcggcccgggctgcgcgccggcgcgggaccatggagcgcgggatgcacctcggtgcagcggccgccggcgaggacgacctcttcctgcacaagagcctgagcgcctccacctccaagcgcttggaagcggctttccgctccacgcccccgggcatggacctgtccctggcgccgccgcctcgggaacgcccggcgtcctcctcctcgtcgcccctgggctgcttcgagccggctgaccccgagggggcagggctgctgttgc

SEQ ID NO: 32045 - DNA, 149 bp, Homo sapiens; identical to SEQ ID NO: 3283
  misc_feature 1..149: note = chr8:65493806-65493955
  misc_feature 1..149: note = hyper
  source 1..149: mol_type = genomic DNA

SEQ ID NO: 32046 - DNA, 25 bp, Homo sapiens
  misc_feature 1..25: note = chr8:65494076-65494101
  misc_feature 1..25: note = hyper
  source 1..25: mol_type = genomic DNA
cggcttaacatcaatgcccgagagc

SEQ ID NO: 32047 - DNA, 149 bp, Homo sapiens
  misc_feature 1..149: note = chr8:65494102-65494251
  misc_feature 1..149: note = hyper
  source 1..149: mol_type = genomic DNA
ccggcggatgcacgacctgaacgacgcgctggacgagctgcgcgcggtgatcccctacgcgcacagcccctcggtgcgaaagctctccaagatcgccacgctgctgctcgccaagaactacatcctcatgcaggcgcaggccctggagg

SEQ ID NO: 32048 - DNA, 87 bp, Homo sapiens
  misc_feature 1..87: note = chr8:65498465-65498552
  misc_feature 1..87: note = hyper
  source 1..87: mol_type = genomic DNA
gaagggttagctttgcgtgtacgactgcaggaccagcaaatgatcatcttcgatagagctctctagttacccgtgcttctccctccc

SEQ ID NO: 32049 - DNA, 86 bp, Homo sapiens
  misc_feature 1..86: note = chr8:65498612-65498698
  misc_feature 1..86: note = hyper
  source 1..86: mol_type = genomic DNA
gcacccgcacgcagtctgcaatgccctcaccagtccccgcagctgggcaacccctccaagaccctgtgttacgcttaaattcctct

SEQ ID NO: 32050 - DNA, 201 bp, Homo sapiens
  misc_feature 1..201: note = chr8:65499739-65499940
  misc_feature 1..201: note = hyper
  source 1..201: mol_type = genomic DNA
accaaatgacgtccacgcagcactcgcgcccaccgcgctgtttttgcttgcgcagtgctcccgaagggattcgggatccgcatccggagggattcgggatccgcatccgaagagcaccccttctctcaggacttcccctgggaccgacgtttccagtcacccctgcgggcgcaattgtccttcaaccgccaagctccttgg

SEQ ID NO: 32051 - DNA, 351 bp, Homo sapiens
  misc_feature 1..351: note = chr8:67024934-67025285
  misc_feature 1..351: note = hyper
  source 1..351: mol_type = genomic DNA
ctgtctacagaaccccgggcttcagtggcgtcttcctaacccggcttgcctgccgggggcgttccgagaccctcggggccttcccttcaccccgcgggagttggaccggtggcgctggtaaggcctcccgggctcaaagtgcaacggacactgcagaaatccaaactgctggcattcgcggtttggggacgccagaggaggtaatgatttctggtttgttaacctcaagtgacaataatgccgagccaggcaggagctggacctacaatcttctgatgcgtggtcagacacgttatcccttgcgccactggcctaccacgctactccttcagtcgccgttggattactgtg

SEQ ID NO: 32052 - DNA, 492 bp, Homo sapiens
  misc_feature 1..492: note = chr8:67089544-67090036
  misc_feature 1..492: note = hyper
  source 1..492: mol_type = genomic DNA
gggctgctcggactgcggcggcggctggaagaaatccaagggctgagggtgctgcggcgcctgccgagctcccgggaccggcccgcggctcaggagcgccctgcatggcgggcagggcaggagagccaccagcaggactcccgcggacacaagcagcggcagccgcatgttaggggcactcgctgcggcacagaggtgggcggagggcggaatgagagaggggaagagagaaagaaagagttggttagagttcgctcagctgggaggtgcacacggggtcttcctacgggactgccttagacgtgctgggctttggcctcagtgattcggatgggcgctgtccgcggtgctgaagcgcctggggagcggggaaagggggcgcctgcagggctccgcacctaagctcatgcgctcaccggccaggagtgacccttctttctagactctgaaaggacggtccctgcgtcctcttcctaacgatcctcaaaacta

SEQ ID NO: 32053 - DNA, 156 bp, Homo sapiens
  misc_feature 1..156: note = chr8:67344509-67344665
  misc_feature 1..156: note = hyper
  source 1..156: mol_type = genomic DNA
agcagttaccttctacggcaatttcaagggtggatggtgcgagcgccgctggggcagctggcgttctggttcttactccgtgggaaaatggccctgagcccgactggcttgaggcttagacaggtgaccccgcgaagcgggtgggcaggcgcggcc

SEQ ID NO: 32054 - DNA, 27 bp, Homo sapiens
  misc_feature 1..27: note = chr8:67344666-67344693
  misc_feature 1..27: note = hyper
  source 1..27: mol_type = genomic DNA
aggggcgggaggcgggcagcctccgtg

SEQ ID NO: 32055 - DNA, 95 bp, Homo sapiens; identical to SEQ ID NO: 795
  misc_feature 1..95: note = chr8:67873327-67873422
  misc_feature 1..95: note = hyper
  source 1..95: mol_type = genomic DNA

SEQ ID NO: 32056 - skipped

SEQ ID NO: 32057 - DNA, 251 bp, Homo sapiens; identical to SEQ ID NO: 797
  misc_feature 1..251: note = chr8:67873800-67874051
  misc_feature 1..251: note = hyper
  source 1..251: mol_type = genomic DNA

SEQ ID NO: 32058 - DNA, 509 bp, Homo sapiens; identical to SEQ ID NO: 798
  misc_feature 1..509: note = chr8:67874164-67874673
  misc_feature 1..509: note = hyper
  source 1..509: mol_type = genomic DNA

SEQ ID NO: 32059 - DNA, 103 bp, Homo sapiens; identical to SEQ ID NO: 799
  misc_feature 1..103: note = chr8:67874755-67874858
  misc_feature 1..103: note = hyper
  source 1..103: mol_type = genomic DNA

SEQ ID NO: 32060 - DNA, 402 bp, Homo sapiens; identical to SEQ ID NO: 800
  misc_feature 1..402: note = chr8:67874859-67875261
  misc_feature 1..402: note = hyper
  source 1..402: mol_type = genomic DNA

SEQ ID NO: 32061 - DNA, 179 bp, Homo sapiens; identical to SEQ ID NO: 801
  misc_feature 1..179: note = chr8:67875262-67875441
  misc_feature 1..179: note = hyper
  source 1..179: mol_type = genomic DNA

SEQ ID NO: 32062 - DNA, 255 bp, Homo sapiens
  misc_feature 1..255: note = chr8:67875442-67875697
  misc_feature 1..255: note = hyper
  source 1..255: mol_type = genomic DNA
ggaagcgtgacttgcagcgaggcaggacccgatcccaggcttctttagaaagcggacgctgcgccccaaggcctgttcagagccgccccaggaagccgtgggtccccgaccgccccaaaccgcagcggtttctgcaggtcctggacccgtcgccttcgtaggtgaaatctaagtacttttcagcaacataattagaacacactcgaaacaatgcctgcagttctccgagtaggacattttctgtttttgtgtttg

SEQ ID NO: 32063 - DNA, 314 bp, Homo sapiens
  misc_feature 1..314: note = chr8:67940696-67941010
  misc_feature 1..314: note = hyper
  source 1..314: mol_type = genomic DNA
cccacgcttattccccgcgggcagctcaccgctcgcgggacagtccggtagctaactccagtttggtcggtttcatcggcgccgggtccctacgcagaccagcggcggttgctgggcgaccagacgcgctgtccaagcgccgctcacgagaaatctcgcgacatcgcaggctgctccctccccggtgggtccttcccctgtgaggcggcggccgggcgctgatgggcactgacggtggtcactaggccgactccgactagagtcctgttagcttgaagaggccgtgaggcatcggtcaccgcattgttttagtg

SEQ ID NO: 32064 - DNA, 306 bp, Homo sapiens
  misc_feature 1..306: note = chr8:68864545-68864851
  misc_feature 1..306: note = hyper
  source 1..306: mol_type = genomic DNA
cgccgccgggggccgggcagcagcgggcgcgcgggtcagcgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggtgagtgtccccggcagacgcagggggacgtccgggcggcgcggggcgcgggtcccggagtggctgcgggaaggacgcgcg

SEQ ID NO: 32065 - DNA, 42 bp, Homo sapiens
  misc_feature 1..42: note = chr8:68865398-68865440
  misc_feature 1..42: note = hyper
  source 1..42: mol_type = genomic DNA
caattccctcccccccgccccccgccccggcttaaatctgtc

SEQ ID NO: 32066 - DNA, 71 bp, Homo sapiens
  misc_feature 1..71: note = chr8:69242905-69242976
  misc_feature 1..71: note = hyper
  source 1..71: mol_type = genomic DNA
cattggctttttaagcggcgctgtcgctagggagcggctggtagggcgagcagcctcggggagcagcccgg

SEQ ID NO: 32067 - DNA, 202 bp, Homo sapiens; identical to SEQ ID NO: 3297
  misc_feature 1..202: note = chr8:69243284-69243486
  misc_feature 1..202: note = hyper
  source 1..202: mol_type = genomic DNA

SEQ ID NO: 32068 - DNA, 329 bp, Homo sapiens; identical to SEQ ID NO: 3298
  misc_feature 1..329: note = chr8:69243487-69243816
  misc_feature 1..329: note = hyper
  source 1..329: mol_type = genomic DNA

SEQ ID NO: 32069 - DNA, 140 bp, Homo sapiens
  misc_feature 1..140: note = chr8:69244370-69244510
  misc_feature 1..140: note = hyper
  source 1..140: mol_type = genomic DNA
cagtagaaggaagagcgcgaggacacgagaaaatgagaacaagagattgaagcctggcaccagcaaagcgtcccgcgggttgccagggtgctgagcaggggtggggcgtgcggaccgtagtcagaagtggaggcccttgc

SEQ ID NO: 32070 - DNA, 125 bp, Homo sapiens; identical to SEQ ID NO: 9614
  misc_feature 1..125: note = chr8:69244511-69244636
  misc_feature 1..125: note = hyper
  source 1..125: mol_type = genomic DNA

SEQ ID NO: 32071 - DNA, 84 bp, Homo sapiens
  misc_feature 1..84: note = chr8:70404780-70404864
  misc_feature 1..84: note = hyper
  source 1..84: mol_type = genomic DNA
gggtgctcagggagccggaaccacatgcctggaaaccctgagcccctgcccgccgccgtccaagccggccggctgcagcgcagt

SEQ ID NO: 32072 - DNA, 49 bp, Homo sapiens
  misc_feature 1..49: note = chr8:70405100-70405149
  misc_feature 1..49: note = hyper
  source 1..49: mol_type = genomic DNA
tcttggggccggtgtcgggccggggcggcttgatcggcaactaggaaac

SEQ ID NO: 32073 - DNA, 406 bp, Homo sapiens
  misc_feature 1..406: note = chr8:70744839-70745245
  misc_feature 1..406: note = hyper
  source 1..406: mol_type = genomic DNA
agcttctgcagtggccggcgcctccagctgctctcccgccccgggctgcagtccagtgccttcgtccatggcgcttagaattcagatttgatagctgatggcacccaagcactccggcacgtttcatccaccggcacgaggggccgaagccgggcccagtcagtcttgcccacctgggactggggctgggggcgcagggccgcgcagcagggcatcctcaccagctgcgaggcgcccagtgcatcctgatcacagacacggcttcaaggctccgcagccgcgtgccacagggggcaggggtccgcgcggtactgcgatgagccctactcggcgtccctctccgggcggtagcttgaggcaggcgcctcgcgcgtcccgggctcatcccctccgccgccgccgccgc

SEQ ID NO: 32074 - DNA, 30 bp, Homo sapiens; identical to SEQ ID NO: 9617
  misc_feature 1..30: note = chr8:70945287-70945317
  misc_feature 1..30: note = hyper
  source 1..30: mol_type = genomic DNA

SEQ ID NO: 32075 - DNA, 229 bp, Homo sapiens
  misc_feature 1..229: note = chr8:70946686-70946915
  misc_feature 1..229: note = hyper
  source 1..229: mol_type = genomic DNA
tgaaaagagaaaacacgtagacataatctggatggcggagactgaagagtgattatctctaggtggctggatgctgggtataggttggccgcaatgttatttttgtaaggctaggagaaaaacgttattttaaatatacggaatttgctcctctccaaatccactctccctttcgcctccctagaggttgtcaggttcaagaagcggcccggagttgcaggaagggcgc

SEQ ID NO: 32076 - DNA, 568 bp, Homo sapiens; identical to SEQ ID NO: 3300
  misc_feature 1..568: note = chr8:70947090-70947658
  misc_feature 1..568: note = hyper
  source 1..568: mol_type = genomic DNA

SEQ ID NO: 32077 - DNA, 166 bp, Homo sapiens
  misc_feature 1..166: note = chr8:70981714-70981880
  misc_feature 1..166: note = hyper
  source 1..166: mol_type = genomic DNA
ttcactgctggcacccgcgtactcgtggctgctgctcaggaagggcggcacttccctggggacgtggggaattgggtaccacggtggcagcttgctgtaccagggcagatcgtagagaggctccctctgtaggcccagacccgggctcagcaagggaggcgccatc

SEQ ID NO: 32078 - DNA, 23 bp, Homo sapiens
  misc_feature 1..23: note = chr8:70982262-70982285
  misc_feature 1..23: note = hyper
  source 1..23: mol_type = genomic DNA
cgctcccacaattaagacaaaac

SEQ ID NO: 32079 - DNA, 281 bp, Homo sapiens; identical to SEQ ID NO: 804
  misc_feature 1..281: note = chr8:70982286-70982567
  misc_feature 1..281: note = hyper
  source 1..281: mol_type = genomic DNA

SEQ ID NO: 32080 - DNA, 1020 bp, Homo sapiens
  misc_feature 1..1020: note = chr8:70982850-70983870
  misc_feature 1..1020: note = hyper
  source 1..1020: mol_type = genomic DNA
cgtccgccacattccccgggttcctcggaaactccaatcattctaccaggactattggggcctggggtagcccctcgggagccgcgtggacgagccctggccaggtgggagcgaagagcctcggcgactgccagtcctcccgcccccgcaccgccgggaaaggatggcgttttaatagacaggcagcaagttcaccgaggctgaagaatgaagccccttcagggccggcgggtcttgagatcaatgagcccaataagaaaaccaagcagggtcatgactcagaaattaaagaacacggggtcaggagaagaggtcagccacgacacaggcagcggcccgtctcctcccgatcctccaaaggcgcccttctcctagcctcctccgacctcagggatctgcaacttgggattcaaagcccccgagagggcagaacgaccatccaaaacgaactgcgccagcgagtgctgccgccctccccaacggccctggaagaccaccgccccgggccccaggcgcgtcctgtcccgtgcctacctccgacaccacctccaagagcgccaccgcggagcgggcgcctcctggacgctgcggggccactcgggctcggtaggccactcgggctcggtagacttcgggcgggccctgagggctgagccaggcttaagagggcgggcggggccgcggggcatcgacaggtcgagggtagggaattgacccggcccacgcagatccccgcgtcgtcttctccccgcccaccgcagccattggccgactctcgactcgccctctgtcccctggggtcgctcacttaactcatcagttttccaaaccctccctgggaccctagtggcgagcactcgccgctggccttctagggcaggcagtattgccgctccaggcgtgcggagtcggggagaaaaaaaccgaacacgtgtgctacccagggcccccagataagcccctccgcgcgcacacacaccctgaaccggagtccagaaggccggactcgcgtcccggggt

SEQ ID NO: 32081 - DNA, 277 bp, Homo sapiens; identical to SEQ ID NO: 807
  misc_feature 1..277: note = chr8:70984016-70984293
  misc_feature 1..277: note = hyper
  source 1..277: mol_type = genomic DNA

SEQ ID NO: 32082 - DNA, 319 bp, Homo sapiens; identical to SEQ ID NO: 808
  misc_feature 1..319: note = chr8:70984343-70984662
  misc_feature 1..319: note = hyper
  source 1..319: mol_type = genomic DNA

SEQ ID NO: 32083 - DNA, 250 bp, Homo sapiens; identical to SEQ ID NO: 809
  misc_feature 1..250: note = chr8:70984744-70984994
  misc_feature 1..250: note = hyper
  source 1..250: mol_type = genomic DNA

SEQ ID NO: 32084 - DNA, 226 bp, Homo sapiens
  misc_feature 1..226: note = chr8:72273908-72274134
  misc_feature 1..226: note = hyper
  source 1..226: mol_type = genomic DNA
tttaatgtgttccttcgaattttctgggttagcaaacctccattcctgacatagttttgctcctggatgggtacgcgcgggggctctcaggcgctctggtgcagccgcggcgcttctgggagtggagcgcctctgcaggggaaagctcggcgcagggggcaggcgcctggccgctgccgcaggctcgggctgccgagcgactgagcgaaaacgtgttccccaggaa

SEQ ID NO: 32085 - DNA, 103 bp, Homo sapiens
  misc_feature 1..103: note = chr8:72460433-72460536
  misc_feature 1..103: note = hyper
  source 1..103: mol_type = genomic DNA
cgcccctccgctctgcagccggagcctgggcctggtgcccactgccccgcggggtgtctcggacgcctggcccctgcagcgttttctacggagaggcctcaga

SEQ ID NO: 32086 - DNA, 638 bp, Homo sapiens
  misc_feature 1..638: note = chr8:72468569-72469207
  misc_feature 1..638: note = hyper
  source 1..638: mol_type = genomic DNA
cgggcgcctaagctgcggatcactcctgcgggcgctcgctctctccacgccgccgcccgcgcgcccgcggcagccacgagcgtcccgggcggggaaacgcgttgcctcccggcggcgcctattactagcagctgcttctgcttagcccttcgaggatcggtttgccccaacccacggcctctcccagggttcggtcttctcccgcccctccctcccttccccgcctctcccccaagctcctcagtggccgcggcccgtcaacactgtcgcgcagtcactggcgcaggttcccagctctcagctgggggtttcggggggagggagcagaaggaatgagacagaaggaacgggaggctttaagcccaccgagggaggttagaggaaggcgctgtggctgtgggattaggaggccacagacgggaaccgcgccgagctagactagctgtagaaggctgtctctccaccccgccacagcgctccgagaaggagcgggaggcctgggcaggggagaggcgctcctgcccccacccgcgccctgctggccacctgtggcgtcggggagaccacctgcggagagggtgcagggatgctgctgccctgacgaggggcctcccggggactagcgaaacgtttcgcct

SEQ ID NO: 32087 - DNA, 76 bp, Homo sapiens
  misc_feature 1..76: note = chr8:72469461-72469537
  misc_feature 1..76: note = hyper
  source 1..76: mol_type = genomic DNA
gcgggagtgggaccccgggccacagcaagagtcgccgggtgaggacgggcccggcccgtggcgcctagctgtaaag

SEQ ID NO: 32088 - DNA, 192 bp, Homo sapiens
  misc_feature 1..192: note = chr8:72470594-72470786
  misc_feature 1..192: note = hyper
  source 1..192: mol_type = genomic DNA
ccccccacctccagccgtaagacccaaaccaattcttgcccttagcggaggcctcctagaatttctggggccgccactgctctgggggaatcgtgggacacagtccggggaaagaacaaagctaggcgccaggaagggccgaccagcccggacgggtcagccgggtcctagccgtctcgggttctttccaag

SEQ ID NO: 32089 - DNA, 30 bp, Homo sapiens
  misc_feature 1..30: note = chr8:72471116-72471146
  misc_feature 1..30: note = hyper
  source 1..30: mol_type = genomic DNA
gccattgaatgaatgcgggaccgtttgcgt

SEQ ID NO: 32090 - DNA, 775 bp, Homo sapiens
  misc_feature 1..775: note = chr8:72754490-72755265
  misc_feature 1..775: note = hyper
  source 1..775: mol_type = genomic DNA
cgcgaaaggccggggctgtgtggaaccgtcccgcacgtgtgcgatgaatctggctccgctgagaacggatccgtgggctgtctggcgcgggctggggcagcagccgagagttagtctacagagctagggcccgagggtggacctgcgtccgcgtctcgtcacgaaaggaagctctttttggagaggcaaaacgtggtcgcccagatccggcgcagctgtagccgtgggcgctgtgcagtgacagccacacccgccacctgtcacgatcacagttccagggaaaggggaagggtcaaggagaatccagcggaaacttcttcccatctcacgagctctcccttctctccgtggcccccaaacactcgcatttaacgaataatcccatcaagtgagttccagtccgatttaagcggtggttccacatagtctgttggctgcggaaacttctttggtgtcagagtccggtcttcccgagaccacgaatggccatgtctgtaaatcaaaaagaacgtgagatattagagagaaacgattgtctcaaaccgaaacagctctcctacgcgaaccccagatattcctgacttggagtagctaagattttatcagcattctgggaatttgcatgtcctctctctgaactaagattttcattttactggaggttgataatccgagacttgccatatccgttcacgcttcttcctggactttgcccgcaggataatttggtgaaactcatctgactttgaggttctgtcgtttagttcccttcccc

SEQ ID NO: 32091 - DNA, 490 bp, Homo sapiens
  misc_feature 1..490: note = chr8:72755325-72755815
  misc_feature 1..490: note = hyper
  source 1..490: mol_type = genomic DNA
ctccaagctccaagtaggaactgggcttggacaggatttttcccaagccgggagagctggcagatcagagagggactttccagataaatcccatctggggaaacgttactatcttccacaagcaatttttctaaaaatgcaaatgctcttttatagagctcggccttccctcctttaagaaagggcttgccgattcaaacctgcccgactcagctggattaagttgggcaagggagatttgccgtcagtctgcaacctggtggcagatggagatggaaccaagatttaccctggaagtaggatattagtcaatggctgtcactggggtacaatgttcagaacgatgcaaacagacacggagggttgattcttcttcagggaaatggctggccactcccttgatttgggagaaactaaactggccttctcgttcccagtcccagaacctccacccctttcgaattcttcccaacgggctgaccctgcccgg

SEQ ID NO: 32092 - DNA, 157 bp, Homo sapiens; identical to SEQ ID NO: 812
  misc_feature 1..157: note = chr8:72756655-72756812
  misc_feature 1..157: note = hyper
  source 1..157: mol_type = genomic DNA

SEQ ID NO: 32093 - DNA, 102 bp, Homo sapiens
  misc_feature 1..102: note = chr8:72756813-72756915
  misc_feature 1..102: note = hyper
  source 1..102: mol_type = genomic DNA
ggggaaggggacgtctctgcagagccgagatttgggctctgaagcccgacggcccttcaacatgtctgcgcaggataagtgagctttcggggagtgaagggg

SEQ ID NO: 32094 - DNA, 30 bp, Homo sapiens
  misc_feature 1..30: note = chr8:72917399-72917429
  misc_feature 1..30: note = hyper
  source 1..30: mol_type = genomic DNA
gagaggtccggactccggggattcctgctc

SEQ ID NO: 32095 - DNA, 316 bp, Homo sapiens; identical to SEQ ID NO: 3313
  misc_feature 1..316: note = chr8:72987600-72987916
  misc_feature 1..316: note = hyper
  source 1..316: mol_type = genomic DNA

SEQ ID NO: 32096 - DNA, 119 bp, Homo sapiens; identical to SEQ ID NO: 3314
  misc_feature 1..119: note = chr8:72987917-72988036
  misc_feature 1..119: note = hyper
  source 1..119: mol_type = genomic DNA

SEQ ID NO: 32097 - DNA, 164 bp, Homo sapiens
  misc_feature 1..164: note = chr8:73163497-73163661
  misc_feature 1..164: note = hyper
  source 1..164: mol_type = genomic DNA
aatagataaagcaggcgctgtgtgggcgcgtcattagcggggtctcctcttggactgtgaacacaccccaaagcttgcaaccccctggccactccacgctttctccaaaccaagggctgcccgcaaggaaacctcgagccgaaccgcggccggacttcagaacc

SEQ ID NO: 32098 - DNA, 149 bp, Homo sapiens
  misc_feature 1..149: note = chr8:73163859-73164008
  misc_feature 1..149: note = hyper
  source 1..149: mol_type = genomic DNA
cgagagagcgctgtcagccggccaggcgctggggtccgcgcgagcccgagctctccctcgctgcagctcacaggcagcgaaaatctcgctccgcgagagccctggagaacttctggaaggagttctcaggcccgcgctacttacagtgc

SEQ ID NO: 32099 - DNA, 46 bp, Homo sapiens; identical to SEQ ID NO: 9640
  misc_feature 1..46: note = chr8:73448786-73448832
  misc_feature 1..46: note = hyper
  source 1..46: mol_type = genomic DNA

SEQ ID NO: 32100 - DNA, 30 bp, Homo sapiens
  misc_feature 1..30: note = chr8:73449084-73449114
  misc_feature 1..30: note = hyper
  source 1..30: mol_type = genomic DNA
gtgggagctgcagagcgaagcaggtgggtg

SEQ ID NO: 32101 - DNA, 38 bp, Homo sapiens
  misc_feature 1..38: note = chr8:73449394-73449432
  misc_feature 1..38: note = hyper
  source 1..38: mol_type = genomic DNA
gcggccgctccagcccgcgggtgcgcggagcgcgggag

SEQ ID NO: 32102 - DNA, 292 bp, Homo sapiens
  misc_feature 1..292: note = chr8:73449663-73449955
  misc_feature 1..292: note = hyper
  source 1..292: mol_type = genomic DNA
actcccgggctggcgcggctcgctttctggctccttccgcgcggcgagctcagccccgctcgatttttcctcttctgttccagccctctcttgtctgggtggctgtggcggcggcagggggatggggaccccgtgtggggaaggggttgaagatcgatgaagattattgttcttttaaaggatgccttagcttcctcccgccgcctttcctctgagccttcctactagagaccgtgaaccagagtcagggatgtaaagacagggggaaagcacgccgggagctccagccagc

SEQ ID NO: 32103 - DNA, 136 bp, Homo sapiens
  misc_feature 1..136: note = chr8:73450026-73450162
  misc_feature 1..136: note = hyper
  source 1..136: mol_type = genomic DNA
cggggagaggctccccggagggagcggggaatcccacagccctttgtggtgcccgagcccgtgccgcctgctgagcggggtctgtgggagctaggtaagtggcgggggcattgctgctccccgaagggggtcttcc

SEQ ID NO: 32104 - DNA, 51 bp, Homo sapiens
  misc_feature 1..51: note = chr8:73450520-73450571
  misc_feature 1..51: note = hyper
  source 1..51: mol_type = genomic DNA
attcttcaagcggtgcgcggtctccgttctgtagcacgattcctgagaggg

SEQ ID NO: 32105 - DNA, 30 bp, Homo sapiens
  misc_feature 1..30: note = chr8:75232938-75232968
  misc_feature 1..30: note = hyper
  source 1..30: mol_type = genomic DNA
gtcagatccagccctcgcgccccagtccgg

SEQ ID NO: 32106 - DNA, 262 bp, Homo sapiens; identical to SEQ ID NO: 3317
  misc_feature 1..262: note = chr8:75896574-75896836
  misc_feature 1..262: note = hyper
  source 1..262: mol_type = genomic DNA

SEQ ID NO: 32107 - DNA, 460 bp, Homo sapiens
  misc_feature 1..460: note = chr8:75896837-75897297
  misc_feature 1..460: note = hyper
  source 1..460: mol_type = genomic DNA
cccctcgctcctgcagctactgctcagaaacgctggggcgcccaccctggcagactaacgaagcagctcccttcccaccccaactgcaggtctaattttggacgctttgcctgccatttcttccaggttgagggagccgcagaggcggaggctcgcgtattcctgcagtcagcacccacgtcgcccccggacgctcggtgctcaggcccttcgcgagcggggctctccgtctgcggtcccttgtgaaggctctgggcggctgcagaggccggccgtccggtttggctcacctctcccaggaaacttcacactggagaggtaagggcgattctaaaatgcatcgctgagtcgtcaagctgccaccctttcctatctccctttgccttcttaaactgtacttaaaaaaaaaaaaaagccaactgtacagagtggttgggcgcgatgggtgggtgggctaccc

SEQ ID NO: 32108 - DNA, 39 bp, Homo sapiens
  misc_feature 1..39: note = chr8:75897298-75897337
  misc_feature 1..39: note = hyper
  source 1..39: mol_type = genomic DNA
gaaagcagcgacgatagaaattagcgggagctctagttc

SEQ ID NO: 32109 - DNA, 134 bp, Homo sapiens
  misc_feature 1..134: note = chr8:76316422-76316556
  misc_feature 1..134: note = hyper
  source 1..134: mol_type = genomic DNA
gcagctttagagctccgacaatctgtgccctcgctttgggctgcgccagggagcaaaaaacctctgcttttttgaaagaggccggggcaacaaggtagagagccgcggccagaagcagccccgggccataaacc

SEQ ID NO: 32110 - DNA, 276 bp, Homo sapiens
  misc_feature 1..276: note = chr8:76316614-76316890
  misc_feature 1..276: note = hyper
  source 1..276: mol_type = genomic DNA
cgagccctcccccctcctagccacagtgaccggaatcccagacttcccttctgatgcataaaacattcagtggcctccagggagtttttgaaattctggcggaggctgctttatccgttgtttcgccccctgggtcaaacactggtccactgggtgagttggaggagcgagtagctcagctatagattaaatttaacctgagccccggtggccgcgtcccgcccgcggtcctttctatacgagtagctttgaaggtgtcaccgagctgtgcccaaa

SEQ ID NO: 32111 - DNA, 322 bp, Homo sapiens
  misc_feature 1..322: note = chr8:77585073-77585395
  misc_feature 1..322: note = hyper
  source 1..322: mol_type = genomic DNA
gccactctgctcttccgcccagcccactcctgcctgcagtgttgctgctgtcacgccagccggtgatttgataggcttgtcgggttgccatggtgttgacttcttgcctctgaggagctgcccaatgactggaggtctgggattaaagcgggaagaggcagcggccacagcgaatttcagcggcagctgcagcagctagaaacaagaagcaagagtacgaggtctttaggctgcgtccccctcccgcagtcagggctgccagtgagggaaagagaagaaagggtggacggttgaaatggtgatcactcgaagtcagaagata

SEQ ID NO: 32112 - DNA, 237 bp, Homo sapiens
  misc_feature 1..237: note = chr8:77585603-77585840
  misc_feature 1..237: note = hyper
  source 1..237: mol_type = genomic DNA
tcacagatgcaaaggcgctgtacggtgaactttatatcgtggaaactaacttaactccgagaagagaaagtgcaattagacggcaaccgagtataagaaaatagttgccttggacggaggctggcggggcggggggagcgggggcggggaagtcagagagtgcatgtgcaatgcacaaccccagacggaaattgtaaactaggaaatgaaagggaaagaaaccgcttctgttataaa

SEQ ID NO: 32113 - DNA, 517 bp, Homo sapiens
  misc_feature 1..517: note = chr8:77586100-77586617
  misc_feature 1..517: note = hyper
  source 1..517: mol_type = genomic DNA
aggaaagaaatagtccgcgattcacccaagggactgggagattcagagagattccaggagaaggaaaggaacataagttcaggctcccagcgtaaggaaaggaggaaacgacaagaatccctaagagaaaaagaggaaaaagctgtgtgctgctgaggcggggcgtgggaagacaaccacagtcaattggaaggagcccgagtcagggagcaattgctaggacttcggacagagagggcagaagattgtgtagacaggcggtcaaccagagcagcgcggggcaggacccacgagcgcgaagccaggtgccgcgcggtccgcgccccggctccgggcgacgcagggactttgctggcaatgagaaggctgctcgaccagcctgccggagtcacgattccccgcgagtcccaaacacacgcttcactaactactttacagccacttccattgattttctttaacaaataaacataatacccgttacagcaacacttcctcttgccgccacagctagaat

SEQ ID NO: 32114 - DNA, 434 bp, Homo sapiens
  misc_feature 1..434: note = chr8:77590098-77590532
  misc_feature 1..434: note = hyper
  source 1..434: mol_type = genomic DNA
tctagggaaagttctcggagcggcagggaaacctctactcctttcactttgaaataaaaagtggcccaacgttccgtgagggcggcggcgggttcgcgcagagtttagggacagtggaatgggggtggggcagggagtgggagtcagggtcaaaggcgtccgcggagacccgagaggagcagctgggtttcctggcgctgggagcccagaagtagggcgcaagcggccgcggcacagcggagcagccaggtccagccgctcggatcgcgctcgcgccccatagcggcccgcgggctgggctcgggctcgcccgcctccccgctcccctgccagcggcgccgcgctccgcgccccggggcccaccccacgcagtcccgccgccgcttcagcccaacagccctcctcacgctggcgcgctccgaggccaagccctg

SEQ ID NO: 32115 - DNA, 425 bp, Homo sapiens
  misc_feature 1..425: note = chr8:77593310-77593735
  misc_feature 1..425: note = hyper
  source 1..425: mol_type = genomic DNA
gggagctttggaagccgtgaggctccggagctgctctgagtccgggctgcgcgtcatttgcagtctggggaatgttgatcacctcactaattacacctctctctcccccctctccctctccctctccctcgctctcctctctcattcccagagtgcatatcgggaatagacacacaaagacatgcgcactcaacttaatcagccatttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattatttttt

SEQ ID NO: 32116 - DNA, 609 bp, Homo sapiens
  misc_feature 1..609: note = chr8:77593986-77594595
  misc_feature 1..609: note = hyper
  source 1..609: mol_type = genomic DNA
tctctacccctacctcgctcgctcctgctcgctgtcgcacacatcccctcatcccgaccatctcttccgctctgccccccttttctatctctttccccttttttttggctcaaggttttgctccgctgagggagggagggggcactgagggacctgattttccactttctttaggggggctgcgtttttccggatttaacttttggattaagtggcggaggatcatctacgtttgcttgggcagttttctctccttttccctgtcttttcgggttttgccttccccgcgagccccgggcattctagtggctgggggaagctgtcagctccgcaacggcgcgggcactgccaggggtctccgctcgccccgcgcccctgcaccccgatcgggatgactggtcctccgcactcatcctctgaaagtttggacgttggtcggtggggctgggagcccctctctccctgctctttccctgctttaccctccaccccccaccccaccttattcagcctcgtttttcttcctccttttaccacccgcccctcttccccttctcaagttccccgaaggtcgcttagtgtgcggggctggcggaggcccgggggttc

SEQ ID NO: 32117 - DNA, 79 bp, Homo sapiens
  misc_feature 1..79: note = chr8:77594596-77594675
  misc_feature 1..79: note = hyper
  source 1..79: mol_type = genomic DNA
tgagctctggggaggggattccaagaggctggggtgaacgctggggctggggctgcaggtagacacccgcccaccggag

SEQ ID NO: 32118 - DNA, 168 bp, Homo sapiens
  misc_feature 1..168: note = chr8:77594757-77594925
  misc_feature 1..168: note = hyper
  source 1..168: mol_type = genomic DNA
cgggatcgcccggcctctgggccagggacccgcgaggcggcggctgcttgctccgaacggaacgccgccgggtgtgcgttagaccagcggatagacgcccgcggcttggggtcaagaatcttttcctttttagcaaagggcaaggggtgtgtgcgtgtgcgtgtgcgt

SEQ ID NO: 32119 - DNA, 305 bp, Homo sapiens
  misc_feature 1..305: note = chr8:77595189-77595494
  misc_feature 1..305: note = hyper
  source 1..305: mol_type = genomic DNA
ataaagtttctctgccgatgtccaagttacagaaggttccctattctaatccccttcccctagaagacggtgcactggtttctatttcttttgttacctgtgatccgggcggggggctcctttcggccgctcgggctggggtccggcccagagaggaggcttctgcgggcgcctttggccgcgacttctcacttccgcgcggttctggtgaggttttagctaccgttcggtgagacaccctccttgtaggtaccaaaggttcagatcgcaaacacggaccccccccacctcgacccctacacaca

SEQ ID NO: 32120 - DNA, 658 bp, Homo sapiens
  misc_feature 1..658: note = chr8:79428289-79428947
  misc_feature 1..658: note = hyper
  source 1..658: mol_type = genomic DNA
aacagtccatgcagccggggtgacgggggagcgctcggaggaaggacgctatgcagagaaagcccccctggctcttctctctcaatccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcggaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaaggtaagcagcccggcaccggtgcgccctggccgcactgcgtggagctttccgcttggttaataatggggtttgcagcacggagggaagaaggggagaaccccgctgcattctgcaatgagaaaaggagcaacaactaggatggaaatgttgggcggccaagtgcagaggttggaggagcagtgttactgggcaaacaaagaaggcgttcttgcctctatactcttttgaacgtgatctaccattt

SEQ ID NO: 32121 - DNA, 578 bp, Homo sapiens
  misc_feature 1..578: note = chr8:80523889-80524467
  misc_feature 1..578: note = hyper
  source 1..578: mol_type = genomic DNA
attgcaaagtcaaagcggtcccatcccgctgtttgaaagatgggtggagacggggggaggggatggagagaactgggcacattttacggtattgtctcgtcgaagaaaccgctagtcctggggtgcggtgcagggaggtaagacggcgggggacagggtgggggtaggacctccgctcctttgttttagggcaagggaggggaaggagagaggaagtcgcggagggcgtggagggcgcgggtgggcagctgcaggggcggggaagcgcgcggcagggaggggtggagggacagcggcttcgaaggcgctggggtggggtttctttgtgtgcggaccagcggtcccggggggaggcacctgcagcgctgggcgcacaatgcggacagccccacccagtgcggaaccgcgcagccccgcccccccgcccggtgctgcatcttcattcgaaagggggtcgggtggggagcgcagcgtgacacccaggagcccaaccctgcggggacagcggcgccacgccccgcgctccccgctcccgactccccgccgcggcttccaagagagacctgaccactgacccc

SEQ ID NO: 32122 - DNA, 13 bp, Homo sapiens
  misc_feature 1..13: note = chr8:80524468-80524481
  misc_feature 1..13: note = hyper
  source 1..13: mol_type = genomic DNA
ccctccccacgct

SEQ ID NO: 32123 - DNA, 928 bp, Homo sapiens
  misc_feature 1..928: note = chr8:80524845-80525773
  misc_feature 1..928: note = hyper
  source 1..928: mol_type = genomic DNA
tgccttgagtgcccacggttctggcgctcagtggccccggggtgaaaaggcagggtggggcctggggtcctgtggcagctggaagcacgtgtcccccgggacttggttgcaggatgcggagacagggaaagctgccgaaaggactccatctgcgcggctccgccctgccctaccctccccgcggagccggggagacctcaggctccgagactggcggggaagaggaatatgggaggggcagttgagctgtatgcagtcctggaacctcttttttcagccccgcagtccacaacggcccgagcaccccttgatgtgcgcagacccccggcgtggctctcagccccagcaccgagcccctcccagccaagcgggtggctctgcagaaaagctggctcgagccccgcccggccacacaaaggcgcggccccacccagcccgggcgcgagaccgcagaggtgacccccttcccagggattcagggagggctgtctcttctcgcccacccacggtccgcggagctcggggctttttttcccccagcccaagccccccgcccaccctctgttctctatgattttccagaatggagaccccgcgaggggcttctctaagggagaccctcgctcctccagcggggcgcggctcggccccacccctcccagctgaggcccagagccgcctaccgctggccgggtgggggcgcacgtggcgactgggtgtgtggagcgcagccagccctgcagagccccgcgccgcgccctgcgctcccctccccggagttgggcgctcgcccccgcggtgcagccggggagaccggtttctgcgcagtgtcctgagctacccccgctttccacaattcgcagttcactcgcacgtccagaaaggttctgagaatgggtggtgggggcgatctcgcctcgctttctgc

SEQ ID NO: 32124 - DNA, 345 bp, Homo sapiens
  misc_feature 1..345: note = chr8:80803548-80803893
  misc_feature 1..345: note = hyper
  source 1..345: mol_type = genomic DNA
gacagaaaaccgagccctatttgttattagtatttttttttttatactctcaaatgccaccggcacattcttttaaaaaaaaatgaaaggaaagaaagaaagaaaaagaaaataagagaggaaaaggtcctgagaaatgacggacgcttgaacctcgggcccgggaagaccagcgccctttggcggctaggcctcgggggcgtgcggagggcgggcccccgcgcggccgccgctttcccaggccgccaggggtgaggaggtgacgctgcgggcttggtggcggctggtttttcacacaggaatcctcctcgccaccgctccctcgaaggccgccccccgctccac

SEQ ID NO: 32125 - DNA, 101 bp, Homo sapiens
  misc_feature 1..101: note = chr8:81400332-81400433
  misc_feature 1..101: note = hyper
  source 1..101: mol_type = genomic DNA
aaaaggctgactttgcggtaaaaaaattttattagctgtgattttagagaagctggtctatgctcacagacgtttagtgtgctggtcgaagtcaaatcggg

SEQ ID NO: 32126 - DNA, 324 bp, Homo sapiens
  misc_feature 1..324: note = chr8:81478141-81478465
  misc_feature 1..324: note = hyper
  source 1..324: mol_type = genomic DNA
ctgcgtgggtgttctcgtctttcctcctatcgtatgttacggttacctgcagaggctggcgtcgaaggagaggtgctatgcgaggatggccccaagttaaacagtgacagcctctgccctcccagaccccaggcgcgcgggggcgggcgcggaacaccggttccaccgccaccttcaggcctcccggtgtggcgcggttcgggacgtcacacaaataccagggcacccatgtttctgccctgggaaactctcacgtcagccggccccccaattctgctaaaggagaaaacaaaatttccctcccatggacgcagctgggcactt

SEQ ID NO: 32127 - DNA, 672 bp, Homo sapiens
  misc_feature 1..672: note = chr8:82192624-82193296
  misc_feature 1..672: note = hyper
  source 1..672: mol_type = genomic DNA
ctggttagcacctcccgaccccgagaaggcccagggggcgcccggcgggcggggcggggaccgggcgaggcccgcctcccattggccgcatagcgccgcccagcgcgggccgccgttataaagcagccgccggcgccgggtgcctcacagcacgctgccacgccgacgcagacccctctctgcacgccagcccgcccgcacccaccatggccacagttcagcagctggaaggaagatggcgcctggtggacagcaaaggctttgatgaatacatgaaggagctaggtgaggcacccggcctggcagcgcctgcaacgtggcgtgttgtgcggtcgtctgtccctaggtccccgtcagcgtgccagattctggggcaggagatgctcggcggcctacccccatcccctcccatcttccccaccacgcggccgttgggtgcagcgcgcgcagcaccacgcgggcaggcggcgaggagcagggagcgtgcgcgcctcttgcccgcccgcgggccgcaagattccggaggtggtccaccccgtggtccacctacctctgcttctttcccttcgcccaaacggcagcccttccgcattgcttcctgtcctttagcgcgcgcacccgtcacctcacgctgcacttctttcgaccccctccaggcgaccctgtatttcc

SEQ ID NO: 32128 - DNA, 165 bp, Homo sapiens
  misc_feature 1..165: note = chr8:82193521-82193686
  misc_feature 1..165: note = hyper
  source 1..165: mol_type = genomic DNA
ttcctctgtcagccccgtctcccccaggtcctctgctcgcccttaccagttgagccgaaccctttggattggtaccccatggaacaccagggcccccgagaagcgtggcgctggcggtgccgacctgctgctggcactgccgggccggggcgccgcagtgggcgg

SEQ ID NO: 32129 - DNA, 42 bp, Homo sapiens
  misc_feature 1..42: note = chr8:85094795-85094837
  misc_feature 1..42: note = hyper
  source 1..42: mol_type = genomic DNA
catgcccccacccaccgctccgcaacccgcagaaagaaaccc

SEQ ID NO: 32130 - DNA, 191 bp, Homo sapiens
  misc_feature 1..191: note = chr8:85095307-85095498
  misc_feature 1..191: note = hyper
  source 1..191: mol_type = genomic DNA
cacacactcccaatgcgaggcggcggcggcagcaacagaggcagcagcagcaatcgcggcagcagcggcagaggcggcggcagctgcgcgcctcgggcccaaccccgctcggctccccctctcgccggcgccctgcctgtcttgcgtgtgcgtgtgcgtgtgctcagcctcagcgtgaggggcacctgctc

SEQ ID NO: 32131 - DNA, 180 bp, Homo sapiens
  misc_feature 1..180: note = chr8:85095499-85095679
  misc_feature 1..180: note = hyper
  source 1..180: mol_type = genomic DNA
tctgggctcacagcgaaggcagcctcgccgcgagctgccgctgccgctgctgccgccactggtgttgccgctctcaggcgccaggctccccgtcgccgccgccgccgcctcgccagccagagttgggctccgtgggcttcccccctcgcagcctcggtccttccccgctgcctgcaagtc

SEQ ID NO: 32132 - DNA, 117 bp, Homo sapiens
  misc_feature 1..117: note = chr8:85095999-85096116
  misc_feature 1..117: note = hyper
  source 1..117: mol_type = genomic DNA
gttctgtagacaaggcgctgtgtctcggagtccgcggcgaccgtgcccgctgggagcgtctcccaagtccagcaaaatgtgcaactggttttatggaaaaagcgatgtgaagtatgg

SEQ ID NO: 32133 - DNA, 139 bp, Homo sapiens
  misc_feature 1..139: note = chr8:85096583-85096722
  misc_feature 1..139: note = hyper
  source 1..139: mol_type = genomic DNA
aaaaaaaatgaagtgcggtttggtttccttgtcaacggaggatgaagtgaacagctgagcagctcgcagagagcaggtacttggtccccttggaggcgtttcccgggtgtgcagtggcaacactggtcctagcaaagaa

SEQ ID NO: 32134 - DNA, 151 bp, Homo sapiens
  misc_feature 1..151: note = chr8:85096852-85097003
  misc_feature 1..151: note = hyper
  source 1..151: mol_type = genomic DNA
cgttttctagatgtgcgcaaaatacagtcccctccccccacccctcccacggtgagctgcgcccaggtcgtctcccggcggggcgggtggcgtctgcgctgcgggccgcgccggccgggcactaggcggccggcgggccctgtaagttctc

SEQ ID NO: 32135 - DNA, 158 bp, Homo sapiens
  misc_feature 1..158: note = chr8:85097062-85097220
  misc_feature 1..158: note = hyper
  source 1..158: mol_type = genomic DNA
cgggctagaggggaccctcagagcacccgggagatgggggtagaagcggcagagaccgcatattccggaggggctggctccaggccacgcgagccggagctggagacatttccagagccttgaggatggcaccggccctcgcacgctcaactcctgct

SEQ ID NO: 32136 - DNA, 53 bp, Homo sapiens
  misc_feature 1..53: note = chr8:87081803-87081856
  misc_feature 1..53: note = hyper
  source 1..53: mol_type = genomic DNA
cagcgctggtggccccgggaccaccttcctgctggcgccgcaccccatacccg

SEQ ID NO: 32137 - DNA, 941 bp, Homo sapiens
  misc_feature 1..941: note = chr8:89339042-89339983
  misc_feature 1..941: note = hyper
  source 1..941: mol_type = genomic DNA
gtgaaaagcatggaccggctacaattgtgtctttgagcgcgcagcatcgtgctttgtgctgccggggataacggattctgggtctcacacgcatccgtcacctaaaacacccttaaactgaaccagggtctccacagctggaagggaaacaacgtgctgggacccaggctgctctgagctacaaggatcccaggagtgaaggaaatgtttcagggagcagcccaggcagcggggggaggaagaaagccctcgcactcttacctccacattgaaatactgctccgttccgcagactgtagcacataaaatccaaagcaaggtttgcaagaaaaacacccccgaatgatgcacgaaatccaaccgtcttccagtgctgaatgtgagtaagatcatagtgaactgtgcttcaatggatggacgagctccccttcgttttctccctctctccctctccctccctccctcgtttcctttcaaaaaaaagtcctccgggtgggtaaggagcctgcaggttcacccacagccgggcaaggggaggagacaggggccccgcgctcggcagcccccgagaggcagcggcgaagacagggtcagcagtagttcctgttcaccatcctccggggtcagtcaccgggaacgtggcgcctaagttcaccggcggttccggctcaaagagcctagtcgcagccgcagcagcagcagccgccgccgccgccgccgcctccagcccgtgcgtcctcctcctgcactgcctactcctcctcctcctccgccgccgccgccgcccccagctcctgcgggaagggcctccgccgctcctcactctctcgcctctgcttctccttccctcctctcctcgctcccctccagaatgttcatccgtaatctacataactcctccttcccggggtctgcctggctctcggggcccttggcgcgcg

SEQ ID NO: 32138 - DNA, 10 bp, Homo sapiens
  misc_feature 1..10: note = chr8:89340043-89340053
  misc_feature 1..10: note = hyper
  source 1..10: mol_type = genomic DNA
cacacacgcg

SEQ ID NO: 32139 - DNA, 156 bp, Homo sapiens
  misc_feature 1..156: note = chr8:89340081-89340237
  misc_feature 1..156: note = hyper
  source 1..156: mol_type = genomic DNA
cgcgcgcttcttaaaggagacggctcataaaggattccccactacggtagggcgcaccggaggtatccagcccgcgacaagggccctggtttgagcacagctcttcgacagtatctcccatcccgcatccccgaggcaggcacccaggaacttggg

SEQ ID NO: 32140 - DNA, 711 bp, Homo sapiens
  misc_feature 1..711: note = chr8:89340273-89340984
  misc_feature 1..711: note = hyper
  source 1..711: mol_type = genomic DNA
cgcatctaaaaacgagtgcgcccctctccagccatgagctgggtggggctcaggctgcggaccctagtggggcctggggagcggcccaaccctggtcctggagagcggtcggcattcctgaggaagcggccctggaagaataggggcgctgggaatcagaggagcgcctggtcactgagcgcccctgggtggctcgggtcggtggccggggctgaccaagtttgggaagactgagatagcaaatcccgaacgtccaaaactttgttggggtcccgagcctgtggcctggtgtcttcctgaatcccctctaccatagctacattccgccttccaggcttgaggagtaggcacagggttttggtggcggactagacaaatacagaagcgggatgaaaacgctcactttccaagtgaacggtggacacacgcgcacagtgggacccgggagagatggtcctgggtgttaacaaaacatccgatgagagggatgggggcgctggaaagaaaccggctgcgggagccaggggaagggttggggaaagaaggagaagaagcagcctgaggaaaggcgagtaaagcagctggcaagggcgggaggaagaggctgctcgcagaccgagcgggggagaggctggcgggagctaggagagctgcaggcaagagggggaggcggctggcaagaagcacgggcgaacgcgggcagggaacttc

SEQ ID NO: 32141 - DNA, 32 bp, Homo sapiens; identical to SEQ ID NO: 9668
  misc_feature 1..32: note = chr8:91094254-91094286
  misc_feature 1..32: note = hyper
  source 1..32: mol_type = genomic DNA

SEQ ID NO: 32142 - DNA, 33 bp, Homo sapiens
  misc_feature 1..33: note = chr8:91095051-91095084
  misc_feature 1..33: note = hyper
  source 1..33: mol_type = genomic DNA
gccgggcgctgtcctcggtgctgctcagctcag

SEQ ID NO: 32143 - DNA, 15 bp, Homo sapiens
  misc_feature 1..15: note = chr8:91095141-91095156
  misc_feature 1..15: note = hyper
  source 1..15: mol_type = genomic DNA
cggccccaagccggg

SEQ ID NO: 32144 - DNA, 189 bp, Homo sapiens
  misc_feature 1..189: note = chr8:91804064-91804253
  misc_feature 1..189: note = hyper
  source 1..189: mol_type = genomic DNA
ggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacgtaagtacagatggtgggagctgggcggttgcttcccagc

SEQ ID NO: 32145 - DNA, 463 bp, Homo sapiens
  misc_feature 1..463: note = chr8:91997046-91997509
  misc_feature 1..463: note = hyper
  source 1..463: mol_type = genomic DNA
tagctccttttttggcgatggctttggtctcggccacttgcccctccgtcgggctcccctggccccctacactttctttcccctcatccgacgctctcgctcccatcccactcccattcagggtccacagggtactgaaggggccctgagagatttcccgacccacctcagagcttctcttcctcgcctcaactttcccggggtcgggcctgggagacggcgcccacccgcctcctccacaccacggggcccgacttccgtcccccagtgtcgctcatcctccctagccacttaccgactcaaaatccacggggatttcggggcagcagcgtcgccgcgctcagcccacacgcggaggccgagcgccctgctgcccgtcggggaacggctcctgccgctggtccgctggctgaccgcggtggcggcggcggggggcgaggggcggggggcgaggggcgggggg

SEQ ID NO: 32146 - DNA, 479 bp, Homo sapiens; identical to SEQ ID NO: 815
  misc_feature 1..479: note = chr8:91997527-91998006
  misc_feature 1..479: note = hyper
  source 1..479: mol_type = genomic DNA

SEQ ID NO: 32147 - DNA, 401 bp, Homo sapiens
  misc_feature 1..401: note = chr8:93114306-93114707
  misc_feature 1..401: note = hyper
  source 1..401: mol_type = genomic DNA
cgacgggaacacccaggagggccggggcggctgagtccagagcgcgcagaggtcgggcggggacgactctccccatcggcccctgactgcgaagcccgggaccagcctcgggcgggagccgccgtccgcccgctcacccaggagcttcccagtccagcaccccaaacggccaggagtaacaaggaaagttcgcaggcaggcgcagagcgcctgggtacctctaagcaaacccccaccctagttgcagccgggtcccaaagttaagatcccgcctctttactccttagggctaagttttccaccatcaaaacaagtctttgcttccagtttacagaaaaagaaaagaaaaaaaaaaaaaagaaaggaaaagaaaaaaacccacgatgcgggcatagggccac

SEQ ID NO: 32148 - DNA, 30 bp, Homo sapiens; identical to SEQ ID NO: 9673
  misc_feature 1..30: note = chr8:93115382-93115412
  misc_feature 1..30: note = hyper
  source 1..30: mol_type = genomic DNA

SEQ ID NO: 32149 - DNA, 167 bp, Homo sapiens
  misc_feature 1..167: note = chr8:93115692-93115859
  misc_feature 1..167: note = hyper
  source 1..167: mol_type = genomic DNA
gcaggggggaggacccgcggcggggcgtgggggaggtggaggtgggagacatctgtgttgtgcgggggtcacggaggtcaagtatatgttaacaatgggcaggcccggcacgctagggcgcgcgggctggcgggcggcctccctcccggcctcgccctctcccatgc

SEQ ID NO: 32150 - DNA, 30 bp, Homo sapiens
  misc_feature 1..30: note = chr8:94712418-94712448
  misc_feature 1..30: note = hyper
  source 1..30: mol_type = genomic DNA
gggcctctggtttcacgtctccctcctggt

SEQ ID NO: 32151 - DNA, 300 bp, Homo sapiens
  misc_feature 1..300: note = chr8:94713129-94713429
  misc_feature 1..300: note = hyper
  source 1..300: mol_type = genomic DNA
gggtccccacactgccgcgggcagtgcggaagcctaggaggcagccgggcgcccaggccgcgctgcgcggagcagccggagcagccacctccccagttaaggccaggcccacccggcctgggccttttcctgtgcctacacagtccggatagtgaggtcaggaccccatggagagcagtccgcgccgggagacgctgggtcgttgatgggtttacgccttcaaagctgcagaatgcccggggaatgtttgcatgttaaattaacgtgaagccttctcatctctaacgagaatgttttgcc

SEQ ID NO: 32152 - DNA, 30 bp, Homo sapiens
  misc_feature 1..30: note = chr8:95246973-95247003
  misc_feature 1..30: note = hyper
  source 1..30: mol_type = genomic DNA
cttccagcttcatctcggggcgctctgttt

SEQ ID NO: 32153 - DNA, 30 bp, Homo sapiens
  misc_feature 1..30: note = chr8:95651480-95651510
  misc_feature 1..30: note = hyper
  source 1..30: mol_type = genomic DNA
gtagctcggagttaccggggctggggagga

SEQ ID NO: 32154 - DNA, 229 bp, Homo sapiens
  misc_feature 1..229: note = chr8:97156981-97157210
  misc_feature 1..229: note = hyper
  source 1..229: mol_type = genomic DNA
agcgcagcgggaagtcgcatacaccctcgcagtgataggcctcgtactccaggggcgcgataatccagtcgtcccagcccagctccttgaagttcacgtgcaggggcttcttgctgcagcgtagcctggacttcttgccgtgccgcttgccatggcgactggcgaaggccgtgcgccgccgccggcggccgggcgagggcagccaaggcctggcatccggggcgcccga

SEQ ID NO: 32155 - DNA, 232 bp, Homo sapiens; identical to SEQ ID NO: 817
  misc_feature 1..232: note = chr8:97157666-97157898
  misc_feature 1..232: note = hyper
  source 1..232: mol_type = genomic DNA

SEQ ID NO: 32156 - DNA, 134 bp, Homo sapiens
  misc_feature 1..134: note = chr8:97158021-97158155
  misc_feature 1..134: note = hyper
  source 1..134: mol_type = genomic DNA
ggcctaccgggttttccccccaaaaggcttcgtaaccactaatgtgccctttgtggtctcaagcctgggccgcgtttcccctagacctcctctgggctgggctggctcgttctcgttgacgtctcaaatgtcac

SEQ ID NO: 32157 - DNA, 163 bp, Homo sapiens
  misc_feature 1..163: note = chr8:97165633-97165796
  misc_feature 1..163: note = hyper
  source 1..163: mol_type = genomic DNA
ccaaaccgaagctctcgtactgttcccgcgctgagccctccctccccatctcactgaggcgcgcacgcggcctgcccttcccctggggccgggacctggggggttggctaggggcggccttccctgcactgtcgaccggtaagtcacccgggagcccagggga

SEQ ID NO: 32158 - DNA, 30 bp, Homo sapiens
  misc_feature 1..30: note = chr8:97166425-97166455
  misc_feature 1..30: note = hyper
  source 1..30: mol_type = genomic DNA
ccctggcctctttcacgcccactctcgggt

SEQ ID NO: 32159 - DNA, 45 bp, Homo sapiens
  misc_feature 1..45: note = chr8:97167178-97167223
  misc_feature 1..45: note = hyper
  source 1..45: mol_type = genomic DNA
cgggtccaggtgacacgcatcctctccggtcggaaagaggagctt

SEQ ID NO: 32160 - DNA, 212 bp, Homo sapiens
  misc_feature 1..212: note = chr8:97169708-97169920
  misc_feature 1..212: note = hyper
  source 1..212: mol_type = genomic DNA
cgctcctccccttgggggacccccggctccaccgagccaggccagccccactcgacggcgatttaaacatcccttaggcaaggcgccaagttagcgctgctggcccagctctaggcgggccgctgctctttcctcctcgccaggccgtccacgcgttgggggaggggaccctaggggggttggcgcggttaagagccccacgtgagaggggc

SEQ ID NO: 32161 - DNA, 35 bp, Homo sapiens
  misc_feature 1..35: note = chr8:97169921-97169956
  misc_feature 1..35: note = hyper
  source 1..35: mol_type = genomic DNA
gaagtccttgccaggagccggggatgcgcggctgg

SEQ ID NO: 32162 - DNA, 285 bp, Homo sapiens
  misc_feature 1..285: note = chr8:97170053-97170338
  misc_feature 1..285: note = hyper
  source 1..285: mol_type = genomic DNA
cgatgctaagcaagccccggaaggtccagcctgaggtcaccgccggtgacacatcaaatcaaaatcagtgagagggaaagtgaggctttccctttatcaagctggggctgcagccagcaacgcaccccctcctctgcgcacccctcccgcccgtggctccgcactccttcacccccgcgcggcgtgcgacaagccgcaccgccttcccagtcaacgaactgcctttcttcgcattttctgagaacccggagacgcggaggagacagcgcctttgaagatgctgtc

SEQ ID NO: 32163 - DNA, 824 bp, Homo sapiens
  misc_feature 1..824: note = chr8:97170377-97171201
  misc_feature 1..824: note = hyper
  source 1..824: mol_type = genomic DNA
cgcatccccagccctccaccgcattccggggttgtagcggtacttgtggatctcggtcctgctagtctggaggccttggctcgggaacagaggcctccccagactgggtgcacatgcaatccctcctctatctccaggatcgggggcatacagcgcagtggcggggatgggggtggggaggctacagggcaaaccagggtaaagtgatttcgcgtctacgccggattggggcccccaagacttttccccaacccttgtctgaatgccacaggcttccggagacacctccgaacagcccgcagggtcttttggtcctgtgccaaattcacagggcgcagcgaaccagttatggtgcccacttgggggaggggcagagattcttgccacttcattcccgggcaaagaaaatccgcgcccaaccgccggccagcctaggcctctgggacttcttctcttgaggaagggcctcttgagcagtcttctctgagcttccttagcctccttccgcaattgtagtagagaaagtgcacgattaacagaggactttgagggacagaaacaactgtagcaaggcgtgcgtcgtggggagggttggcgagctgcacgggcagcacggaggccagggactcagttgcactactacgaagaagccacatgtctttgcaaaggtgactttagtagccctaaaatcatcataaaatacctggcgttaatttgccctctggacctttcagcagctcatgaacctcgctgacctcgggctgcagcggcgagaccctcgagcaaggaacgcgactatgagtgagaggcggggactggagccg

SEQ ID NO: 32164 - DNA, 374 bp, Homo sapiens
  misc_feature 1..374: note = chr8:97171585-97171959
  misc_feature 1..374: note = hyper
  source 1..374: mol_type = genomic DNA
tgagggcactggccacgctgcagatcaacgccggtggcaagaaggggccgcaagggtttccgcagacacccacacatgcaggcgttcccacagagggtaccagggatttcccagacccccaccagccctcaggaatagcgtagagagaggaacgtcgcctggctgagaaaggtggatgggcatacccatgtacctttgtgtattaagtacccacaacctccgaacttagccgtccctgtcccggcccgcccaactgctgccgccgcatctgcagaaaccactcgtgttgaggcctcggagcagccgggagcaccacgctggagcaaaaaagccggagggcgcagggctccagcccggctgaccatcccacccag

SEQ ID NO: 32165 - DNA, 722 bp, Homo sapiens; identical to SEQ ID NO: 824
  misc_feature 1..722: note = chr8:97172018-97172740
  misc_feature 1..722: note = hyper
  source 1..722: mol_type = genomic DNA

SEQ ID NO: 32166 - DNA, 140 bp, Homo sapiens
  misc_feature 1..140: note = chr8:97172821-97172961
  misc_feature 1..140: note = hyper
  source 1..140: mol_type = genomic DNA
cgacgaggaggatgagatggaagcctgctggaaaccgggcaaatcccacagaaaactgatgaggaagacggccgagagcaggaccctgggagtatccatggcgggcaagtggctgcgtctccccaggaggcggtggcggc

SEQ ID NO: 32167 - DNA, 564 bp, Homo sapiens
  misc_feature 1..564: note = chr8:97172962-97173526
  misc_feature 1..564: note = hyper
  source 1..564: mol_type = genomic DNA
gcgcaggacgcgcggggcacggagcggctggacagcggccggggcccggctcctcgggcggactcggagtgcgaggagccgggtcccagccacacaaaccccggccccgccacgccccctcccgcccctcgccgggaggggaggaatggggagggagggcagaggaggggtggggagggtgggaggagagccgggtggtgcgggccggaggtgtgggggagaggggccgcggtgcgccggtgtggcaggaagacgcagcgcccccgcgggacgcgcgcggggttgccgggcggtgcgcgcggcgcgggccgcaagcgctgaccgggggaaggcgggcgctgccggcccgtggccggggagcaaaggctggcccgccgcgccagggtccccctcgaactcccggaggtgtggtccctccgcagcgcggccccggctctcggtcctcgccagccgcctccactttcctgggagcgagcggccccggaggagggaagcggcggcggcgcccccaagagacagcttggagcaggcgcctctgctgcaggctgcgtgctgcctcggggc

SEQ ID NO: 32168 - DNA, 32 bp, Homo sapiens
  misc_feature 1..32: note = chr8:97173527-97173559
  misc_feature 1..32: note = hyper
  source 1..32: mol_type = genomic DNA
gtggtaccctccctcctcggccccaaccgcca

SEQ ID NO: 32169 - DNA, 42 bp, Homo sapiens
  misc_feature 1..42: note = chr8:97173822-97173864
  misc_feature 1..42: note = hyper
  source 1..42: mol_type = genomic DNA
gctgctccacttcttcgtctgctcccgggatcctctccctct

SEQ ID NO: 32170 - DNA, 30 bp, Homo sapiens; identical to SEQ ID NO: 9688
  misc_feature 1..30: note = chr8:97505645-97505675
  misc_feature 1..30: note = hyper
  source 1..30: mol_type = genomic DNA

SEQ ID NO: 32171 - DNA, 231 bp, Homo sapiens; identical to SEQ ID NO: 3340
  misc_feature 1..231: note = chr8:97506177-97506408
  misc_feature 1..231: note = hyper
  source 1..231: mol_type = genomic DNA

SEQ ID NO: 32172 - DNA, 157 bp, Homo sapiens
  misc_feature 1..157: note = chr8:97506447-97506604
  misc_feature 1..157: note = hyper
  source 1..157: mol_type = genomic DNA
cgttttgccctggttgcaagcagcggctgggagcagccggtccctggggaatatgcggcgcgcgtggatcctgctcaccttgggcttggtggcctgcgtgtcggcggagtcggtgagtgggccaggcggaggatgcgcgcgccgtttagggtgtttg

SEQ ID NO: 32173 - DNA, 46 bp, Homo sapiens
  misc_feature 1..46: note = chr8:97506848-97506894
  misc_feature 1..46: note = hyper
  source 1..46: mol_type = genomic DNA
cggcgggtcttgctgcgtggtctgggaaggacggaggggaaagggt

SEQ ID NO: 32174 - DNA, 580 bp, Homo sapiens; identical to SEQ ID NO: 3342
  misc_feature 1..580: note = chr8:97507115-97507695
  misc_feature 1..580: note = hyper
  source 1..580: mol_type = genomic DNA

SEQ ID NO: 32175 - DNA, 219 bp, Homo sapiens
  misc_feature 1..219: note = chr8:97657861-97658080
  misc_feature 1..219: note = hyper
  source 1..219: mol_type = genomic DNA
atggggaagctgtgacgtgggggtggtggagggtgctgcgggacagcagcgagcacggccctcagccgtccttcccaacacggtttcacttcccctcagctccagggctcagccccaagccgcccccttcatcccccatctgcaaacaatcctggtccccctgagcctccaatatgccttatgcagttcttttggggttcctttcgcattttaccgtgt

SEQ ID NO: 32176 - DNA, 50 bp, Homo sapiens; identical to SEQ ID NO: 828
  misc_feature 1..50: note = chr8:98289818-98289868
  misc_feature 1..50: note = hyper
  source 1..50: mol_type = genomic DNA

SEQ ID NO: 32177 - DNA, 455 bp, Homo sapiens
  misc_feature 1..455: note = chr8:98289922-98290377
  misc_feature 1..455: note = hyper
  source 1..455: mol_type = genomic DNA
cgcctgggtgtcttccccgagactctggtactgtgaagggtccgggtcgcgcggggcgtcgtccggagcagggcggactcgggctttggcgcggcctttgccccggtttttggcgcgggaggactttcgaccccgacttcggccgctcatggtggcggcggaggcagcttcaaagacacgctgtgaccctgcggctcctgacgccagctctcggtcgggaccgagcgggtctctccacggcaaccgccgacgtcacgaacgtacaactgtaccgtcgcgagaggacgtgatgcgcccggtgattggcgccgccgctgcggctgcgcaggagacgacccccgcgggcgctcccacccccatctcgcgcggactcgctttaggtctcggcgagtttctctgatatgcgctcgcgggggtgctgccatttcatctcttccgcgcgggctcatcgtgct

SEQ ID NO: 32178 - DNA, 129 bp, Homo sapiens
  misc_feature 1..129: note = chr8:98788308-98788437
  misc_feature 1..129: note = hyper
  source 1..129: mol_type = genomic DNA
caccatcctgctcggcgtctggtatctggtgagcgcggcgcgcccggcccgggaccctgcgttgcttccgcgcccctagctgggcttctggcccggcctcgcggtggggtgaggcgtgcgctcatccgc

SEQ ID NO: 32179 - DNA, 30 bp, Homo sapiens
  misc_feature 1..30: note = chr8:98788975-98789005
  misc_feature 1..30: note = hyper
  source 1..30: mol_type = genomic DNA
gcgtttccatctgcccggggaagccatttt

SEQ ID NO: 32180 - DNA, 94 bp, Homo sapiens; identical to SEQ ID NO: 9694
  misc_feature 1..94: note = chr8:99076589-99076683
  misc_feature 1..94: note = hyper
  source 1..94: mol_type = genomic DNA

SEQ ID NO: 32181 - DNA, 253 bp, Homo sapiens
  misc_feature 1..253: note = chr8:99076759-99077012
  misc_feature 1..253: note = hyper
  source 1..253: mol_type = genomic DNA
cgcgcttgcgctctacgcccaagggagccgggctgcagagctggagaaacttccgcggctacgggtgcagttgccttcggttcccggttccgggccgacacccgcgcagggctgagacaggtgtctgcgctccccgcaatgggctgctccagcagcgccctcaacaaggccggcgacagcagcaggttccccagcggtgagcagggtaccggcgccgcccgcgcccgggctggggactcgggtgggctaactc

SEQ ID NO: 32182 - DNA, 40 bp, Homo sapiens
  misc_feature 1..40: note = chr8:99077254-99077294
  misc_feature 1..40: note = hyper
  source 1..40: mol_type = genomic DNA
gttgaggccctaaggcggttagcctcggcattgccttaaa

SEQ ID NO: 32183 - DNA, 561 bp, Homo sapiens
  misc_feature 1..561: note = chr8:99438813-99439374
  misc_feature 1..561: note = hyper
  source 1..561: mol_type = genomic DNA
caacaaccccacccccgggcttcgggaaacttttcttcaggtccctaaaaggggacacctggagttcctccggtcccgccctgtccccggacacgcgcaagccgccctttatttcccagcccagctcccgccagacccagcggggaaaggtcaccgtaggcagccccctgcctgcgccctgggggtggtgataataacagctgtcaccgggggatggtcggggggaagggagaggtgtcggccccgcgccgagccgggggcgcaaggtggtcgcggtgacgcgccggggaagcgcagagaagcagcggcggcggcggctgcgccttccgagcccgggcggcggccgaggcacgcggagctgtccgttcagcaccaccgcgccgcgccccgcgcagggcgggcgccccgtcacacccgctctgctcccgccccggctcacggggcgaatgcggcgcgggttcctgcctctctgggtgggtgaggggcgcgcggatccggagagggggctccgggagcggcgggaccacgcagccacctgtgagccttcggcagctgcgggcg

SEQ ID NO: 32184 - DNA, 729 bp, Homo sapiens
  misc_feature 1..729: note = chr8:99439648-99440377
  misc_feature 1..729: note = hyper
  source 1..729: mol_type = genomic DNA
cagggagacctgggccggggacgcgggggctgcaggcgtgggatctggacccaggggaggccgggccgcccccctcattcccgcggcccgggtttccagactccagcgcatcccccccaccccaccaaagctacgcgccccccgtgtcggcccggccctgcccgtgcgtatctcagctccggtcccgcctgtctgcggcgagcgggcgggggcgtctcccgggcctgcccatggacaaggtcagcatgcagccccctgggcgctcagagccgcggggacgcgaccccgcacgcgcaaagcgcccaccgagacccctggggtggagctgtgctaatagaaacatacccacccccagcctttcctgggaggggatcagacccctcaaactcttgccccagcccagcccttcagcacccaagacccaccaggaggcctgggcccgccagtaatgggtagggagagggggccccgccagggcgcacggcgctctcgccgacgctgttccctccgcttccaggtgtagcgcccccgcgcggcgcgggcggccggcgcctccagcatgaccggccagagcctgtgggacgtgtcggaggctaacgtcgaggacggggagatccgcatcaatgtgggcggcttcaagaggaggctgcgctcgcacacgctgctgcgcttccccgagacgcgcctgggccgcttgctgctctgccactcgcgcgaggccattctgga

SEQ ID NO: 32185 - DNA, 59 bp, Homo sapiens
  misc_feature 1..59: note = chr8:99951404-99951463
  misc_feature 1..59: note = hyper
  source 1..59: mol_type = genomic DNA
atgcgtgcattctctcgagtgaaggaagaaggaagaggtagggacggaggaggagagag

SEQ ID NO: 32186 - DNA, 308 bp, Homo sapiens
  misc_feature 1..308: note = chr8:99951836-99952144
  misc_feature 1..308: note = hyper
  source 1..308: mol_type = genomic DNA
cagccaactcactgccgcgtaggaacggaggtcatcggaaatcaagatttccgtttgaattttcccaaagtttaagcgttggcaagtgcgttgaaaaacacacacaatatgaaagcctaataaaaatataggtttgcagaccgtgccctagtcttttccgaggatgttcttttctgtcatccatcgtctacccacgttgagcacgacagccgggccagtcccgccctgggcggttggggccttcccagaggggcccggtgcggagagcccccctctccccggatgtgtctggggcctgtccttcactg

SEQ ID NO: 32187 - DNA, 106 bp, Homo sapiens; identical to SEQ ID NO: 832
  misc_feature 1..106: note = chr8:99952198-99952304
  misc_feature 1..106: note = hyper
  source 1..106: mol_type = genomic DNA

SEQ ID NO: 32188 - DNA, 401 bp, Homo sapiens
  misc_feature 1..401: note = chr8:99952532-99952933
  misc_feature 1..401: note = hyper
  source 1..401: mol_type = genomic DNA
gccggctctgggctccgccgctgcggcagccgagggcctcagctgggaaatccaaacccgggctggacctgggctcaaggaggtttctgtccccaggctagaccaccacggccacggccacgcaacttgccctgagaccccgtgctcggccttcccactgagctccccttccctgtgactcagtgcctcgcaggctggtggccggaagggtgcctgcggctggctggcccggcccgattccgggtggcggggttcctgcagtgaggaacgaccctcagctcccgcagacgcgggaaggcccccgcgccatccgtgggagtggggcagcctgtctgcacgcggtcccctgggaaacccctctgcatctcccgcccggacaaggtccccggccttggaatctg

SEQ ID NO: 32189 - DNA, 96 bp, Homo sapiens
  misc_feature 1..96: note = chr8:99952968-99953064
  misc_feature 1..96: note = hyper
  source 1..96: mol_type = genomic DNA
cgctggggtcagaactggtatctttctcctcctctggggaagtcagggcagcccggagtggcgtcgtgggtccgaaaaatccgtctcagaaaccca

SEQ ID NO: 32190 - DNA, 335 bp, Homo sapiens
  misc_feature 1..335: note = chr8:99954228-99954563
  misc_feature 1..335: note = hyper
  source 1..335: mol_type = genomic DNA
ccctctccgcacacccgaaacccacaactcgcccgtgggccgcgtggcctttctgcgccgagggctgctgggggcgggcggcgagcctggcgggtgacctgctcttgggtgggccccgcaatgcctgcgccctagacgccggccgggacgaggggctggctgggtctgagcctggagaaacacaagggtcagcccccagtgggcgcagaggtggcccaggagggcccgcggacggtgctgcgctgcgctcagcctccgggccgctccccgcgttcggcgcgcacctgcccatcgaggcggcagggccagcaggcggcctaggcgcggccgggcca

SEQ ID NO: 32191 - DNA, 84 bp, Homo sapiens
  misc_feature 1..84: note = chr8:99954678-99954762
  misc_feature 1..84: note = hyper
  source 1..84: mol_type = genomic DNA
cgtggacgaagtaaacacatttatggaaaaaccccggggttaggaggtttgcggaaagagggagcagctcgtggggttggaaat

SEQ ID NO: 32192 - DNA, 100 bp, Homo sapiens
  misc_feature 1..100: note = chr8:99955180-99955280
  misc_feature 1..100: note = hyper
  source 1..100: mol_type = genomic DNA
aggatattaaacactcgaatctccgtttcaagctcactttttaatctttgcgaacttaaaattggaaagacagaaaaaaaatctgcgacccctgttatgt

SEQ ID NO: 32193 - DNA, 30 bp, Homo sapiens
  misc_feature 1..30: note = chr8:99955993-99956023
  misc_feature 1..30: note = hyper
  source 1..30: mol_type = genomic DNA
gaaatgaacatttgccgattaaagcttaaa

SEQ ID NO: 32194 - DNA, 30 bp, Homo sapiens
  misc_feature 1..30: note = chr8:99957393-99957423
  misc_feature 1..30: note = hyper
  source 1..30: mol_type = genomic DNA
tgggtcgacttgtcccggggcagccgcggc

SEQ ID NO: 32195 - DNA, 30 bp, Homo sapiens
  misc_feature 1..30: note = chr8:99957679-99957709
  misc_feature 1..30: note = hyper
  source 1..30: mol_type = genomic DNA
ttgtggagggagccccggatctgtcttcct

SEQ ID NO: 32196 - DNA, 450 bp, Homo sapiens
  misc_feature 1..450: note = chr8:99960048-99960498
  misc_feature 1..450: note = hyper
  source 1..450: mol_type = genomic DNA
tttcctctccctccccggagcgctctcctctctcctctcccctctcttctctctcctctctcgtctcctggggcatcccgggtggagggatgtaggggtcgctcctcggtgccaggccgggaagcagctcaggcctcccaagagcttggcgctcagtctgggaaaaggggttcctctggcctcagggacgttctccgcccccaccccaccccctgggagcctgaaccatctggaagggatcttagtcgggggttgggaggagagcccgtggataggaggagggggcgattctaggccgaatccagcccctgaggtgtcacttttctttcctgcggcccgtcaccgctgatagatggggctgagggcagaggaaggaaaaagaaaacctccgaggtcagtgcggggcgaggtgagcccctcccagggccctctggcccaggaggatgaagc

SEQ ID NO: 32197 - DNA, 34 bp, Homo sapiens
  misc_feature 1..34: note = chr8:99960921-99960955
  misc_feature 1..34: note = hyper
  source 1..34: mol_type = genomic DNA
gcagtcccctcacggctttcggggggtcttggag

SEQ ID NO: 32198 - DNA, 15 bp, Homo sapiens
  misc_feature 1..15: note = chr8:99961568-99961583
  misc_feature 1..15: note = hyper
  source 1..15: mol_type = genomic DNA
cgcctaagatgggag

SEQ ID NO: 32199 - DNA, 65 bp, Homo sapiens
  misc_feature 1..65: note = chr8:99961792-99961857
  misc_feature 1..65: note = hyper
  source 1..65: mol_type = genomic DNA
tgccacaaggccttccggaggcaagatcacctgcgggatcacaggtgaggcgggcaaggaggatg

SEQ ID NO: 32200 - DNA, 199 bp, Homo sapiens
  misc_feature 1..199: note = chr8:99985845-99986044
  misc_feature 1..199: note = hyper
  source 1..199: mol_type = genomic DNA
ggcctaggcctagttcgtgtccatgaagcctctccacgtggccgacttcccttagagaagtcccacaagccctcagccctcacagcctcgcccgcgacgccgtgcccacccctcccctggcagccccgagactctgggcgtgtgcttcccgctccccgagggccttaggcccagcggacgcccggccggagcctgatgc

SEQ ID NO: 32201 - DNA, 302 bp, Homo sapiens; identical to SEQ ID NO: 835
  misc_feature 1..302: note = chr8:99986225-99986527
  misc_feature 1..302: note = hyper
  source 1..302: mol_type = genomic DNA

SEQ ID NO: 32202 - DNA, 165 bp, Homo sapiens; identical to SEQ ID NO: 836
  misc_feature 1..165: note = chr8:99986791-99986956
  misc_feature 1..165: note = hyper
  source 1..165: mol_type = genomic DNA

SEQ ID NO: 32203 - DNA, 486 bp, Homo sapiens
  misc_feature 1..486: note = chr8:101118005-101118491
  misc_feature 1..486: note = hyper
  source 1..486: mol_type = genomic DNA
tctcatgtctgggagcggggataccgctaggagggcaggaggtaaagtccagaggctggcgcgtggtgcggccccgacgccgcgggctgatcctctgtccctgtggggccgccacctacccgcggtgagcctcttctcgggcatgccgtccccgctgcccgcgcctggagcccgcgcgggccgtcagggccctagcgcgcgggtccagcgcgggtcagggcctgagcgacgcggcgacggcgcgcgggctccggagctacgctggctagcgtggccggcgccgcgccggggttgctatggagcttagacaatacggccgcccagggaggccgaggccggccactcaggtgcctttcggggttcccaagctgcgacgggaacacccccgccgccccctaccctcccttcctcctcctctgggcagggaccagcgcggcgaacgaaggctgggggcggacgcgcgtgtggacccccagcgcggtcacc

SEQ ID NO: 32204 - DNA, 79 bp, Homo sapiens
  misc_feature 1..79: note = chr8:101661840-101661919
  misc_feature 1..79: note = hyper
  source 1..79: mol_type = genomic DNA
ccacgcgactcagagcgaaccccggcgcccgctctcgccggccggggacatctacaggtggggccggggccgggccgcg

SEQ ID NO: 32205 - DNA, 173 bp, Homo sapiens
  misc_feature 1..173: note = chr8:101821973-101822146
  misc_feature 1..173: note = hyper
  source 1..173: mol_type = genomic DNA
tgattggtgcagagacgctgtaaacgcacctttgcggaacacagacgacacaggaaagacgtttggcagtaatactacgacagcgaggggcccgggaagcccgcggaaacgcaggaggcggccaggagaggcagcgctacgcacatcccccccaccttcggagccctgtccta

SEQ ID NO: 32206 - DNA, 446 bp, Homo sapiens
  misc_feature 1..446: note = chr8:102505540-102505986
  misc_feature 1..446: note = hyper
  source 1..446: mol_type = genomic DNA
gtgggcgtgagtgcgcgcccgcgtgtggccccgatgggaggcgaggcgctgggaggccggggggcgcgggggcggccggcgccgtcccccactccctcgacatcccgccttcctcccccctcccccgcctccctcccccgggtccgcccccgcattgtttggccaccttcctcaggtgcccggggggaaaggacggttcgcgaactgggggaactcatgtgaggcctcgagttagggcctcggcggggcgcgaaggggcgcctgccactgagcgattcacccgcgcccccgacggcgtctgcacgcccctcgagctcgcggccctccacgcagttggccgccacctcggacgcggcaggcgggactgcgtggggcgcgccgagccttctcggggtgctctcgccgtcaaggccgagggctcggggcggcgggaacgctgggctcgc

SEQ ID NO: 32207 - DNA, 276 bp, Homo sapiens
  misc_feature 1..276: note = chr8:104152711-104152987
  misc_feature 1..276: note = hyper
  source 1..276: mol_type = genomic DNA
gccagagactgggaacggtaatgccggccagacgggtccgagcgcctcgggagccccagccctcctccggctgcggggccgctgctcctgctcccgggccgtcacggagccctgagggagggggcgggcgagcgggggccttggggcggccagggcgctgggagggaggactgggcggtggggaccggaggggagggagggccttggaggcggagaggagggacgggctgggagagggcccggactaggggcggcgggcaccgcaggagctccgcg

SEQ ID NO: 32208 - DNA, 295 bp, Homo sapiens; identical to SEQ ID NO: 9713
  misc_feature 1..295: note = chr8:104153267-104153562
  misc_feature 1..295: note = hyper
  source 1..295: mol_type = genomic DNA

SEQ ID NO: 32209 - DNA, 30 bp, Homo sapiens
  misc_feature 1..30: note = chr8:104310870-104310900
  misc_feature 1..30: note = hyper
  source 1..30: mol_type = genomic DNA
gtggaggtggcttcccggccccgcagccgg

SEQ ID NO: 32210 - DNA, 355 bp, Homo sapiens
  misc_feature 1..355: note = chr8:104511157-104511512
  misc_feature 1..355: note = hyper
  source 1..355: mol_type = genomic DNA
cattgaacccatctccgtgcttcgaaaatctgactctaacccgatctcttcgcgtctccgcctcttctttctagagtgagcgccaaaaagggcctgacagacagaagcctttggccccagcaccggcccagcccgtctctagacgattcttgctcctttcaccctcacagcctccagtggtcgcttcatcttcgcaccctcccggccaaccctaactctcctcgtctctcctcgcgctgtctcgcgtcctcccctcaggatccttccgcacattctcagcgtccagcgcggtttcccacaacttcctcacgccccgctcccctcgccctgtccccgccctcgacaccacctgcgt

SEQ ID NO: 32211 - DNA, 1150 bp, Homo sapiens
  misc_feature 1..1150: note = chr8:104511983-104513133
  misc_feature 1..1150: note = hyper
  source 1..1150: mol_type = genomic DNA
ctccccgcccggccccggacccagcctggagatcgcgctcgggaggggcggctgccgcccgcggggcgcccgcggtgcccgggcctgggcagcgaggaggtgacgccgcccccgcgggatgagcccgggaggcggaggggcggaggaggtgctggcggcggcactgagcggcggcggcgcagggcgcgcgggccttccgcgccgactccatcgacccaaggggcggcggcggtggcggcggctgagcgaccctgggccgggcgcgtgatgaggaggggccggcgccagaccccgctgcacgtcggagctcgcctggatccgggcgttggcagccgaagggccctggccccgggactctccgccgctagcccccgtcatatcttctccgctttcgcttctccactctagccgggggtggggtgggtggggttggggtctccgcgggggtttccggccccgcggcccgctcccgggtgtgcctggaggagttctccctctgtggcgcgcgggagccctgtgatgcgtcagccggcgggacggatgagttgcttctccgggaaaccgtcctcgcttcctcacgaccctctcggctcccgcctgggtgcccctcgggccggcagtactccgcctccgggcgctcgaagcgagttccccgggggcttgttcgcaggcaccccttcccctccgaggcggcgcgcgcgctcccggccctgaccgcggccggacacactcgcgccccggtccgcctgtcgccctcccgcctgctccctccagtcaccccacccttagctgtccccgccaccttactccaccaccctcccccgcctctccgcgcactccgcgtcccggcctccagttcccctttcccttgaaccgctcacttcacagcccttcgcccccgggaagaagaaacatttcccgaagcgcactcctcagccctccttccccacgcgctcgccctcccctccccctgcttttcttgggggaggggggctgtcgccttggattgaaggccattgatttgtatgtatttgtcccagcgctggaggctgccccagccgccgcgccggtgccgccgctgccagtggagttgcctccccgcttccctagggtggttcggctccaccaaacatgtcggctcctgtcgggc

SEQ ID NO: 32212 - DNA, 527 bp, Homo sapiens
  misc_feature 1..527: note = chr8:104513382-104513909
  misc_feature 1..527: note = hyper
  source 1..527: mol_type = genomic DNA
cctccctcccgctggcggcgcccaggccacgagggctgcggccagcgccggccgcccgggctgttttaggggtgtctgagagcaggggtgtgtgtcggggagggagggcgccaaggccggctgaggtgagggtggcgagccttaggcggtgtgattttccttggcgcctttccggatttcctcgctggtcatcttggctccggggccccagcgggactggggctgaacccaggctctgtgcgtaccctctcctttcccgccgcgctgaggcagtgactggggcacagaatccaatatggccgtgcacaggtgctccctggacggacccgggcgaaggcgcgctggcaggggatgcggacgccaccctggtcccacgcctccgcggggcggctctaccagcaacgcgggacagagcagggctgcccacagtggctgcgagcagcgggcggcggcgcgggctaggggcctaagctctgtcgcggtcgggtgggtgtgcgtccgccgccatcttccagcccctccccctc

SEQ ID NO: 32213 - DNA, 16 bp, Homo sapiens
  misc_feature 1..16: note = chr8:104513910-104513926
  misc_feature 1..16: note = hyper
  source 1..16: mol_type = genomic DNA
gcgagtgctaacaccc

SEQ ID NO: 32214 - DNA, 253 bp, Homo sapiens; identical to SEQ ID NO: 3356
  misc_feature 1..253: note = chr8:105235249-105235502
  misc_feature 1..253: note = hyper
  source 1..253: mol_type = genomic DNA

SEQ ID NO: 32215 - DNA, 161 bp, Homo sapiens
  misc_feature 1..161: note = chr8:105235643-105235804
  misc_feature 1..161: note = hyper
  source 1..161: mol_type = genomic DNA
cgccaccgcctccatctcctcctctggacccctctccaataaattggaggtcccggcggccaggaaagccacgtctcctccgggctgggtcagggaggcaggggccagagcctcagggtcccgtggcaccaacctggcttctggcccactggtcccggaac

SEQ ID NO: 32216 - DNA, 191 bp, Homo sapiens; identical to SEQ ID NO: 9719
  misc_feature 1..191: note = chr8:105235863-105236054
  misc_feature 1..191: note = hyper
  source 1..191: mol_type = genomic DNA

SEQ ID NO: 32217 - DNA, 187 bp, Homo sapiens
  misc_feature 1..187: note = chr8:105479247-105479434
  misc_feature 1..187: note = hyper
  source 1..187: mol_type = genomic DNA
cgacagcccccgagctctgcctcaggctgcaaatccggagcccggcggcctgacgggtttatgacctggccgcatatgcggctcctccccccgggaaggctgggctggagcccaaaggccgggattgaacaggtccgcatggtccttgcacactcagaccccaagtgttctgcgccctgagttgagg

SEQ ID NO: 32218 - DNA, 155 bp, Homo sapiens; identical to SEQ ID NO: 9720
  misc_feature 1..155: note = chr8:105600526-105600681
  misc_feature 1..155: note = hyper
  source 1..155: mol_type = genomic DNA

SEQ ID NO: 32219 - DNA, 266 bp, Homo sapiens
  misc_feature 1..266: note = chr8:105601010-105601276
  misc_feature 1..266: note = hyper
  source 1..266: mol_type = genomic DNA
gttcggtcagcggggcgcggggacgcggacacttaccgtacaccccagcgaggaaaagcaagagcaacgcagacctccaccgcggagactcttttgtgctccagcgacaggccataaccacagcagatggagagagagaggaggagacggaggaggagggaggagaagctggaggtagacgacgccgacgccgccgccgccgccgccgccgccgccgagccaccggctgctccctgcgctctccgcggctgcgggagggggaaggg

SEQ ID NO: 32220 - DNA, 58 bp, Homo sapiens
  misc_feature 1..58: note = chr8:105601510-105601568
  misc_feature 1..58: note = hyper
  source 1..58: mol_type = genomic DNA
ggcaatcccctggcccgcctgcctcggttccctccccgcgctccgctggactttccaa

SEQ ID NO: 32221 - DNA, 115 bp, Homo sapiens
  misc_feature 1..115: note = chr8:105601944-105602059
  misc_feature 1..115: note = hyper
  source 1..115: mol_type = genomic DNA
cacgctcaaggtgcccggaatgagtcgggcaaggcttgtgcagagcccctccagtctggcgtggaagcgccaagaggtcatttgacatctcacgctgggtcgggtgcagctgggc

SEQ ID NO: 32222 - DNA, 38 bp, Homo sapiens
  misc_feature 1..38: note = chr8:106330435-106330473
  misc_feature 1..38: note = hyper
  source 1..38: mol_type = genomic DNA
ggccctcctccaagccgtccccacgcctcccctccaac

SEQ ID NO: 32223 - DNA, 63 bp, Homo sapiens; identical to SEQ ID NO: 9724
  misc_feature 1..63: note = chr8:106331011-106331074
  misc_feature 1..63: note = hyper
  source 1..63: mol_type = genomic DNA

SEQ ID NO: 32224 - DNA, 174 bp, Homo sapiens
  misc_feature 1..174: note = chr8:106331083-106331257
  misc_feature 1..174: note = hyper
  source 1..174: mol_type = genomic DNA
cggcggcggcggcggcgggagccgagggagcggcagccgcgaccgcgggcaccgcgggagccccagcggcagcagccgccgccgagatgtcccggcgaaagcaaagcaaaccccggcagatcaaacgtaagtttgcgcgcggggccgggagttggtgggattattgcccaggag

SEQ ID NO: 32225 - DNA, 114 bp, Homo sapiens
  misc_feature 1..114: note = chr8:106331860-106331974
  misc_feature 1..114: note = hyper
  source 1..114: mol_type = genomic DNA
ggcgggtccggctcacgccgccaggacgctcagccgagcggggattcgggtggtgtctggccctggtggcgcgcggagtcctccctgggaggggccgccagtcacttcccagcg

SEQ ID NO: 32226 - DNA, 30 bp, Homo sapiens
  misc_feature 1..30: note = chr8:107281960-107281990
  misc_feature 1..30: note = hyper
  source 1..30: mol_type = genomic DNA
cagaagcttttttatcgctttaacaaaact

SEQ ID NO: 32227 - DNA, 196 bp, Homo sapiens
  misc_feature 1..196: note = chr8:107282301-107282497
  misc_feature 1..196: note = hyper
  source 1..196: mol_type = genomic DNA
cggcgtggtagcctccggctcgcggcgccccacggctcctctcagtctcccccgccgctgccggctcttggtagcttccacgcgggcaggtccggaaactgagcatgtctgcaagcgctcagcggcgccggcagcagcggggctagagctgggctgcgtcaggctgagcccattcacctcgcggccacaggagctc

SEQ ID NO: 32228 - DNA, 57 bp, Homo sapiens
  misc_feature 1..57: note = chr8:107282838-107282895
  misc_feature 1..57: note = hyper
  source 1..57: mol_type = genomic DNA
ggaagaaggaaagaccgcgcggcgagggaggagaccgggcggcgagggaggagaccg

SEQ ID NO: 32229 - DNA, 720 bp, Homo sapiens
  misc_feature 1..720: note = chr8:107283112-107283832
  misc_feature 1..720: note = hyper
  source 1..720: mol_type = genomic DNA
agggacagtgggctccggaggggcgagtggattcggataatttggggaatcagtaaaaggctagggggcacatcatgatggagtcagcctggaatctgtctcccgctagagtacccgaggccacatgttgggaactggctggggaaaggatggatgtagaaagtggcctggagggccgactggaaaatcgctgagggatttgggtgaagagggggggagctgtgcagtatcgggcggaggaactgggctgctggtagggcctgaaaggttcaggagagggttggaggcttccccgtgccgccccttgaatagtgatttagtactgttatctgaggttcactttcacccctggctcctcctccgtctactacccggcttggacgcacctcggctcgctgtaggcgagctttaggagatttaaatagacattaggcagtggggaaggtagtcgtttacggggggagctgctcgggcttccgttcagtggttcccggcacgctcagggtgcagtgtagggtctgaatgtgtgtattgcgggggtagggggagtggtgtcagttctaggccacaggaattcgtggtctggccccagaggtgcggtgtttttggccgggaagtcaggcagaagtctgcagcgtgcaactcgcagcggggcgtgtgtgtgcgtgtgtgcgcgcgcgtgtgcatgtttccggcccggggtcgcgtgtgtggctgcag

SEQ ID NO: 32230 - DNA, 22 bp, Homo sapiens
  misc_feature 1..22: note = chr8:107284032-107284054
  misc_feature 1..22: note = hyper
  source 1..22: mol_type = genomic DNA
ggaggactcagccgccggctgc

SEQ ID NO: 32231 - DNA, 167 bp, Homo sapiens
  misc_feature 1..167: note = chr8:107284055-107284222
  misc_feature 1..167: note = hyper
  source 1..167: mol_type = genomic DNA
accaccgtggactccctctatggaagggaatcctgggagtcccggccgtcagaggggttcccaaatccaaagggtccatctccaaggcgtcactccaggggtccgcggttcactttgctgccccttgcaggtgatgctgtgattgttgcctgcggactgggaagcac

SEQ ID NO: 32232 - DNA, 454 bp, Homo sapiens
  misc_feature 1..454: note = chr8:109093726-109094180
  misc_feature 1..454: note = hyper
  source 1..454: mol_type = genomic DNA
gggaaggggctgctgcgcgcccttcctgcgcgggtaattcgatgtgcgtgtggtgagtggtttatgtttaaatccacccagaaaattgaatcgtgtctagccgcccttcttctaaaatgcagttggattagttgcatctccagcggactccgagacagaaatacgcactaaatctgcaggaaagcgagttccccgaaacctttctggaggcttccacccgccttctccgctacgcacaagtgatggagagggagggagcagttaaaaagccgcaagtgaatttcattgagaacagaagcctccaccggtgtggctgcttttgcaaagcaaatggagagagcgaagtggggcctgttttaaaaacaaacctctggaggcgaggactccccagaaaaccagcgcgggaattgctgcttaattcagaaagttcccatctcgtcgcagtttccagaaa

SEQ ID NO: 32233 - DNA, 1040 bp, Homo sapiens
  misc_feature 1..1040: note = chr8:109094397-109095437
  misc_feature 1..1040: note = hyper
  source 1..1040: mol_type = genomic DNA
cagagagaagaacaacgacgacaaaaaaaaaatgcatgtcagataagaaatacgtcctaaagagacaagtttagatgaggaggtggggcggcgaacatgagtgcggaccgcacgacttagccctgagcgcccgattggcgcccggctcgccgagctcccagcgcgtctcgctccggctccccgcgcctccagggtacagaaaacagagtgttttgtagagctccagggtcctaaaggtggggactggggacccgcaaaagctggggtggagagcacagccctgaccatctgagcccccggagccagggcgtgagtgagcgcctccacacgccacccctgaagcccaccacgcacctttggcagagagggacccacctcgcttactgcgtctccatcggttgccttggcagtggctgtaatccatgcagttcagaatgatgagggcaaaggagaaaaggcgaaactgcatctgggcggtcgggcgggggagagacgcctctcaaagtctaggaactggagggttcgcccaaagagccggcgccggccgcgctgctggggaggactcagagggagactcgccactcacccccgggccgcaccggtcagttcagcgcgatcagcatctctccgccacgaacctgagagacaagaagcgaaaacagggtgtgtgggggatggagagagccccggggaggcagctgcgccttcgcacgtcccaatttaaagaagagagggaaggaggaagcgaacccactgcctagcacgagccgcggagcggcttaatccagagcgggcagctgcggacgagttggagaggaaggtgattataatcagtgaattagcaacctctgccgagccctaagctccgacccagcggcataatgcgttgtgccggcgctccggggaaaggaaagaactctaaaggcactgagagcgcagggctaaaagaacgctcttaggccatttggagtccacggcggtgtacccaagcgccgcagctgcggctgccttggtgtgggttgcctaccgtgcgcacgtct

SEQ ID NO: 32234 - DNA, 63 bp, Homo sapiens
  misc_feature 1..63: note = chr8:109095505-109095568
  misc_feature 1..63: note = hyper
  source 1..63: mol_type = genomic DNA
cgtgggctggggaaaagtttgccgagaccggctgggagcgcctggcagctctggaattccagc

SEQ ID NO: 32235 - DNA, 405 bp, Homo sapiens
  misc_feature 1..405: note = chr8:109095569-109095974
  misc_feature 1..405: note = hyper
  source 1..405: mol_type = genomic DNA
gccgccgcggggttggcgacgccaggcaggagcgcggagcggcgggtgcagccactgggatgctccgtccccgcccgcgagcgcggtccccaggcaaggggtgcgcccgctcacactctctgcctccctaaccaattgtgtcgcttcctgcgctttctccacggtcacttcacagctaagatttctttctttccgagctgtagaaggcagaacgctctcgggaggacgaagtgatccgaagggatgtggcaagcgcactttccgatggagatgcagaccggctgaggcttgggatgcttctataagtaggtggtgctgtggtccaaggcatctaagtctaggctgcctcggagttcctgggtcctaaagccagaaacgtcccggtttccctgaggtcctaaagaa

SEQ ID NO: 32236 - DNA, 170 bp, Homo sapiens
  misc_feature 1..170: note = chr8:109799570-109799740
  misc_feature 1..170: note = hyper
  source 1..170: mol_type = genomic DNA
aggtacggatgtgtccgcctagtactcggagacgaaggagagagagcggggatatgcgctccagctctgctaggctccagggctctcacccttgcattcaaagcctccaccccatcccactccccgccactcaccttctgcttcggccacccggtgcggctccagcaccg

SEQ ID NO: 32237 - DNA, 15 bp, Homo sapiens
  misc_feature 1..15: note = chr8:109799888-109799903
  misc_feature 1..15: note = hyper
  source 1..15: mol_type = genomic DNA
cgggagttgtaggcc

SEQ ID NO: 32238 - DNA, 345 bp, Homo sapiens
  misc_feature 1..345: note = chr8:110703537-110703882
  misc_feature 1..345: note = hyper
  source 1..345: mol_type = genomic DNA
accgcataggcgccccggtcttaccctttctcgcccagaagggccccatcgcgctgtccaggaggaggcacctacgtgcgcccgggagaccgggccccggctgggccgggtgccggtgcggacgggaccccgcgtcgctgctggtttgcgctcaggcccggggagccgggcccggcccgctccgcccgccttagcccggcttggacacgtggtgccgcggaatcccttgcgctccggtgccctcggcccctcggcctctgcagccagccgggcggctgctggggctgaggacaaaatggagagaagggcgggggaccaaagggcaggcaccgctgggtggggcgc

SEQ ID NO: 32239 - DNA, 65 bp, Homo sapiens
  misc_feature 1..65: note = chr8:110704189-110704254
  misc_feature 1..65: note = hyper
  source 1..65: mol_type = genomic DNA
gcacccttgtcctcacgctggagaggaagagccctgaacactgacttcagcgtgaacctaaggtg

SEQ ID NO: 32240 - DNA, 52 bp, Homo sapiens; identical to SEQ ID NO: 9735
  misc_feature 1..52: note = chr8:110986212-110986264
  misc_feature 1..52: note = hyper
  source 1..52: mol_type = genomic DNA

SEQ ID NO: 32241 - DNA, 691 bp, Homo sapiens
  misc_feature 1..691: note = chr8:110986328-110987019
  misc_feature 1..691: note = hyper
  source 1..691: mol_type = genomic DNA
cggggttggcatcgtcgcaaagctccagagggctgggcacggcggccagggccccggggcggcggtaggaagccaccaccacggccagcttgccaaggcgcgtgtgcgggaagcaggacagcgcctgctgcgagagcacgaagcggctgccgcccacgttgaccgtgaagcagtccccgagcgccaagggctccccttcaccctcgctgcagaagacactagagtccagggaggtcagggagccgctgtccagcggcgagtccagcagcgctctgccgctggaaggcatctctaacccagtcgccgcggcctgagggcgccacaaagttggggacacgccggaagctttggtcccgcgagggcggtggcacggcccctggtggcggccgggattccccgggctcccgaaggggttacctctccttggcgcaccctctccacccgctgtgcgccttcctcctcctgccgctagggagccgggagtgcgcggaagcagcgcacaagtggcagaaagaggagacagggagcagaggaagggtcgcgctaagagagaggatcaggtgaggtccaagcccgacacagtccctgtgcacactgccggtcgccctggcccttcccaaacgttgtcaccccgcctcccaacttcgcaattgcgattcccagcccaggaggtgtacagattgaatgactc

SEQ ID NO: 32242 - DNA, 202 bp, Homo sapiens; identical to SEQ ID NO: 9738
  misc_feature 1..202: note = chr8:110987020-110987222
  misc_feature 1..202: note = hyper
  source 1..202: mol_type = genomic DNA

SEQ ID NO: 32243 - DNA, 146 bp, Homo sapiens; identical to SEQ ID NO: 9739
  misc_feature 1..146: note = chr8:110987765-110987911
  misc_feature 1..146: note = hyper
  source 1..146: mol_type = genomic DNA

SEQ ID NO: 32244 - DNA, 15 bp, Homo sapiens
  misc_feature 1..15: note = chr8:114444379-114444394
  misc_feature 1..15: note = hyper
  source 1..15: mol_type = genomic DNA
ccaaccagatgattc

SEQ ID NO: 32245 - DNA, 34 bp, Homo sapiens
  misc_feature 1..34: note = chr8:114444481-114444515
  misc_feature 1..34: note = hyper
  source 1..34: mol_type = genomic DNA
cgttcaagccctgtcagtccggtaaattgggtta

SEQ ID NO: 32246 - DNA, 408 bp, Homo sapiens; identical to SEQ ID NO: 837
  misc_feature 1..408: note = chr8:114444784-114445192
  misc_feature 1..408: note = hyper
  source 1..408: mol_type = genomic DNA

SEQ ID NO: 32247 - DNA, 500 bp, Homo sapiens
  misc_feature 1..500: note = chr8:114445521-114446021
  misc_feature 1..500: note = hyper
  source 1..500: mol_type = genomic DNA
gttgggaaagactgtcgccttatgggcgaggactgtgggtgtcagtccccgggacacacgcggggctgaaagctccggacatggccacctgggcgggcgtctgtaaaaggtgctaatgagtgcctctggcagctcttccccctcataagacacccgcgcccctctccagtagcaactaactgcgggagaggatgcgatttccacttttccaaaagacctctgtggcaggagtagtatctccttggagtctcagagcacgcagaaacgtggatccttcgcgaagtcgctctggcgagaatccctggaaagacgctctggcgtggggtgcgcgacgccgcacccggtctcccacctgctgcctacccagagatctgtgccttcgcggtaccttcgctgcacggtgtgtgttcccctgggatccactgacaagcagcgtgggaaaacatcccatggatgtctctttacatgggcgggacgcttaagcacgacttggagattca

SEQ ID NO: 32248 - DNA, 388 bp, Homo sapiens
  misc_feature 1..388: note = chr8:114446958-114447346
  misc_feature 1..388: note = hyper
  source 1..388: mol_type = genomic DNA
tccaaagtaaattaacgcgcctttcctttctatcggcgcatctcattcggaaaatacggtaggtgcgggcagccggggctctaattgcaggcggcgcggatcagcgttagtcaggctgtaatgctcgccccgcttcggagacttccctccccctcatctgcccccgaatgtgttttggctcaacaggtatcacatgaaaactcgcacttaaaccctggtcatcttctcacaggagccacccttacatttttctgccagggctgctgctggctattcgcgcctcccccacgcgaagcgcgcgtctagcaggcagccccagggccatccattaaccaccaactcccagtggcaggcgaactaagcataaatgtgtggctcctcacccgtc

SEQ ID NO: 32249 - DNA, 101 bp, Homo sapiens
  misc_feature 1..101: note = chr8:114447347-114447448
  misc_feature 1..101: note = hyper
  source 1..101: mol_type = genomic DNA
agccagcgacaaagaaaccttgtaagcaacctgagccgtgctttgtacatttggcagtgtagttgtgccacttaggacaagcttttcggctcagagctgct

SEQ ID NO: 32250 - DNA, 32 bp, Homo sapiens
  misc_feature 1..32: note = chr8:114447789-114447821
  misc_feature 1..32: note = hyper
  source 1..32: mol_type = genomic DNA
tgttgacagccctggcgcgcctgggccaaaac

SEQ ID NO: 32251 - DNA, 73 bp, Homo sapiens
  misc_feature 1..73: note = chr8:114448753-114448826
  misc_feature 1..73: note = hyper
  source 1..73: mol_type = genomic DNA
ctgagggggggagaacgagctgtgaatcaactcctttagtattatcagattattttatcggtgcaaattgcaa

SEQ ID NO: 32252 - DNA, 67 bp, Homo sapiens
  misc_feature 1..67: note = chr8:114449039-114449106
  misc_feature 1..67: note = hyper
  source 1..67: mol_type = genomic DNA
ttggattcctttgctcggctttcccctttgcggatccctttcatattattcgcgagctcctaattcc

SEQ ID NO: 32253 - DNA, 200 bp, Homo sapiens
  misc_feature 1..200: note = chr8:114449402-114449602
  misc_feature 1..200: note = hyper
  source 1..200: mol_type = genomic DNA
cttgctttttttccccgaatagatcaattctgcctgtaaaagcagcccaagaaataatgttagtgagctctccgttgcaggctgcgaatacagaagcatgtcaaaggaatattttaatcggaggatctgtgttgcttttggggaaaccgtgacgataatgaatcgggctccatcgatgcccacgtcgttataatgggaca

SEQ ID NO: 32254 - DNA, 34 bp, Homo sapiens
  misc_feature 1..34: note = chr8:116660538-116660572
  misc_feature 1..34: note = hyper
  source 1..34: mol_type = genomic DNA
gcaccgcgcagcagccgaggatgagagaggtaac

SEQ ID NO: 32255 - DNA, 86 bp, Homo sapiens
  misc_feature 1..86: note = chr8:116660615-116660701
  misc_feature 1..86: note = hyper
  source 1..86: mol_type = genomic DNA
cgataacacgcccacagcccgggcgccgagcacgcgtggtggcggccgcaggcccggggctcctgcgagagcgaacgccagcgaca

SEQ ID NO: 32256 - DNA, 639 bp, Homo sapiens
  misc_feature 1..639: note = chr8:117950319-117950958
  misc_feature 1..639: note = hyper
  source 1..639: mol_type = genomic DNA
ctgggagcaaaggagcgtctctgaatggcggggcagttgcagcatcccacttggcaagggtccttgaattacctccgcccccgccctgaccccgccctaaacatcaaacttagaaactcatctttcagcagcagcggtagagcagtgaccaggcgtctccgcgatgggccccggggacttccgccgctgcagagagagaatttcccaggggctccagggactcccaggtagagcggagctttggttcccacctcgtcccgcgtgcgacttcttcggggacggcaggagcacggacatccaggaggaggccctcgccgccagcccgctgctggaggacctcagacgacggctgacgcgcgccttccagtgggcggtgcagcgcgcgatctcgaggcgcgtgcaggaggcggcggcggcggcggcggcgcgggaggagcagagctggacgggcgttgaggccaccctggccaggctgcgggcggagctggtgagagagcgggctaggcggacggctcccagggctccctctcccgggtcctctcctccagctgcagagccgctggccgcgtagcccacccgacgccttggggggcccctcaggtctggacacggcgttgacgcccccgcctccccagcatc

SEQ ID NO: 32257 - DNA, 107 bp, Homo sapiens
  misc_feature 1..107: note = chr8:120428615-120428722
  misc_feature 1..107: note = hyper
  source 1..107: mol_type = genomic DNA
tgcactgcagccaaccggcttgtgcgcgtcccaggagcgcgctataaaacctgtgctgggcgtgatcggcaagcaccggaccagggggaaggcgagcagtgccaatc

SEQ ID NO: 32258 - DNA, 39 bp, Homo sapiens
  misc_feature 1..39: note = chr8:120429017-120429056
  misc_feature 1..39: note = hyper
  source 1..39: mol_type = genomic DNA
cgggccggtgccctgcgacgccgccgacctgcgcccccg

SEQ ID NO: 32259 - DNA, 30 bp, Homo sapiens
  misc_feature 1..30: note = chr8:121135998-121136028
  misc_feature 1..30: note = hyper
  source 1..30: mol_type = genomic DNA
aaaggcgccttgctgcggccgcgccctgtg

SEQ ID NO: 32260 - DNA, 601 bp, Homo sapiens
  misc_feature 1..601: note = chr8:121136826-121137427
  misc_feature 1..601: note = hyper
  source 1..601: mol_type = genomic DNA
gcatcgctgctttggcgttttagagcccttggacttgttcacaagaggaagagggagaagaggaggctcgaagggggcctttatagtggatacctgtttcactcggagctcagggtctttgacgcgggaaggcaaagtctgtcttttggaaatggggaagtgggcacacagcacctgagaacaggagggctcgagacctcccaaagagagcagggggcctggtttgggagcttgcagtagcttctgccccagtggaagggaaagagcctggctcgctctcggcgcgccacatccggctgccgcgcgcacctggggggaccgccaggttcggggtaggcgagcgcgtgagcggcacggggctggcttctccacatctccggtagggcggggatgggggagaggaggaggagagaaagtgggggcgttatgggcttaggcctgcctcccacctccccacctcccgcctccgcggccaccctccgctctataattggctgccggcgggccttcctttcctcttatctgatcctgggctcccagctggagaggcggaggcagctccagggggctggaagtggaagcgcagcggcagaaggagagg

SEQ ID NO: 32261 - DNA, 81 bp, Homo sapiens
  misc_feature 1..81: note = chr8:121137638-121137719
  misc_feature 1..81: note = hyper
  source 1..81: mol_type = genomic DNA
gaaaagtggaggcagcgagccacctgcagacgcaatgcagttccatggactttcttttcacgcgcgcgcccagaatggact

SEQ ID NO: 32262 - DNA, 42 bp, Homo sapiens
  misc_feature 1..42: note = chr8:122651743-122651785
  misc_feature 1..42: note = hyper
  source 1..42: mol_type = genomic DNA
cggacgtttgggggacggagggagaggcgctaggggaactgg

SEQ ID NO: 32263 - DNA, 373 bp, Homo sapiens
  misc_feature 1..373: note = chr8:122652029-122652402
  misc_feature 1..373: note = hyper
  source 1..373: mol_type = genomic DNA
cgggaactgccgtgacgaattccccccaaggtgttgattatccatcccaacccagcctctggcttccctcccacctccaccccagctcccacaggcccctcgccccgttcatcggctgggcgctcgagacggcgcccccagatctcccaccgggcagtgtccccagctgcagctgaggagagaagcgccggcgtgcgcggtgccacgtcggaattggctctggggacgccgcagctgccgaagcgcagcgcgcggtccccacgcacgccctgcctccgggcggccggcgggctggcccggcgaggagaggagggatgcgcgccctcctcccgctcctatctgcgggtgccaccgcctgcgtcagggacccctg

SEQ ID NO: 32264 - DNA, 323 bp, Homo sapiens; identical to SEQ ID NO: 9754
  misc_feature 1..323: note = chr8:124173095-124173418
  misc_feature 1..323: note = hyper
  source 1..323: mol_type = genomic DNA

SEQ ID NO: 32265 - DNA, 30 bp, Homo sapiens
  misc_feature 1..30: note = chr8:124934797-124934827
  misc_feature 1..30: note = hyper
  source 1..30: mol_type = genomic DNA
ctcagagaccattagcgagagaaggcagcg

SEQ ID NO: 32266 - DNA, 30 bp, Homo sapiens
  misc_feature 1..30: note = chr8:126400946-126400976
  misc_feature 1..30: note = hyper
  source 1..30: mol_type = genomic DNA
gtgagactatgagaacgtaggattccatct

SEQ ID NO: 32267 - DNA, 164 bp, Homo sapiens
  misc_feature 1..164: note = chr8:131455233-131455397
  misc_feature 1..164: note = hyper
  source 1..164: mol_type = genomic DNA
gggcctgccaagcagcgccgggtccgggtaggggccgggggccgcggggaactttcctcggctgcaccagagacaatgccgggagggcgccccatcggcggggtccgggccgccaagcacgtcgtcccgggccctcccccggagggggacgcgaaaccccccag

SEQ ID NO: 32268 - DNA, 476 bp, Homo sapiens
  misc_feature 1..476: note = chr8:131455603-131456079
  misc_feature 1..476: note = hyper
  source 1..476: mol_type = genomic DNA
cccggcgcccttcttcgcgcgagagactgggcagggggcgcccgcgactgtgggcgactccgcccggccccgccgagcgcgcccgagcgccccgcaactcaccgggacctggcgggccgctgggcattattccatcgcgggttcggccgggcgctcgcggctctcgggtgggaaagcgaactgcgaccgggaagcgccggctgggcgggaggcgcgggcccggggctgcccagcgcacagtgctcgcccgcggcagcggccaggccaggcgaggcgcgggagccgagcgcggcgcaggaaggggcgggcgaccatgtgccgagggggaggaggccgcggcgacgcgagcggctcgcacgatcccgctcggcggcggagggcgcgggtttcaggaaatccaaacacttcgacaggaaatcggaatcctgactaagcattcccggccccgagccgctccgcgccgggggctcccgcct

SEQ ID NO: 32269 - DNA, 366 bp, Homo sapiens
  misc_feature 1..366: note = chr8:132051934-132052300
  misc_feature 1..366: note = hyper
  source 1..366: mol_type = genomic DNA
caggatgcccttgagcgggtccatgggggccgaggccaggctcaagtgtaggaccaagagagtgagtttggtcagcacgtccagcacgttcatcaccacttccgatttgcgcctttggcccaagaaatagcgctggtagaggcgttccaaatcccgagatttgaaggagttgcgcagggtggggaaaatgacccctcggtagctatagcccccattaagaaagaaatccgagttgctaggggcacagtcaaggtgcaggaagcccaggtcgcccccgcctccgctgccgctggcactgccgctcccgctgcgttccgggaagactttggtgccgcaggtgctgtgcgctcgctctcccgggcccag

SEQ ID NO: 32270 - DNA, 118 bp, Homo sapiens; identical to SEQ ID NO: 3368
  misc_feature 1..118: note = chr8:132052398-132052516
  misc_feature 1..118: note = hyper
  source 1..118: mol_type = genomic DNA

SEQ ID NO: 32271 - DNA, 409 bp, Homo sapiens
  misc_feature 1..409: note = chr8:132052589-132052998
  misc_feature 1..409: note = hyper
  source 1..409: mol_type = genomic DNA
cgcagggaaggaggcccagaaccttggggaggcagccggaggaggggttcctaaagactcaaaggcggcctggtaggagcttggcaaggatcctttttatcctaggctgccccgttgcaggagccctgcgctagggctccctgtaggtcgggtcatactgtgcccaggggcaaagggcacctggaagatcgcggcggacctcggcgtccttgcgtgctgctctcccgccagccggcgcagcttgggtacgcagcggcagtggctatttgtcctcaggagccgcagcgctgtgagccacgcagccccttcctgggctcaggctccttggttgattctaggctcagcgttttggcgcagcctttgctctccaagagacgcctaagcgcctgggcgccgtgcttctgctgcg

SEQ ID NO: 32272 - DNA, 324 bp, Homo sapiens
  misc_feature 1..324: note = chr8:132053217-132053541
  misc_feature 1..324: note = hyper
  source 1..324: mol_type = genomic DNA
tggcggggcgccccgcgacagggttggagaggtggtagcctcggcgctaacaattcaccaaatagttaatttggaggaaggggtatgctgaggctccctcctaggctctttcctagttcgggagcaaggactgacagcgcagcgctggctctggccagaagcatccctcccggagggggtgtggggactctcgctccagggtcccagcctgagctataagacgaggtcaacgctttcagctgtgctttcgaagggtcgcagcacacagttctcatcccctttatttcgttctttggagtccatttggctcggagctaggaggat

SEQ ID NO: 32273 - DNA, 838 bp, Homo sapiens
  misc_feature 1..838: note = chr8:132053746-132054584
  misc_feature 1..838: note = hyper
  source 1..838: mol_type = genomic DNA
cctggagctctgaaacgcaccgcgggcgccaggcgactgggagaaatttggagacctgtcagagtggtcagacacccgcggtgacttaaacccgcccccgcgccaagccacgcccccggaaccgggccgggggtggcggagggacctgccatccagatctggccaggacgccccaggtcttgtaggcagaggcacgcgcgggccggcgtgggagaggaccactgagggctagggccggcgggcgcccccggccttccctgggcgcactgcgatccagcgttccagctggccgcgccagccggttcctccgctgttcttttttaggcattggctcttgtcctctgcaggtgcggagccaggactcgtaggccgctttgcgcacggactcggagagcccagcgcgacggaatacagggtttccttttcgcccttcctacccgtgcgtcttttggcaaagccaactttcgggctaaacgcaaaatcccccaagaggccgcaatcatagaggcagtcagtttcctacaggagcctctttactacctcgatccgaagggggtggagggtacgggacatcaaaatggggacgtcccctgcctgcctcgcacactaagtttctccgcttacaatagggtcgaggaggcggacgtggagaaaggcatgtccaggggccccgcctcgccctagcccaggtttcccgcccgcccagactcagccgagcgctagcggacaaagcctgcggcggagcttgcggcggaccaagtcgctgagcggtgggagcttagtgccggtgctaatgacagatgagccgcgtcccggggtgcagggtctgcagggcaaa

SEQ ID NO: 32274 - DNA, 205 bp, Homo sapiens
  misc_feature 1..205: note = chr8:132054593-132054798
  misc_feature 1..205: note = hyper
  source 1..205: mol_type = genomic DNA
cgcagtcccgcagccggatgcaggtggaggagcggtggtggtcaccacctcctccaccaagactgcggctgcagccagtggagcccgggcccagagcacagtcagctgatggccaatgacgtcaggccctgggcgcgttcgcggctccccgtggcgtcccatgaaagcccaaatgaccgccttgccttgccgccccctcagtccc

SEQ ID NO: 32275 - DNA, 312 bp, Homo sapiens
  misc_feature 1..312: note = chr8:133492319-133492631
  misc_feature 1..312: note = hyper
  source 1..312: mol_type = genomic DNA
tctcagctccagccccgaccccaagtccccaagcgcgccgccgccgagggcgccccgagcggccgggtactcacaccaacgcgtggtaaagcagcgcccagccccgcggtctctccagggcgtcgtagatcaaagtttggatgcgccggtacttggcgttgtttctcttgactgggcggctcagcggggtcttggccaggagcccgatgccctgcggggtcctccgctgcccctcgtcgcggccgccgccctccagcagcagggtcccgtctttgtcggctccggccccgagcgccaaggtgacttgctcca

SEQ ID NO: 32276 - DNA, 182 bp, Homo sapiens
  misc_feature 1..182: note = chr8:133492712-133492894
  misc_feature 1..182: note = hyper
  source 1..182: mol_type = genomic DNA
cgcctccgccgcccccgtcgccgccgccgccagccgcccccgccgccctgcgcgccttgagccccatctgcctcgcccccgccggccgcttcgccttctccgctgctgctctgggaagaaggggcgctcggggtgcgtgaacgaggcggcggcggcggctgcaagcccgggaactccaatgc

SEQ ID NO: 32277 - DNA, 135 bp, Homo sapiens
  misc_feature 1..135: note = chr8:133493617-133493752
  misc_feature 1..135: note = hyper
  source 1..135: mol_type = genomic DNA
ggactggggggttgtcgcccaccaaacattggctctgtggttgcagctttgtgaatttccctcaccccctacccctgctcctcggcttcagaggtaaaagccaagttgtcgggttggtcaaggccgggcgcaccg

SEQ ID NO: 32278 - DNA, 30 bp, Homo sapiens
  misc_feature 1..30: note = chr8:134581243-134581273
  misc_feature 1..30: note = hyper
  source 1..30: mol_type = genomic DNA
tcagaaggcagtttccgcctgctgctgcag

SEQ ID NO: 32279 - DNA, 190 bp, Homo sapiens; identical to SEQ ID NO: 9765
  misc_feature 1..190: note = chr8:139508757-139508947
  misc_feature 1..190: note = hyper
  source 1..190: mol_type = genomic DNA

SEQ ID NO: 32280 - DNA, 230 bp, Homo sapiens
  misc_feature 1..230: note = chr8:139509693-139509923
  misc_feature 1..230: note = hyper
  source 1..230: mol_type = genomic DNA
cggggctcccctctcgagccaagaccccaggcctcgggcaggaaaagggtccctgcagatatccgggggcggggcgcggcggagaactggctgggaggggactgttgaacttggaagagaagcccaggcaacaagtagatgcctgagaaagggtaaaagcgctgagcaacccatacctccaatgcgaagtcagcagtggccttcaaccagccagccggcccgtcatccga

SEQ ID NO: 32281 - DNA, 30 bp, Homo sapiens; identical to SEQ ID NO: 9766
  misc_feature 1..30: note = chr8:139926700-139926730
  misc_feature 1..30: note = hyper
  source 1..30: mol_type = genomic DNA

SEQ ID NO: 32282 - DNA, 65 bp, Homo sapiens
  misc_feature 1..65: note = chr8:140643383-140643448
  misc_feature 1..65: note = hyper
  source 1..65: mol_type = genomic DNA
tcatctgggaaaagtcgctaatctttctttctcatagatgagatgtcatgcgatgaatgttttct

SEQ ID NO: 32283 - DNA, 307 bp, Homo sapiens
  misc_feature 1..307: note = chr8:140714570-140714877
  misc_feature 1..307: note = hyper
  source 1..307: mol_type = genomic DNA
taaggctcagagccccgcgcagcccagcccgcgccggggcggtgggtgggtgggtgtctgctatgggattattcttagcgctccactctcttcgcaaaagtggcgcctccgccctcccggctcaggcacactcgctcggggctcgcacgcccggcccagacaccagcgcggtggagagcaccgggtggggtccccgaagggtgaggctcggaggcgccgcggagggggggctccctagagaggagggggcgctgcgggaaggcccccaagggaggctgcgtttaaccctcgacgccctgcacccagc

SEQ ID NO: 32284 - DNA, 369 bp, Homo sapiens; identical to SEQ ID NO: 9768
  misc_feature 1..369: note = chr8:140715219-140715588
  misc_feature 1..369: note = hyper
  source 1..369: mol_type = genomic DNA

SEQ ID NO: 32285 - DNA, 323 bp, Homo sapiens
  misc_feature 1..323: note = chr8:140715699-140716022
  misc_feature 1..323: note = hyper
  source 1..323: mol_type = genomic DNA
cgggaaccggagccagaaagcggccggagggcggccgcggggcccggtacccctgtgggtccagctcgcgggtggcggtgcccagcaaggagcctgcaggtccgcgcgcccagcggaacctgcttccccttttacccctcctcgccccctctcggtggtggggaggaaaagtttgcgaagtggcggtgtctctggagtcccctgcaagcggggagggggccgagcaggtgcagcgggaggggcagcccgctccccaaaggtccgcgcgcccagcgcccacccgggcgcgcgggtgcgcagcggggtccccgccgggcgtcggc

SEQ ID NO: 32286 - DNA, 14 bp, Homo sapiens
  misc_feature 1..14: note = chr8:140716339-140716353
  misc_feature 1..14: note = hyper
  source 1..14: mol_type = genomic DNA
cgaatgtgtgtgtg

SEQ ID NO: 32287 - DNA, 498 bp, Homo sapiens
  misc_feature 1..498: note = chr8:140716681-140717179
  misc_feature 1..498: note = hyper
  source 1..498: mol_type = genomic DNA
gggtccttctagccccgctccccaagagcgcaagcagccctggcgggtggagagtttgagggactcggggttggaggaggaaaacgggattcagccagagatggcaggctgacagcttcaggcagattgggcagagagtggggagcagaaggggagggggccatgggcacacaggagagcggcagcagcggttcacgaagtcttccccaccccccaccccccacctagccacccggcgcgggagcgtgtcattggccagggacatggcctcgtggagtggtggggtcccgagggctgcctcggccccctcgcctcccagcggcacagcccgcttgggccagcacctgcagacccgagtcgtttccctggagagcgctaaggacagcatgggccgccacttttggagtcaggacagcggggaaagacatcgcaatcccccgacccagtaacctctctgttgctttactgaaggaaaaaaaaaaaatacacacacacaca

SEQ ID NO: 32288 - DNA, 137 bp, Homo sapiens
  misc_feature 1..137: note = chr8:140717239-140717376
  misc_feature 1..137: note = hyper
  source 1..137: mol_type = genomic DNA
cactctttgatatatataatcactctttggttccccacagctgggcgcaaggtgcgccgtggatgcagccctgagccacgcgatagccccctcgagaccacctggggtaggaacacgaggctcgggctggggcgcac

SEQ ID NO: 32289 - DNA, 153 bp, Homo sapiens
  misc_feature 1..153: note = chr8:140717707-140717860
  misc_feature 1..153: note = hyper
  source 1..153: mol_type = genomic DNA
gtcccttctgtgggtcgccccctggagcggtgctcgggctccctggcctcagggaccccgggcccagagggtctgggaccccagtgattcaccgaggcctcccagctgggacgctctgcaccccactttcagggatcacgggtgcccaccagg

SEQ ID NO: 32290 - DNA, 191 bp, Homo sapiens
  misc_feature 1..191: note = chr8:142528212-142528403
  misc_feature 1..191: note = hyper
  source 1..191: mol_type = genomic DNA
ctggccacctctcttcgcgcccggcctcctggtctcccgcctgcgcgggccgctcccggccctccccgccctgccgggcgttcactgtcccctccgcccgcaggtcccgcggcgcccccggagcccgccttcccggacatctacggcggggacgcgcagctctgggaggcgcatttccgcggcatcgggcg

SEQ ID NO: 32291 - DNA, 153 bp, Homo sapiens
  misc_feature 1..153: note = chr8:142528454-142528607
  misc_feature 1..153: note = hyper
  source 1..153: mol_type = genomic DNA
cgagaacttcacgctgcccttcccgttcgcctggccgccggggtccgaccccgcctgcgggccgctcttctacgacccccgcgaccgcgcagacttcgacttcctgctgcgcggccccggagcttcgcccccagcgctgctgcggcccctgca

SEQ ID NO: 32292 - DNA, 112 bp, Homo sapiens; identical to SEQ ID NO: 9773
  misc_feature 1..112: note = chr8:142528670-142528782
  misc_feature 1..112: note = hyper
  source 1..112: mol_type = genomic DNA

SEQ ID NO: 32293 - DNA, 128 bp, Homo sapiens; identical to SEQ ID NO: 9774
  misc_feature 1..128: note = chr8:142528834-142528962
  misc_feature 1..128: note = hyper
  source 1..128: mol_type = genomic DNA

SEQ ID NO: 32294 - DNA, 15 bp, Homo sapiens
  misc_feature 1..15: note = chr8:142529027-142529042
  misc_feature 1..15: note = hyper
  source 1..15: mol_type = genomic DNA
cggaggcaggccctc

SEQ ID NO: 32295 - DNA, 235 bp, Homo sapiens
  misc_feature 1..235: note = chr8:143530528-143530763
  misc_feature 1..235: note = hyper
  source 1..235: mol_type = genomic DNA
attcatctgtgtgtccgtcctgccgtccaccatccatcatccagccagccagtggggccactcccctgctcctggagaaggccgagagcaggaacccaactcttggcttctctgctgcgcggggcaggcaccgggctctcctaggtgtgcgcgcgtgtgtgcattttatccgcccccccttatctcgctcccctccccccacacccccgccccccgctagcgctccccctctaat

SEQ ID NO: 32296 - DNA, 751 bp, Homo sapiens
  misc_feature 1..751: note = chr8:143531020-143531771
  misc_feature 1..751: note = hyper
  source 1..751: mol_type = genomic DNA
ggcaggcgagaggagcggagcggcggcggcggccggagagggagcggcgggcgcaggcggcggcggcgggcgcggcgttggcggcggccccggcggagcgagcgcggagccggagagccgggagcacaggcggccgcgccgcgtcctggcccggcccgggcccgcgcgccagcatcgtccgcagcgcgggcatccggaccctccgggcgcccggggggctccagcaggcgcgggggaacgggagggggcctgcgtgcgccggcgggtgctctccagggggcgtcccggcgaggcccagagcgggccgggggcggcggcggctggaggagccccccccacctccggtcgggcgcccggctcagccgccggcgacgcgaggcgctcgcggggatttgcaactcgccggatcgagtcctcgccggcggggccgctgctgctggggaaggtaaggaaggctccggcggggggctgggggcgcggcgggtgggggcgcagcgagggtgggagggggtcgggggaggggcgggcgcccagacttcctaacttcgccgtttggggcttcgcagctccgaggttttgcgctcagagctcaggagtttggacccccaccccctaccccctcagccccctgccttctccagcggtggcgatggaatgtggcaggtccccgcgagcccgcattgggcaggctgaggagggggcgaccctggacgcaggagaggctcctcggcgccgccgcctcctccccatc

SEQ ID NO: 32297 - DNA, 514 bp, Homo sapiens
  misc_feature 1..514: note = chr8:143531996-143532510
  misc_feature 1..514: note = hyper
  source 1..514: mol_type = genomic DNA
gacgtcctccccccacgcacagagctcggggcaggcaggagaaaaccccagactccttctcgaagccctcgctcgtagaagccctcgcctgtagacctggcattggcagtggagactccctggaggtactctcccccacttcgggcggagggctatttttgcgccccccacccccacgcgaacgcctggctcttccctccttgtctacctttccactgggtcggacaggccgcgcggataagccgctctcaactttgggccggccctatgccgtctccgctccaagcgccgagcactcccgggcgccgagcactcccgggtccgcgtcgccggtgagcagaggccgccggccctccaccgtcgccgcgctagcttggagccgcgcggagctgcctcgaggaacgagcacggcccccgccccctcctggggaggctgggagctctggacccggccaggagccctctccctaggtccccgcggccccctgggcgaggtagagagctcctccggcct

SEQ ID NO: 32298 - DNA, 958 bp, Homo sapiens; identical to SEQ ID NO: 3374
  misc_feature 1..958: note = chr8:143532541-143533499
  misc_feature 1..958: note = hyper
  source 1..958: mol_type = genomic DNA

SEQ ID NO: 32299 - DNA, 141 bp, Homo sapiens; identical to SEQ ID NO: 3375
  misc_feature 1..141: note = chr8:143533500-143533641
  misc_feature 1..141: note = hyper
  source 1..141: mol_type = genomic DNA

SEQ ID NO: 32300 - DNA, 497 bp, Homo sapiens
  misc_feature 1..497: note = chr8:143533708-143534205
  misc_feature 1..497: note = hyper
  source 1..497: mol_type = genomic DNA
cgggcgcttgttcctgccggggtcccgcgcaggggcggatagagggcgattcgtcgcctcggcctcaggcagcactcatccggatcccgggctagggagggggcgcagccaagttgtggagccctcggaggcccttccctctcccgcaggctccggcccctctcggacctcggtggccgcgtccgtgaaatggggacgcgggctctgctctcggatcccttccagcccccgaccctccgcacttgtcccgagatccaacgtgcccggtccgcagcgtgctgggtctgcggcgtcagggtggcccgagtcccgagaccatctgcgcttgcggacacagccgcggggcctggcatgaagggccccagggagggcctagcaagcgcccggggtccgagcagcctcctgcggcgtcctccgcccccggtcggcccgaccccgcctccgggagtgggtcgtggggcgcggagcccgtcctccggggacgccgcggggctcca

SEQ ID NO: 32301 - DNA, 304 bp, Homo sapiens
  misc_feature 1..304: note = chr8:143534453-143534757
  misc_feature 1..304: note = hyper
  source 1..304: mol_type = genomic DNA
gcctcgcgtctcggccggagcccccctcgccggcccggcccggtccccgtgtgcggtgcgctggcgtgagcgcgcgtttgcgtgctggtgtccatgtgtggcgcgcatgcacgtgcgtgcccgtccgggaggctgggggcacgtgtgtgcaggcatgcagacttgcacatgtgtgtgcgtgacgggggcgggtctcgcgccggtgtggccccggatggcaggatttagtcaaaccccgttttaccgtcggctctggctctgggctgcccccgggtctgctctgtgtgcacgggatggacccctg

SEQ ID NO: 32302 - DNA, 255 bp, Homo sapiens
  misc_feature 1..255: note = chr8:143591552-143591807
  misc_feature 1..255: note = hyper
  source 1..255: mol_type = genomic DNA
tcctgtgcttaaatgcgtgctcagatgaaaagcggggcagtcgcggcccgtagacagcgggcggctgggtcagaccgcagagggaagtttccagcggcaagcctccccgcggggaaggctgtgtctgtcccaggagatgagccgcaggcaccaggggtgatgaggcccgggggaggtggatgtgggggatggagcggtcccaaggtcgtcagctccagccggcgccctgggccgcggggccggagagctccggag

SEQ ID NO: 32303 - DNA, 156 bp, Homo sapiens
  misc_feature 1..156: note = chr8:143591888-143592044
  misc_feature 1..156: note = hyper
  source 1..156: mol_type = genomic DNA
cgcgcccctccgggcctccccctccttcccgcgcgggccgggggcgcgggccccggaggagctgggggcggcgggggcgcggggcgggcgactgccgggccccgggccagctctcgccccccgccccgcccccgatcgctcggctcccccgcccgg

SEQ ID NO: 32304 - DNA, 178 bp, Homo sapiens
  misc_feature 1..178: note = chr8:143592101-143592279
  misc_feature 1..178: note = hyper
  source 1..178: mol_type = genomic DNA
cggcatgggcgcccgggccgcggggcctggcggcggcgggcggacgggcgcgcggctgcgggcgcaggtgcggggcggcgggccggggccggggccggggcgcggagccgccgctcgggggccggggcgcccgcgtccccgccgccgctgacgctccgcctgtctccctcccgtgtcc

SEQ ID NO: 32305 - DNA, 221 bp, Homo sapiens
  misc_feature 1..221: note = chr8:143592358-143592579
  misc_feature 1..221: note = hyper
  source 1..221: mol_type = genomic DNA
cgacgccctccggacgcgctgcctctgtgaccggctctccaccttcgccatcttagcccagctcagcgccgacgcggtgagaccccggccgggccggcgggaggggcgccgggcaggggcgcgggcgggggctgccggcgggcctgcgggtggggagggcccgcacccgtcctgtcccggaggggtcgctgtggcccgcagccgccgtggcctggcccggc

SEQ ID NO: 32306 - DNA, 24 bp, Homo sapiens
  misc_feature 1..24: note = chr8:143592663-143592687
  misc_feature 1..24: note = hyper
  source 1..24: mol_type = genomic DNA
cgggacccccggaaagtggctgat

SEQ ID NO: 32307 - DNA, 200 bp, Homo sapiens
  misc_feature 1..200: note = chr8:143695463-143695663
  misc_feature 1..200: note = hyper
  source 1..200: mol_type = genomic DNA
cctgcttggacacctcggccagcaggtgccggtgcgtccgccgcacgtgctccagcatctcggcccggcacttcccgatctgcaggatcacgttgggcttggccacctgcccgccccgcggcccggggtaggcgtggagcccgccgctggtccggtggtccagctccatctgtgcgcaggtgctccggcaggcggcaaac

SEQ ID NO: 32308 - DNA, 39 bp, Homo sapiens
  misc_feature 1..39: note = chr8:143858697-143858736
  misc_feature 1..39: note = hyper
  source 1..39: mol_type = genomic DNA
ccagcgcgagctcaccgcaggccccgccccaggcctgcc

SEQ ID NO: 32309 - DNA, 45 bp, Homo sapiens; identical to SEQ ID NO: 9788
  misc_feature 1..45: note = chr8:143859143-143859188
  misc_feature 1..45: note = hyper
  source 1..45: mol_type = genomic DNA

SEQ ID NO: 32310 - DNA, 56 bp, Homo sapiens
  misc_feature 1..56: note = chr8:144099611-144099667
  misc_feature 1..56: note = hyper
  source 1..56: mol_type = genomic DNA
tccaggtgtcagtgacggtcaccccgacctggtcccctgtccggcctcgccaggtc

SEQ ID NO: 32311 - DNA, 184 bp, Homo sapiens
  misc_feature 1..184: note = chr8:144241250-144241434
  misc_feature 1..184: note = hyper
  source 1..184: mol_type = genomic DNA
gccccttctccagagcgtccgccgtcacagcatccccgccgggagacgtctggcctctggggcgaggtgacagctcgagacgcctccgccccgcgccggcacctgtgtgggggagcggatggggggcgtcctcttctccccggggagctgcaggtgcgtccggacaggaatgagcggcaggggc

SEQ ID NO: 32312 - DNA, 87 bp, Homo sapiens; identical to SEQ ID NO: 3378
  misc_feature 1..87: note = chr8:144241435-144241522
  misc_feature 1..87: note = hyper
  source 1..87: mol_type = genomic DNA

SEQ ID NO: 32313 - DNA, 120 bp, Homo sapiens
  misc_feature 1..120: note = chr8:144241583-144241703
  misc_feature 1..120: note = hyper
  source 1..120: mol_type = genomic DNA
cgcgggcctcggggtcggggggctcactcacatcccgggggtgtccgcactccgggctcgggcggcgtgcgcggcgcggggagctgtgcccttcggtctccctgcggaccggaatccggg

SEQ ID NO: 32314 - DNA, 482 bp, Homo sapiens
  misc_feature 1..482: note = chr8:144241757-144242239
  misc_feature 1..482: note = hyper
  source 1..482: mol_type = genomic DNA
cggggcggagccggggcgggggccgcgcggggggcgggggcggctgggagacgcgcggggcggggggcgcccggggctcgcggcccccacgcaggtagctggcccgggccctccgcgcccccttgctggcgcgcgcgctccctcgggttcccgctccctccctcgcggcgccccctgctcctccccagcctccgcggccccctacccaggcgtgggcaggatcccttccccctctgcttggctgagatccccttggaatttctcggaagaacgtttactgcgaaaggaagcaaaatgcacaaagacgcagagagggggaggtacccggcgcggcgccacgcgcaggtccgggttcgcagacccctggggtcagactcccgccctggggccccgccctccccctcctccccgcccctccccaacctcatacccgtttccccgtttccccgtttccagtggctccaggccgttctcctcccctg

SEQ ID NO: 32315 - DNA, 406 bp, Homo sapiens
  misc_feature 1..406: note = chr8:144328190-144328596
  misc_feature 1..406: note = hyper
  source 1..406: mol_type = genomic DNA
gctgggagcacatcccggaggggctgcctgcggcgggaggagcggcaggggccacgtggtgggggacggctcgccagggcgcgcacgcggtggcggcggcggtggaggcgttgcccgcctagctaggggcccgcggcctggagaggcgtcggttctccttccgcgctgaaggcggagacagcgacttcccgtggaggcaagccgtgggcgccgcggaggcgggggctgggggtcggcggaggcgggagctgggggtcggcgggggctgggggttggcggggagcgtcctcagggacaagtctcccagcacgcggccgcgacctccccgttgggggtctggagccaggagcccacgcgcgtcggatccggagagtctggtgggcgcagcctacgtgacagggtcggc

SEQ ID NO: 32316 - DNA, 49 bp, Homo sapiens
  misc_feature 1..49: note = chr8:144490051-144490100
  misc_feature 1..49: note = hyper
  source 1..49: mol_type = genomic DNA
ctgggggcgggagaccggagaagaagcaggtgcacggggaggtgggtgt

SEQ ID NO: 32317 - DNA, 112 bp, Homo sapiens
  misc_feature 1..112: note = chr8:144503380-144503492
  misc_feature 1..112: note = hyper
  source 1..112: mol_type = genomic DNA
tgcaattcatcttcccgtctctcttcccatacctgagcctcgtgccgcccgggattgcggcgcccgcgccaccacgctggggtaatggtcccagcaccgctgccctgcgtcc

SEQ ID NO: 32318 - DNA, 50 bp, Homo sapiens
  misc_feature 1..50: note = chr8:144509068-144509118
  misc_feature 1..50: note = hyper
  source 1..50: mol_type = genomic DNA
caggctgccagaagtcgctgggtcctgtactttctcggccagggaaaggc

SEQ ID NO: 32319 - DNA, 2852 bp, Homo sapiens
  misc_feature 1..2852: note = chr8:144509520-144512372
  misc_feature 1..2852: note = hyper
  source 1..2852: mol_type = genomic DNA
tcctccaggtctctccgcttgaaacgataaaacaaactcaggagactcactcacagaggattccgtcccgtccccagaaagaacctccgcttacccccgatggaaaagcagcacagccccctcccaagaaaggcgagtttggaagcccttgcaggccagaagccctctctccaaatttgcaaaccacggaccctcgcctgcctctcttccggcagtgaagggagggaaccatcaacgacgtgtcctgcagccgccctgggccctgtgaactgagatttctggggtactgcctcctcccctgtgctcccagtccatgcccagccagccgttcagaggagcaagggtaggctgcgccttcaggtgggagacgggcagactccgagggctggggacagttctggccaccaggatgcagcggtgtgtcccaccaaggacacctcctgccctgcacccccagcctgcctcagtgactctccccaaaagcccctcggccttctttgccgagggcagacgcagagggcacaggtctgcggggtgcaggccggctaacgctgcctcgctgctcagtttctccctggtcctgccgtcacccagggcccgtccgtcacccagggccagcacaaagcccaatgcagggccctcctcttccttcaattcagggagaaacacggcaaaactgaaagccaccgaccaaccagccaggctgcggtgacttggatctgaacagatttattttgtgtatttttttctttttctcagtttcgtagcaaatgaaaaaagaactcaacgaaaaccaactacacaacaaaactttcaacgagtcggcgcgccttccactccgagtgctcaggggaggggtgtggagcggctggaatcccactgatggcccctgagggcctccgaaaacgggcagatcccccaggcgcctggcccagcctacagggcctggagcacccgcctcctcgccctctctcccggctagtccaaagagcgacgaagcattaaagaaagattccacaaacaaaacgaaacacaatttaaattaaaataaaaacactttctccacccgccccatgccagaaggctctggcccaagcctcctcttaaaaaaaaaaattttctgctagaaatactgtgcattacttttttctttcacttctcttgaaggttaaaacaagatgtatttccccaggagttacagatatgttctggtgcatagagagacagcagctcgggatccgggccagcccccacccgactgagcacaggactcacccccctccccccacccccggttgagcatagtaggacagcaggcctggacacagcacgggtgacgtccctggcttcgacctccaaggaacgccggtagcagggtcgggggcaagcggggagggggcaggcaggggccgggcccctcctggcgagcgactcatgctgtgactcgcgactgagggcggaccccggctggggaaagaaggggcttcctccaaggttttcttttctaatcaccaagcataataattataaatacttcgaaaataagaccgattttaaaacggggaggggaagttaaaaaaggcaaggaaagggaggctgagaagagaacgaaggagggcgggggcaggcaggggccacccgggaagggacggcagcgcggtccctctaggctggcagggcgaaggtgggaacggagaaccacgttcaacgtatgtacaagcggacgcttggaaagaagttagacctggctcaagtttccttagaaatcaccgttctccgctcaacctcaggacggcgacccgggccgacgcgcgcgaacggggaccgggagcgaaggggcctccagccccgcgcccgcagacttggcaccggggccagcacggccgggccgggcctggtgtccacgtcctgtaccgcggagtccgagccgaggccccgagaggcctgcgcgaacttgtccccggcgacggcggcgcgggctcggggtccggcgcctacaggaagaagtcggccgtgcccttggccccgccgggaccggcctgcggcggcgaaggctcccgcgggaaaccggccccgcccgcgctcccggggccgccccggcccgccagcttctcgtatttctccttgtacaggtcccgctctttggccaggcgccccacctccagcttcagctgctccacctggctctggagttggcacttctcgctctccagaatgtgccgctgctgcacccgcttgaagcggcaggactgcgcgtagccgcggttcttgagcgtgcgccgcttctgcttgagccggatgacctcctccttgctgaagccgcggagctgccggttcagctcgcgcaccgacatggacaccagctggtcgtcggagaagcgctcctccaggcgcacgtggtggcccgcgccaccgccgtgtcccgcgccgccatggtggtggtggtggtggtggtggtggtgggcggcgtggtgatggtgggcggcgtggtgcgcgccgtggtggtggccggcgcccatgtcgtccgctccgccgccgcccgcgaagcccgggccgcggaaagcctcgtaggctgcggcggccgccgggtggtgcgcgccgtggtgcgcgccgtggtggccgctgccgatgagcgcctccaccgcgtcctcgggcgtcaggttgagcgcctcggggttgaggtgatgctggtagccgctcatccagtacagatcctccagcgccggcttccccgaggtgcccccgacggcgccggggcccccgctcggcggcccgggggcgcccccggcctgagacgagccgccgccgccccccgcgccgccgccgccgccggtgcccgggctgggcgcgca

SEQ ID NO: 32320 - DNA, 226 bp, Homo sapiens
  misc_feature 1..226: note = chr8:144650887-144651113
  misc_feature 1..226: note = hyper
  source 1..226: mol_type = genomic DNA
gtctgcgtgggagggcgcagtcagggcaggcggagacagagaggggctgcaagggtgggagggggcggccagcgcggagcgaggaagcggcgggtctagggaaggctgctgactcggtgtgatctggggacagggaacagggcctggagctggacctggttgggaagcctggagagcccctgcagggggtggggcttgaagggatggggtccggaaggaaaagtcg

SEQ ID NO: 32321 - DNA, 210 bp, Homo sapiens
  misc_feature 1..210: note = chr8:144651759-144651969
  misc_feature 1..210: note = hyper
  source 1..210: mol_type = genomic DNA
gcagcagcgtgctcacgtgccgcacctgctgggactcggggtcagcctcttgcagacctcgccgcgaccgggccaagcccctctccacccctccccttctctcacaccttcctgcgattcagcgcgaggtggcccaggcccagcaggcccaaccagcgcacagtgggttcggggtctccctgccaggtgaggagtcgctccaggatgacc

SEQ ID NO: 32322 - DNA, 154 bp, Homo sapiens
  misc_feature 1..154: note = chr8:145700252-145700406
  misc_feature 1..154: note = hyper
  source 1..154: mol_type = genomic DNA
gccggtatggccggccgtgcagcacgtaggggcccaggtccttggcgaaggctccacgcgcacctccgttctgccagcgccggcacagggcggtgttctgcagccggagcgcctcagctgggatcaggctcacgtcgaccgcccagaagttgcc

SEQ ID NO: 32323 - DNA, 194 bp, Homo sapiens
  misc_feature 1..194: note = chr8:145700607-145700801
  misc_feature 1..194: note = hyper
  source 1..194: mol_type = genomic DNA
tgaagaaggggaacacggcctggacctgacggatgatctgaaaccgccaggcggccggccggcgccgtgagcccagacggggagggggtagcgccctacccctcccccactaccgggctcaggggcgcgcggtgccggcccctgctgtccccgaagaaggacatttctgcgcggaagcgcggcagagagggcaa

SEQ ID NO: 32324 - DNA, 62 bp, Homo sapiens
  misc_feature 1..62: note = chr8:145806186-145806248
  misc_feature 1..62: note = hyper
  source 1..62: mol_type = genomic DNA
ccattcacctggccccgcccatagcagctgcccccgccctcacctgccgctgtcctccttca

SEQ ID NO: 32325 - DNA, 131 bp, Homo sapiens
  misc_feature 1..131: note = chr8:145925298-145925429
  misc_feature 1..131: note = hyper
  source 1..131: mol_type = genomic DNA
acagaactctttctccgtgaatcgcatccttttctgtgcgggatgatttacattctgggaacaaacggggccgtatctcacagtgctgcaggatgccagtggtgcaaacagtcggcgacccggccatttcc

SEQ ID NO: 32326 - DNA, 187 bp, Homo sapiens
  misc_feature 1..187: note = chr8:145925458-145925645
  misc_feature 1..187: note = hyper
  source 1..187: mol_type = genomic DNA
cgctccccgttccctgtccgtcacctcctcgttctcctacgaaggcgcgaacgttccagactctcgccggtcctcgacagcactcattcagtctcccccctggagatcccaggctgtactctgggacagaaaagaaggcgggtacgaccgcggtgtcgggtcctaccttagccgctccttctcctga

SEQ ID NO: 32327 - DNA, 83 bp, Homo sapiens
  misc_feature 1..83: note = chr9:73223-73306
  misc_feature 1..83: note = hyper
  source 1..83: mol_type = genomic DNA
tgcggccctgacggtcgcgcaggccgacggacgacagcgcgctccggatgaagttgggcgggtagctgcgctggccctggaag

SEQ ID NO: 32328 - DNA, 111 bp, Homo sapiens
  misc_feature 1..111: note = chr9:113402-113513
  misc_feature 1..111: note = hyper
  source 1..111: mol_type = genomic DNA
accttcgccccaggccggcgcagcccagcttcccgggcaggctccacgctaccggggtccagtgcgcggcgacgaagcggagagctgtgtccagactccggagagaaactc

SEQ ID NO: 32329 - DNA, 605 bp, Homo sapiens
  misc_feature 1..605: note = chr9:113549-114154
  misc_feature 1..605: note = hyper
  source 1..605: mol_type = genomic DNA
ggagctgcccaactccgccgcctcgggaaggcggcttcgggcccgcagggagccccggggagggttcccggttccgccggcagcggcgtcgaggggtgcctgggctcctggggaccgcgagaggaaaaagaacggaaatcgcaccggggaggaaggacgcgcagaacgcccccgtgaagcggggtgctccggtcaggcgtgcgcgggagcgcggtccgggggagtccggcggcgccgtcgcgcgcactcggcagaggcttcgcgggagaacgcgcagcccggggcgtggggcggggaactgcccgcgcgaggctttcggcgcgtctgggtctcggcgagagcaaagcgcgtcctggcaccgggggcggcggcgcagaggccgggaggaagaaatccgggccctggcccaggtcgggcttccacccctgcgacccgcgagaggcccaggcgggaaaggcggcgagtggcgtcagcggttccgaaagcaaacctggcccggtgctactgcccgagggtcgccgggcgcgtttcctaattcccccgagtctggaaaacggagacttccgtagcgtcttcttcagtgcgtgctgcgagtgctgaaggag

SEQ ID NO: 32330 - DNA, 130 bp, Homo sapiens
  misc_feature 1..130: note = chr9:114722-114852
  misc_feature 1..130: note = hyper
  source 1..130: mol_type = genomic DNA
gcaacccctgcgggtcgcgcccgaaggccggacccctccaagccgcctgggagcttccaaacaggtggacccgaagctcctgtttgatcggagaataacgttcaatttactccgccgctgaactgatggt

SEQ ID NO: 32331 - DNA, 88 bp, Homo sapiens
  misc_feature 1..88: note = chr9:117872-117960
  misc_feature 1..88: note = hyper
  source 1..88: mol_type = genomic DNA
caaactctgaggggtcgctcgggccgccgccgccctcgatgtgctctcggggaagcgcaaccccgccccaccgggccacctgcagccc

SEQ ID NO: 32332 - DNA, 277 bp, Homo sapiens
  misc_feature 1..277: note = chr9:214944-215221
  misc_feature 1..277: note = hyper
  source 1..277: mol_type = genomic DNA
gaccctagaagccaccgaaccgccggcgggccatggccactctgccgagcgcagagcgccgcgcgttcgcgctcaagatcaacaggtaagacgccccccgcggcgcgcaggttgcggccggacagcccagcgctggtgtgaagcggagcttcgctgcaggggccgaggccggacgagtccattcgcgtccgcggcggggcgcgcctgagacctggggcgcccggttcccgaggctgcggcggtggagccgctggacgcgcggcggctcctgcgctgg

SEQ ID NO: 32333 - DNA, 39 bp, Homo sapiens
  misc_feature 1..39: note = chr9:841367-841406
  misc_feature 1..39: note = hyper
  source 1..39: mol_type = genomic DNA
gcttcctcggtgcaccgtgctttggcaaccgggtcttgg

SEQ ID NO: 32334 - DNA, 401 bp, Homo sapiens
  misc_feature 1..401: note = chr9:841449-841850
  misc_feature 1..401: note = hyper
  source 1..401: mol_type = genomic DNA
cgctctgtatctctcggtgcgcttgcagggaccctgcagcaaagccctggatgcttgcagccggtgcaagtttgcaagcagctggagagcggtggctggagtcggggggcggtgggcgtggccacgctccctcccaggcagtcccgggaatgttctgaaaagtatccgaaagttctgagtcgcgcgcgcgccaaaagaaaaggcacaaccccccaccactccgggcgtggcgtgcccagacctcgccactccagctgcgcctccggctgcagcgcacacgtctcctgcgcctcctcctccggagcgtcgctgtccgtcgggttcatccctcgcagcagtctccaggcgagagagggggccagagtgctcgcacttctcctaggggcaccatgcccaacgac

SEQ ID NO: 32335 - DNA, 181 bp, Homo sapiens; identical to SEQ ID NO: 3384
  misc_feature 1..181: note = chr9:841851-842032
  misc_feature 1..181: note = hyper
  source 1..181: mol_type = genomic DNA

SEQ ID NO: 32336 - DNA, 19 bp, Homo sapiens
  misc_feature 1..19: note = chr9:842207-842226
  misc_feature 1..19: note = hyper
  source 1..19: mol_type = genomic DNA
cgggagcccgggttcagcc

SEQ ID NO: 32337 - skipped

SEQ ID NO: 32338 - DNA, 138 bp, Homo sapiens
  misc_feature 1..138: note = chr9:842610-842748
  misc_feature 1..138: note = hyper
  source 1..138: mol_type = genomic DNA
cggtacttgccgacagcggcggcgcttggggtcctgggctcccggccacgctacatcgccggtctgggagcgccggagacgcgtctgatcccgcccgccgggcagagttgcgggcttcgctcggctcggggttcccca

SEQ ID NO: 32339 - DNA, 186 bp, Homo sapiens
  misc_feature 1..186: note = chr9:842779-842965
  misc_feature 1..186: note = hyper
  source 1..186: mol_type = genomic DNA
cgggggttccctctgctcccgggtccctgagatccctgatcccgctctcagggcagggaattccggggttcgcccctctgggcttccccgcgatcccagagcccgcgttccaacagaattgggagggtttattgcgctagaggagtcttcaggatcttcgctcccgccctccgaggtgaggctaga

SEQ ID NO: 32340 - DNA, 518 bp, Homo sapiens
  misc_feature 1..518: note = chr9:843202-843720
  misc_feature 1..518: note = hyper
  source 1..518: mol_type = genomic DNA
cgggaaagggaggctcggccggctgctgcttacgcgggtaacctgtcggaaagccttgtttgtttttctggaaaagtcgctgcaatggacacagcgttgcgcggtttccctgcgcgcctggggcgctttttgtcttcgccctccgtggatggaggctgagcgcctcagccattttgagagctctggaaattttattagcattttaaaatttgcattctcgaccgaagattaaagtgcaaattactttgaagatgttttaaagcacgcttaagaattttaaagaatatgcgcaggtggaaaaaagcgcgccagggtttgagatttggtccgtctgtggttttgtttttttgaaggttcgtaagtaggctggtaatttaacattttaacggaaagttaatgtctttagtattctaaaaggatttttggaaggcagtaatccacgttatttccagttaaaagttgtttcatctttttaagacaggttatttaaaatgaaaagataacgaagaaatgtttgc

SEQ ID NO: 32341 - DNA, 59 bp, Homo sapiens
  misc_feature 1..59: note = chr9:969556-969615
  misc_feature 1..59: note = hyper
  source 1..59: mol_type = genomic DNA
ctgtagctgttgtgacggctacggcggaggctgcggccgcgcggggaatggagccggac

SEQ ID NO: 32342 - DNA, 438 bp, Homo sapiens
  misc_feature 1..438: note = chr9:969667-970105
  misc_feature 1..438: note = hyper
  source 1..438: mol_type = genomic DNA
cgcgcccaccttgccggcgtgttcgcgggcccctgcccactgccccccctctttctttaggtctggcttttgaggatcccggagtcttgcagctcccgccattccgcagataacctccgcacacttaattgtgacccgcggggtggtcggagaagctccgcacgcgtcctcagtgggaaagtgtcccctctcagcactgcccccttcagtccccctgcatttctggaaagtcaggcaaggcccaggtaggctgccagtgcactctcagccttgactgagcacctttcgggcctctggtgagccccgagagccaggtttggctcggcagagcgggcttgggctgcgcaagcaatgcgcatcgtggccgcctgcaccctgggaactaggcctgtccagtgggcagcatcctcatttttgaaaaggcccttctaaacccac

SEQ ID NO: 32343 - DNA, 40 bp, Homo sapiens
  misc_feature 1..40: note = chr9:970185-970225
  misc_feature 1..40: note = hyper
  source 1..40: mol_type = genomic DNA
cggggcccgggacctgcgctggccacgcagggtctcaagc

SEQ ID NO: 32344 - DNA, 417 bp, Homo sapiens
  misc_feature 1..417: note = chr9:970495-970912
  misc_feature 1..417: note = hyper
  source 1..417: mol_type = genomic DNA
gcccccttccgcgggcgggatccatggtgtgtgcagtgtaagagtgcgcagaacgcgtgtgttcaagtgtgggcgtggcaggcgtcgtgtgctcgccccgcgcactgtgcggatcgcccagacagccttgacaggtttttgcagatgtttgggtgctacggtgtggggaaacccaggcaggagcgccaggcctaattctcctggactcttggtgagcggccgctactccacgaggggctagaagcaaagggggcacgcgcttttccccaggccgcctcttgctgccgcagtggctgagggcgctgatgacccctccccgcttccagcggacttgacccgcgggctgacaacccaccgcgacaagcaggcggctgggttcgcgccgccgccccggggcccttggctcaaatttcacct

SEQ ID NO: 32345 - DNA, 187 bp, Homo sapiens
  misc_feature 1..187: note = chr9:970992-971179
  misc_feature 1..187: note = hyper
  source 1..187: mol_type = genomic DNA
cgtcatacccgcagccggggctccctccgctaaccacgcttggagaccccaatcggggacagaggtgggagtcagaccccccctggcctgcactgccgtttccctcgattcttgcggaaacaagactcccgcccacacataaaaatgcagctcccggccaccgggcgccggtggctcacgcctgtaa

SEQ ID NO: 32346 - DNA, 142 bp, Homo sapiens
  misc_feature 1..142: note = chr9:971939-972081
  misc_feature 1..142: note = hyper
  source 1..142: mol_type = genomic DNA
tccccaccccggccccggtccaaaaaaccagcaaacggaacttttccacagttgaaagccgcggcccgcgaggccgggctgggaggggaaagcggggcgtgtctggggggcggggccccgagcactccggaagttgccccgc

SEQ ID NO: 32347 - DNA, 714 bp, Homo sapiens
  misc_feature 1..714: note = chr9:972307-973021
  misc_feature 1..714: note = hyper
  source 1..714: mol_type = genomic DNA
tccgcttgctttccccgcggctgggctttgttcagggacagcaaaggaggaggcgggaggctggtgaggttttctggaaaaggggcttgtcccgaggaggaagtgccccagatccctgagagccaacgctctggggagaagaaactttccttctcccttgaatgttgctcagattacctaaaattattttttcagcccttgtgttctaaagtcgcagggtaaaggttatcttaagacttaacatcagcgctgctcatttgtacgttggtggagacgtgccttttttcctttgcacttaaggtggacagggtctgcgacgctcccttccaggacggtgtggggaagcggccgacgtccccagccggactcacgccctcctactactgggcgtcggctccgccgcgggcgctcccgacagggagctggagtcggacgagcggctgcccccagggcctccaggaaccgcggcccagcggggagcgccccaggctagcgcttttccagttcccttcgaaagcgcggggctgaggtcgcggcgctgggccctcggatgaagccgtgctgtagctacacctgaaccccgcgaaaggctggcgcggtcgtgtatccaggctgggtctgaggaatccgcaagcgggagagcgctaactcctaggcgtgagccgctgctggcttcgagagttcgagaacatgaaggacctggcttctcccgcc

SEQ ID NO: 32348 - DNA, 106 bp, Homo sapiens
  misc_feature 1..106: note = chr9:973183-973289
  misc_feature 1..106: note = hyper
  source 1..106: mol_type = genomic DNA
cggtatccccgggccggtgaccccggggttcagtcgtctccccgaccccaagcggcctctgctttccacccctcgccccggagggcggcttcggggatctcatggg

SEQ ID NO: 32349 - DNA, 43 bp, Homo sapiens
  misc_feature 1..43: note = chr9:973762-973805
  misc_feature 1..43: note = hyper
  source 1..43: mol_type = genomic DNA
tgtacacacacccagcgattgtgtgtgccgagaaagacccaca

SEQ ID NO: 32350 - DNA, 907 bp, Homo sapiens
  misc_feature 1..907: note = chr9:975783-976690
  misc_feature 1..907: note = hyper
  source 1..907: mol_type = genomic DNA
ctggcgcaagacctccgtttgcttccagtagctgctgggagcgagggaagaggatatcggtaactttgggggcgccaatgtggcttctgtgtctgccccttgaaagtttatacccggcgcttaacaaatcctttacaggagcacgtacgtccctgacctttcaggatactgttttatattaaaacatggacaggagggtagaaaagtaaaattcgcctgcaaaatggcttgtcatccttgggccggcagatctccaaaaccattttcttctaaagcaacaaaagagaaaaaaatacgttctaaaaggaaattacgaaaagagcctaactttcctaaaccaacatcacttcactcccctatcctaaactccacccaggtccggggtgcaaccgcaacactcccgtaggttcgagttctcccggagctgagcttctgcggccaaatgtcgggataaaagcggccttgggctcggaaaaacgcggccagatctggactggagggaggagaagagagagaagcggagcggccacctcactcgcttacaggcacccccaccctcactcccgctggtcctccccttctccgccccgcgagcaccgccgcgttctggagcgccgcagtctccagccgcgggctggggtagcggagagggcttggaggagggggccgcgagcgcccccgcgagagtggcctggctgcaggtggcaaggaaggtgaagtgcaggcacccgaggggcgcaaaggaggaggaaggcgtggggcggggagtgcaaggagacagggaccccaggggcgggggtggcggtgggaaggaggaggggttgggggagggcggcggaggtgttgggtccggccggctcacgagggagctgcagaagagctggctcagaccttaatcagagctgtc

SEQ ID NO: 32351 - DNA, 40 bp, Homo sapiens
  misc_feature 1..40: note = chr9:976911-976951
  misc_feature 1..40: note = hyper
  source 1..40: mol_type = genomic DNA
cgcccctgagcgggcctcgcagccccgccgtccagcgctc

SEQ ID NO: 32352 - DNA, 34 bp, Homo sapiens
  misc_feature 1..34: note = chr9:977171-977205
  misc_feature 1..34: note = hyper
  source 1..34: mol_type = genomic DNA
gtgcatcctcatcatcgagcggcagcgggtcatg

SEQ ID NO: 32353 - DNA, 159 bp, Homo sapiens
  misc_feature 1..159: note = chr9:977422-977581
  misc_feature 1..159: note = hyper
  source 1..159: mol_type = genomic DNA
ccggggctctgcaggcgcagctcgccaagccaggtaagagcgtctgaggtgcgggagtttggccgggcgcgggggcaacttcggagtgccagctgcagctccacttgggaggactggaggcaaagttttgggacgtgggcctgtcggggctttccttcc

SEQ ID NO: 32354 - DNA, 46 bp, Homo sapiens; identical to SEQ ID NO: 9824
  misc_feature 1..46: note = chr9:981797-981843
  misc_feature 1..46: note = hyper
  source 1..46: mol_type = genomic DNA

SEQ ID NO: 32355 - DNA, 175 bp, Homo sapiens; identical to SEQ ID NO: 3388
  misc_feature 1..175: note = chr9:1042326-1042501
  misc_feature 1..175: note = hyper
  source 1..175: mol_type = genomic DNA

SEQ ID NO: 32356 - DNA, 371 bp, Homo sapiens
  misc_feature 1..371: note = chr9:1042615-1042986
  misc_feature 1..371: note = hyper
  source 1..371: mol_type = genomic DNA
cggaagccgggggcgctgggtctcaggcccggatgctgagcgcggaccggcgtgtcctccccacagcgcccccgcgcggcctcctcccgctgcgccccgcacggcgacccgccgcgggtagccctggcgtttggccacgccgtcggctgaggaccgctagagctggggggagatcaaagcattcctatggggcccaaagagcctgggattgcagtgttgttagcctggcctcgccgcgtcaataaattttcggcgaaagttgggagcaggagtggaggcttggggcgggggttggtggggcgcgggggttggccggagggagggtccgggggtttcttgcacctgcgctcctgccgcgttaagtcagtggg

SEQ ID NO: 32357 - DNA, 76 bp, Homo sapiens
  misc_feature 1..76: note = chr9:1051563-1051639
  misc_feature 1..76: note = hyper
  source 1..76: mol_type = genomic DNA
ccccagagtgagggccgccaggctcaggccccagcgaagccccgagcgccatggccgacccgcaggctggctccgc

SEQ ID NO: 32358 - DNA, 414 bp, Homo sapiens
  misc_feature 1..414: note = chr9:1051904-1052318
  misc_feature 1..414: note = hyper
  source 1..414: mol_type = genomic DNA
ggcaccggtccccgagagcgctgcactcccgcgggcggcggcgcggagccgcgcaagctgagccgcacgcccaagtgcgcgcgctgccgcaaccacggcgtggtgtcctgcctgaagggccacaagcgcttctgtcgctggcgcgactgccagtgcgccaactgcctgctggtggtggagcggcagcgcgtcatggccgcccaggtggcgctccggaggcagcaggccaccgaggtgcgtacccgcccggcccgggcgtctcaggccacagtggaggtgggggagttggaggggagcggggcggccgtccacaccccccgcgcccagggccttgcggtgcctggcactccctaggaaggatggtaagaacgcttttctgcttgcactggcgagcagggtcgggagggaaaaagc

SEQ ID NO: 32359 - DNA, 380 bp, Homo sapiens
  misc_feature 1..380: note = chr9:2621312-2621692
  misc_feature 1..380: note = hyper
  source 1..380: mol_type = genomic DNA
ccgtcagtggggaggcggtggcaacagcaacgatagttgcatcagcgctaactgctgctgctgctgcgtgttctgccggaggctgccgggagggtacagtaatgactgtagggagcgcacagccgctgcggcggcaggttccctggatcaggaaattaggacaggcacccgggattggaggcgagggcggcgcgcgagccaaccagcggtcgccccgggcccccgtgagccccaggcgaacgcgcggagcagccgggcccctagagcggtccgggtggcggcggcggcagccacgaccacgaccgcggtcactcacgcacgctcacactcgcacgctccccgcgcgggcacccggctgcccggcgcgtgcaagaggagcg

SEQ ID NO: 32360 - DNA, 44 bp, Homo sapiens
  misc_feature 1..44: note = chr9:2622978-2623022
  misc_feature 1..44: note = hyper
  source 1..44: mol_type = genomic DNA
accgctcgggtctcccgtgtagctgaacgcggagggggagtgga

SEQ ID NO: 32361 - DNA, 30 bp, Homo sapiens
  misc_feature 1..30: note = chr9:3181153-3181183
  misc_feature 1..30: note = hyper
  source 1..30: mol_type = genomic DNA
actcgcatccctacacgtgcacacacccgc

SEQ ID NO: 32362 - DNA, 307 bp, Homo sapiens; identical to SEQ ID NO: 9828
  misc_feature 1..307: note = chr9:3181573-3181880
  misc_feature 1..307: note = hyper
  source 1..307: mol_type = genomic DNA

SEQ ID NO: 32363 - DNA, 30 bp, Homo sapiens; identical to SEQ ID NO: 9829
  misc_feature 1..30: note = chr9:4299034-4299064
  misc_feature 1..30: note = hyper
  source 1..30: mol_type = genomic DNA

SEQ ID NO: 32364 - DNA, 58 bp, Homo sapiens; identical to SEQ ID NO: 9830
  misc_feature 1..58: note = chr9:4299348-4299406
  misc_feature 1..58: note = hyper
  source 1..58: mol_type = genomic DNA

SEQ ID NO: 32365 - DNA, 58 bp, Homo sapiens
  misc_feature 1..58: note = chr9:4299639-4299697
  misc_feature 1..58: note = hyper
  source 1..58: mol_type = genomic DNA
cgtctgcgagggcagcggcggcagggggaggaggaggcagaggcggggtggctggacc

SEQ ID NO: 32366 - DNA, 189 bp, Homo sapiens
  misc_feature 1..189: note = chr9:4299943-4300132
  misc_feature 1..189: note = hyper
  source 1..189: mol_type = genomic DNA
gccggtgcccgtgcgcgccgcgctctgggctgcccgggcggcgcagtgtggacgcggctgcagggagaggggaagggggaagagggagggaggaaggcagccgggcgaggagtgtggatgtgtgtgcggccgcgagggccggcctgtagccagctgcttcctgagtgtgagcgccggagggggaggggg

SEQ ID NO: 32367 - DNA, 329 bp, Homo sapiens
  misc_feature 1..329: note = chr9:6412571-6412900
  misc_feature 1..329: note = hyper
  source 1..329: mol_type = genomic DNA
taggcctggagctgccgcctccgccaggcgacgggaaaccctcggaagtgggtttccgcgcgaaagtagcattgcggccaggcgggaaacgtgttcgcgaagcaggagggcccccggggcctttcccgggcgacccgacccgccaggccgcgtggcgggagctttcctgttgagcgcggtggagcgcacacatttccttcagttctttctcggaagtttaggccgcacccacccgcgccccctttccaggattatacaagtgcacgccagggtttcttatttttggtgtgtttttgagaccaaagaaccatatccgctaagcctgagga

SEQ ID NO: 32368 - DNA, 17 bp, Homo sapiens
  misc_feature 1..17: note = chr9:6644351-6644368
  misc_feature 1..17: note = hyper
  source 1..17: mol_type = genomic DNA
aacgcaggggaagctcg

SEQ ID NO: 32369 - DNA, 15 bp, Homo sapiens
  misc_feature 1..15: note = chr9:6644539-6644554
  misc_feature 1..15: note = hyper
  source 1..15: mol_type = genomic DNA
cgattttcagggaac

SEQ ID NO: 32370 - DNA, 1252 bp, Homo sapiens
  misc_feature 1..1252: note = chr9:6644899-6646151
  misc_feature 1..1252: note = hyper
  source 1..1252: mol_type = genomic DNA
gatttcagttgcaaccggagctaaccggtaagcccactcttaatcagggggtcttcctcctcttgcaaagtttaggtccatccacagggccacttgggctgggggtggtttaaaaatgtacacttttgaggcacgaagactgggtgcaggagaaagtaagctgttaagaagtaagaaggcacgaggaccaaaggcacgaatttgcttccacgccacggcccgggacccagggtgcggggaccacgcggagcgcagcagagctcagggtaggagccgggaggccgcgcaggcagagcccgggcagggcggaggggaggccgcggagggccgggtggaggtccttaccgccagccccaaggtctgcagcatctctctctggtctttgtccccagggccgatgtgcctccgagcgaagtcgtcgtgtctgggcagaaggcgctccaggaggcgcgaggccccagccgcggcgctgtccccgccgccactgctgctgtcccggctccgcggcgcccagcacggccccgatcccccagccaggcggcggccgcccccgaccccgcggcccaggcgcagcccccacgccctggcacaggactgcatggccgcggccaccgtcccctgccccggcccgcaagggtcagccgcgctcttggcccctctcctggcctcggtcccccgggtggcggctgcgcccggcctggagcccctttcgctggacagtcggccggacagatggatggacgctcgcgggcaatgaatgggcgctgcgctcaaccaagacactcgcgcaaagttgtggctccacccaaggcacctgctccgcacactttaagcggcgccctggaggcgggaggtgggttggggccaggaagcccttggccaatgaaagtagacagagggggagggggcggaacagttcccgcccccgccccctcttcctaccctcttcccagcccttccgtggagtcccgcttcccctggaccggaggctgccatctccagtcctacccactccgacgctggctggtgccgggggccgggacgctccgtacgccgcccgccagggtgtggagccgcactggggcaagatcaggtgggacagcccaaagactccgggccaagttcctgggggactcggcggagatggaagatgattctcgaagctctccatttccttaattttgaggtatctttctctgtcacatttcatctcagggaaattaatatgggcagatggcggttcttttatctt

SEQ ID NO: 32371 - DNA, 37 bp, Homo sapiens
  misc_feature 1..37: note = chr9:6704532-6704569
  misc_feature 1..37: note = hyper
  source 1..37: mol_type = genomic DNA
cggcgtcgtgttgagcgggctgcggacacagacagcc

SEQ ID NO: 32372 - DNA, 43 bp, Homo sapiens
  misc_feature 1..43: note = chr9:8857443-8857486
  misc_feature 1..43: note = hyper
  source 1..43: mol_type = genomic DNA
gagaggacctctgcccgaggaggtccagaggagcaaactgtgc

SEQ ID NO: 32373 - DNA, 147 bp, Homo sapiens
  misc_feature 1..147: note = chr9:8857685-8857832
  misc_feature 1..147: note = hyper
  source 1..147: mol_type = genomic DNA
cgccaacactttcctccagcgccttcgcgccccgccacggccgcgccgccgcctccgggcggccaatttaatcccgcggagcagcggccgccgccgccgaagcccccctggtcgccgccgccgcccagccctcgtgcggccagccca

SEQ ID NO: 32374 - DNA, 363 bp, Homo sapiens
  misc_feature 1..363: note = chr9:8858327-8858690
  misc_feature 1..363: note = hyper
  source 1..363: mol_type = genomic DNA
ccagaaactgaggctcgtggggggagaggggtgcgaggcgacgcctgggaaagggcccgagcagagtcgagggccgggaggtggggtggccggtgcagcccagtctttggacctggcttgaacctggtagttacggctgcagaagaggtggtttggggaggggggaaaattaaacgaaaaagcccaggaaagtcattggaaaggcttctctctttgtttccttgtgtgggtgatttctaaaatcctcgtaacgtgctggggatcccacggaattgctgtgctccagcgctgggggattgtgtgtgcgcgttgcctgcgcgtgagtgtgagtgtgggtgcgcccggacgcggggagagctgggc

SEQ ID NO: 32375 - DNA, 123 bp, Homo sapiens
  misc_feature 1..123: note = chr9:10612684-10612807
  misc_feature 1..123: note = hyper
  source 1..123: mol_type = genomic DNA
tacctgcactctccccgccgaggctggctggcggcgccgcgccggaggggaggaggctcgggaggaggaggagaaagagcagcgggaggactcgggctgggaggggagcgcagggttggggag

SEQ ID NO: 32376 - skipped

SEQ ID NO: 32377 - DNA, 100 bp, Homo sapiens
  misc_feature 1..100: note = chr9:12775664-12775764
  misc_feature 1..100: note = hyper
  source 1..100: mol_type = genomic DNA
gcctttcatctgctgcgttttattactattatcgccgttccggaaaagtcatggaagacagcccgctgccagacctcagagacatcgagctgaagctggg

SEQ ID NO: 32378 - DNA, 208 bp, Homo sapiens
  misc_feature 1..208: note = chr9:13278748-13278956
  misc_feature 1..208: note = hyper
  source 1..208: mol_type = genomic DNA
accggtaccaattagcggctcgcctcggggtccccgcggctaaggcgagaacgcaggaccaggagcattgctgcccactctctaccgcaacccgcacatcccgggaccacgtaacggcggatggggcgtccgggagcggcccctgcaggggagagcaacaggctcccgcgccctggaggcctggtctgcgctccgggcccccaggcta

SEQ ID NO: 32379 - DNA, 44 bp, Homo sapiens
  misc_feature 1..44: note = chr9:13279362-13279406
  misc_feature 1..44: note = hyper
  source 1..44: mol_type = genomic DNA
cctcggcctctgggccggggctcaagcgccgcttacccggctcg

SEQ ID NO: 32380 - DNA, 116 bp, Homo sapiens
  misc_feature 1..116: note = chr9:13279633-13279749
  misc_feature 1..116: note = hyper
  source 1..116: mol_type = genomic DNA
cgcgcgccgcacttgcgccgaccggggctgccgcggaggcggtggcggggcccaggctgctggggctgccgtgacgcctgcgaccggcggggcggcgggcgcgccttggccaatca

SEQ ID NO: 32381 - DNA, 30 bp, Homo sapiens
  misc_feature 1..30: note = chr9:14347643-14347673
  misc_feature 1..30: note = hyper
  source 1..30: mol_type = genomic DNA
ctcttcggtcaggtccgcccaaggtcccag

SEQ ID NO: 32382 - DNA, 345 bp, Homo sapiens; identical to SEQ ID NO: 3394
  misc_feature 1..345: note = chr9:14348107-14348452
  misc_feature 1..345: note = hyper
  source 1..345: mol_type = genomic DNA

SEQ ID NO: 32383 - skipped

SEQ ID NO: 32384 - DNA, 26 bp, Homo sapiens
  misc_feature 1..26: note = chr9:16154745-16154771
  misc_feature 1..26: note = hyper
  source 1..26: mol_type = genomic DNA
cggcccggggacggcagggggcggct

SEQ ID NO: 32385 - DNA, 52 bp, Homo sapiens
  misc_feature 1..52: note = chr9:16870273-16870325
  misc_feature 1..52: note = hyper
  source 1..52: mol_type = genomic DNA
cactcccctccacctcgtccccccagcccgtccccaacgccctggagcctcc

SEQ ID NO: 32386 - DNA, 463 bp, Homo sapiens
  misc_feature 1..463: note = chr9:16870661-16871124
  misc_feature 1..463: note = hyper
  source 1..463: mol_type = genomic DNA
gtcaagtgcagcccccgcctcttggtctcctcttagcggccgcgcctggaccagcccctcggccgccgctggctccctccgtctcggcctttctctccctccccctccgagttcctccgggcctccgctctcgccgcctccgcctccccgcccgcccgcgcgcgccctcgccgcggcccctctgcgctcaggtgactgatttacactcgcgccggggtcgcgctcgcgccccgagtcccagccggcacggttccccggctcctcctcgggacaaaaaaaaaaaaaaagggaacggcttgtcccgggagggggctgccctgctcgcgggaggcgggggaccggcgggcgaggtgacctcggcggccgtgcaagccccacaagtttttcctctctctgcagaattgtcgtgactacaatgttgcttcccttttgcaaaataaaagtcggtcgttgtgttgtttgt

SEQ ID NO: 32387 - DNA, 236 bp, Homo sapiens
  misc_feature 1..236: note = chr9:16871415-16871651
  misc_feature 1..236: note = hyper
  source 1..236: mol_type = genomic DNA
acgccgaggaaagggcgcgaactttattccgactgcagcaaaccgcggcagctctttccttttcgggcactcgggcgtctctgtcccctttgaccagttcctcctccccagccccgcacgccccctcctcccctgccccttccccagcgtcccagccgcggccgacccggctccccgcgaccctctcagcccagctcctccgcgcgccgctggggagaaggcgagtgaggcggagg

SEQ ID NO: 32388 - DNA, 30 bp, Homo sapiens
  misc_feature 1..30: note = chr9:16872003-16872033
  misc_feature 1..30: note = hyper
  source 1..30: mol_type = genomic DNA
gccgcaagaatggggcgggggtgggggggg

SEQ ID NO: 32389 - DNA, 341 bp, Homo sapiens
  misc_feature 1..341: note = chr9:17135041-17135382
  misc_feature 1..341: note = hyper
  source 1..341: mol_type = genomic DNA
tgacccgttagcagccgcagccatggcggcgcgttcgcctccctcaccgcacccttcgcccccagcgcgacagctgggccccaggtccccacgtgttgggcggggagctgaagtacacgcaatgcgcagcgaggcctcgggttttgccggcgcagcgcgggaggtggtcgcggacgaaagtgataaaatctgggtgggtgaagaagggtcagggggccggcgagggcctgggggggcagctccggctcatgctcccctcctcagcgcgcccatggggtccagacggctagagggcatctcggtagaggaggcgatggtgacccggacgcagctgctggagg

SEQ ID NO: 32390 - DNA, 87 bp, Homo sapiens
  misc_feature 1..87: note = chr9:17135632-17135719
  misc_feature 1..87: note = hyper
  source 1..87: mol_type = genomic DNA
cggccagacaggcttcgcctccgcgcccgggtttggttttggtcacttggatactcgcagtcgcatcctctccgcttcccccccaag

SEQ ID NO: 32391 - DNA, 586 bp, Homo sapiens
  misc_feature 1..586: note = chr9:17578706-17579292
  misc_feature 1..586: note = hyper
  source 1..586: mol_type = genomic DNA
gtctttttcaggctgcggcgcagagacgccaggctcaaagggcaggagggccgtctgcaggcagcgccgccgcggctacctggaagcccagcaagtcacctgagtcctgcgggtgcctgggctgccaatctgcagcgacccgtccgcagcccccgggggcaggaacaccaaccccgggacaggaggacgtcctcggcccgctgactagggatccgccagcgggtgccgctgagccacatccccgcagttggcgccagcatccaggtaccgcgcgccacagcacctgcctgggcgttcccgcgcttggggcggggcttcccgcgtcccctttaagaggccgcatcacccgcccttgacgtcagagtgtttctccgcaagagcccgtgtcccgctaggctccgcgccctcgcgcccatagccccggcggcggcacgaccagaggcggccaggggagcgcgccgccccgctcggccctccagtccccctccgcctcctccctcccgcacagcagccgccagcgcggcctcctgcaccatgtcggtggccggcctcaagaagcagttccataaagccactcaggtaaggc

SEQ ID NO: 32392 - DNA, 297 bp, Homo sapiens
  misc_feature 1..297: note = chr9:17579402-17579699
  misc_feature 1..297: note = hyper
  source 1..297: mol_type = genomic DNA
ggccgcgccccgcctcgcaagccaaggcggcggctcggggcatccccggtctgggcgtccaccctcggtcccccgcccccggcttggtgcgcgctgccttcccgcgggtccccggcgtcctgcctggtagcgctgctcgccgcccccgcatcatctcgcgcccgtgctgcaggaaggggaccgcggctgcactgctgccgcggcgcgcaggtgccttggcggcgcggtgggagattatgtaaagtcgcctcttcacgggtgaccttgcggagtcggtgcacccggctttcccgggat

SEQ ID NO: 32393 - DNA, 91 bp, Homo sapiens
  misc_feature 1..91: note = chr9:17906058-17906149
  misc_feature 1..91: note = hyper
  source 1..91: mol_type = genomic DNA
gaaaagctccatgagcgcccaggggacaagtccccacggacaaacatgtcataacgatttcagttttgtcccattacgtgaggttgtaagt

SEQ ID NO: 32394 - DNA, 29 bp, Homo sapiens
  misc_feature 1..29: note = chr9:17906404-17906433
  misc_feature 1..29: note = hyper
  source 1..29: mol_type = genomic DNA
ataaatagaagccagcgcgcagccccgct

SEQ ID NO: 32395 - DNA, 234 bp, Homo sapiens
  misc_feature 1..234: note = chr9:17906460-17906694
  misc_feature 1..234: note = hyper
  source 1..234: mol_type = genomic DNA
cgctgccggggcggctggatgtctgcgctccccgcctccgctgggctgacacgggaggggaggagcaggagctggaggggtgttgggggtggggggagcgcgaaccatctcgagccaagacaagcagcacattcacaaataacgcccccacccccagcgcacgcgctcccattcaaagcagacccgctccgcggccgcactgaagctccaaagccgcgccgcctgccccagcgc

SEQ ID NO: 32396 - DNA, 52 bp, Homo sapiens
  misc_feature 1..52: note = chr9:17907031-17907083
  misc_feature 1..52: note = hyper
  source 1..52: mol_type = genomic DNA
ctggggctgcgctgccgcccaggctggggacaagtggcgcggggttggggct

SEQ ID NO: 32397 - DNA, 25 bp, Homo sapiens
  misc_feature 1..25: note = chr9:17907346-17907371
  misc_feature 1..25: note = hyper
  source 1..25: mol_type = genomic DNA
actcctccacacttccgcccttctg

SEQ ID NO: 32398 - DNA, 51 bp, Homo sapiens
  misc_feature 1..51: note = chr9:17907450-17907501
  misc_feature 1..51: note = hyper
  source 1..51: mol_type = genomic DNA
cggacgccggaccaggtgggctccctggtgcctccgcggtctagaggtggc

SEQ ID NO: 32399 - DNA, 130 bp, Homo sapiens
  misc_feature 1..130: note = chr9:19127231-19127361
  misc_feature 1..130: note = hyper
  source 1..130: mol_type = genomic DNA
ccaggacctggaagccgcgaggcgagcggggggtctcggaccatcacccccgcgtcccgtccacctttgagccccgcggggagcagagcagcggtcccaaggccccggggagccccccaccccaactggg

SEQ ID NO: 32400 - DNA, 547 bp, Homo sapiens
  misc_feature 1..547: note = chr9:19788355-19788902
  misc_feature 1..547: note = hyper
  source 1..547: mol_type = genomic DNA
aagtcatctccagcccgatcctcgctccccctgaaaacccaccgctcgtctccccgggagctgcctccgtaggagaatgttcgcccccagccgcgccccaactttgccttgcgtggtcccaaactttccctggtggattaataggaaaataaatctaaaggacagacgccccacctgtgagcttggagctgggttgcatttggtgaggcgcttggcccgcatccccctgagtcgtttgtaggtggctggggaatggaagcgcccctctgcgcgtctcccccgacggcaggccctgccccacgccccccatcccaagccaaaagcaagggtaggagaggcgggggctccaaatccacgccccggagcacagagagttggctaactcctagcggggcctggggcgcccacatccacggcagagccacctgtgagcctgcagagcagcaacgggatgcgcgcaaccgggatgcggggacgaccgccacagcggctacagcggcaggcggggcgcagccgcccgcacttaccaggataagatgggaggacg

SEQ ID NO: 32401 - DNA, 367 bp, Homo sapiens
  misc_feature 1..367: note = chr9:19788934-19789301
  misc_feature 1..367: note = hyper
  source 1..367: mol_type = genomic DNA
cgctccagtccgccggccctccgcctacccgctctgaggcccgggctctggctcgcactggctgccgctctcgccagccgggctgggttcgggaggagactgagccgctgtgagcccggcgctccgagtctggcgctgcccggcccccgccggcccctccctctgggctgtgcgctgtgcgctgggagcggggccgcagcgcgctcagctcccgagtcctttgctccacgcctcctgggcgcagaggcgacgctggcagccgtctcttaggagatttctccgcagtgtggacgggggtcaggatttgcaggcgagcaagggcagagaggagaaatcgtacaggtcggtgacgcgcctaattcacaaa

SEQ ID NO: 32402 - DNA, 424 bp, Homo sapiens
  misc_feature 1..424: note = chr9:21031412-21031836
  misc_feature 1..424: note = hyper
  source 1..424: mol_type = genomic DNA
aggggtgcctgggcacggtagcgctgcgccttgctggcgggcggggggtgccgcccgcccgcccgccgcagaggggagctcccgcctccaggccctccacccgcgccccctcccctcgggattcggccgagcgccctacctgggctgcagccaggcgggcagcgccaagggccccatgggccgccgccgccagggcttccagcgcggtccaggaaggagtaccggggaggaggcaggggcggccccgcggctgggcgcggaagggcggggcctctccacactcagcagtttacaaaaagaaaaagcccgaggtcgtgcgttggggaagagatgaaaacgaagttctcgaagtttctgcagcactgctagagcgcgtcagggcgcaaggctgggaggcggctcgcgttcccggtggggttaccaa

SEQ ID NO: 32403 - DNA, 315 bp, Homo sapiens
  misc_feature 1..315: note = chr9:21395999-21396314
  misc_feature 1..315: note = hyper
  source 1..315: mol_type = genomic DNA
ctctaacactgactacggcacgatctgattttgagccgtcagtcccctcaatacactggcacattggtaaaacggtctcgctaaaatgttccatgagaaaaatgtctcgggggaggcggcggtagagctctccctctgtagtcagagccgtgaaaggcggcgtttactcgctgctcacgaggcctgcggaccctaatccccaagcgcccgggcctccactctgcggaccccaagcgcgggtctccttgaggaaggggcgaccgcgggttagggtcgctggtgggtccgttaccgctggtccggcgccctctgtcg

SEQ ID NO: 32404 - DNA, 575 bp, Homo sapiens
  misc_feature 1..575: note = chr9:21402571-21403146
  misc_feature 1..575: note = hyper
  source 1..575: mol_type = genomic DNA
cgccccagggtccagcgtgtccccttccccaagacgtccccgccctgcgcccccacacaaacggaatccccaagattaaacccgtgcgatctcgagccctcaagtcccggaatcaacgggtccctctgtaaaaacaagtctcgctgaagtctctatgggaaataaaagccccaaacccaggggaaaatcccgaaaataaaaggtgccctgctggctacctgaggaagatgtctcaagggagaccacggcggagctgcctcctgagcagcaaaagagatttttttactcaggtcgaagctgcacaaagttggcgcgataagccgcgacgacgtttccctggggctgcgggacgccccgaaactcaaacccgcggttcccaaatcctgggcatcaggaaaacccattctggcgccttgctgcggccgtggtgcgcagcgctgggagctttgcgctctttgcgcagcgggcccgcgccccttcgaggccggctagtgaatctctgaaatcacagtggcctacacctccctggtaatggcgggagtcatcatgctcatctccagcgctgcctgctcact

SEQ ID NO: 32405 - DNA, 134 bp, Homo sapiens
  misc_feature 1..134: note = chr9:21559984-21560118
  misc_feature 1..134: note = hyper
  source 1..134: mol_type = genomic DNA
ctcctcccttgggcccggacgggacccaggtttctccactgcaacgcagctcccgagtgacggaattttgtgggggaagcggcggccactacgctcgcttttggcacagtagccctttgcgggtgggagcttct

SEQ ID NO: 32406 - DNA, 482 bp, Homo sapiens
  misc_feature 1..482: note = chr9:21964943-21965425
  misc_feature 1..482: note = hyper
  source 1..482: mol_type = genomic DNA
tgagacacgtgagatctggaaggaggtggaggtgaagaccctcccacctggcctgcatccagagtacttggggtgtggcactggcgtgggccccaggaaggatcccagccagttttggtgctggaggcccggccaaaggaagggctgctctcccgtcccgcgggctccgaggtcgccgcacccgggcgcgcctgggcctcgtcacccgcgctcgtgacgcgtgcttacaaaggaaacttttacaggtttcggtgggcagggccttttattgcccttctgctccacagcccccgtgcttaatcggttggttgggaggtttctttcgtccgtggttttggaaagtccccgcctccaaaccgcagtcccgcagtcagttctgcagcctcagggcctcgaacagccatgcttagaatccgtccttctttcctgctccatctacccttcccctctggcttcttttttttcactggagaaagcccacc

SEQ ID NO: 32407 - DNA, 191 bp, Homo sapiens; identical to SEQ ID NO: 9859
  misc_feature 1..191: note = chr9:21965569-21965760
  misc_feature 1..191: note = hyper
  source 1..191: mol_type = genomic DNA

SEQ ID NO: 32408 - DNA, 35 bp, Homo sapiens
  misc_feature 1..35: note = chr9:21967367-21967402
  misc_feature 1..35: note = hyper
  source 1..35: mol_type = genomic DNA
gcggggactgggagccgagtcggattccgagacta

SEQ ID NO: 32409 - DNA, 183 bp, Homo sapiens
  misc_feature 1..183: note = chr9:21968251-21968434
  misc_feature 1..183: note = hyper
  source 1..183: mol_type = genomic DNA
cagaaagaaaacaggcgttagaaacctgaggtcaaagatgtgtggcacatcccgccctcctctcttgccgtccctaccggcattgaaatacttatggataaagttctcgcaatggcttcacgtgcatgtacccgccgccaccgctctcccacacctccctggtccagcagctagtccactgcc

SEQ ID NO: 32410 - DNA, 239 bp, Homo sapiens
  misc_feature 1..239: note = chr9:21968456-21968695
  misc_feature 1..239: note = hyper
  source 1..239: mol_type = genomic DNA
cgaccgctcaagcgctccaggtccacccggcggagggcagagaaagcgcgaccgcgcggcccgcagggttgcaagaagaaaacgagtgttatataatgagtctcagtggttgctcacaatgccaggcgcgaaggcgtgaagatgtggcctttcccttcccgcatccccaggcatcttttgcacctggtgcggagtgagccagccagcttgcgataaccaaagggcgcctcaggctctgg

SEQ ID NO: 32411 - DNA, 92 bp, Homo sapiens
  misc_feature 1..92: note = chr9:21969169-21969261
  misc_feature 1..92: note = hyper
  source 1..92: mol_type = genomic DNA
aggaggggggatgatcgcttgagcccagataacatggtgagaccttcgtctctattaaacaaacaaacaaacccaggcgtcgtggcgtgcac

SEQ ID NO: 32412 - DNA, 141 bp, Homo sapiens
  misc_feature 1..141: note = chr9:21969747-21969888
  misc_feature 1..141: note = hyper
  source 1..141: mol_type = genomic DNA
cgaagtctccttcttcacctcccgggacctggatgctagctgtaactggagggaattggcgggggggaggggaggaggggccgagtaaagaagaacttcgcgtctttaacttcgaaggtgattttgcgttctgtatttaca

SEQ ID NO: 32413 - DNA, 126 bp, Homo sapiens
  misc_feature 1..126: note = chr9:21970940-21971066
  misc_feature 1..126: note = hyper
  source 1..126: mol_type = genomic DNA
gcctctggtgccccccgcagccgcgcgcaggtaccgtgcgacatcgcgatggcccagctcctcagccaggtccacgggcagacggccccaggcatcgcgcacgtccagccgcgccccggcccggtg

SEQ ID NO: 32414 - DNA, 936 bp, Homo sapiens
  misc_feature 1..936: note = chr9:21974181-21975117
  misc_feature 1..936: note = hyper
  source 1..936: mol_type = genomic DNA
cgcccggccgcttctgaataatttcgatcaaaatttatattcgatatttattccaacatacaccacagatttccactgataatccctcctagtaagaaagataagctccatccaggtatctgtgaattggaggctaagtagtcccagcacatcttacatttctttaagactccctttttatcccaaacgttcgtaaattttgtatctgataaagagcatacttccatctaatacaaatatgttccccccttcagatcttctcagcattcgagagatctgtacgcgcgtggctcctcattcctcttccttggcttcccaagcccccagggcgtcgccaggaggaggtctgtgattacaaaccccttctgaaaactccccaggaagcctcccctttttccggagaatcgaagcgctacctgattccaattcccctgcaaacttcgtcctccagagtcgcccgccatcccctgctcccgctgcagaccctctacccacctggatcggcctccgaccgtaactattcggtgcgttgggcagcgcccccgcctccagcagcgcccgcacctcctctacccgaccccgggccgcggccgtggccagccagtcagccgaaggctccatgctgctccccgccgccggctccatgctgctccccgccgcccgctgcctgctctccccctctccgcagccgccgagcgcacgcggtccgccccaccctctggtgaccagccagcccctcctctttcttcctccggtgctggcggaagagccccctccgaccctgtccctcaaatcctctggagggaccgcggtatctttccaggcaaggggacgccgtgagcgagtgctcggaggaggtgctattaactccgagcacttagcgaatgtggcacccctgaagtcgccccaggttgggtctcccccgggggcaccagc

SEQ ID NO: 32415 - DNA, 446 bp, Homo sapiens
  misc_feature 1..446: note = chr9:21975190-21975636
  misc_feature 1..446: note = hyper
  source 1..446: mol_type = genomic DNA
cgccctccggcctccctgctcccagccgcgctcccccgcctgccagcaaaggcgtgtttgagtgcgttcactctgttaaaaagaaatccgcccccgccccgtttccttcctccgcgatacaaccttcctaactgccaaattgaatcggggtgtttggtgtcatagggaaagtatggcttcttcttttaatcataagaaaaagcaaaactattctttcctagttgtgagagccccaccgagaatcgaaatcacctgtacgactagaaagtgtccccctaccccctcaacccttgattttcaggagcgcggggttcactaagtcagaaaccctagttcaaaggattccttttggagagtcggactgctctctccttcccctccccttcccctcctgcgtgtaaaacggctgtctggggcaagggtttctcagacgtgtacattgcctg

SEQ ID NO: 32416 - DNA, 32 bp, Homo sapiens
  misc_feature 1..32: note = chr9:22011013-22011045
  misc_feature 1..32: note = hyper
  source 1..32: mol_type = genomic DNA
cagatgtgtgagcttcgcgaagcaagttgact

SEQ ID NO: 32417 - DNA, 351 bp, Homo sapiens
  misc_feature 1..351: note = chr9:22446925-22447276
  misc_feature 1..351: note = hyper
  source 1..351: mol_type = genomic DNA
tgtaaaacttttgtccgtgcgcgggtggagctcagtaggaccacggcgcgtcctgccccggcttccccagcctcccagcagggttagctgcggtcagcgcactttccacttgggactcccggccagaaatttctcgggaatggagcggtcacagtgtggcagcagagaccgaggcgttagcggccgacctcacttggcccctgggctagtggtggctgcccctccgcccccgtccccggcgttgccggtaccatcggggatgcaggttcccccagcgttcctgcggccgcccagcctctttctgcgagcagcggccgcggccgccgccgccgctgccgccacctcgggaag

SEQ ID NO: 32418 - DNA, 122 bp, Homo sapiens
  misc_feature 1..122: note = chr9:23821297-23821419
  misc_feature 1..122: note = hyper
  source 1..122: mol_type = genomic DNA
aggcgcgactgtccccgctcggctcccgccgcccccaacctgcttgtgcccacgggaggggcggtgccacctcccgaggcgcccaattctctctactcccgccgcaacgggctgagctctag

SEQ ID NO: 32419 - DNA, 30 bp, Homo sapiens
  misc_feature 1..30: note = chr9:23822239-23822269
  misc_feature 1..30: note = hyper
  source 1..30: mol_type = genomic DNA
tttttccccctacttcgcagccaaggggtc

SEQ ID NO: 32420 - DNA, 71 bp, Homo sapiens
  misc_feature 1..71: note = chr9:23822568-23822639
  misc_feature 1..71: note = hyper
  source 1..71: mol_type = genomic DNA
gcctgtcctcagacccggccccacggctggaagtcaaaacccaccccggagccacgcggctggagcacgtt

SEQ ID NO: 32421 - DNA, 579 bp, Homo sapiens
  misc_feature 1..579: note = chr9:23824012-23824591
  misc_feature 1..579: note = hyper
  source 1..579: mol_type = genomic DNA
ggaagggacagaatccgtgcatttcggggagaaagtacagagacctccatccctgtccagcagtgttaacagtaaatactaaatggttggctatttctctcaccctcgccataataaaaccagacctgcagccggtaattacgagaaaatacccagtctcgccatcagttttgctaaccggtacttgaaaatgggaaacggggaacttatccaacctccaatttgtcacagttgtatagctttcgtattaattctgtacagacgtgaaataggtgggtacgtagcaacgtgctgggcataaattaagcaacaatggccacgcgaggtctcgtccgccgcggagctccagtggtgggcactgccaccttgccatccctagcccccaccgcccttcgcagagtccagtccgggaggctgacggtgcgctggctttcccagccggtagagtgggtggggtgaggagcaacgagacgttaaccccagccggctttgtagctttttcccatcctctgcctctcgagcaccacatgagcgctctcacgcacacactcacccacaccccctcgtgccaataattta

SEQ ID NO: 32422 - DNA, 61 bp, Homo sapiens
  misc_feature 1..61: note = chr9:23826326-23826387
  misc_feature 1..61: note = hyper
  source 1..61: mol_type = genomic DNA
gccaggctcctatcccgggcagcacgcgcggaagtatacgccgaatcgcgccacaacgtaa

SEQ ID NO: 32423 - DNA, 40 bp, Homo sapiens
  misc_feature 1..40: note = chr9:23829874-23829914
  misc_feature 1..40: note = hyper
  source 1..40: mol_type = genomic DNA
gaatgttttattccacgggactttgcggaaaagactgtcc

SEQ ID NO: 32424 - DNA, 30 bp, Homo sapiens
  misc_feature 1..30: note = chr9:23830739-23830769
  misc_feature 1..30: note = hyper
  source 1..30: mol_type = genomic DNA
tttgcagcctcagatcgacgattattttat

SEQ ID NO: 32425 - DNA, 254 bp, Homo sapiens
  misc_feature 1..254: note = chr9:23831117-23831371
  misc_feature 1..254: note = hyper
  source 1..254: mol_type = genomic DNA
ggacctgggaagaaacggtttttatgcttccgatgctcggaggctctttcttatattgaagatttatgtttccacttgtgtgcgatgcacgtctaatttgaaataataaaaccgggctgagcaaccagtcaatcagagccatccagggcgctccgcacgccgccctgccccccacctccctccggtctctaactctttccctcctcctccccctctcactctcctggccctccccgtcttccttcctccctcct

SEQ ID NO: 32426 - DNA, 15 bp, Homo sapiens
  misc_feature 1..15: note = chr9:23831450-23831465
  misc_feature 1..15: note = hyper
  source 1..15: mol_type = genomic DNA
cgggccacggtgaca

SEQ ID NO: 32427 - DNA, 30 bp, Homo sapiens
  misc_feature 1..30: note = chr9:23831747-23831777
  misc_feature 1..30: note = hyper
  source 1..30: mol_type = genomic DNA
gcattaaaatgctttcggcaggcagagggg

SEQ ID NO: 32428 - DNA, 38 bp, Homo sapiens
  misc_feature 1..38: note = chr9:23849841-23849879
  misc_feature 1..38: note = hyper
  source 1..38: mol_type = genomic DNA
aaaccacccacagaccgagcagacgagaagaaatggta

SEQ ID NO: 32429 - DNA, 45 bp, Homo sapiens
  misc_feature 1..45: note = chr9:23850410-23850455
  misc_feature 1..45: note = hyper
  source 1..45: mol_type = genomic DNA
ggttggctgctgctgcgaggctgctgcagccgaggctcccgcgag

SEQ ID NO: 32430 - DNA, 30 bp, Homo sapiens
  misc_feature 1..30: note = chr9:23850946-23850976
  misc_feature 1..30: note = hyper
  source 1..30: mol_type = genomic DNA
caactgaaccgattacggacggcgaattta

SEQ ID NO: 32431 - DNA, 30 bp, Homo sapiens
  misc_feature 1..30: note = chr9:25678053-25678083
  misc_feature 1..30: note = hyper
  source 1..30: mol_type = genomic DNA
agccgcgcgttctgccggtcccactcgtcc

SEQ ID NO: 32432 - DNA, 132 bp, Homo sapiens
  misc_feature 1..132: note = chr9:29212039-29212171
  misc_feature 1..132: note = hyper
  source 1..132: mol_type = genomic DNA
cagagaaccaagaggcgaaaggagagtggaggagaaagagggcattacctcccggggctgccctcagggtgcgggtcaggatctcatccccgaagtggctccagttcaaggcacagctttccagagctcagc

SEQ ID NO: 32433 - DNA, 572 bp, Homo sapiens
  misc_feature 1..572: note = chr9:29212210-29212782
  misc_feature 1..572: note = hyper
  source 1..572: mol_type = genomic DNA
cggaagcgcgccgggactgccgctcacgtcccccgcccctgccgcgcgggctccgccaccccgcgagcacgctggctctccgcgctcaccccgccgcctcctggcgcccccacacccacccgctccgcggcgcccgctgggagcctctagcggaggcgaagggaacagcaggcgacctgcggcgcccaggttccgacgccggttgcagggagccggccaagcggcagcgtgggcttcgcgcgcccccgagtccgcaggccgggtgccgccgccgcccccacctgcccacctgcgccaggctcacctgccaccgcgtcctagttgcgttcaccggtgcccacagctctctatggcaattgggggtgggtctgcggtgctaataaaaatttaaaaaaaaaacctctctggtaaaaaaacgaaaacccaaaacccaaatccacgctgtatatcaacctccacagagaacccagtccgaaatcgttttccaataggtttcagaaagtgtgaggacaggacactcctctggcttcctgcctcgcagctgggcagcgccgcaccggctactccctgac

SEQ ID NO: 32434 - DNA, 46 bp, Homo sapiens
  misc_feature 1..46: note = chr9:29213181-29213227
  misc_feature 1..46: note = hyper
  source 1..46: mol_type = genomic DNA
tattcagttttcttccgtaaccccacagacacgtcagtcaattccc

SEQ ID NO: 32435 - DNA, 993 bp, Homo sapiens
  misc_feature 1..993: note = chr9:29213476-29214469
  misc_feature 1..993: note = hyper
  source 1..993: mol_type = genomic DNA
tgggcgggcggcgggcggcggcgccaggtgaggaggctttgaggaggcggctgcaaggcgggacgcaggatagccggctggggcttggcagccgggctcagagctcgggctgcgcacacacacaggcgcgcacacccgcgcgcgcgcagctacacacgcacgcccagccctgcgcccgcggcccccggccagtggcgagcgaaaagtcgggagtcctgaggaggggtaggggttccaaggatgctgatgacagaaagagtcaatcaatcctcactagttagcggattgccggcaggcagttcctcgccgcacgccgttaagtccgttgggccacctctccgttctctgccctgtctggcatttcaactccctagctcttttcttgaagccagttacaccccctcgacacccagcgagaggccaccagactaaagatgagccccgttcccatcgccaccctccaggggccacctccgccccttctgtagtggagaattgaagtggctgcagcagctctcctgggagctgaggggctccccgaggtccttcgaatagaggagcctacacatcgcttcgtgaacataatcccctcgcatcccgtctttacctgcccactcccttcgtaacatttcccccaaggagctcccgaaagtcgcttagatgttttgaaaatgaatttcttagggaattgtagtgcctagcttttggaactgggttaatttaggtgctacgcttatattgtaaactggacggtagcaggtgaacggctcagctggagaaaggggagggattaggagtctggagacccaacccctttagcagccatttccaaggttttgcaccaggagtagctgtccgggtctctggctagctcctgtcccaacttctttttcttccctcgacggtcgggagggatcactgggtgctacaccgctggggcgtcccaggcaggagagacttcgctctcagaagcgcccccgtgtcatccacaac

SEQ ID NO: 32436 - DNA, 453 bp, Homo sapiens
  misc_feature 1..453: note = chr9:29214681-29215134
  misc_feature 1..453: note = hyper
  source 1..453: mol_type = genomic DNA
tgccctctggggcttcgcgaatatctatggcttcggacctgctagcggaaaacgcaaagttgcccagcttggagatggcaccaggttcctttgctctggcgctggatgctccgctccgccacccaccgccgccgtctccatcgagaatctcctcaaaatcaagggagttcttgactgtccctctccaaattggaaggcggttgactttgccgggaaccgagttcctgagcggcaaacgtggagtcgcagagcgcagaagtgaagatttaatacaaaagatgaaacttgtaggatgacctctagcagcgctactcacagctctgaaatcgatccagagcattccacagtgagcgttgcggctcccaggggctccggaccggtaacttcaggcgcaagtctgaatttcagggatgaacctgctttggattctgtttgagccgactcagtgcagag

SEQ ID NO: 32437 - DNA, 306 bp, Homo sapiens
  misc_feature 1..306: note = chr9:32782630-32782936
  misc_feature 1..306: note = hyper
  source 1..306: mol_type = genomic DNA
ccctgcctaccagagcgggaggaacgcaggctctcaatgcctgcttcagcaagggaggagagaatcgcccagagctgagcggcgtcgtagggtggtggtcctgaccggtcaaggccccttctcctcgtgaactgggggccagggagcccttctccctgtccccccggcaccacagcgctgtagaagtgaaatcccggctccaaggtcaccctctcccgagcctggagctggaaagccacggggactccggggactcccccaaggcccggactagcctggcacccacccctcaccactaacccactc

SEQ ID NO: 32438 - DNA, 138 bp, Homo sapiens; identical to SEQ ID NO: 3402
  misc_feature 1..138: note = chr9:32783083-32783221
  misc_feature 1..138: note = hyper
  source 1..138: mol_type = genomic DNA

SEQ ID NO: 32439 - DNA, 161 bp, Homo sapiens; identical to SEQ ID NO: 3403
  misc_feature 1..161: note = chr9:32783259-32783420
  misc_feature 1..161: note = hyper
  source 1..161: mol_type = genomic DNA

SEQ ID NO: 32440 - DNA, 146 bp, Homo sapiens
  misc_feature 1..146: note = chr9:32783590-32783736
  misc_feature 1..146: note = hyper
  source 1..146: mol_type = genomic DNA
cgccgggctccgcttgcacagcaccgggaccgacgggcactgctgggagagccgctctcccaggttccacctccccgatgcagagtccgtgggggaaaccaggctttcctcccagaaccaagggagcgagccgagggggcagctgc

SEQ ID NO: 32441 - DNA, 300 bp, Homo sapiens
  misc_feature 1..300: note = chr9:33523982-33524282
  misc_feature 1..300: note = hyper
  source 1..300: mol_type = genomic DNA
gcaggaaccgaccctcagccccatccccgcggacggtccctggagcggccccgatctctcttcggagaagaggggcgggagtcacggccaggcgggaagggatgcgcgcctgagattccggaacgtcccgcgccagcccaggagaacccgcaagccagcggcgcctgagcccgagctgcagtcaccctctgcgggccacgcgagctcgagggcgccttccggagtccgggctggcgctgagctgtaggcgcgcgcctaaccgctttactgggctcactctatcgagaggtcggaggctgc

SEQ ID NO: 32442 - DNA, 499 bp, Homo sapiens
  misc_feature 1..499: note = chr9:33524342-33524841
  misc_feature 1..499: note = hyper
  source 1..499: mol_type = genomic DNA
cgggtttgggggtgcatcttggatttaggggtggatcgctgggtggggagggggatctcgaatttggagctgggtgggggtggaaaggccacgaggagccgcggcgtctcaggagcgggtggtgggcatctgagaagtcgccaccatgaggaagctcctcagttttgggagacgcctgggccaggcgctcctgagctccatggaccaagagtatgcgggtcgggggtaccacattcgggactgggaactgcggaagatccacagggcggccatcaagggcgacgccgcagaggtggagcactgcctgacgcgcaggttccgggacttggacgtccgcgacagaaaagacaggtagcgggggctcagccctcggtgggagggggcccccaggcccggtttccccgcaccgcctgaggcggggtcgtcggagttcgccgggaccctgggagccgcggagccaaatggagcctcagctgctttccatcgctgggaatttccc

SEQ ID NO: 32443 - DNA, 644 bp, Homo sapiens
  misc_feature 1..644: note = chr9:33676771-33677415
  misc_feature 1..644: note = hyper
  source 1..644: mol_type = genomic DNA
tgcttggctctggaccgcagccgggtaatggctgcggcagcagctgctggatggtggcagctactgggcctgcttctcctcagcagccagaggcctggcagcggcggcagcggaatggggagaagacgaataatcctccgaacggctgcctcctccagcggcctccggagcccgggccacggggggtgcggcggcggcggacgagaggtttaaaaccggcccgggtccctccatgtgccgccgccgccgccgccgccgccgccgtgttggaggcagtagaaggggagagaccaactctccggcgttcccagccctggaaatggtgacaggcgactcagaccccctccctggagctgcagccgccggggccaccgggggcgccgccgccgccgcttctccccccgctccaggagggggaggtgccgccgccgccgcgcctcagccggctcccgcccaagcccacggcttccaccttccctttcaggagaagccgaggaagaggctgcacagttagaaaagacgaagaagaagcgagaaacgccgccgctgccggcgccgcccccgcggatgctcacgggttgctgagaggggcttcaggccgggccgggccgggccgccgccgccgccgccgtctctgtctctca

SEQ ID NO: 32444 - DNA, 283 bp, Homo sapiens
  misc_feature 1..283: note = chr9:34589020-34589303
  misc_feature 1..283: note = hyper
  source 1..283: mol_type = genomic DNA
agaaaaccatggggacgccgaccgacacacacatgcacacacacacgcgcgcgcgggcgcgcggattcacacggacacacatgcactggcagacgcgcaaccgtcggttcgcatccccgggcgctttgaagtccagatttctgcccgagaaagaagccacctttgggcgcgcaaaggccactacgaacctccccaaacccaggaatttttccagaccccgcgcgtgcagctgaggggtggggagaacagggacactaggacaaaccgccggagccacctccct

SEQ ID NO: 32445 - DNA, 152 bp, Homo sapiens
  misc_feature 1..152: note = chr9:34590071-34590223
  misc_feature 1..152: note = hyper
  source 1..152: mol_type = genomic DNA
gcgttcaccctttctcgggcgcgccctcaagacggctgtggtccccgtgcttcacgcgcagccccggccgcgggtctcgcaaacgcgcgcgcgcacacacacacacacacacacccactcggcccgctcccctagggcggctgggcgcgcac

SEQ ID NO: 32446 - DNA, 177 bp, Homo sapiens
  misc_feature 1..177: note = chr9:34591455-34591632
  misc_feature 1..177: note = hyper
  source 1..177: mol_type = genomic DNA
ccccagggggctgaccggcctcggcgctctaatccggccggggaggggcggacggggtgaaaattggcgagtggtttggggaacggacttgacctccagatgccctggtgtccctggctcagcctctttctgccaggttgggagcagtcgggaattctgtcccggtccaacgtcccc

SEQ ID NO: 32447 - DNA, 148 bp, Homo sapiens
  misc_feature 1..148: note = chr9:34665047-34665195
  misc_feature 1..148: note = hyper
  source 1..148: mol_type = genomic DNA
tggctggctgggcagcggcggtggggctgcggcgggggaagccacgacccgagcgctggggagtaggacccaggccgctggacagacagctcatcaggcctcgcagaggctccagcttctgctccccggggtgcgccgagctgtgggg

SEQ ID NO: 32448 - DNA, 187 bp, Homo sapiens
  misc_feature 1..187: note = chr9:34701358-34701545
  misc_feature 1..187: note = hyper
  source 1..187: mol_type = genomic DNA
ctgtggggctctgggcgaccggggcatgtgtgcggatgtgtgtccgcgcccgtgagcgtgcccatgcatctcccttcctgggcctgcagggggcgccccgagcctgggaagggaggctctggagtggggcgcggctgcggcagaggggtgggcgcatgcggctgtgaccctgcgagctcctcagaga

SEQ ID NO: 32449 - DNA, 135 bp, Homo sapiens
  misc_feature 1..135: note = chr9:35162260-35162395
  misc_feature 1..135: note = hyper
  source 1..135: mol_type = genomic DNA
ggcttgcccgatcctcggccatgtcactgctctgcgtgcgcggtgagtgcgcggactgaggcggggaggcggggtgtcggcgtagaggtccccgcacccttccagtggacgtccggtgaccgtctcacccaaact

SEQ ID NO: 32450 - DNA, 374 bp, Homo sapiens
  misc_feature 1..374: note = chr9:35616922-35617296
  misc_feature 1..374: note = hyper
  source 1..374: mol_type = genomic DNA
gaaggaaatatcagacggagagaggggaaggggggcaggtaggtgaattgggaccatccgcaggggggcggtgcacgtcggattcaggcgcaccggatgaaggtgaatgtggcacggcagcccgggcgtcggaaggactgcgcccgggtttatcccggaaggagctgcaccccgcggggcccagcgccatccgcagccgggacaggcgcgagcacttggccccgcggctgccccgcacaggcacactcacaggggagaatccgcccgacagctggtgacgtcacggctctccaggacgcagttggctgctccgacttgaccgctgtcgaggggagcatccagtgtgagaccggaagccccgagtgttgcccctt

SEQ ID NO: 32451 - DNA, 154 bp, Homo sapiens; identical to SEQ ID NO: 9888
  misc_feature 1..154: note = chr9:35675494-35675648
  misc_feature 1..154: note = hyper
  source 1..154: mol_type = genomic DNA

SEQ ID NO: 32452 - DNA, 294 bp, Homo sapiens; identical to SEQ ID NO: 9889
  misc_feature 1..294: note = chr9:35675837-35676131
  misc_feature 1..294: note = hyper
  source 1..294: mol_type = genomic DNA

SEQ ID NO: 32453 - DNA, 65 bp, Homo sapiens; identical to SEQ ID NO: 9890
  misc_feature 1..65: note = chr9:35728859-35728924
  misc_feature 1..65: note = hyper
  source 1..65: mol_type = genomic DNA

SEQ ID NO: 32454 - DNA, 812 bp, Homo sapiens
  misc_feature 1..812: note = chr9:36036783-36037595
  misc_feature 1..812: note = hyper
  source 1..812: mol_type = genomic DNA
caaagagccctggtacggggcacgttcccgcccccgggaggttttggaaacactgtgaggcagggggcggggcttgagcgggccgcagccagtcaccaaagggccgggcgctgggggcggggcctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgagtaacctccagagcaacggttcgaagctgtcgggagcggccgccacagcgctccaagatggcgcggggcagggggcgggggtgcgcgcgacccccagaccctgcccacgtccggcgaccccgggaccccaggtctcagcgctccagaggctggtgccgaggcggggcgagtgaggaactctctccgccccaagatcttctgggcggtgactcgggtttgaggccttggtctgtcacccaccgacacgggccccctcttcggcactgaccccttcgcttgcctctgctgcttgtcagaaaagggtgcgatgcccccgcccaggatcgtcgcgaggtttagatgggatttcggatacgcagccgccctaccgcggccctagttagttattgttacttgttacttgacccgcacttggttcataacgaccttggtggcggtgagcactgacggtccccacagcccgcgtggtgggtcctggactcgggcaggagacatt

SEQ ID NO: 32455 - DNA, 151 bp, Homo sapiens
  misc_feature 1..151: note = chr9:36257863-36258014
  misc_feature 1..151: note = hyper
  source 1..151: mol_type = genomic DNA
tcaaatatacaaggaagcccagactcagaatgtagactcagagcagggaggggaccttttagcccagccttttcacgccaggacagctcgcctgccaggcagttctccaccctctctcgccccgccccgctcctaacgggacagtcagcat

SEQ ID NO: 32456 - DNA, 364 bp, Homo sapiens
  misc_feature 1..364: note = chr9:36258282-36258646
  misc_feature 1..364: note = hyper
  source 1..364: mol_type = genomic DNA
tctcccggagtcccacgccgccgcgcggctctcaccagacgccgtcagaggctccctcccacgccgccaccgcgctcctcgggcgagggacgaaccaagcgccacgaagcaggcagagcgcgagcctgcccctcggtttccgcgctcgggcgcgcgggtagacgactcgtcgctcgaccttgtccccactcctcgctcgcccagccacgcccacccggagtgccgaatccgcgatcgcgccctgacgccacccgagagagctcgcgtgattggctgctcccgtccccgtcccccaccttcccggcggtattttgaggcgcaggcagggtgctgaccagcggaccatcttccatggcctctgccg

SEQ ID NO: 32457 - DNA, 321 bp, Homo sapiens; identical to SEQ ID NO: 9893
  misc_feature 1..321: note = chr9:36258697-36259018
  misc_feature 1..321: note = hyper
  source 1..321: mol_type = genomic DNA

SEQ ID NO: 32458 - DNA, 189 bp, Homo sapiens
  misc_feature 1..189: note = chr9:36739811-36740000
  misc_feature 1..189: note = hyper
  source 1..189: mol_type = genomic DNA
ggagcaggatttattagcagacaggatggggaagttgattagcctccgcggctgaacggacatcctgtcagacaggcctcttaatccaatcacttacctgtggaggggagccggctgcctcctcctggcccccttcctcctcccatggcacctgcggggccacgcggggtgctccggagccagggtaca

SEQ ID NO: 32459 - DNA, 36 bp, Homo sapiens
  misc_feature 1..36: note = chr9:37002482-37002518
  misc_feature 1..36: note = hyper
  source 1..36: mol_type = genomic DNA
cctttcccgtgttcacgaaaaggacagcgtgcgggc

SEQ ID NO: 32460 - DNA, 294 bp, Homo sapiens
  misc_feature 1..294: note = chr9:37002818-37003112
  misc_feature 1..294: note = hyper
  source 1..294: mol_type = genomic DNA
cggcggaccggctgtcaccgcacgtgaggctgggggcggctgggagggagcgagcgcagggtgggcagggggcgctgaggaccctcgctctgcggaggcggccacacctgagccacgagcgcaggcctcgggcgggccgtgtgccccagttctctgcgatggggggagaaagggaagggtgggcactgagaaggactgacccctgcagaaaggaacacggggacacggggacaggaagggctttcgcttaaattccagcctatccatggatgcaggaagcaggggatggagagg

SEQ ID NO: 32461 - DNA, 1046 bp, Homo sapiens; identical to SEQ ID NO: 3408
  misc_feature 1..1046: note = chr9:37025306-37026352
  misc_feature 1..1046: note = hyper
  source 1..1046: mol_type = genomic DNA

SEQ ID NO: 32462 - DNA, 839 bp, Homo sapiens; identical to SEQ ID NO: 3409
  misc_feature 1..839: note = chr9:37026433-37027272
  misc_feature 1..839: note = hyper
  source 1..839: mol_type = genomic DNA

SEQ ID NO: 32463 - DNA, 60 bp, Homo sapiens; identical to SEQ ID NO: 3410
  misc_feature 1..60: note = chr9:37027324-37027384
  misc_feature 1..60: note = hyper
  source 1..60: mol_type = genomic DNA

SEQ ID NO: 32464 - DNA, 642 bp, Homo sapiens
  misc_feature 1..642: note = chr9:37027385-37028027
  misc_feature 1..642: note = hyper
  source 1..642: mol_type = genomic DNA
gggtgtctacctcgtgccaaccaactcttcgagccccgccgccctccctcgtgggtctgattccactgtctttccgctgcctcttccgggacggccgccgtgcctgccccaggcgtggagtgaggaacagaggagagagcagagggtcccagccaccaaggccgccggggctgccggggctgagatggagccgcagtcggctctgactgcctgcgttgccgccgccgccgccgtcgctagccctccgcctgctcggcgcgcacagtgcgccaccgcgccgccccggagccgctttcaggacccgctgcgtgtggacagcgccgcccggggctcagctccctccgggcgggggcggggcgggggctaacctgccaatcacgctccaccaagccaatcagagtggcgtcagccggccctggcccgaaacaccgccccattggctaagcagcccacaggctccgcctgattagcggacacctgggcaatgggagagaatggggggcggggcccaggcggcggcgccacgttcattgacaaacgcgctggactaaggcctagtggatcgcggctgtggggaggggaaaggggcccacgcagtgcctggagagtcccgctgcgggtcccacgcgggctggacctccc

SEQ ID NO: 32465 - DNA, 40 bp, Homo sapiens
  misc_feature 1..40: note = chr9:37028470-37028510
  misc_feature 1..40: note = hyper
  source 1..40: mol_type = genomic DNA
agttagtaactggggcgcaccagggcgcacctgggtggag

SEQ ID NO: 32466 - DNA, 30 bp, Homo sapiens
  misc_feature 1..30: note = chr9:37028944-37028974
  misc_feature 1..30: note = hyper
  source 1..30: mol_type = genomic DNA
accttgaaaaggaagcgtgtgacagtcatt

SEQ ID NO: 32467 - DNA, 216 bp, Homo sapiens
  misc_feature 1..216: note = chr9:37029348-37029564
  misc_feature 1..216: note = hyper
  source 1..216: mol_type = genomic DNA
cagtagacaagtttccggcgctgacacccgtccccaccccccaccagggcacagctgcggaaaacggccccaggcgggactctggggacccaggaggctgcagtgcgcgccggggtggagtggcggcgttatctcttctttgtctggaaccccgcctgtccggatcttcccctttcacccccggccttggagcaggaagatcgcaacagcagagag

SEQ ID NO: 32468 - DNA, 884 bp, Homo sapiens
  misc_feature 1..884: note = chr9:37029893-37030777
  misc_feature 1..884: note = hyper
  source 1..884: mol_type = genomic DNA
gtagaagaaaggctgcgggctggaaacctttctcaaaagcgcctctccagagccgctctcgggatggtgggggaggggcgatgctgccaaatcgaagaactcggctggaatatgcccgcacacgcaggttttccttcggatacccgtgaggcttgcatagaatccccggggcacggcccgagcaggagtagcgccgattctccctttcacacagtaggtgttcggcttcgggacagtgttctgctgcgtggcacacacaggacccgtcttacctgtgcacccagagcagccccttcccgcaactctcggcgttcttgggggaaggagtttccctctggataggggtgattcatcaccgcccgagcgggcggcctctgggaagttccaaccccaaaaggcgcgaccggacctcataccgtgaccacctagcccagccttacaggtcaccaaacgacagcccagagaggttacgtgactagctcgaggctgcacagcaagtccatggtggagccgggctactgcgcctcagtcctgtctctgaacgcccacgagccgcagcctgggtccaggagagcgagactagcagctctcaccgcggctctcaacgcagtcgggcctcactctgatctacagtgatgcgctttctttctcccagtaacagggctttgggccgggccctgtgctaggcgctgggggcaggagaccgcgaaaggaaactatccaggaagaaactcaatttatgtgaaccgaattgcctttgaaagttttagtactgaaagacagcccattgagaataatgtgtgagaagccagagacctcgtttcactggggacacaccccctcccggcttccctttccacgcctcccagcgcactgcattaccg

SEQ ID NO: 32469 - DNA, 750 bp, Homo sapiens
  misc_feature 1..750: note = chr9:37034197-37034947
  misc_feature 1..750: note = hyper
  source 1..750: mol_type = genomic DNA
tgagctgaaactaaacgttttaggtggaaaaaaagcgtccgaaggcaccgtgaaatgattaaggaactaaagagcttctcgccatgtgagatcatgtcctgttctcgccaacatcacaagatgtccccagacacgccgcgcccccagcgcgccgccccacactgccggcccggagcgaggaaagggtaggcgctgcgcggccgggcctgctcagcgcgccagacgtggcggacccggcccggccggagtagagcgggaagccgggagagcagcagtgctgctgccgcgccgccccagacttttataggggttggggggagggaaggaaggcttcagcctgcgccgggcgctagccagcgcacctacgggaaggggcagaccgaagcggagcccgggagcccgggtcttccagccgcaccttctattaagacatgcgcttgggggtcgcggccctctgcgctgtgcgcggggcctgtgacatctccatgtgcaaaccccgctgcttagacgagcgcaggccgggtttttgtttttgaagaaattaactgctcggccaagcaggtgcttttgaaaggggttgcaaaggctggcagtgttgccaggcaccgaggcgacgttccggtttactccgattcacccctagggcggcgcccgaccccagggttcccagccatccaacccccaccccaatttgttggggtcctgactattgctgggcccctgaccctagggcagcgccagatccctaaa

SEQ ID NO: 32470 - DNA, 286 bp, Homo sapiens
  misc_feature 1..286: note = chr9:37035534-37035820
  misc_feature 1..286: note = hyper
  source 1..286: mol_type = genomic DNA
gaagagcctagagctcgaggaaaggggggcccccggcggcaactggacatcacatatccactgagcagatttcgccacaatcggaaatgtggctgtggattcccgggcggcccccccaccaagtggtctgcgcagttccccagcgccgcctcctccctgcagcctgcgggcccgtgtccctaccccgagatttgatttttggccatctccgagtgctcgactctttccctccgcagcccagccccagcccaggcttcccgccctcccgcctcgcccgcgccgggag

SEQ ID NO: 32471 - DNA, 1003 bp, Homo sapiens
  misc_feature 1..1003: note = chr9:37036127-37037130
  misc_feature 1..1003: note = hyper
  source 1..1003: mol_type = genomic DNA
tgtctttttgtgtgtcgtttgtaaggcttttccttctccgcggtgtttagatgtgttttgatttggtgtgagtgggtgtcgtctgtgtgtgtgttgccttagggaatttcgtgttgtgtgtgttttgtttccttcgatttgaattttatttttttgaactgtacgttttggtgggggatcgggttatattttcatgtgttgtctttagtttttgtgtttgtgagatgcgctggtgagagtttgcgtgtgtattttggcttttgtggggctttgggattagggaggggacatcagccgctactccgttcctgcccgcacccatgaagggcagaggattaggccaagcatcacgaatcgtaggttcgccgtgctccgccgcttcgcgctctggacgctcgagaccagcgggaaacaaatgtggttcccgagggggcgcccgctggtcgtcaaaacctcgcgggcccggaggcgccgctgctgggtcagaatcgcagagcccccctcgcggggtaccgaggcccagccgccgtccccttgcccaccctctcccctgtgagtcggtctccccttgcgcctggccagcatgcttcggaccgtccggactcccgcagcgttggcccaaggggcggctcccctcggcggagcaggtgacgaaccacttcggaggacacggaattgacactgcggccctagagatacgggacaaggggccagaacgcggggagtctaggctcagatcggagtcgggatcccgggaaaatcccccatctcccttgcccgcagccctagaatcccagaaacccaactccgcgcagctttcggtttggagagcccgccctggtttgcaagcacagatacatgtgcccacacccgaacacacgcagacaccgccagagagcgagacagcgagcgggcgcctccgtagcagcggcctgcggggcggaaccggagctggcgccgcctcaaggggaaaccgaactgtagtgaccggaaatgtccccag

SEQ ID NO: 32472 - DNA, 835 bp, Homo sapiens
  misc_feature 1..835: note = chr9:37037430-37038265
  misc_feature 1..835: note = hyper
  source 1..835: mol_type = genomic DNA
ggaaaagaaaagagacgcagaaggggttggcctaggcacgctgcgagctgccctccagctaagacgctgcgggcaagggagggggaggccgacatcgccaggcgaggggccaaggtcgggctctttaactcagccaggaaacatcgttgggggctccagggctcgtggagcccgaactggggctcatttccggcccgatgcccctcttccccagacccctagcccggaatccagcaaaggctgggccatcgccgtccgccactgggcctccctctgtgcgagccctgggagaagcctcagggaacgactctggcactggggctcggccccggagctagcgcagagcgtgggtgggagtcgacatccaggcaggaggcaaagaagaggccccgccctaaagccgagggcccagttcttcgaaagcctgtggccggagctggactcacaggattcggggtccgtacagcgcgcacgtggtaccgcatcttcggcaggcggcgcccctaatgcccagccccgccctgcttcgtttgccgggcctgaactgtgtcagcattgagggtggacgccgagtcgcggcgagttggtcccttgcggtataaacttggggcttccctaggggcggtgccgggatggatgggggcgcctctccacctgcaactcccccagcgcagagcgcaaaaagtgcacatcgcgggccagccgtcgcctcggggtttcaggcggcgcccggggcaaaaaggagctgaggattggtttgggtcaaaacacccatttcagttggcagtggggtcctctgcgcctacagggcttcgagctccgggtgcgggctcac

SEQ ID NO: 32473 - DNA, 88 bp, Homo sapiens
  misc_feature 1..88: note = chr9:37576058-37576146
  misc_feature 1..88: note = hyper
  source 1..88: mol_type = genomic DNA
cagacccctgatgcccgaagcccgaccagacgctcagcctcggccaggactgagcggcgcctcctgggtcggtcgcctggggaagcgc

SEQ ID NO: 32474 - DNA, 290 bp, Homo sapiens
  misc_feature 1..290: note = chr9:38424315-38424605
  misc_feature 1..290: note = hyper
  source 1..290: mol_type = genomic DNA
ggcgccggccgcccacgtcgcggatcccaaggctcggggacagcggcggcagcagcggcagcagcagcagaagcagcagcggcaagagcagagacaagcgcggcatggcttgctccgggacagcggcggcgcctctgcttcgcgctccgctccgcgcccgccgagcagtcaccgctcccgccccgcggccgctgattggccgggcctgcaccgcggggcgcccgcagaccgctgctccagcccgggacccgcgcggtgcccgcggcccgggtctccgagctggagggtcg

SEQ ID NO: 32475 - DNA, 124 bp, Homo sapiens
  misc_feature 1..124: note = chr9:38620225-38620349
  misc_feature 1..124: note = hyper
  source 1..124: mol_type = genomic DNA
catggagctcaggagcgcctggcccaggcgtctcccgaagctgaagagcttcctcatggtggcgacttctcagacgcccaccacccgctcctgagccgcggcggctcctcgtggcctttccacc

SEQ ID NO: 32476 - DNA, 257 bp, Homo sapiens
  misc_feature 1..257: note = chr9:38620735-38620992
  misc_feature 1..257: note = hyper
  source 1..257: mol_type = genomic DNA
tcccgcgggacgtcccggaatcccaggagtgcatcccttcccgcctgagggcctgcctggccctgactcccgacccgctcctcctccgaagagagatcggggccgctgacaggggccctccgcagccaccggggatgggactggggggtcggttcctgtcccggtgcagccgccgccgggtagaccgcctggcttggccgcagccagggcgacatgtagccccggttctgccaggctgggagcgccagccatcttgg

SEQ ID NO: 32477 - DNA, 508 bp, Homo sapiens
  misc_feature 1..508: note = chr9:38621429-38621937
  misc_feature 1..508: note = hyper
  source 1..508: mol_type = genomic DNA
cgcccattcctccaccggagggggatcggggtcgctggcatgggcacttggcagtcactccggatggggttgagcaggggttctcagttttcgcccctgtgcagccgccgccgggcagaatgcctggcttggccgcagccactgctacacctagcgggtcgggcgggccggggggtgaaagcgctgggaggcgggtgccttctcgccctgtggcgcctctgggccccacggcttgtcggcctccggcgcgcagggctccccagcatcctgggcgccggcccgctgcctgcacaaagtcaactcagacaggatgaacttcggttgccttgtctggctgggctgccaggcggggcagctgacctgctgatggggtgactttcttcatcttcttgcccacaggacagcgggctgggaagccaggggccgccgggacctggggctggaaaccacatctgcccacagccgcagcctcctgcacctgtcatcctggcggcgccctgacgtcgga

SEQ ID NO: 32478 - DNA, 55 bp, Homo sapiens
  misc_feature 1..55: note = chr9:38622559-38622614
  misc_feature 1..55: note = hyper
  source 1..55: mol_type = genomic DNA
gcccgagagacagcacgtcaccgtcaccgtcaccgcctagcgcccctgacccgct

SEQ ID NO: 32479 - DNA, 72 bp, Homo sapiens
  misc_feature 1..72: note = chr9:66455725-66455797
  misc_feature 1..72: note = hyper
  source 1..72: mol_type = genomic DNA
gaaagttgtagagtgcgcccctcactgtggcaggagcagtggcgctgagcgtgcccacgggccgcggcttgg

SEQ ID NO: 32480 - DNA, 300 bp, Homo sapiens
  misc_feature 1..300: note = chr9:66458276-66458576
  misc_feature 1..300: note = hyper
  source 1..300: mol_type = genomic DNA
ctggctgccccaagagcccggcccagccaagcccgcatgactccaggcgtcatcgccaccccggggccgcgggtctcggatccaggacccccagaggcgctcgcccgtgcccccgggcagctgtctccctctacacccgaggaccgccggcctcccagagagtcccgccgtctccggcggccaggcctggctcaggaccaatgtggcaccgccctgctgttgttggggggcgccgccggaggcctctgtcccctgcgcaggcttccggctctaggggcggcctcctttccgcccacgctc

SEQ ID NO: 32481 - DNA, 180 bp, Homo sapiens
  misc_feature 1..180: note = chr9:66494102-66494282
  misc_feature 1..180: note = hyper
  source 1..180: mol_type = genomic DNA
ggcggagcatggtctgggtggctgctggaatgcttgcgctcgaggcctgagggacccactgttggtgccacctgccctgctctgcgcctctccacgcctgcgccggcgccccctccgcgcctgcgccccctccgcgcctgcaccccctccgcgcctgcgcctctctgcctttgcgaaggg

SEQ ID NO: 32482 - DNA, 297 bp, Homo sapiens
  misc_feature 1..297: note = chr9:71788964-71789261
  misc_feature 1..297: note = hyper
  source 1..297: mol_type = genomic DNA
gcgcgtgacgcggttcgccgcaggagcctcgaaggcgcggcgccggcgagcccttccccggcaggcgcgtgggtggtagcggccaatttgacagtttcccgggccgggcggccagcgcggaggcgccacgctcgggtcgggggcgggctgacgccgccgccgccgcgggaggagggacaaaggggtgggtccccgcgggtcggcaccccggcggttgggctgcgggtcagagcactgtccggtggtgcccaggaggagtaggagcaggagcagaagcagaagcggggtccggagctg

SEQ ID NO: 32483 - DNA, 61 bp, Homo sapiens
  misc_feature 1..61: note = chr9:71789696-71789757
  misc_feature 1..61: note = hyper
  source 1..61: mol_type = genomic DNA
atttcaaaccacactcggtattgatgcaaagttacaggcttgtgtacgtgagagaaactga

SEQ ID NO: 32484 - DNA, 30 bp, Homo sapiens
  misc_feature 1..30: note = chr9:71939754-71939784
  misc_feature 1..30: note = hyper
  source 1..30: mol_type = genomic DNA
tctctagccccagctcggcgggtggggaca

SEQ ID NO: 32485 - DNA, 87 bp, Homo sapiens
  misc_feature 1..87: note = chr9:74061672-74061759
  misc_feature 1..87: note = hyper
  source 1..87: mol_type = genomic DNA
gtctgcggctctccgcgttgtcctcgcggtcggagcagccccgctccatttccgccgcatccctccacttcttccccatgagaagtt

SEQ ID NO: 32486 - DNA, 323 bp, Homo sapiens
  misc_feature 1..323: note = chr9:74061787-74062110
  misc_feature 1..323: note = hyper
  source 1..323: mol_type = genomic DNA
cgccgagcgctctcgctggctcctcgccgcgggtctccctccagcctgcgcgcggctctcggttggcgctgcctttgcctccgccggctcctgccagagccccgcgctccgttaccgccgccgccaccaggctgcgcttgcgcccgcgattggctcaactgtgggctggggctgcgagcgccacctgcgcccgagccagctttcttttgcgtccccaaattgctctccacccggcagccgccgccttctctggagagtgcagggcccacgcctgaggctgttgatgcgccgcagggtagcgctcccagcggtcacctcaccct

SEQ ID NO: 32487 - DNA, 566 bp, Homo sapiens
  misc_feature 1..566: note = chr9:74764297-74764863
  misc_feature 1..566: note = hyper
  source 1..566: mol_type = genomic DNA
gagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaagtaagcaggcgcggggtcgagcgcactccgacgggcgggaggataggtgcaaggaacctggcgcggtgcttcgcgtagcccggggttcgctcggtgcgcagtgagcgccgcggctccggagttgaacttgagtctttggctcttgggcaacgcagagagaaccctggcgctaggttcgtgggctggctggggagttcccagaagtcgggagcagtggcgtgctaacgccacaactggctcgacagcagtccgggctgcggtagag

SEQ ID NO: 32488 - DNA, 577 bp, Homo sapiens
  misc_feature 1..577: note = chr9:77111763-77112340
  misc_feature 1..577: note = hyper
  source 1..577: mol_type = genomic DNA
caaaccacctgcccacggaaacccccgccggagaccgaagtttacccaaatagcgctcggcaaagcgctgccataaattcaaaactaactctgccgggcccgcgggggttgcgagacagggaccgaacgtgaaacccggggagccccgcgtctcttgcctccgaaggttttccgtgatcagtgtccccttctctgctggagtcggaagtgcctgtcacctgcggatctgcccgactctcccggtcggcccttcttctctgcccagttcggacagtctcgaattccccgtcgcagccccggccacctcggactccctggtccccagcccccgccccaccccccgcctccaccacgtcccctccccgcggtcccagcctctccaggcgctgctgggctctgattggcggctgcgctgacagcaggcggggcctggaagtcgcggccaagcccgccctcgcgtataagcccctctcagcgctctctctccatctctcccctctctttctctctcgctgctcccttcctccctgtaactgaacagtgaaaattcacattgtggatccgctaacaggcacag

SEQ ID NO: 32489 - DNA, 167 bp, Homo sapiens
  misc_feature 1..167: note = chr9:77112729-77112896
  misc_feature 1..167: note = hyper
  source 1..167: mol_type = genomic DNA
gtcaccctgcagccacggcgtccgcctaaagggatggttttctcggcagagcagctcttcgccgaccaccttcttcactcgtgctgagcgggatttttgggctctccggggttcgggctgggagcagcttcatgactacgcggagcgggagagcggccacaccatgc

SEQ ID NO: 32490 - DNA, 444 bp, Homo sapiens
  misc_feature 1..444: note = chr9:77112897-77113341
  misc_feature 1..444: note = hyper
  source 1..444: mol_type = genomic DNA
aggtaagcgagtctgcgggcaccgaggctccccgagtccggccaactccagccagacggggagatgggggaggggagggcacccagcagaaagggaaagaggttgcccaggcgcagttccccgaattcgctctcgcaggtggggctgcaaatggcctgggcgtagaaagttgcgggaaggtgttgatgtctttcgggagttctggagggacgcgggagggcgcttttttggagaggggagacaggctagttggttcttaccagtccttgagttgcactgaatcttttttgcttgtcgctctcgggtgcggaagcggacgcgggatggagaaagccgaaagagggatgcctctggacaggagcagtttggaagcgcccggcgcgcagtggtcgccggccgggtttgggcgcgcggggcgcaccggccgggggcagggtggacacg

SEQ ID NO: 32491 - DNA, 151 bp, Homo sapiens
  misc_feature 1..151: note = chr9:77113558-77113709
  misc_feature 1..151: note = hyper
  source 1..151: mol_type = genomic DNA
cggcccagggagtagtgcgaccccggaaaagttgtaatgagaaagttctggaggcttggaaaggccacactgctcacagtcggagagtcatgggctccggctcttttgtcagataaagggccggtagtggaaggaggtgctggtgcaccct

SEQ ID NO: 32492 - DNA, 257 bp, Homo sapiens
  misc_feature 1..257: note = chr9:77113805-77114062
  misc_feature 1..257: note = hyper
  source 1..257: mol_type = genomic DNA
cgttacgcttgctccggctggactctgggcctctcgaagggctggagggtgggtttcggggagtcacttggtctcctctcctgccttgccggagacctcaggtttccttcgcgctgtgctcggcctttcttcactcttttactgaagagccaggcgggtgtccgcttgacatggggatctgtgcaagctctgggcacccacccccactcccagtccctcttcctggccacacagcggttaatcgggggctcttctct

SEQ ID NO: 32493 - DNA, 425 bp, Homo sapiens
  misc_feature 1..425: note = chr9:77114444-77114869
  misc_feature 1..425: note = hyper
  source 1..425: mol_type = genomic DNA
atggtcttgattggccggctcgctgggagtggggcacccgtgtgtgtgcgcgctggctccagctgattgtcccggttgggggttggttacacgctccactgtctaaattctttcaagaaactatacttgggcaattggagagtagagaaccttggcttagtaagagacgcccggtcttttgtttttctttttctagcccatctcaccatcccatccattctttcggtttcccccgtcccagtccagagctgccagttcgtccctccccttcttcccttctaactttccccctgtggctgggttcatactttctgaacgtcgtaaactatgcgccacctcagctcggacccagcactaggacctagggcataaaatccgctcactccttacatcgtagaaggagtgcggcgcggggtggggatggg

SEQ ID NO: 32494 - DNA, 30 bp, Homo sapiens; identical to SEQ ID NO: 3415
  misc_feature 1..30: note = chr9:77115417-77115447
  misc_feature 1..30: note = hyper
  source 1..30: mol_type = genomic DNA

SEQ ID NO: 32495 - DNA, 209 bp, Homo sapiens
  misc_feature 1..209: note = chr9:77502024-77502233
  misc_feature 1..209: note = hyper
  source 1..209: mol_type = genomic DNA
cagaacttcctgttgcgccatatgccagcggtggagaggagccagcggggactcctgaggttgcaagtccgggcggcgccgcgttggggaaggaagcggactgcggcggggcgggtgtttaccgtaaccggcgctgtcatcgctccgggactcctgcacggggaacactgggcgcacggggacgcgcaggggcgcggagggacggccgt

SEQ ID NO: 32496 - DNA, 96 bp, Homo sapiens
  misc_feature 1..96: note = chr9:77502613-77502709
  misc_feature 1..96: note = hyper
  source 1..96: mol_type = genomic DNA
gctattctagatcctcgttagatgtagtgtccctggccccacccacttctatctaaggccgggggcgcagatctagcgaatcgcctaaggtccttg

SEQ ID NO: 32497 - DNA, 20 bp, Homo sapiens
  misc_feature 1..20: note = chr9:78506416-78506436
  misc_feature 1..20: note = hyper
  source 1..20: mol_type = genomic DNA
atgctctgtctcctgcgcgc

SEQ ID NO: 32498 - DNA, 541 bp, Homo sapiens
  misc_feature 1..541: note = chr9:79626876-79627417
  misc_feature 1..541: note = hyper
  source 1..541: mol_type = genomic DNA
catttctagaagtgccgctaccccaggaaactcacatctctccacctccatcgctgtgcggagaaaacccgcaccgaaggcggcttcctctctaaggcggcgaccaggggagacagcgccccctgctgactaaaatcacgcaggcctcgttgccaaagtgcagcgggcgcagcgggcgcagcggtctcccggcttccctcccggcgcccgcagcctgcctaaagcctttctggaaactcgtgttttcagcctcagcctggcagactgcggagggcgggccaggaagagtcaaggagccgggggtctcagactttgctcaccccttggaaatcaccttctcgacccgctagcctaggccgagacacagtctgtattctgaaagccgccagtcccaccaggggaggagaaacccaaaacagaaggagcagggccccacggctgggctcgtgacgaagcatttaatgacctttttaaggaaacgagggaggaggtgaggaggccaacagccgcttaggagagcccgaaacgagcaggctggagg

SEQ ID NO: 32499 - DNA, 35 bp, Homo sapiens; identical to SEQ ID NO: 9925
  misc_feature 1..35: note = chr9:79628238-79628273
  misc_feature 1..35: note = hyper
  source 1..35: mol_type = genomic DNA

SEQ ID NO: 32500 - DNA, 230 bp, Homo sapiens
  misc_feature 1..230: note = chr9:79628711-79628941
  misc_feature 1..230: note = hyper
  source 1..230: mol_type = genomic DNA
gtctttgttattagtcgtcggagggagcgcaagaaagttatttaatttttaatcgttggttatttatttggtggttatggttgtcagtggccgctacctaaacagacacggcccgtaggaaagcttctggatgttggccaagaggtgtgaggcgcgggtggactgtaaaggggaaattgctctgctagggtgacacaaacgcttcccatctccacgctgattgcgcgccc

SEQ ID NO: 32501 - DNA, 199 bp, Homo sapiens; identical to SEQ ID NO: 851
  misc_feature 1..199: note = chr9:79629207-79629406
  misc_feature 1..199: note = hyper
  source 1..199: mol_type = genomic DNA

SEQ ID NO: 32502 - DNA, 541 bp, Homo sapiens
  misc_feature 1..541: note = chr9:79629879-79630420
  misc_feature 1..541: note = hyper
  source 1..541: mol_type = genomic DNA
ggcgcggggactggacgggtcggaaacggggcagggatgcacttcgcagagatgtcaggtcgggttggtgacgctggaggcgacggattcctaaaacgttataaggggttgacgggtggcgctgctgccctgcagcgtccccagctgcgcagctcctgagctccccgctccgagcgcccagacccccagcgccactccaccgtcgagatcacagcttcaaacctcaactccttggagccttcgaaggcgcagttctgactactgagtatttcctggaaagaaaaagaagcccaaagcggtgaaatgatgcctccagggtcatccaggcctggactcgagctggaagccacgtttccgagtcctggggctggctttctcctaccctcttcaaatccactttaggagtttcgtctgggaaaagtatgcgccgagaagtcagccgaaggtcaggcaagtgccaggctagcgtgaccaggaaggctcctgggaggaccccaaacgtaactaacccaggcaaccttccgcacgtcagctaagtcag

SEQ ID NO: 32503 - DNA, 575 bp, Homo sapiens
  misc_feature 1..575: note = chr9:79631016-79631591
  misc_feature 1..575: note = hyper
  source 1..575: mol_type = genomic DNA
gtcggaattaacctccggggaagtaggggaagaggagagcgcgcccccctccccaccgcggccccagctctgcaccccggcccagtgccgcgcttggaatcccccaggatcctccgcggcggccgcagcccgccactctccaaaacagacacgcgacccgagctccctgtctgcgctctaggcagcaattgcggcctgggccgccgcgtccggctgtggcctaggtggtgggaagtactttctaccctcgccaagcacaacctgaatgcggaagcgtgaggctcggggcgcttcgctcagcctccgagactgttttgtcccaggttgcgtggaacctggctcgccgaggccgaagacactggccaagcccctggcgtcccctggcgctgaacctgaggttgtggcggcgggtctgcgggctgtagcgagctcacccagtgagggcctggctcattttttgtgctcagggttcgcgttatgcgcccaagatttgtcccgggagtccctgaagggcccctcccctcgatcggttcccaggagccgcaagtgcccaacgggcacggtcccagagctgc

SEQ ID NO: 32504 - DNA, 317 bp, Homo sapiens
  misc_feature 1..317: note = chr9:79631865-79632182
  misc_feature 1..317: note = hyper
  source 1..317: mol_type = genomic DNA
aattctgtggcttcccgaggccaagaggctgtccgctgctcggctctctcaagtgtctcagcggacaaaaatcgcgcagaaactcctatggcaggaggaaagcttccgacatacagtgaaagagaaaacatcttactttgaaaagggcttaggaccaagaagctgctcttttccccgggccttcttgcaagcttcagtcgtaacatctattctcagacgtcttctggcctaggacaaactggccacatagagctagccagaaatctagctcctgactaaagatggaaattacgggcctgacccgctcacggcactcc

SEQ ID NO: 32505 - DNA, 67 bp, Homo sapiens
  misc_feature 1..67: note = chr9:79632823-79632890
  misc_feature 1..67: note = hyper
  source 1..67: mol_type = genomic DNA
ccccagctcagacatcgccatcccagagaaacctcatcttgtccaactcactcgctccaggaaagtg

SEQ ID NO: 32506 - DNA, 487 bp, Homo sapiens
  misc_feature 1..487: note = chr9:79633250-79633737
  misc_feature 1..487: note = hyper
  source 1..487: mol_type = genomic DNA
gtaaaaggaagggggcggaagagggagatgccagagagaagagaagcaagaaggcagtgtcctgttccccctccaccgtgcttggtggcccgggtggggcgcagctgcgggaaatgcacccggagctgtgccccctcccggcgaacagcctgcgccacccgccgcaccgggaggtggctgggggctgccgagcgagtggtgaacgcgatgggtggagagcgcccgaaacgaggtggaaaagggggcgggggcgaggcacggcgccttcttgccccttcttcagctacagacgcggcggcggcggctgagtccctcagcctcggtcatgtgatagtctcgaagcgctagctgcgggggtctcggcgtctcggggaccattacaaaacgcagccaggagagcgcgtcgctgccactgccgtcgcctctcctcctcaagacaagcccgggagaaaggcggcagctgcggcgcggacggctgagcctcccc

SEQ ID NO: 32507 - DNA, 1290 bp, Homo sapiens
  misc_feature 1..1290: note = chr9:79633738-79635028
  misc_feature 1..1290: note = hyper
  source 1..1290: mol_type = genomic DNA
gccagcactcacccagcattcgcagacgccctctccagcccgccgctcgctcccagagtcctgcgccccacactcctcagcagaacctgcgggcgctgccgcttcagaaaccaccaaagttttttctcctcagcgacagcctagggctgcgcgtctcttctaaccccggcgacgctgcgagcctcggagaaaagagaggcgccctagaagccaatcttctctctccttaccctgatttttcactccaggaaaaggagaactccagcgcggtctggctaagtgcctggccaggggcctgcgtccagggcactggaagtcctgctgtcactggcctccaggacagcaggcgcaaactcagatttaaagggccagagtctctactgcccagaccttcctcccagccatcttggtctgggtttccctcggacctagaaaaagcaaagaggccgggaggaaacacggccccttgccactctcctctgcagccagctccagcactcagtctttggccacccgggggaagacgcagagaaggcggcggtaaacctggtgcactccgcccgcgactgtgcgcgccagtcggcaaccgtcggggccagaagttgccagcttccgagagctgagtaggcccgaaaggccaaggtcggagacaccaggcaattcggagaaggcaggagagagaagcagagagggcctggagggcgagagggcaaagtggcgggactggaggggccgagtgggaattagtgggggcagccaggccccaggaacggagtgcggagagattctgtggtccagtgcgggccggagggcggtggaggagccgggggcgatgccgcggccggggaagagctcgtacagcgaccaaaaaccgccctactcttacatctcgctgaccgccatggcaatccagcactcggccgagaagatgctgccgctgagcgacatctacaagttcatcatggagcgcttcccctactaccgcgagcacacacagcgctggcagaacagcctgcgccacaacctctccttcaacgactgcttcatcaagattccgcggaggcccgaccagcctggcaagggtagcttctgggcgctgcaccccgactgcggggacatgttcgagaacggcagcttcctgcggcgtcgcaagcgcttcaaggtgctgcgcgccgaccatactcacttgcacgcgggaagcaccaagagcgcgccgggcgccggtccgggagggcaccttcacccccatcaccaccaccacccccaccaccaccatcatcaccacgctgc

SEQ ID NO: 32508 - DNA, 361 bp, Homo sapiens
  misc_feature 1..361: note = chr9:79635088-79635449
  misc_feature 1..361: note = hyper
  source 1..361: mol_type = genomic DNA
gccgcacatggtacactatttccatcagcaaccgcctactgctccgcagccgcctccgcacctcccgtcacagcccccgcagcaaccgccccagcagtcgcagcctcagcagccgtctcaccccggcaagatgcaggaggcggcggccgtggcggcggcggcggcggcggccgcggcagccgcggtgggcagcgtgggacgcctgtctcagttcccaccctacgggctgggctcggccgccgccgctgccgccgcggccgcggcgtccacgtcaggcttcaagcacccctttgccattgagaacattattggccgggactacaagggcgtgctgcaggctggagggctgcccttggcgtcc

SEQ ID NO: 32509 - DNA, 220 bp, Homo sapiens
  misc_feature 1..220: note = chr9:79635745-79635965
  misc_feature 1..220: note = hyper
  source 1..220: mol_type = genomic DNA
ggcgccatccaccgtgtgctccgcggccgcggcctcgcccgttgcctctctgctggagcccacagcccctacctcggccgaaagcaagggcggctccttgcactcggtgctagtgcactcctaggggacccggcgggcgtggggagaccagcggggtgagagacgccgggcccggaaccgcccaaaccacccgacggggagagggcgccctggtcaggcc

SEQ ID NO: 32510 - DNA, 295 bp, Homo sapiens; identical to SEQ ID NO: 853
  misc_feature 1..295: note = chr9:79636258-79636553
  misc_feature 1..295: note = hyper
  source 1..295: mol_type = genomic DNA

SEQ ID NO: 32511 - DNA, 524 bp, Homo sapiens
  misc_feature 1..524: note = chr9:79636830-79637354
  misc_feature 1..524: note = hyper
  source 1..524: mol_type = genomic DNA
tgtttccctaacttacgaatgcaggaaaaactcggcacatcactcgacaatattgctcttaacgcttgcagaaacgttccatggctgttcccttccagtctcctcggacggaagcaaggggaccacccagtcacctttgcacgctgcggctgtttttgtattccgtgtgctgtttgagcgcttatgtctttcaggcgaattaattcttcagtttcaattcgtgaatgggaaagaaacttgccttgtcgctcttgcccttcccccctcttgagccccagggaatagcactttactcgcgacacaattttgggaatggaggggggcagagtggggagaaatccgctttgccctttggctctaagtcacctccgcctcttgtccgcgccgcgttcgggttgtgactttgtttatgtctgctggtgttgtacgcggtgttctctattaaagcttctctctggatatctatgctagccccgtgtgaaggtgtttcagttctccaaggatgaggccgtggtttgagtgcc

SEQ ID NO: 32512 - DNA, 239 bp, Homo sapiens
  misc_feature 1..239: note = chr9:79637650-79637889
  misc_feature 1..239: note = hyper
  source 1..239: mol_type = genomic DNA
caccacctatttttaatatgtccgtttcctaattgaacttaagtccaccaccatggtagagactgaattagcaaaaacccgcaacagtgcgtttttcctgtcaccactatccgtcacctctctcccattttgaggtcctcgactaccatctaaggccaggaactcggtgtcagcggggtgggtgcccgacggcgcccccttaagtctgcggtcctggacggaggcagccgggttggcgc

SEQ ID NO: 32513 - DNA, 88 bp, Homo sapiens
  misc_feature 1..88: note = chr9:79638136-79638224
  misc_feature 1..88: note = hyper
  source 1..88: mol_type = genomic DNA
gctggggcctgggaagccgcgtcccggcctccgccctccaccctttagcacaggtctactttgaaccagcttccgtgtgcccagccag

SEQ ID NO: 32514 - DNA, 151 bp, Homo sapiens
  misc_feature 1..151: note = chr9:80263366-80263517
  misc_feature 1..151: note = hyper
  source 1..151: mol_type = genomic DNA
gggacgagcagggggcgcggagctgggggtgggagctggcacctctaggagcagctcccacacttgcctccctggctggggcgtcccggccaaggtttgctgtaatctgcgcgtctggccgccaggcaccgggttccgacaggtgagtgag

SEQ ID NO: 32515 - DNA, 41 bp, Homo sapiens
  misc_feature 1..41: note = chr9:80646329-80646370
  misc_feature 1..41: note = hyper
  source 1..41: mol_type = genomic DNA
caggtgggccgggggcgcggtgggagcggatagtctgggcc

SEQ ID NO: 32516 - DNA, 30 bp, Homo sapiens
  misc_feature 1..30: note = chr9:82185353-82185383
  misc_feature 1..30: note = hyper
  source 1..30: mol_type = genomic DNA
ggaaaggcgcactgacggaggccgccccca

SEQ ID NO: 32517 - DNA, 40 bp, Homo sapiens
  misc_feature 1..40: note = chr9:82185643-82185683
  misc_feature 1..40: note = hyper
  source 1..40: mol_type = genomic DNA
tgctctgttcagtaccgaccgtgttcggggttcacgtggc

SEQ ID NO: 32518 - DNA, 378 bp, Homo sapiens
  misc_feature 1..378: note = chr9:86152387-86152765
  misc_feature 1..378: note = hyper
  source 1..378: mol_type = genomic DNA
atccctcaaggctggcgcccagggcagcccggcctctctcactctggggaaacttcgccaccgccccacgcggagaactaaagaccaccggcggagggtgagggggaccgacacggagcggaaagcaggttccgggactgagggcgtctccggagcctgggcgcgggagacagaaatgagtgaacccagctgatgcatgccttctccacgtggaagaagggaggaaataccagtgggcgacatgcaggtgcccctctcagccctcggagctcccatctcctggcggagtagggcccagaggggccagagtccctccggaggcagctgccccgcgcccctagcccgggcgcagtgagacgcgcgcgcagggtgcacgcg

SEQ ID NO: 32519 - DNA, 35 bp, Homo sapiens
  misc_feature 1..35: note = chr9:86153332-86153367
  misc_feature 1..35: note = hyper
  source 1..35: mol_type = genomic DNA
ctgttcgctcgcctccgcctcgccccctcctttcc

SEQ ID NO: 32520 - DNA, 581 bp, Homo sapiens
  misc_feature 1..581: note = chr9:86755532-86756113
  misc_feature 1..581: note = hyper
  source 1..581: mol_type = genomic DNA
gctccccaggcaaagcggccccgccaggacgggcacggcttcgcgtcctcgctcaagtccccgatgatggccgcgtcccggcaggcacggtgcgaattgactggggtttgggggaaacgaaagccccgaaggggccttctctgccaaatgtcttcttccgtcggctcgatggcagcccccaagcctttcattttcaatgtatgaaaacactggggtggatttagcttttcctttgggaaacaaacaaacaaaaaagaacacaaagagcgtgtgtgcgggtcttctttcaaaatagtggggcatttgaaacccgcgctgcagctgcgggcgctgcttcaatcgcaagcgttttgttttctgaaagcgctttaaaagatgctgaagaggaagagagcgagcgccctgcgcattttcggaaacggaagattttgaaaacctgtatttatccgcccttcgcaaaaaatcagcttctctagggcgagcctttccaaccttttccgtcagggcacacagaaaatgacctgatttcaagagcatttggggtaaaactggaggggatttcagagcgtctctgtgaggtt

SEQ ID NO: 32521 - DNA, 30 bp, Homo sapiens
  misc_feature 1..30: note = chr9:86886706-86886736
  misc_feature 1..30: note = hyper
  source 1..30: mol_type = genomic DNA
agcgggggagaccctcgctttctggataaa

SEQ ID NO: 32522 - DNA, 658 bp, Homo sapiens
  misc_feature 1..658: note = chr9:87283008-87283666
  misc_feature 1..658: note = hyper
  source 1..658: mol_type = genomic DNA
gttttacgttcccttcgtaatatttaacgcttggcctagatccgagcattcactctaacgttcggtttcttgatccttcccatccccaaactctgcgggtagatcagtgactattactatattttgaacgagactccaacccattgctctctcgagagagaaggattgcccgcctttttcccccgggcaggagctcggcgaggccaggagagccgcgcaccggccgggcagggacgcgcaggcgtcgggcgccgctggttgcgcatctggcgccagagcgcgcccccagcgctgtgcccgccgcgacccgggccatgggctggtgctccggagcgtgccgggcgctctctccccgcgcgggggcaccagagccctcggaagtgtcaggcactgcggtgtattttccccgttctcttttaaatgactgcggaaaaacagattccgagccgcaaaagggaagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgtt

SEQ ID NO: 32523 - DNA, 30 bp, Homo sapiens; identical to SEQ ID NO: 9945
  misc_feature 1..30: note = chr9:87284009-87284039
  misc_feature 1..30: note = hyper
  source 1..30: mol_type = genomic DNA

SEQ ID NO: 32524 - DNA, 439 bp, Homo sapiens; identical to SEQ ID NO: 9946
  misc_feature 1..439: note = chr9:87284555-87284994
  misc_feature 1..439: note = hyper
  source 1..439: mol_type = genomic DNA

SEQ ID NO: 32525 - DNA, 254 bp, Homo sapiens; identical to SEQ ID NO: 9947
  misc_feature 1..254: note = chr9:87285279-87285533
  misc_feature 1..254: note = hyper
  source 1..254: mol_type = genomic DNA

SEQ ID NO: 32526 - DNA, 85 bp, Homo sapiens
  misc_feature 1..85: note = chr9:87285748-87285833
  misc_feature 1..85: note = hyper
  source 1..85: mol_type = genomic DNA
ctttcgcctgtcccacgtcctgcaaatgcagtgcctctcggatctggtgcagcgacccttctcctggcatcgtggcatttccgag

SEQ ID NO: 32527 - DNA, 82 bp, Homo sapiens
  misc_feature 1..82: note = chr9:88137644-88137726
  misc_feature 1..82: note = hyper
  source 1..82: mol_type = genomic DNA
tgggttgcggcttcccgcgggtaaaccctgtcggtacccgatccccgtccgcggaaggccaggagaacgcggttccccttct

SEQ ID NO: 32528 - DNA, 240 bp, Homo sapiens; identical to SEQ ID NO: 3427
  misc_feature 1..240: note = chr9:88137874-88138114
  misc_feature 1..240: note = hyper
  source 1..240: mol_type = genomic DNA

SEQ ID NO: 32529 - DNA, 411 bp, Homo sapiens
  misc_feature 1..411: note = chr9:89560694-89561105
  misc_feature 1..411: note = hyper
  source 1..411: mol_type = genomic DNA
cgagtggggtccaggcgccccggggcgccaagcggccgccgccgccgctgctcctgcgcccaggcccatagggcaggtccccgcggccgcccgatgcagcagcgccgctgcccgggcgcggtgggtgcgggacgccgtcgtcgtcgtccagcggctgctcaccacccgcgcccccggtgcgctgctcgtcatcgtagtcctcatcgtagtagtcgtccaggcccccgtccgagccgctgctgccggggccgttgcccagctcggcgccgaagcacaggcgggccatgttctccttgaccgactcgcagatgggccgctcgaggccgtcgcacacgcagtcgttgagcagcgccgccttgggcatagccagcatgtcctcaatgacggtgcggcattcgtccgtgcagcgca

SEQ ID NO: 32530 - DNA, 65 bp, Homo sapiens
  misc_feature 1..65: note = chr9:89763321-89763386
  misc_feature 1..65: note = hyper
  source 1..65: mol_type = genomic DNA
tgctactttccatcccgttaatacaatcccggccctgtttcccggccccgcggccattgcagagt

SEQ ID NO: 32531 - DNA, 53 bp, Homo sapiens
  misc_feature 1..53: note = chr9:90112803-90112856
  misc_feature 1..53: note = hyper
  source 1..53: mol_type = genomic DNA
gccggaccgagccaacgccggggactttgttccctccgcggaggggactcggc

SEQ ID NO: 32532 - skipped

SEQ ID NO: 32533 - DNA, 93 bp, Homo sapiens
  misc_feature 1..93: note = chr9:90589194-90589287
  misc_feature 1..93: note = hyper
  source 1..93: mol_type = genomic DNA
atgtaaaaagggaaccgaaacagtttagagcgttagccggagggtggcgggggcacacccccgccaggctgccggccgcggtccagcctcacc

SEQ ID NO: 32534 - DNA, 108 bp, Homo sapiens
  misc_feature 1..108: note = chr9:91149171-91149279
  misc_feature 1..108: note = hyper
  source 1..108: mol_type = genomic DNA
ggaggaggaagagcacggtgtgggggaagcgcaggaggcaataggtggggcgggacggagggcagggcgctgcgtcgggagaaagtgtagaagcgctggggagagtgc

SEQ ID NO: 32535 - DNA, 190 bp, Homo sapiens
  misc_feature 1..190: note = chr9:91150170-91150360
  misc_feature 1..190: note = hyper
  source 1..190: mol_type = genomic DNA
tgctccagccacaggcgaggcctggccaaggtgtgggcgcatctggggcaggtcttgagaggtccagcgcccggtggtgcggacagaggcggggcaccgcggcgctcgccgccgcctccccgcaggtgatcatcctcctgcaggtgtcctcgggtctcaggtggctgcgtgtctgcgccatggttgacat

SEQ ID NO: 32536 - DNA, 40 bp, Homo sapiens
  misc_feature 1..40: note = chr9:91150621-91150661
  misc_feature 1..40: note = hyper
  source 1..40: mol_type = genomic DNA
ggcgctgcccttccacgacccctaccggcagtgagtgggg

SEQ ID NO: 32537 - DNA, 398 bp, Homo sapiens
  misc_feature 1..398: note = chr9:91605965-91606363
  misc_feature 1..398: note = hyper
  source 1..398: mol_type = genomic DNA
gcccaaacaaaccctcgctgtcagggcgacaggcgcccgcccaagcccagacctcggacctggttccaagcctgttcccgctgggtctctgggcgcccggtttctgcacctggagctcgcccgatgaggacaaggtctggaggccggcctgggaacaggggccgaagggcgagccggaccctaggggattggtagggtcggggagaaggggtccaggctaggggcgggcggggcgcacggagaccaggcggcttgagcgggaggtggggagctggaggagtgccgggttcgcgggcgggggacggggagaggggggcggggagaggggcgggagtcgggggcggcgaggggaggggcggagcgcgggtcccgccccggcgggccgctggaaaagttta

SEQ ID NO: 32538 - DNA, 30 bp, Homo sapiens
  misc_feature 1..30: note = chr9:91606806-91606836
  misc_feature 1..30: note = hyper
  source 1..30: mol_type = genomic DNA
ccggagcgtttacaacgggctggagctgaa

SEQ ID NO: 32539 - DNA, 91 bp, Homo sapiens
  misc_feature 1..91: note = chr9:91792357-91792448
  misc_feature 1..91: note = hyper
  source 1..91: mol_type = genomic DNA
tgagaaagtaaagcccgtcgaagagaaagcagcacagcatttggcctgctctgcaaggagctgggaattcttgctgcggggggcaacaaga

SEQ ID NO: 32540 - DNA, 310 bp, Homo sapiens
  misc_feature 1..310: note = chr9:91792776-91793086
  misc_feature 1..310: note = hyper
  source 1..310: mol_type = genomic DNA
tttgcttgcctctaacgtgacagtcgcgggagcgccccgcaccccgggcttcagggaatgaaggagtctgccccgaactggccccagaacccccagcccccagggcggcccgcgcccgcacccaccttgaccacgtaggtgactccgggccccagcacctggtcgctggcgtgcggcgccccccgagggggcctgggcagcggctcgtcgccgggccggcccttcctggcggcgctcatggccggggcgcggggcgccgagggcgcactgccgtccggggcggccaggctgggcgcgctgcagctgcccg

SEQ ID NO: 32541 - DNA, 144 bp, Homo sapiens
  misc_feature 1..144: note = chr9:91793455-91793599
  misc_feature 1..144: note = hyper
  source 1..144: mol_type = genomic DNA
ccactgtccccggagcgggacggagagtgggggccccgggacagccttctggagaacgagagcagagcaagaggatggtgccctcccaccgttaaaagccagcacagcggcggccgcgcagccccggcccgggagaccgctgct

SEQ ID NO: 32542 - DNA, 193 bp, Homo sapiens
  misc_feature 1..193: note = chr9:91849616-91849809
  misc_feature 1..193: note = hyper
  source 1..193: mol_type = genomic DNA
caagggtaaaccctgcgggctgaggaggcagcggcggaggctgggcgcacgtgggtgctgcagtagccggcggacgcccagggcgcacgggggcgcaccgagagacctcaccgaacccaaagagcgtgcggttcgtctcgcccaaaaccacagcgctggctacagaaacccctgaaatcggaaatactctaac

SEQ ID NO: 32543 - DNA, 206 bp, Homo sapiens
  misc_feature 1..206: note = chr9:93405037-93405243
  misc_feature 1..206: note = hyper
  source 1..206: mol_type = genomic DNA
ggaagaacacaactccgctcagagcttcttcagagctccactcgcgcaggacagggcagcgcagggtgtgtggatgcggctcctcccggaggcaggcgcagcgcactccctcccgccgccgtgacgatgctgtcagctgctcgcccgccgtgcgccctgcaccgcccaccggccgtgctccctgcgcccagcgccctcgcgctcca

SEQ ID NO: 32544 - DNA, 84 bp, Homo sapiens
  misc_feature 1..84: note = chr9:93956485-93956569
  misc_feature 1..84: note = hyper
  source 1..84: mol_type = genomic DNA
acaaagtctgttcttcgaaggaaagagttggaatcaaggacttcggacgggaggaagttggtaagttaccgcttcctccctcct

SEQ ID NO: 32545 - DNA, 123 bp, Homo sapiens
  misc_feature 1..123: note = chr9:94183821-94183944
  misc_feature 1..123: note = hyper
  source 1..123: mol_type = genomic DNA
cgccactaccagacccgcccccagccccggattctcgcagaccccaccggcccgcaggagggagcggcgcactgggggccgcacggactcgccattggagatcgcgatcggaaggtggcgcca

SEQ ID NO: 32546 - DNA, 539 bp, Homo sapiens
  misc_feature 1..539: note = chr9:94711379-94711918
  misc_feature 1..539: note = hyper
  source 1..539: mol_type = genomic DNA
gcctcctacaggtcccgggggtccccccggcgcggccagaaggcggccgcgccccagccgctcagggacccgcgatcccagtcacaaaccatttcaatccagatcacacaccacttcggccaccccagagcggtgggggagaggaggtttcagggaccaacaaaagggatgccaaagagcccgtttccatcaagcggcccgcgggctgggaaagtcaggacccgggagccgccggcgcccccacccccgccgcaagagccgcttctccggggccacgtccaccccaggattctgccaggcatcaggccgccctgggggtggggggacgctccgagacagacgggggacactcggggccgtgtgcccttgaaggaggaagacctcggggaggaagcccgggtcctgggaccctcggggcacatctgcggactcgggtcccgggcccagggcgggtactcacattcacactcgcactcccactcgcgaccctcgggaagcgccaccgagaggctcccagccgccgccgcccgcccccagac

SEQ ID NO: 32547 - DNA, 794 bp, Homo sapiens
  misc_feature 1..794: note = chr9:94712294-94713088
  misc_feature 1..794: note = hyper
  source 1..794: mol_type = genomic DNA
cggggtcgggcgccaccacccctttctacgatgcgtccgctcctccttctccctggcgcttcgcaaacgggtccacttcgaggacctcgtcgtcgtcctcttctccggcccggatgcgccgctcggctccggccacggcaagggctggctggggaggttccttggcgcgggctggggcgtcccgccggccgccaggacgagcgcggggggcggaccgcgggcgagcgcgcaggaggcagggtccccgctcgcccgccccgatgggcagagcgaggcttgcgccggcgccccctgccgggggaacgcgcgggcggcgggcgggacccaaggagctggggctgcagctggggccccggacctgcctcctgcgcccgccctcgggcctgcgcctcggaacgcttgaacacaaaggtggcgccttgggggcgtcagccggagttcggcgggtctgcccacgcaggagaggcgcccagagcgggtgcccccgactttcgggggcgacacacccggggatctaggtcacaaatcagtaactccaggctgcactgcgcaccgggacaaatctgagagccacccagccccagacaccagcggtgaggcaggaagaggagaagcgaaagttgcaaaaggaaatgttcaggaaaacaaacaggccgccttggcaccggcgccctcccaggtcggtggggacaagcgcgtcccccgaaatgctcaaaactgccaggggtcgagctgcgtggagggagccctcgggagcgcgatgctatccgaagccaccgcggcttttggtttac

SEQ ID NO: 32548 - DNA, 999 bp, Homo sapiens
  misc_feature 1..999: note = chr9:95569759-95570758
  misc_feature 1..999: note = hyper
  source 1..999: mol_type = genomic DNA
ggaacaagctgccagcgggcctggggagaaccgcccgtccgatgagctcggctgagcgtgcacgcagtgccgaaatcaaggacgcctggatgcttttcgttgcagagtgacaaaggttcaacaacaggaagaggatcaggggccaagacaagaagctgaagttcggcctgccaggaaccccgggccccagcatcccacccaaggcgctgctgcaggagttccagctgctgctgaaaggtgcggtgccgcagggccagagtgcgggatcctgagccctgcatgccagtccttgcgggggccgatcgctgtgagccttactcaggtccagccgcctccagggaggacaatgtagacgaggtgcggggcgtgagggcggtgctggccgcacccctggtcctgaggccacgggagccgcgcgaggaggccgccttccactgacgcctgcaccgggaccggttgctgcagcggtgccagctgcaggagctccgcgtctgctgcttctccgacgccagggcgccgccaggatgacaggtgcaggagactgtggctgtgggcagatgtggtttccagccccaggtccccgcggcccctggcttcccagcgcgctgtcctgtgagcaagaagatgaaaaaagccacccgatcaacaggtcagctgccccgcctggcagcccagccagacaaggcaaccgaagttcatcctctctgagttgacttcgtgcgggcagcgggccggcgcccaggatgctggggagccctgcgcgccggaggccgacaagccgtggggctcagaggcgcctcagggcgagaaggcacccgtctcccagcgctttcaccccctggcctgcccggcccgcgtggtgtcccagtggctgcggccacgccaggcattctgccccgcggcggctgcacagggacgagaactgagaacccctgctcaaccccatccggggtgactgccaaatgcctatgccagcggccccgatctccctccggtgga

SEQ ID NO: 32549 - DNA, 39 bp, Homo sapiens
  misc_feature 1..39: note = chr9:95570878-95570917
  misc_feature 1..39: note = hyper
  source 1..39: mol_type = genomic DNA
agacagcagcctccaggcaatccccgagcccgcccgcac

SEQ ID NO: 32550 - DNA, 144 bp, Homo sapiens
  misc_feature 1..144: note = chr9:95571523-95571667
  misc_feature 1..144: note = hyper
  source 1..144: mol_type = genomic DNA
gccccctgcaggccacgcgggctcgggagcggtttccggagtccgagctggcgctgagctgcaggcgcgagcctaaaggcttagccggggcccacgctgtctgagagatcggagcgttcagctacaggcacgcgcttaacggct

SEQ ID NO: 32551 - DNA, 204 bp, Homo sapiens
  misc_feature 1..204: note = chr9:95571727-95571931
  misc_feature 1..204: note = hyper
  source 1..204: mol_type = genomic DNA
gtggaccaggctggatcgcggattctgagctacatcgcgggtttggtggtggatcttggatttgggggtggatcgcgggtttgggggtggatcttggatttgggggtggatcgcgggttgtgggggggatggcggatttggggctgggtgggggtggaaaggccacgaggagccgcggcggctcaggagcgggtggtgggcgtc

SEQ ID NO: 32552 - DNA, 127 bp, Homo sapiens
  misc_feature 1..127: note = chr9:95572141-95572268
  misc_feature 1..127: note = hyper
  source 1..127: mol_type = genomic DNA
agaaaagacaggtatcgggggctcagcctgcggtgggagggggccccaggcccggcttccctgcagcccctggggcgggggccttggagggccccgggcaccctcggagccgcggagccaaatggag

SEQ ID NO: 32553 - DNA, 132 bp, Homo sapiens
  misc_feature 1..132: note = chr9:95821259-95821391
  misc_feature 1..132: note = hyper
  source 1..132: mol_type = genomic DNA
cgccggcccagcaggcgccctagcggagccgaagcctggcagcgagcagttcgaaaccaggcggctgcacgcagcagcccgcgcgcccgttcccgagtggccgcagcgccttggtcccgggcgtctgcggac

SEQ ID NO: 32554 - DNA, 253 bp, Homo sapiens
  misc_feature 1..253: note = chr9:95946216-95946469
  misc_feature 1..253: note = hyper
  source 1..253: mol_type = genomic DNA
cagctgacagccctgcggggcgttccaaagaacttcagaggacaggagcgctacctcgagcaaagaaccgcgggtgggagcccaggtagccggcccgcaggtggccgcgcgcgcctgccagtcagccagcccgtccgcagccaggtgggcgtgccaggcccagccccctgcgccggtccggggcggggcgaacggagccccgccctccccgcgcgccgggtcggagccggtgcgggagcggagccgcgcgaag

SEQ ID NO: 32555 - DNA, 113 bp, Homo sapiens
  misc_feature 1..113: note = chr9:96588627-96588740
  misc_feature 1..113: note = hyper
  source 1..113: mol_type = genomic DNA
gagaacacaatgcaccgcgcacaggctgtgccaaagtccacaggcacccttcggcctccatcatcgcgccctcttcacagatgagcaaacggaggccagacgtcaccggcagg

SEQ ID NO: 32556 - DNA, 115 bp, Homo sapiens
  misc_feature 1..115: note = chr9:96588857-96588972
  misc_feature 1..115: note = hyper
  source 1..115: mol_type = genomic DNA
cggggcgggttgccgcccctcccgggagtacgggcggaggcaggggcgggcgggggctttcagcagctcgtccgcggaacatttgcatgtaatttgggagcgggtcacatgtggg

SEQ ID NO: 32557 - DNA, 259 bp, Homo sapiens
  misc_feature 1..259: note = chr9:96708199-96708458
  misc_feature 1..259: note = hyper
  source 1..259: mol_type = genomic DNA
cggcgccgcctgccatgcgcagcacgagcctcgctaatgcgtttcgcatggcgcgtcagtcaaacgcccttctaatgtccttaaagcacgcagaaaattgcatccttatgaaaaaggagaaaaaaagcaaattgcctggtggaagcggagctgccgcgggggctggggcggcagcgcgtgcgggcggagttgcgttcggcagggcggacttggggcggctgtcaggggctctcccgggccaaggcgcaagagcaagacg

SEQ ID NO: 32558 - DNA, 30 bp, Homo sapiens
  misc_feature 1..30: note = chr9:96710135-96710165
  misc_feature 1..30: note = hyper
  source 1..30: mol_type = genomic DNA
ccccgcccagcggagcgaggagtcccagct

SEQ ID NO: 32559 - DNA, 783 bp, Homo sapiens
  misc_feature 1..783: note = chr9:96710664-96711447
  misc_feature 1..783: note = hyper
  source 1..783: mol_type = genomic DNA
acttgggctgggacccgcgcttcttcttttttttttttctttcttagtccccacaagtgaccctctaggggaatccagaacagggaagggagcaagccagaggaactttttttttttttaggtgaaaagccagggggagggatggggcgcccccgctcgcgactacgcctgcgactgtcctcgcgctgcgggggctgtgcgtggagcccgcggtaagctggaatatccaagccagctgcaagtggccttccgttccccacacgcctcctgcgtgctgggcccagctgggcgccgcccaaatcttctctctcccgagactctccagctccccttctactgaccaggagaacgtcttgctccggccaggatcacaccagtggagaagcgaccccctcccccatcccgggccggggcccttctgacaagcctccccaaggactccctcattccccaggccaccttgaacaaagcacactgagcgcaaacttcgcgcctctgggggaacgctgcggccaggctaatcccagccctctctcctcccccagcccttcgcgtccccagggtccaggcggtcgcaggcgctccccactcccgcagggccacagctctcgcgagactcctgagccctctccctcccctggctgcggcccccgggctccgggaagctcagccacctgggcccacgccatatctgggtttttttcccaggactttggggatgagaagagacttgtgcatagagcggaagaggaatgggatccaagggacctttccttcaagtcc

SEQ ID NO: 32560 - DNA, 83 bp, Homo sapiens; identical to SEQ ID NO: 3431
  misc_feature 1..83: note = chr9:96711534-96711617
  misc_feature 1..83: note = hyper
  source 1..83: mol_type = genomic DNA

SEQ ID NO: 32561 - DNA, 278 bp, Homo sapiens
  misc_feature 1..278: note = chr9:96713615-96713893
  misc_feature 1..278: note = hyper
  source 1..278: mol_type = genomic DNA
gcggtgcggccagaccgctcctgccagcgactctctggctggcaagggagaggaggtggagttcagactggcccctcacgcccagagtggaagcgattcctaggatcctgcagccaccgagccgcccgccgtgcctagcccgggcttgatggtgaagagcacagctgccttcgacagagccggaggaaaggaagtttaagaagcaactgcccgcgttccgcttatcttgccgagcccacccccacccccaccctcaccccctgcggattcagaagctg

SEQ ID NO: 32562 - DNA, 14 bp, Homo sapiens
  misc_feature 1..14: note = chr9:96715687-96715701
  misc_feature 1..14: note = hyper
  source 1..14: mol_type = genomic DNA
gtgttctgtcctgg

SEQ ID NO: 32563 - DNA, 524 bp, Homo sapiens; identical to SEQ ID NO: 3432
  misc_feature 1..524: note = chr9:96716904-96717428
  misc_feature 1..524: note = hyper
  source 1..524: mol_type = genomic DNA

SEQ ID NO: 32564 - DNA, 130 bp, Homo sapiens
  misc_feature 1..130: note = chr9:96717449-96717579
  misc_feature 1..130: note = hyper
  source 1..130: mol_type = genomic DNA
cgcggtttggcggcggcggcggcgacggcttggctccggcgcggggcccgcgcggggctctaggccggcccgcagctcggggcggcgcgcgggcgccggctcatgccccctcccccgccggccggccggg

SEQ ID NO: 32565 - DNA, 342 bp, Homo sapiens
  misc_feature 1..342: note = chr9:96717857-96718199
  misc_feature 1..342: note = hyper
  source 1..342: mol_type = genomic DNA
gagagccggagagttcgggaggcaagacccccagagacgagagtcggagggatcaaacgacacaggtgagagaaggggcagaggcagacggcgtgggccaaacaagattccagacagtgatgtgagggcaccagagacgccaccgagatgtgcgcagagagaccaaaagaggcgtgagagccagcgggctgtgacgtgacggagggcacagaggcaggcggggcagaggaagggggcggtaaagaaatgggaacagctagaaaaccggcggcttgatcggcttttaggtagccccggaaaggtcgggaggaggaggggcaaaggccgcgctcctcagctggg

SEQ ID NO: 32566 - DNA, 45 bp, Homo sapiens
  misc_feature 1..45: note = chr9:96720841-96720886
  misc_feature 1..45: note = hyper
  source 1..45: mol_type = genomic DNA
ggacacaccccctcccgaggcctctagccgccgccgcgaaaatcc

SEQ ID NO: 32567 - DNA, 366 bp, Homo sapiens; identical to SEQ ID NO: 857
  misc_feature 1..366: note = chr9:96721102-96721468
  misc_feature 1..366: note = hyper
  source 1..366: mol_type = genomic DNA

SEQ ID NO: 32568 - DNA, 114 bp, Homo sapiens; identical to SEQ ID NO: 858
  misc_feature 1..114: note = chr9:96721688-96721802
  misc_feature 1..114: note = hyper
  source 1..114: mol_type = genomic DNA

SEQ ID NO: 32569 - DNA, 30 bp, Homo sapiens
  misc_feature 1..30: note = chr9:96722011-96722041
  misc_feature 1..30: note = hyper
  source 1..30: mol_type = genomic DNA
tggagaccaccaactcgctttctctttgga

SEQ ID NO: 32570 - DNA, 29 bp, Homo sapiens
  misc_feature 1..29: note = chr9:96723131-96723160
  misc_feature 1..29: note = hyper
  source 1..29: mol_type = genomic DNA
agagagcggccggctcgtgcgggccagaa

SEQ ID NO: 32571 - DNA, 32 bp, Homo sapiens
  misc_feature 1..32: note = chr9:96723170-96723202
  misc_feature 1..32: note = hyper
  source 1..32: mol_type = genomic DNA
cgcccgcggaaacgactcggcttttctttctt

SEQ ID NO: 32572 - DNA, 57 bp, Homo sapiens
  misc_feature 1..57: note = chr9:97402023-97402080
  misc_feature 1..57: note = hyper
  source 1..57: mol_type = genomic DNA
tccgtgccctccacccgcactgtggagcgggactcgggccatcggactctgccagag

SEQ ID NO: 32573 - DNA, 212 bp, Homo sapiens; identical to SEQ ID NO: 859
  misc_feature 1..212: note = chr9:98111349-98111561
  misc_feature 1..212: note = hyper
  source 1..212: mol_type = genomic DNA

SEQ ID NO: 32574 - DNA, 264 bp, Homo sapiens; identical to SEQ ID NO: 860
  misc_feature 1..264: note = chr9:98111894-98112158
  misc_feature 1..264: note = hyper
  source 1..264: mol_type = genomic DNA

SEQ ID NO: 32575 - DNA, 52 bp, Homo sapiens; identical to SEQ ID NO: 861
  misc_feature 1..52: note = chr9:98112343-98112395
  misc_feature 1..52: note = hyper
  source 1..52: mol_type = genomic DNA

SEQ ID NO: 32576 - DNA, 355 bp, Homo sapiens
  misc_feature 1..355: note = chr9:98277959-98278314
  misc_feature 1..355: note = hyper
  source 1..355: mol_type = genomic DNA
aagcactgggctggtcgcccatctctgtaagggtggcagccacccaagcgcctgaatcggtgggcataagagtcacacacaccacctctcttacccaccgccccttccagaactccaaaagcctctctggcccttttcccgcagcatgggaggggaggtgggtaaggtgcgtctcttctagcccgggtgtcccgcacccctaggcgtgcgtgcgggctcgagagcgggtctgcggggcgcgagcgtgcccttccctgcggctgcggctgctcccgcgagctggcggcagcggcttccgcgcgcgcgctctgagccccctcccctcggcgctgtcactctccgcaccagcccttcc

SEQ ID NO: 32577 - DNA, 30 bp, Homo sapiens
  misc_feature 1..30: note = chr9:98315763-98315793
  misc_feature 1..30: note = hyper
  source 1..30: mol_type = genomic DNA
tgcagactccggggccgccccagccgccgc

SEQ ID NO: 32578 - DNA, 315 bp, Homo sapiens
  misc_feature 1..315: note = chr9:98783210-98783525
  misc_feature 1..315: note = hyper
  source 1..315: mol_type = genomic DNA
ccaagacgcgcgggccggggagcggggagagggcggagggaacggcgcaccgggccccgtcggactgttggaccaaaagtcctcagtgtcgggggctcgcagcgccgccgcggcgaacccagctagggggcaccgcctgcgccgggcacagggaggccgttcggctttccccctcgcgcccattactctcaggcgtcccggggaaccccgcgggccaagtgtcgggctgcgtccgggcagaggcggcttcgcctggtgtcagcgcgtttccgaagggcacccgcggcggggcccacaactcgagctgggagccgc

SEQ ID NO: 32579 - DNA, 252 bp, Homo sapiens
  misc_feature 1..252: note = chr9:98784084-98784336
  misc_feature 1..252: note = hyper
  source 1..252: mol_type = genomic DNA
ggcgggactggggctcggacggaggacaggggcgaggaggaggcaggaaggacgccgggtactgcggggcgcctagggggttccgagcgcagcggctgcggggccgacccgcccaggatggaatcagggccccggcgcccccacgccgctcctccaggccgaacccctgcggccccaatcccccggcctcacgcccaccccgcaggtcggccctgcagctgccttcccttcctccacctccctcccgcctcc

SEQ ID NO: 32580 - DNA, 40 bp, Homo sapiens
  misc_feature 1..40: note = chr9:98784337-98784377
  misc_feature 1..40: note = hyper
  source 1..40: mol_type = genomic DNA
aagccggcgcccccggccaagtggccgctctcaacctgtt

SEQ ID NO: 32581 - DNA, 148 bp, Homo sapiens
  misc_feature 1..148: note = chr9:98784772-98784920
  misc_feature 1..148: note = hyper
  source 1..148: mol_type = genomic DNA
gcacagaggggcactcggcttgtaagcaacggagtaattcagagcccgtcagccccacgccgagtttattcaccctggcaggggcttccgcgggagccatgacccttcctaactggggtggaaggacccgcagcgccagccgggtccg

SEQ ID NO: 32582 - DNA, 335 bp, Homo sapiens
  misc_feature 1..335: note = chr9:98789678-98790013
  misc_feature 1..335: note = hyper
  source 1..335: mol_type = genomic DNA
gaaaggagagggcagcgactgggcgagggaggaaagaccctggccggggcagcccggcgcgggagaggctgcgtgtgcccggctcagtcacccgccctgggagaaggcggcccggttggaaagttgaggcggaaccgaaggcccccgcgtggaggctgcagcccctgcgccggccgggcgggtccggaaggagcccaggccgcacctccaggccggcgccgccgccgcccagcgcccacccgtccccccggcgccactccacatgcaccttctcccggggcgccgacggcctcggctgcccccgcagcgtttccctagcttccctccaaggcccc

SEQ ID NO: 32583 - DNA, 97 bp, Homo sapiens
  misc_feature 1..97: note = chr9:99381503-99381600
  misc_feature 1..97: note = hyper
  source 1..97: mol_type = genomic DNA
tgatgtccaggtacacgtcgtcctgggggtcccggcggcgcgggtcttgctgcgtggagctgcggatcttcttcacacccggcgaggtcgacgagca

SEQ ID NO: 32584 - DNA, 245 bp, Homo sapiens
  misc_feature 1..245: note = chr9:99449135-99449380
  misc_feature 1..245: note = hyper
  source 1..245: mol_type = genomic DNA
gtcctcactgccgcccgggcctttccgcttcttcaccaaggcggacaggctgacgcactaccacgccgcgcgacagcgaccgcgcgcaaagcgccaggaaccccccctactgcccgccccgcgctggcgaagcgcgacccgtcccgccccgccccgccctcggcacagcgtcagaggcggggacgcgcgctggtctatttttgggcatccggatggcgactgcgggaaatcgagttctcatgctg

SEQ ID NO: 32585 - DNA, 30 bp, Homo sapiens
  misc_feature 1..30: note = chr9:99539965-99539995
  misc_feature 1..30: note = hyper
  source 1..30: mol_type = genomic DNA
ctcaccgcagacccacgggctgtacgcgct

SEQ ID NO: 32586 - DNA, 477 bp, Homo sapiens
  misc_feature 1..477: note = chr9:99639580-99640057
  misc_feature 1..477: note = hyper
  source 1..477: mol_type = genomic DNA
cctgggggccgcgggcgaaggaacacccccagatgccgctgcgcagggacaggggacgcgcccagacgtagaggccctgacctctgaatcttggcggggcacccaggagcccggcttcggggtgcttagcggggcgaagccgcccccggacccgcgtggctccagcctcctgggggtacctggcagagggggctgcagcgagcgccctgccgcgccgcttcctccgcgcgtctcccgcctggctccgccaagactgggggcttccccataggcccgcgtccgagcgcgtcctcaggcttcgctccgcgagatctgggggccccgtgggctggggttcgggcggggtccgttccttgcggtccgcggtcttgaagcaatttcccggcaaagtcccgggacagcgggaaagaaactggtctccctgcctggggtcgttcccggtggatgtgcctcttcatcagacggaattttccgtct

SEQ ID NO: 32587 - DNA, 571 bp, Homo sapiens
  misc_feature 1..571: note = chr9:99983140-99983711
  misc_feature 1..571: note = hyper
  source 1..571: mol_type = genomic DNA
aaattatccaccaagcgctacaggcgggaaattgccagggatggaaagcagctgaggctccatttggcttcgcggctccagggcccggcgacctccaaggcccccgcctcaggcgctgcgggcaaacagggcctgggggccccctcccaccgcgggctgagcccccgctacctgtcctttctgtcgcgggcatccaagtcccggaacctgcgagtcaggcagcgctccacctccgcggcgtcgcccttgatggccaccctgtggatcttccgcagttcccagtccccgatgtggtacccccgacccgcgtactcttggtccatggagctcaggagcgcctggcccaggcgtctcccgaaactgaagagtttcctcatggtggcgacttctcagacgccaaccacccgctactgagccgccgcggctcctcgtggcctttccaccccgaccaagttccaaatccgcgatccccctccccaccccgctatccacccctaaatccaagatccaccaccaaaccagcaatccacccccaaacccaagatccacccccaaccccgcgatgtagctc

SEQ ID NO: 32588 - DNA, 240 bp, Homo sapiens
  misc_feature 1..240: note = chr9:99983771-99984011
  misc_feature 1..240: note = hyper
  source 1..240: mol_type = genomic DNA
cctctcagaccgagtgagcttaactaagccgttactcgcgtgccagcagttgggcgctccgacctctcagaccgcgtgagcccagcaaagcggttaggcgcgcgcctgcagctcggcgctagcccggactccgggagccgctctcgagctcgcgtggacggcagagggcggctgcagctcgggcgcaggcgccgctggcttgcgggttctcctgggctcgcgcaggacatcccggaatcg

SEQ ID NO: 32589 - DNA, 30 bp, Homo sapiens
  misc_feature 1..30: note = chr9:100000368-100000398
  misc_feature 1..30: note = hyper
  source 1..30: mol_type = genomic DNA
taaaagacatgcaaacgcccttaaccgcta

SEQ ID NO: 32590 - DNA, 30 bp, Homo sapiens
  misc_feature 1..30: note = chr9:100000837-100000867
  misc_feature 1..30: note = hyper
  source 1..30: mol_type = genomic DNA
agcatcccagaggtgcgtgtttttccttcc

SEQ ID NO: 32591 - DNA, 30 bp, Homo sapiens
  misc_feature 1..30: note = chr9:100264785-100264815
  misc_feature 1..30: note = hyper
  source 1..30: mol_type = genomic DNA
tcccatttgtaggggcgaggtttggtagcc

SEQ ID NO: 32592 - DNA, 509 bp, Homo sapiens
  misc_feature 1..509: note = chr9:100503451-100503960
  misc_feature 1..509: note = hyper
  source 1..509: mol_type = genomic DNA
aaggttccaggagggcgcctgcctgcctagagtccccttgccggtctcaccctggaaaggtaggcggaactagaacaggcgggccccactgcctgcagcctgcgaggagacgccagggctgcaagcccccccgccctcctccgcccctgccgggacagtcagccgctaggggattaggaacgggcccagcgcccattcaagccattcagcgagacaggaagccaagcgcgctcctgcccgcccgcctctgccgggcaggtctgcgggatgacgcgcattgtgctggggactcgcccaaagggaggcccagccgtggggaaaaccgcgtcccgcgggaatccgacgcccggtgacgggggcacctgcaaggcttcagggcgaatccctgactcccagcccggggctgagtcctcgtggggccgcctccgcgctgcccagtgctgccggttatctgctcacagcgggtggctccgggccttcaggagcgcgacgggcgccatcccttccag

SEQ ID NO: 32593 - DNA, 40 bp, Homo sapiens; identical to SEQ ID NO: 3444
  misc_feature 1..40: note = chr9:100610095-100610135
  misc_feature 1..40: note = hyper
  source 1..40: mol_type = genomic DNA

SEQ ID NO: 32594 - DNA, 121 bp, Homo sapiens; identical to SEQ ID NO: 3445
  misc_feature 1..121: note = chr9:100610200-100610321
  misc_feature 1..121: note = hyper
  source 1..121: mol_type = genomic DNA

SEQ ID NO: 32595 - DNA, 123 bp, Homo sapiens
  misc_feature 1..123: note = chr9:100610694-100610817
  misc_feature 1..123: note = hyper
  source 1..123: mol_type = genomic DNA
gccgcgcacaaatttcggaaccagaccaagaatcctggactctagacgttgcctgggggccgatcctgcgcccagggtcccagaatctaactgaaatgcgcctgcgggccgccaccttcgccc

SEQ ID NO: 32596 - DNA, 516 bp, Homo sapiens; identical to SEQ ID NO: 864
  misc_feature 1..516: note = chr9:100611124-100611640
  misc_feature 1..516: note = hyper
  source 1..516: mol_type = genomic DNA

SEQ ID NO: 32597 - DNA, 313 bp, Homo sapiens
  misc_feature 1..313: note = chr9:100613687-100614000
  misc_feature 1..313: note = hyper
  source 1..313: mol_type = genomic DNA
cgttaggacaacggtcgtccagaatttaaaatctagatatctgaatctcagaatcttgaaagttactgagagccacgaaatcccgtattaaaaggtgcctataatataatccagttaaaaattttaaaatttgaagtttttcctcctttgtaaaaacgaaacaggacgaaatctgggttttttgcttctccattacttgggaagaaggaaaccaggagttttgtttagcgagtgtaaagcccctctcccttcgttcgaccaaccctctgccgcagaaggttgtcaagcaaacgctttgagcgtttccacacac

SEQ ID NO: 32598 - DNA, 230 bp, Homo sapiens
  misc_feature 1..230: note = chr9:100614192-100614422
  misc_feature 1..230: note = hyper
  source 1..230: mol_type = genomic DNA
cgcggctctgcacccacagccccggcccgccccccccccccaccccggaaagctgcgtccgggctggagccactggaacccgcgccaaggcccggaatcctatacgtagcaggggcctcggagatcagcacacgccctccagctgctatttaacagagtagaacactgaggccctgcgaggggacaaggacaggccctggatctcccagtgaatggccagggaacgaacc

SEQ ID NO: 32599 - DNA, 760 bp, Homo sapiens
  misc_feature 1..760: note = chr9:100614441-100615201
  misc_feature 1..760: note = hyper
  source 1..760: mol_type = genomic DNA
cgcgaggatctcaggttaggaccaagttccggctcagggacagcaggaaaggaactcagaaattggacacccatgaagcaaacgtgtcccgactgcccgccccttcccccggagacgcgcccacccggccaccgctctcttcccactcccccattacccgcagccctcactccccgctgcgggaaggggctgcttggctgcctctgggggtcttcagagctaccctggtcccgggggattggaggaggaggttacctatcctgcgtcgtctttaatccgtgcaccactatccatcaaatagagacagatcctgggcctctcaaagacggatgattgggggtggtgattggcctatccctaaatatctaccacgcaaggactcttgagagatccagaccccggtacagtcgagggacctggggcccaaaaagggaaagcggctacctctaccacacagttgggaagcgcagtcctaaaggagacgcaggttggagactccgctaagcggagaagccgcagtggggccatggcaagtcaccttccctttcgggcctaggaatactcattcgaaagatggggggactggagtgccgagtggctgtggcagccacgattggggtttggaaaccatcctgaaaggcccggggagccagtctcctggaacttctccctccccattcccacaaaaaccaagcgccctctcggccaattctcaccctctcaggacaaaaaagtgagatgagcccgtcctttcacctgc

SEQ ID NO: 32600 - DNA, 834 bp, Homo sapiens; identical to SEQ ID NO: 3451
  misc_feature 1..834: note = chr9:100615202-100616036
  misc_feature 1..834: note = hyper
  source 1..834: mol_type = genomic DNA

SEQ ID NO: 32601 - DNA, 199 bp, Homo sapiens; identical to SEQ ID NO: 3452
  misc_feature 1..199: note = chr9:100616270-100616469
  misc_feature 1..199: note = hyper
  source 1..199: mol_type = genomic DNA

SEQ ID NO: 32602 - DNA, 770 bp, Homo sapiens
  misc_feature 1..770: note = chr9:100617285-100618055
  misc_feature 1..770: note = hyper
  source 1..770: mol_type = genomic DNA
ggtgggatagatcggttcgtgtccgccatgtgagccagcgtagggacgaaaactcatagacacatcggctgttcacacgttccccgcaatctgagaacgaacaggaatggagagaggactcaactgggacccacgtggaaaagaccgagcaggccacagaggctcggtctccccgcgcacagcgtaggcacccggtgtactctgtaaacgggaggaggtggggcgaggcagccagagcccttggactggcacagggaccctcgatggagcgaagccctcaaacgggatgctttctggtattctatcggggagggtccttggcggtaaccagagggcagcgtagtgtcaacaccagagaccaggatccaaattgtggggaatcagtttcagccttccatgtgctgccggaactcgggcctttttacgcggttcgtcctctagtgcctttaactgcgttactacaataaaaggctgcggcagcgcctttcttcttaaagtgaggaggacaaatttgcaaaagaaataggcttttcttcttttttaaattggagaaatctctgctctggttgacctgggctggttttccctgtctctgagaacttgagacctagctccgagttgaactgtgcgtcagcactccagtcccatcacctgaaccttcagtctcccccatctgttacactagagggctgcaggactctatccaccgcccccgggttatcattcagggccccatcatcttggatgctgccctgcgtatttggcagcaa

SEQ ID NO: 32603 - DNA, 1163 bp, Homo sapiens
  misc_feature 1..1163: note = chr9:100619620-100620783
  misc_feature 1..1163: note = hyper
  source 1..1163: mol_type = genomic DNA
agtcccttctcctctcgggtcgtcatttgtgaaatgggaatttgtgactgctacctcagataattttcctgaagttaaacgagaggagaggtgaaaagcgctttgtaaactgcaaagcgcagagcatagcagggctgaaaggctttaaataagcgctgccttgtaacaaagcctcctggagtgtcatgataaagccccgggaaggagaaagacagggtgggaaagagcggacattttcgtcccccattctacttgtcaacttgcgggacaggtaagattgtgccaaaggcgagggtcagcatcaggagagagaggacgctgcggggagggacctggttgtgtgcttcaggtgccccaagggacacggagacgcgcgagggttgggatcaaggcgttgaagacagagcgacagcccttctcggcctcccaccggccgacgacaccaagagctcgcgcaccggccgggccaggtgggaatgggcgccgcgcaggggagcgagtacctcggagacagtgcgcgccgcccggggcctcatccacagcggggtcgcgggcggcccccttagcccgcgtgactgtgggatcctgagaacattccgctgtatgtcttggaaccttctaaccctaggaatttgcaaacccctcccagtccctcatctgggggctcagagactggaggtgccttttttatttttttcttcttcactttatgaacacagaaaaatcgtttgtccctctccgggccctgcacccgccagcgtcgtgtgcaggcgtccccgggctgtggataattagacacgttcttccctcattgcccaaggctcgttagaattcgccctagagctgtatcatgtattttctttcaaattaactttgcttgcaattaagcttagggaaccagcaacaaaagcaaacttggcccgaggtcgttcaccgcgaaaatggattagagaaacttcttccccgatttaaggggaaagattcctgcggccagcgctttggggaaagtgccccgaccgcagaggcgacgacaggggagcaggaagctgctcacggtagtcggcgttggcggcagcggtggccttcctcatctgggcgatgtgggctcctagaagagtaaggataacatcctggaaatgacttctgtacggtttgagcccaac

SEQ ID NO: 32604 - DNA, 126 bp, Homo sapiens
  misc_feature 1..126: note = chr9:101469181-101469307
  misc_feature 1..126: note = hyper
  source 1..126: mol_type = genomic DNA
atgctcaggcaaagacgagggcgataggaatgtcattcggaaatgatttcacaccgggttagccctgcacagccagccagcttgcatcctctggggcagaggacgcctctccgcctgcagcagcct

SEQ ID NO: 32605 - DNA, 723 bp, Homo sapiens
  misc_feature 1..723: note = chr9:101469527-101470250
  misc_feature 1..723: note = hyper
  source 1..723: mol_type = genomic DNA
ggactccagcagaagcgcccggagagtcccaggaagccaggatcaagcccagcgcctcggccccgttccgcgcgatggaagaggcgccaaccgagcgtactgcacaggaaatcactgcccccttcaggccgcgtctcagacgctgcggtcggagcacaggggctcgctcggtccggaaaaactcgcaaacccgaccttgcgcggccagcgatcgctcctccagacccgctccgcgcgctccagccccggcctggcggtgaaggtccgctctggggcttcaggcagaacccaaaccgagggcgtggggaggggtcttgggatggaaagcccttggctctctggctccgctccggactgctctccaagtctgtgctccggctgctaggtcggatgcttcaagcctgagccgtgagaaactgcctgcagccgcccggccaacagcagcggcgcggccggacaccactgcacgtccgggacgagaactgccagggcactttctgagcaactaacccgaggcaggggtctcctgaaatcgctctggccacaggcagcgccgggcacgtccaggcagaagcgctgcagagccggtggccccacacttgcccgcgcggagcgggctcagagctgctggcgcgcaccaggcgcccagccacgctgcacgctcaagccccttgggttccggagccttccggacctcaaagcgcggctcggcttccctggggg

SEQ ID NO: 32606 - DNA, 30 bp, Homo sapiens
  misc_feature 1..30: note = chr9:101470607-101470637
  misc_feature 1..30: note = hyper
  source 1..30: mol_type = genomic DNA
gatctgaccaaaggccggaggttgcctgtg

SEQ ID NO: 32607 - DNA, 90 bp, Homo sapiens
  misc_feature 1..90: note = chr9:101470839-101470929
  misc_feature 1..90: note = hyper
  source 1..90: mol_type = genomic DNA
gcccatgatggagagcggcgggctgctgggcggcggccggggggcgccccgcgcccagccccaggccccgggcgccagaggcagcagcag

SEQ ID NO: 32608 - DNA, 564 bp, Homo sapiens
  misc_feature 1..564: note = chr9:101470989-101471553
  misc_feature 1..564: note = hyper
  source 1..564: mol_type = genomic DNA
gggctgcccggagctccgcggggaagccatgccgcgccgcgggctgcgggcgccggctcactcggcccgcatggcctggcccggcccgccgccccgcgccaaggtcttcccgcggcgcccgcgcaatggcgccggcccgggccccggctccgtctcgggctagggttccggctcggctcagaacggccgcggcggcggcggcggcagcggcggcgcccgtgacggatcaatcacgccgggaaggggtgggagcgagcggagtgcgggaggcggggagcaagcgagcaaacgcggagaggggggccggcgtctccgcgcgcgcctctctccagcgcggccgccccgcaccgggccgcctccgcccgcccccgtgcgcgctctgaaccgctctcccgccgggagctgctaggcggcagcccctggagctcggccgggggagggcggacggcaggaaacgcgggaggcgaaggcgaggctgctcaggggcggctcgggccgcctccagggacggggacgagccgtgcgcgccgggggagggggaggcgctggcgctgcggcggccgc

SEQ ID NO: 32609 - DNA, 365 bp, Homo sapiens
  misc_feature 1..365: note = chr9:101471554-101471919
  misc_feature 1..365: note = hyper
  source 1..365: mol_type = genomic DNA
gggagggccaccttcccagcacacgcacacacgcgcccccggccctccgctgcgccagctgccgctgcccgccgaccgctgacctccaggcaccagagcgcccggggacagcgatctgggaaccgggaccgcgcgctggcacacgcagtggccgccgccgctccgccgagcgctgcctgtagcacctgcacggtggtttggaaccgcttctcggaggtctggccgggaaggtctgggcaggagaatgttccacgaaggcgtcccagaggcatctgcagcctacgctctcccgttcttttctggcgcccacgagcccctgaccgagtcccgggggtcgctgaagacgcccacgggtgctcgaacgc

SEQ ID NO: 32610 - DNA, 65 bp, Homo sapiens
  misc_feature 1..65: note = chr9:101705976-101706041
  misc_feature 1..65: note = hyper
  source 1..65: mol_type = genomic DNA
gcgcggggctttcctcgcaggttacataaggcagccgcgggtggaggcagcagaggcgagcgcac

SEQ ID NO: 32611 - DNA, 154 bp, Homo sapiens
  misc_feature 1..154: note = chr9:101706042-101706196
  misc_feature 1..154: note = hyper
  source 1..154: mol_type = genomic DNA
tccgtcgagggggaaaggggcgtggggaggcggccggggcggccggtatcccccgggcgtgagtgcgcagcgcgcgggggagcgcagggcgcggcggagtcgggtttcagagcgcgggtgactcggggcgcgggccgggagccgggattctgcc

SEQ ID NO: 32612 - DNA, 467 bp, Homo sapiens; identical to SEQ ID NO: 3455
  misc_feature 1..467: note = chr9:101706312-101706779
  misc_feature 1..467: note = hyper
  source 1..467: mol_type = genomic DNA

SEQ ID NO: 32613 - DNA, 109 bp, Homo sapiens
  misc_feature 1..109: note = chr9:102586680-102586789
  misc_feature 1..109: note = hyper
  source 1..109: mol_type = genomic DNA
cccccattgaagatgcggggagacgggaagcacgtgctacagccgtgggaagatccgcttctacccgcgctacatcgagcgcaagctttccgtccgagcagctccagct

SEQ ID NO: 32614 - skipped

SEQ ID NO: 32615 - DNA, 146 bp, Homo sapiens
  misc_feature 1..146: note = chr9:103235748-103235894
  misc_feature 1..146: note = hyper
  source 1..146: mol_type = genomic DNA
cggcggggctctgggcgcgcggctggatgcccccggcctgcggctccctgcgcttcccgccgtccaggggcaccagtcatgggcgccgcagccgctgaggcgccgctccggctgcctgccgcgcctccgctcgccttctgctgcta

SEQ ID NO: 32616 - DNA, 137 bp, Homo sapiens
  misc_feature 1..137: note = chr9:103790552-103790689
  misc_feature 1..137: note = hyper
  source 1..137: mol_type = genomic DNA
aaactcattttagttcggggcgacctgcagcctgtggttcctcctggacctctggggagacgcatctcggttgcccgcagggtagaaagcaagagaatggcccacaggaacgcccgcgccagcgctaaaaccacacc

SEQ ID NO: 32617 - DNA, 212 bp, Homo sapiens
  misc_feature 1..212: note = chr9:103791492-103791704
  misc_feature 1..212: note = hyper
  source 1..212: mol_type = genomic DNA
cttgcttgtgggtgtcgaggtgcagatgaaggcggcgctggggctgtgcagaggagaggacgaacccagggagggtcgcctcctgcgaggtgtcagattgacccagcagaaagctaccacctccctgctcataaactttccttccatgtcatctgggaaacgtggagacaaagggggcgtggaggctccctccgtcccgttccaccctcctg

SEQ ID NO: 32618 - DNA, 113 bp, Homo sapiens
  misc_feature 1..113: note = chr9:103791967-103792080
  misc_feature 1..113: note = hyper
  source 1..113: mol_type = genomic DNA
ctccggtgccaaaggcgccggggtgaggctcgggtcagtgcggggataaatgatgagttactgacaggcttgccataatcacctcctagaacggaggacgctaggatctctcc

SEQ ID NO: 32619 - DNA, 83 bp, Homo sapiens
  misc_feature 1..83: note = chr9:104248540-104248623
  misc_feature 1..83: note = hyper
  source 1..83: mol_type = genomic DNA
gggcagtccctgccacgcttgagcctcagtttcccacccgtaggccgagctgaccgtctccatcgctgcgctccttcccttct

SEQ ID NO: 32620 - DNA, 101 bp, Homo sapiens
  misc_feature 1..101: note = chr9:104248845-104248946
  misc_feature 1..101: note = hyper
  source 1..101: mol_type = genomic DNA
ttacccagactggcacgcgccccgctcgcgtccttctattgacctgtcagcgcagctggcgcaggcaagggccagggaggcgcccccgagacactcaacca

SEQ ID NO: 32621 - DNA, 40 bp, Homo sapiens
  misc_feature 1..40: note = chr9:104249474-104249514
  misc_feature 1..40: note = hyper
  source 1..40: mol_type = genomic DNA
cttggggaaaaaggacggcaaaaggcgccaactgatgggc

SEQ ID NO: 32622 - DNA, 30 bp, Homo sapiens
  misc_feature 1..30: note = chr9:104499932-104499962
  misc_feature 1..30: note = hyper
  source 1..30: mol_type = genomic DNA
gagcccggcggcccccggccatgcagggtg

SEQ ID NO: 32623 - DNA, 15 bp, Homo sapiens
  misc_feature 1..15: note = chr9:104500167-104500182
  misc_feature 1..15: note = hyper
  source 1..15: mol_type = genomic DNA
aggagctgggcaccc

SEQ ID NO: 32624 - DNA, 448 bp, Homo sapiens
  misc_feature 1..448: note = chr9:104500207-104500655
  misc_feature 1..448: note = hyper
  source 1..448: mol_type = genomic DNA
cggcaacagcagacagaccctgctcagcagccaccacaaactcagtctcctcattactgagacccgcagggagaaagcgcgccccctcctgcgcccggctcgcccctctgcagccgctgcctgaggtctccgcctccaggtcccgcgcgcagcttcactccactcggtgaagcggtcccaggagctggagcggtctctaggccatgcaagttggagcgtagcgcgcctccggcagtctcagatcccgctcccaggtccctccgcctggcatcctctgcccgcccggtcactgcgctgagcaggcaggcgggcgggccggcgcctgtcacccgcagctggagcgcccgttccctgcccgccccatctgcagggcgcctcgggcactgcgtccggccccgcgaggcggccgggatgagaagcagccggagttcctcgggggcagcagtga

SEQ ID NO: 32625 - DNA, 174 bp, Homo sapiens; identical to SEQ ID NO: 10015
  misc_feature 1..174: note = chr9:104500856-104501030
  misc_feature 1..174: note = hyper
  source 1..174: mol_type = genomic DNA

SEQ ID NO: 32626 - DNA, 193 bp, Homo sapiens; identical to SEQ ID NO: 10016
  misc_feature 1..193: note = chr9:104501031-104501224
  misc_feature 1..193: note = hyper
  source 1..193: mol_type = genomic DNA

SEQ ID NO: 32627 - DNA, 476 bp, Homo sapiens
  misc_feature 1..476: note = chr9:108418471-108418947
  misc_feature 1..476: note = hyper
  source 1..476: mol_type = genomic DNA
ccgcgagacaaagggcggtgtcctataaaggcggcggcggcggcggcgcggtgtccaggcgagggcgcacacggccggcgagggcgacggctacggcgacgacgcgggctctttgcgaggaggtgcgtggactccggggggacatgggcgcaaccagggccgggctcgtgggcctgcgggtctctcgctgagccatactcacccgggagagcaggaatgcggcggagacttggtagcggccaccgagccaattcggtgggaagaccgggggactttccgcggggcaggggcggtggctcagctccgggggtgctaggccgactctctagcgtgttggcgggcccgcgtcgcttttatgcgtgatgccggggacccccttgtaccgctctcggcggcgcatctcccagagcccttcaaggagctcgcgcgtccccgagcgactcccggacacctggcagattcgaaacttcagccac

SEQ ID NO: 32628 - DNA, 30 bp, Homo sapiens
  misc_feature 1..30: note = chr9:109622797-109622827
  misc_feature 1..30: note = hyper
  source 1..30: mol_type = genomic DNA
ccatcttaggacttacgacccaagccaacc

SEQ ID NO: 32629 - DNA, 168 bp, Homo sapiens
  misc_feature 1..168: note = chr9:109623048-109623216
  misc_feature 1..168: note = hyper
  source 1..168: mol_type = genomic DNA
ggtggcggcggccagcgctcagacaccccccgggtcccggtggggaggagctcggggcaggaggacttccctaggtccctccgggcactcggaagggggagtcctcccaaagccgcacaaagccgggatcatttcaatccggaacagcctcagcgtcctcctcctctc

SEQ ID NO: 32630 - DNA, 145 bp, Homo sapiens
  misc_feature 1..145: note = chr9:109623464-109623609
  misc_feature 1..145: note = hyper
  source 1..145: mol_type = genomic DNA
ggaagtgggtgaaatcgtgcctcggggtgagagattctgctcaggaatatagggtcgggaaaatcttggaaaatgaggatttagatctgtttatgaagccccgctatcggatgggaaccaactccgcgcgcgtctcctcctcttc

SEQ ID NO: 32631 - DNA, 60 bp, Homo sapiens
  misc_feature 1..60: note = chr9:109624462-109624522
  misc_feature 1..60: note = hyper
  source 1..60: mol_type = genomic DNA
tggaaatactcacaccgcaagctggaaagggattaaaaagccccacgtggttgatctggg

SEQ ID NO: 32632 - DNA, 829 bp, Homo sapiens
  misc_feature 1..829: note = chr9:110227815-110228644
  misc_feature 1..829: note = hyper
  source 1..829: mol_type = genomic DNA
tcccgtctattttcacgttagccaaagggaagcctagaagtccacagtccccgggagctggaagccaggcagtgacagcgccagcgtattctccttgacttgattgtaaatttcacaactttggtagcttcaacagggaggaagaggaggggcgccggctccctccagcaaaggcggcgcggagcgggtagccaggtccggagccgtcctgtgccgggccgtccggtggggggcactgcagaccgcgcgggcgctgcgcccgcctctagctccgggcgcagaggggtggccacgctctcctgagtccctcgcgcccctagccgcgcctgggagagcggactggcctcccagagaggatgcgggggaagccgcacaggggcccactgggactgggtaagggcgcgggatgggatcggctctggatatgggtgccccccgagccgcgccccaccccgcgagcgctcccatttgcacctccacttgagcacggagcttcaagaacgagctattctggggtgcgggttccgacactaggccccacacggatctggggactggtttggctacgacctggcggaaggggggaaacctggcctgagaacggaaactgcgggacgatccggcggcgcacttaaatctggctccgctgcttcctcgccccgcccccgctgtcaccttcctctgcttctgcgcagcgattccacaccccactccaccccatcccacccagaccgctcacccgattctgactttgaacccaaaagcgatcaggcgtgttctgggcccggccacagccagcgggcgctctggccctcgcagaagccgccgc

SEQ ID NO: 32633 - DNA, 81 bp, Homo sapiens
  misc_feature 1..81: note = chr9:110251955-110252036
  misc_feature 1..81: note = hyper
  source 1..81: mol_type = genomic DNA
tcactcggcggctcccggtgccgccgccgcccgccaccgcctctgctccccgcgcgcccgcagacacgttcgttctctctg

SEQ ID NO: 32634 - DNA, 45 bp, Homo sapiens
  misc_feature 1..45: note = chr9:110253522-110253567
  misc_feature 1..45: note = hyper
  source 1..45: mol_type = genomic DNA
tcaaaaagtgcacaccgagcccgccgcaggcgtccttgcccaccg

SEQ ID NO: 32635 - DNA, 52 bp, Homo sapiens
  misc_feature 1..52: note = chr9:110400388-110400440
  misc_feature 1..52: note = hyper
  source 1..52: mol_type = genomic DNA
aatgagaggcttgtacgaaacatcagccgacaagaaacggggtgatgtcaga

SEQ ID NO: 32636 - DNA, 182 bp, Homo sapiens
  misc_feature 1..182: note = chr9:111929136-111929318
  misc_feature 1..182: note = hyper
  source 1..182: mol_type = genomic DNA
cccggtctcccctcccgcaacccctcgccctcccgcagcctcaccctcctccgacaggtagcgcaggtcgtagaactcccccgcgaaggtgccgtaggaggagtcgtggcgcggcaccgcctcgtcggcgcccgtgtccccccgcgcgcgtccccggggtccccggccccccgggcccgcac

SEQ ID NO: 32637 - DNA, 189 bp, Homo sapiens
  misc_feature 1..189: note = chr9:111929339-111929528
  misc_feature 1..189: note = hyper
  source 1..189: mol_type = genomic DNA
cgcaggcggcgggccccgtcagtagcagcaggagcagcgacgcccagacccccgggtgctgccggggcggccgcgccatccgtgcgcacagatcccgcagccaggccgctcgggccgcagcgggggcgccgcgggcgcgggccgggactgagcctccgccgaggccaccagcacgcgcccgcgcagccg

SEQ ID NO: 32638 - DNA, 15 bp, Homo sapiens
  misc_feature 1..15: note = chr9:111929585-111929600
  misc_feature 1..15: note = hyper
  source 1..15: mol_type = genomic DNA
cgcagcctccccctt

SEQ ID NO: 32639 - DNA, 80 bp, Homo sapiens
  misc_feature 1..80: note = chr9:112081693-112081773
  misc_feature 1..80: note = hyper
  source 1..80: mol_type = genomic DNA
ggggtcgactcccagcgccccagcaaagggctctgccggtgcaaggcaggcaggtctgagacagccgactctagagttag

SEQ ID NO: 32640 - DNA, 678 bp, Homo sapiens
  misc_feature 1..678: note = chr9:112402623-112403301
  misc_feature 1..678: note = hyper
  source 1..678: mol_type = genomic DNA
cttgcagaggccagacgcttcttgcaacttctaagcggcgagagctgccaccttgccaatgactcaaccgtttgcctatgccctctgggctgtgccaccagccgcagccgccctgctcccccacccacccttctccccaggctccgcgccgcgccgccagtcccaggggagccgccggcgcacctggcgcctagggcgcacggcactgcgcgctggtgggcacctcacccgacgccagctgccagcgcgctccctccccgaaaccctgaagtggggtgtcttgtctagcgcccagcgaacaacattatccaattgcttcccgttttattcgcaggctgggagctgagagagcctgagcattcactttcaaccctccaggggaggagggggtgcgggtggggaggggagacggctcccagctccacctcgcgcgcggcgcggccagtgcactcggctccgggagaggcgagcagcgccggtgagccccgcagcagcgcacccggccgcggagccccgcgatggagtgagtatccccgagccgcgccgccagctgctctcctctcggcatgttgccatggtgaccgcggcggcaggcagatcccgctcgggtccgcgtccaggatgggtgtttaatttcagccccgtgtgtacgcctggtgtttctatagcagccgccgc

SEQ ID NO: 32641 - DNA, 166 bp, Homo sapiens
  misc_feature 1..166: note = chr9:112403302-112403468
  misc_feature 1..166: note = hyper
  source 1..166: mol_type = genomic DNA
gcggcaggaggcaaggggtgggagccccgggtggcgtggtttttgcggctgccccttggctagcagggcctggggggcgagtgaggggagtagatgatgttgctaaggacggaggcatattctaggctttcctatctctgccccaagcttccgcttatcggggagt

SEQ ID NO: 32642 - DNA, 157 bp, Homo sapiens
  misc_feature 1..157: note = chr9:112542235-112542392
  misc_feature 1..157: note = hyper
  source 1..157: mol_type = genomic DNA
gtgtccacgcgggcgcgccacgccagccgtgcgccccagcggctcgccgtgcgcccgcgccccaggtgcccactggctcgcgcgccctccgtctgcgccttggagacccgcggcggcgatcgctcggagccgccttggaccgcggcctcgggtccat

SEQ ID NO: 32643 - DNA, 30 bp, Homo sapiens
  misc_feature 1..30: note = chr9:112542670-112542700
  misc_feature 1..30: note = hyper
  source 1..30: mol_type = genomic DNA
tctagcaaagccccccggggtgcccatcag

SEQ ID NO: 32644 - DNA, 357 bp, Homo sapiens
  misc_feature 1..357: note = chr9:113341265-113341622
  misc_feature 1..357: note = hyper
  source 1..357: mol_type = genomic DNA
ccgggtcgggaggggcgggcgccttaccgcggcttgctggaaggcgcccttggtgtaggtgccgccacctcggtaggagatggcagggatctcttggaggagcagcgcgcacttgtgctggcgcgcgcggcgggtggagatgtaatcgacgcgcggcaccacgtagttcttggacgagaaggtcacgatggccacgcgcgtggccgtgggcaccacggggaagtcggacagcagcttgcggacgaacatgagctcgctgcggaagttgacttcgcccacgctggacgaatcatccaccaggaagacaagctccaggcgctcgctgagctcccgcagcagccgcacgcgtcgccggaa

SEQ ID NO: 32645 - DNA, 169 bp, Homo sapiens
  misc_feature 1..169: note = chr9:113341679-113341848
  misc_feature 1..169: note = hyper
  source 1..169: mol_type = genomic DNA
cgcggggatactcccgggggccccgggcgcggtctcggggaagaggcggaagctgaaattgcgcgacggggacatctgctgaaaggtcgcccagcccgaaacgagcgccagaccccagcaacaaaaggccaggcgaggccacatcgcgctggagacagagcggctgccc

SEQ ID NO: 32646 - DNA, 414 bp, Homo sapiens
  misc_feature 1..414: note = chr9:113341926-113342340
  misc_feature 1..414: note = hyper
  source 1..414: mol_type = genomic DNA
cggggcagcggccaagagcctcagcgccctttcatctgacactggggacagacacaatccagactcctcagcagctcgggaactccggagggaacggcgcgcgctctctacccctctcgctctcctctttttttcttccctctctcctcctcctctctctccctgaagcctataaaatgtttgaaggaaagggggcagtcaagaaaaatctcccgcttccctccttctctccctctctccctctccccgctcctgtctactttctgtatctgtgactctatctccctcctccccctctcattctcctcccgggatcaagccaaaggctcggagattccatgacaccagaaccccgcgtctgtcaggctgtcaacattcccgcagcaagcgcaccagcgccgaagccctgattga

SEQ ID NO: 32647 - DNA, 30 bp, Homo sapiens
  misc_feature 1..30: note = chr9:113800111-113800141
  misc_feature 1..30: note = hyper
  source 1..30: mol_type = genomic DNA
cgcactgacctggcgcgggacaggagggcc

SEQ ID NO: 32648 - DNA, 64 bp, Homo sapiens
  misc_feature 1..64: note = chr9:113800385-113800449
  misc_feature 1..64: note = hyper
  source 1..64: mol_type = genomic DNA
cgcggcctctggcttcgcgcccagggggcgccgtccccacacgccgcgccggcccccttacctg

SEQ ID NO: 32649 - DNA, 300 bp, Homo sapiens
  misc_feature 1..300: note = chr9:113801080-113801380
  misc_feature 1..300: note = hyper
  source 1..300: mol_type = genomic DNA
tcgacacacccgcagcgggagacccgtggccgccagctcgggtcccacccccgcccctcctgcgcttaccccagcgccggacagctggcaggactccggtggacgccccggcacggggcattttcacgttgtcgctctcctcttcccactcgaaaagctctggaaaacatcgcggggcccgcaaaaccccggaaatgtggcctctctttcgtggctcactttctaaactttccagaaggcgcaaagtttctcccagcgccgccctgcactggaggctgcgaagaacgcagaagcggcttt

SEQ ID NO: 32650 - DNA, 136 bp, Homo sapiens; identical to SEQ ID NO: 10028
  misc_feature 1..136: note = chr9:114287491-114287627
  misc_feature 1..136: note = hyper
  source 1..136: mol_type = genomic DNA

SEQ ID NO: 32651 - DNA, 138 bp, Homo sapiens
  misc_feature 1..138: note = chr9:114287962-114288100
  misc_feature 1..138: note = hyper
  source 1..138: mol_type = genomic DNA
gagatcctctggctgcgtcacattttcaccgggcctcctatgtaaactccctgtagacggagccgagtgtcttagtcatcgcggagccccaggtgctcagcacggcgccaggtacgtggtgggcgcctaatatttggc

SEQ ID NO: 32652 - DNA, 30 bp, Homo sapiens
  misc_feature 1..30: note = chr9:114361785-114361815
  misc_feature 1..30: note = hyper
  source 1..30: mol_type = genomic DNA
cctcctccactggggcgtctagaaacttgg

SEQ ID NO: 32653 - DNA, 50 bp, Homo sapiens
  misc_feature 1..50: note = chr9:114362053-114362103
  misc_feature 1..50: note = hyper
  source 1..50: mol_type = genomic DNA
cgggaaatctgagtgcgtttgtgtgtgtgtgtgcgcgtatctctgtgtgc

SEQ ID NO: 32654 - DNA, 621 bp, Homo sapiens
  misc_feature 1..621: note = chr9:115652936-115653557
  misc_feature 1..621: note = hyper
  source 1..621: mol_type = genomic DNA
gcgggcaggtgacctcggggctcatgtgacctctctgatggggatcgaagggctttctggctgcagtgacaaggatatgctcccaaattcggctgctacggctgctcaggtttcagtcccggagcgcgagtgtgctccgtgcgccgggagcgcgagtgtgctccgtgcgccgggagcgcgccggccagtggcgagcagagccagggcacgcagcgcctgtgacagcagcccgcccagcagccgagtgacctcccgagtgactcctcctcaggccagaaaaggccgcgctccaccctgccctcgccacctcaggcagagtaggactggcgacagtccagggaagccaggcgcgggggagcgcaccgcgagtgctggctcctggcgccagcacccccggggccgacgggtcacgctgctcctgtgagcgcggccgcctgacggggccgaatttccccacagccaggcgtgcgtgcccggacctcccgcggatctctgcggaccccccaccaccggggcaggggctggaaggaagctccccaggactggctcagggagcgtttccaaattctcccatcccaggaaggcaggtttgcgcgaggggtgggacgcctaggattctgc

SEQ ID NO: 32655 - DNA, 30 bp, Homo sapiens
  misc_feature 1..30: note = chr9:116756509-116756539
  misc_feature 1..30: note = hyper
  source 1..30: mol_type = genomic DNA
attcagacacagccacgtgggtttcagcct

SEQ ID NO: 32656 - DNA, 43 bp, Homo sapiens
  misc_feature 1..43: note = chr9:116916374-116916417
  misc_feature 1..43: note = hyper
  source 1..43: mol_type = genomic DNA
ccagcacctatgagccgcccccagctctcggagcccgcgccgg

SEQ ID NO: 32657 - DNA, 127 bp, Homo sapiens
  misc_feature 1..127: note = chr9:117267169-117267296
  misc_feature 1..127: note = hyper
  source 1..127: mol_type = genomic DNA
ccgggagcgcggagacgacggctggagcctgggtttggggagcacgggtacagtggctggatcctagggggtcgcggagaccgctgctagagtcccggaggcgcgaagacggcgggggtcgcgaacc

SEQ ID NO: 32658 - DNA, 59 bp, Homo sapiens
  misc_feature 1..59: note = chr9:117880343-117880402
  misc_feature 1..59: note = hyper
  source 1..59: mol_type = genomic DNA
cgagttccccagcagcgctgcctttgtgcccacggaggcgggggcgtgtatctgcgcgc

SEQ ID NO: 32659 - DNA, 212 bp, Homo sapiens
  misc_feature 1..212: note = chr9:118916583-118916795
  misc_feature 1..212: note = hyper
  source 1..212: mol_type = genomic DNA
gccacctgcgccacccgggcggcccgcggccgccgcgcctcgccgccgccgccgccgccgccgggcggtgcctgggaagccgtgcgcgtcccccggcggcggcagcagcgggaggcgaggggcgccaccgaggagccgagcccgccgagccgggcgctctatttcagcgggcgaggcgagcagctgcgcctccgggccgacctcgagctgcc

SEQ ID NO: 32660 - DNA, 30 bp, Homo sapiens; identical to SEQ ID NO: 10032
  misc_feature 1..30: note = chr9:118917350-118917380
  misc_feature 1..30: note = hyper
  source 1..30: mol_type = genomic DNA

SEQ ID NO: 32661 - DNA, 45 bp, Homo sapiens
  misc_feature 1..45: note = chr9:118917733-118917778
  misc_feature 1..45: note = hyper
  source 1..45: mol_type = genomic DNA
aataaaactggggagcggaggtgggggcggcgctggaagagagga

SEQ ID NO: 32662 - DNA, 30 bp, Homo sapiens
  misc_feature 1..30: note = chr9:118919318-118919348
  misc_feature 1..30: note = hyper
  source 1..30: mol_type = genomic DNA
gctcagcagggaccgcgctgctatttcagg

SEQ ID NO: 32663 - DNA, 749 bp, Homo sapiens
  misc_feature 1..749: note = chr9:120175549-120176298
  misc_feature 1..749: note = hyper
  source 1..749: mol_type = genomic DNA
gcaaggagttaacctcggaagttcagggatcgtaaaggttctcacctggaaggcccctcacctgcggtgcccgaggcggatcccgccgaggaaaagacccggggaagaagagctccgggtctgggcgagcccctggcgcctcacgggcgctgttgttggccagactccgacaaccaataaggccccgcgcccccaagaggggaggggagagcgagcaagcagcgagcgcgggagagctaaggggaacaacatttttgtaaacgctctccgagataattaagctatcaattacccgggtgggaaatcagctgcgcttcccacagctccactgaagggccgactcctccgggattcgcgcagggaaccagcaggcagcaagctgctggcgaacttttctgattaacttttccgttggagccccccacccacacccatctcctctcctctcctttttcttgcctttaagtaattattattagcccagggagtgagctgcaaggacaaaccggctctctgcctggaggtgggtagaaagggaaggcggtaacgggggtagagggaggctctaaacgtggagacctcggagtcggaatcccagttctcagcaaccactcaagtctctccagccctatttcacagatggccagaactgaggctcagagaagggaagcgacttggccaaggtcactcagcccatgcggaagccacgcttttgcgggttgagcgattccacacggaactactccatt

SEQ ID NO: 32664 - DNA, 692 bp, Homo sapiens
  misc_feature 1..692: note = chr9:120176817-120177509
  misc_feature 1..692: note = hyper
  source 1..692: mol_type = genomic DNA
caccgcgatgcgccccggcagctcgttacgcacaaagagcaggaggcgcgactcggcggcggtgccggcagagccaggagagcccggggacgcggcggcggcggcggctccggccccggtcccagccccggccccggcgcgggcgccgctccagccgatgtcgctctcccgcagggcgggcagtgtggacaccgtgacggtcttcagccggcacgggctgtcgggctcccgcgaggcagcggcggtggcgccggccagcagcggcggcggcggcagcaggagcaggaacagcagcagcagcggcagcagtggcggcggccccgggtggaagcagagcctcggccgcccccggagccccgagccggggccggggctgagccgggcgccggcggcggccatggcgggaggggctgcggtgctgcgggcggcggcggcggtggcggcggtggcgaaggaggaagaggaggcagctgcggagacggcggacgccgaagcgaaccaggacgcccgagctaaggagcggagagagccgctcgccagcagcccccagctccgggctccgcctcccgatcggccctggaccgcccccccgcgccgcctcccggggcccagccgcccgtccccgatctccggctccccccgcagaccccgagcgtttcggaggctccgcccggcctcgtgcaagtcccagt

SEQ ID NO: 32665 - DNA, 140 bp, Homo sapiens
  misc_feature 1..140: note = chr9:120177898-120178038
  misc_feature 1..140: note = hyper
  source 1..140: mol_type = genomic DNA
cattctcccactgcccgcaaaccttcctctcccctccatccaggccttgtgctagcactaattgctaatggacagaggggcgtcgaactccaccgtctaacgccgaccccacaactgactgaagccgggctgttctggcc

SEQ ID NO: 32666 - DNA, 211 bp, Homo sapiens
  misc_feature 1..211: note = chr9:122131005-122131216
  misc_feature 1..211: note = hyper
  source 1..211: mol_type = genomic DNA
cacgaacacacgcatcaaacgcaaacgacgccgcacacgcaaacacactagcaccacatcaagttcccaccatggtgcacacgtcgggagcgcgcggggacacacacgccactcactcaaacccgcaattagccctttgagccccaggcacaggaaccccctccctagaactggagaagacttggaggcggcggggcggccaggtgaagag

SEQ ID NO: 32667 - DNA, 128 bp, Homo sapiens
  misc_feature 1..128: note = chr9:122131496-122131624
  misc_feature 1..128: note = hyper
  source 1..128: mol_type = genomic DNA
cgtaaagtccccttcgctggtcccgaggacaggcatgaatcccggctccggaaggcggtcactactccctctgcctcccggctctctcgctctcgctctcgctgttgctcgctcgctctctccctctc

SEQ ID NO: 32668 - DNA, 188 bp, Homo sapiens; identical to SEQ ID NO: 10038
  misc_feature 1..188: note = chr9:122131838-122132026
  misc_feature 1..188: note = hyper
  source 1..188: mol_type = genomic DNA

SEQ ID NO: 32669 - DNA, 162 bp, Homo sapiens
  misc_feature 1..162: note = chr9:122132051-122132213
  misc_feature 1..162: note = hyper
  source 1..162: mol_type = genomic DNA
cgcgcaaacccggaatcctggtgcccttaagcgtgactgtactgtgtgtgtcgcgagtacctgagtgtttctggggcggcaggtgtttccacggccgcgtggatccatcgagtgtgggttttgtctcgggagttgcccgtgtgggtccgtttgtgtctgcgc

SEQ ID NO: 32670 - DNA, 42 bp, Homo sapiens
  misc_feature 1..42: note = chr9:124361888-124361930
  misc_feature 1..42: note = hyper
  source 1..42: mol_type = genomic DNA
ccgccccgctccactcggcccagctggcgcgaaggaaacttt

SEQ ID NO: 32671 - DNA, 231 bp, Homo sapiens
  misc_feature 1..231: note = chr9:124990555-124990786
  misc_feature 1..231: note = hyper
  source 1..231: mol_type = genomic DNA
caccctccagcccctcggcgcgccgggtaccggccccgcgtcgggattctcagcgctgcgccggcacaacccccggcgcatcggcgctatcagcgcctattcagacggacaataccggcctcgcctcctcttgattcgcctgtgtctttactaaatcgctttttgagaaattcctccaacatttgcataatgtgttcccgctttccgcgaccccccccccccgctcgcgcg

SEQ ID NO: 32672 - DNA, 114 bp, Homo sapiens
  misc_feature 1..114: note = chr9:124990828-124990942
  misc_feature 1..114: note = hyper
  source 1..114: mol_type = genomic DNA
cgtacccctccttcctgcaaccgcccgccaccctgctcggcccggctgggtcccggaccctgcccgaccccggcccgggccgctcacccagtcgttcgccggctcacctggtcg

SEQ ID NO: 32673 - DNA, 63 bp, Homo sapiens
  misc_feature 1..63: note = chr9:126138079-126138142
  misc_feature 1..63: note = hyper
  source 1..63: mol_type = genomic DNA
ggctggccccaaccccgggtggctcagcccaggaggagcctggacagacgaaggcagcaggcg

SEQ ID NO: 32674 - DNA, 189 bp, Homo sapiens
  misc_feature 1..189: note = chr9:126760259-126760448
  misc_feature 1..189: note = hyper
  source 1..189: mol_type = genomic DNA
cagaaaaggggaaatcgggactcatgtggttgagggttcatgagagcagtttctgtgcgctgaggccgggacttcccagcacagcctacaagacactgcctgcccacgcctggccccgcccacctctgcagcctcatcccgctccccaccccacaccggccactccggctttcgcgctggccttgctcc

SEQ ID NO: 32675 - DNA, 127 bp, Homo sapiens
  misc_feature 1..127: note = chr9:126761476-126761603
  misc_feature 1..127: note = hyper
  source 1..127: mol_type = genomic DNA
ggggagtgacttgtccgaggtctcagagcagggaaatggcttcagttgcattttgggggccgctgttccaaggagagacagagaaagagatagcgagtccccctgagcaaggcgagaaaggggggag

SEQ ID NO: 32676 - DNA, 1318 bp, Homo sapiens
  misc_feature 1..1318: note = chr9:126770490-126771808
  misc_feature 1..1318: note = hyper
  source 1..1318: mol_type = genomic DNA
acacacacttctgaacgtcttcattttgatttaatggtatatcagcgtcaactatcgcttcctctgctggtacacacggcctgatgccgcgggaggagggtgcccatgtttatcaccgagtgagatgactaattacaccttgtcaatcaccggctatgaagacataaaaccagcgcgcacaatgaagtagttgcctgcagcgtcaattagttggcgattctgaggttattgcgtggccctgctttggccgcctctaataacgggacagagcgccgggcaccgcgcactgatcaatcaccctccttccgcggccgcccggctccctcccctctcccccgccgggtctggcctcactttctccgggcggcttgcgcttcctccctccgcggccccggctccgtggcgccggcagccccgggagccccgggaagtttgcgcgcggcagctccgcagccggcagccgggagccccgcagccttcggggagcgccggggctggtggcccctttgttggaggaggcgtggagggagcgcttttgttctgagttagtcacggtggccggctggaggctgctacctcattatgcgccgggtctgcttgtctgcgaggaagcagatggtggggaggtaggcagcggcgagagtggccagacctgaattccgttcacctgtcacctcccacaaaaggcaggttcgggggacttaggcattcgttgccactttctgggggagggggaggtcgaggggccgccgtttccggcgcctgcgaaggttccgtacctgtcggtgcccgctccccccaccccttgcctttcccttggctgcagcttctcgcaccgcgtaaatgtcactcacgtgtcaggatgtgtgtttacagcctgttcctctgcttgtttagtctcggcggacagggctcagcggttgcgcgacgttccccgccgctgggggagattagcaaagttacccgcctctggaccccggggcctgggcccctagatcccgccccgcggcgggagatgcgtttgagccttttacagacggagcgcgtcccagcctgacgcagagggatgaatagacaagcgcaccgggcgggaatcccgactgcctgtgtatctggggtcggcccagcgttggacgtgggctgctggtccgagaggtggcgacggaatcgcgtgcctatatgtatgggggagtggaaagtcgcagggtgtgtttccacgtttcttgagcagcccgcggcaagagttgctgagtaccccaccccccgcccccagatcctaaggcagcccctcgagctttccaaacgtattgtatccagc

SEQ ID NO: 32677 - DNA, 528 bp, Homo sapiens
  misc_feature 1..528: note = chr9:126773252-126773780
  misc_feature 1..528: note = hyper
  source 1..528: mol_type = genomic DNA
gagcgagaagctacacgctgggctgcagattgggccctagcgggcttggagcgtggatatgctggctggcccccctccccgggagtcacagctctcgccggtctcgccactcaggctctgccgggtacccaggaggcttgcacggccgcctgcagcccgctgtgcagagcccgggccgaaggcggagctcgatgggaaacggccggccgaaggctcttgcaactctgccacaggcctgccttcccgggcctcccaggcgggtgcctgaggccgcggctccaggccgaggggagaccgcagtgagacgagcatccccttgctgcgccttcttaggatagagggtttaattttcctttctgaagatatcgcaggaagctgttcgtatcttaaaaactccaaaccccgcgctctccctcctccctgcctcccccccacccccgccctccagcctcgcccaccagctcccaccatctcgactctcctctgctcctcttgcctctcccctccctcttgggtctcccgccttcc

SEQ ID NO: 32678 - DNA, 339 bp, Homo sapiens
  misc_feature 1..339: note = chr9:126773939-126774278
  misc_feature 1..339: note = hyper
  source 1..339: mol_type = genomic DNA
ggctgggcccgcggccggcggctcctcctcccactctgctcctcctcttttttctcctcctccacctcctcctccgcctcctcctcctcctcttcctcctcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagc

SEQ ID NO: 32679 - DNA, 103 bp, Homo sapiens
  misc_feature 1..103: note = chr9:126774517-126774620
  misc_feature 1..103: note = hyper
  source 1..103: mol_type = genomic DNA
gcggtggcgatgcaccgggcccgttagcgccaggagcgccaggcagctgaggcggggggcaagccctccctcggaggagccgcgcccccggccccgccggtcc

SEQ ID NO: 32680 - DNA, 96 bp, Homo sapiens
  misc_feature 1..96: note = chr9:126775412-126775508
  misc_feature 1..96: note = hyper
  source 1..96: mol_type = genomic DNA
tccctgggggccagacgagcagacactgcccgaccagcgggcccagaagtgacctttaggaggccgcggaggtggggagcacgggagaagcttctc

SEQ ID NO: 32681 - DNA, 123 bp, Homo sapiens
  misc_feature 1..123: note = chr9:126777624-126777747
  misc_feature 1..123: note = hyper
  source 1..123: mol_type = genomic DNA
atgccgacgtggcagcggcggccgctgcagccgcggcggccaagagcgcggggctgggcgcagcaggggccaaccctctgggtcttccctactacaatggcgtgggcactgtgcagaaggggc

SEQ ID NO: 32682 - skipped

SEQ ID NO: 32683 - DNA, 106 bp, Homo sapiens
  misc_feature 1..106: note = chr9:126778407-126778513
  misc_feature 1..106: note = hyper
  source 1..106: mol_type = genomic DNA
ctccgagtttcctggcgcctgctggggtgagggccgtgaccctcggaagcgagccccccgggcggggacgagaccggagcaggcctggcctcgcgccggggtgggg

SEQ ID NO: 32684 - DNA, 15 bp, Homo sapiens
  misc_feature 1..15: note = chr9:126779147-126779162
  misc_feature 1..15: note = hyper
  source 1..15: mol_type = genomic DNA
aaaccgagttcagac

SEQ ID NO: 32685 - DNA, 447 bp, Homo sapiens
  misc_feature 1..447: note = chr9:126779597-126780044
  misc_feature 1..447: note = hyper
  source 1..447: mol_type = genomic DNA
cgttcggtgcgccggcggtggctatgcggctggctctttcggggctcccgggactaggttggggaaagagggcatctccccggcctctcggggcccagcccagtcttcctagatctggcgtccgcccttccctcccctcccgcactggcaggagagaaatggccgcagtgtgggccgcggggcagctaggactggaaagcggggaccctggagggtgcgatcgcggacggggtgtgcgggcgcgggtcgtgtgcgtgtgcgtgcagggttccgaccacggggacacgagcttgtttgtggcagtgtcccacatcctgtggcccagccacgacgaccccttgcaaagcctcttgctctggggacagtccctccgaggcgcggcggcaccttactgaagggcggcgagctgggggccgagtggggagggggcgccgtcggggcgccggg

SEQ ID NO: 32686 - DNA, 31 bp, Homo sapiens; identical to SEQ ID NO: 3461
  misc_feature 1..31: note = chr9:126780284-126780315
  misc_feature 1..31: note = hyper
  source 1..31: mol_type = genomic DNA

SEQ ID NO: 32687 - DNA, 334 bp, Homo sapiens
  misc_feature 1..334: note = chr9:126780564-126780898
  misc_feature 1..334: note = hyper
  source 1..334: mol_type = genomic DNA
aggagagagaaagcccgggtcctccccctcccctcggcccctcgctcctccccggatccgatcctggggaatctcgacccgcccccgggcactgggggcgggagtgagggggttcggggcgccggccaaacctgggccccacggctgcctcccccgccgccgccccctgcccttgcctctggccggcctcggcctcgctacttagggccggctcctttccctttttctccactccccttctttccccttttctctactcccccgccaataacggcttcggaaaaggcctcccccgcagggaccgggtctcccggagccccgggattcagctcgg

SEQ ID NO: 32688 - DNA, 110 bp, Homo sapiens
  misc_feature 1..110: note = chr9:126781196-126781306
  misc_feature 1..110: note = hyper
  source 1..110: mol_type = genomic DNA
ttgggcccatgggggcgccggggtccccacggagctcattaacagcagccaggcccaggcgggggctcggtggagggatgggcccaaagataccccgtagggaggctgcc

SEQ ID NO: 32689 - DNA, 30 bp, Homo sapiens
  misc_feature 1..30: note = chr9:126782415-126782445
  misc_feature 1..30: note = hyper
  source 1..30: mol_type = genomic DNA
cttcatttcccttagcgttagtttccacat

SEQ ID NO: 32690 - DNA, 124 bp, Homo sapiens
  misc_feature 1..124: note = chr9:126783416-126783540
  misc_feature 1..124: note = hyper
  source 1..124: mol_type = genomic DNA
gtgaccagccatacccgagcagccagaagaccaagcgcatgcgcacgtccttcaagcaccaccagcttcggaccatgaagtcttactttgccattaaccacaaccccgacgccaaggacttgaa

SEQ ID NO: 32691 - DNA, 294 bp, Homo sapiens
  misc_feature 1..294: note = chr9:126785057-126785351
  misc_feature 1..294: note = hyper
  source 1..294: mol_type = genomic DNA
agctgcggggggagccgggagttggggcccctaggctcccgaggcgcccccttgagcagcgctgcccacggggagcgggcgaggggctgcgggagagggaggactgggtgacgtagccgagggagggagcgtcggccaatgggatgccgatgcgcccctctgggcccgcccctccctcatggtctgttttgctttggagtcccagtggcctgagctcctggtggatggagaacgtgactacactggctggggtagcaggtccctctcgtctgtttccttcgttgtttgccttct

SEQ ID NO: 32692 - DNA, 36 bp, Homo sapiens
  misc_feature 1..36: note = chr9:126872665-126872701
  misc_feature 1..36: note = hyper
  source 1..36: mol_type = genomic DNA
caccccccttgatctcggagacgtctgagaacgtca

SEQ ID NO: 32693 - DNA, 352 bp, Homo sapiens
  misc_feature 1..352: note = chr9:127212654-127213006
  misc_feature 1..352: note = hyper
  source 1..352: mol_type = genomic DNA
aggggcggggtctcccgggccgaggggcgggatctcctggtatctgccagagcccgccgctgcctccccgacttcagtccccgcagatgcctcgcagacggtgaacggccacaggcgccaggccagccatagcgggtgaggaactggagctgggaacaggggagggaccagcggatgaaggggaggcccctgactcaggcccattggcgcctcgcggaggagggacgcgcagtggtgggcaaacttcgcatctccctctcgggcctcaacgagtgtttggagagcaagaaaagtgggcgccagggggcttgagggcgcgaatccaggcagacgtgaacgagggagtgctttt

SEQ ID NO: 32694 - DNA, 64 bp, Homo sapiens
  misc_feature 1..64: note = chr9:127215890-127215954
  misc_feature 1..64: note = hyper
  source 1..64: mol_type = genomic DNA
cccgggcgccctggacgtcacgccctcgctgctgcccactgtgtgggtgcgccttctctgtccc

SEQ ID NO: 32695 - DNA, 172 bp, Homo sapiens
  misc_feature 1..172: note = chr9:127239776-127239948
  misc_feature 1..172: note = hyper
  source 1..172: mol_type = genomic DNA
tctccacccattgcgcggatgaggaagttgaggcacagaaaggcgcagccgctagccagagcccgcacagagccagagccaggtccccactggcgcagatgggggactgcaggcacagcagtagccacgcgggtgtaaacgtagagccgcgtgaacccgggttgtgggatcc

SEQ ID NO: 32696 - DNA, 216 bp, Homo sapiens
  misc_feature 1..216: note = chr9:127265875-127266091
  misc_feature 1..216: note = hyper
  source 1..216: mol_type = genomic DNA
cggccttcccctgccaggccccacgctcccgccccgtccggggggctcctcccgcgcggaccccgtcgcgcccgatctggggccctcgggttcgatgcgcttcgattgggattcgtttgtctgagaacaaaaccccgattctgagaaaaagagatgggctcagccgcggggaagacgccaggggacccaggagcgctggggcgcccggcccgggtg

SEQ ID NO: 32697 - DNA, 257 bp, Homo sapiens
  misc_feature 1..257: note = chr9:127266331-127266588
  misc_feature 1..257: note = hyper
  source 1..257: mol_type = genomic DNA
gagagagagagagagagagagaaacgaggggtgggggattggatcagagactcggagagacagcggaggcccgaagagaaaacccaagagagactgacgcagagccagagacacaacgatagacgacagacagagacgccgagacgagaggagccccggagagacgaggccggggagctacagaaacacggagagaaaacctggaggcggaagcgcccagcccgagggtcggggacaggggacgcgcggaaacctgc

SEQ ID NO: 32698 - DNA, 219 bp, Homo sapiens; identical to SEQ ID NO: 10058
  misc_feature 1..219: note = chr9:127266628-127266847
  misc_feature 1..219: note = hyper
  source 1..219: mol_type = genomic DNA

SEQ ID NO: 32699 - DNA, 201 bp, Homo sapiens
  misc_feature 1..201: note = chr9:127266865-127267066
  misc_feature 1..201: note = hyper
  source 1..201: mol_type = genomic DNA
cggagaggcgaagtccggaggagggaagcgcgaagagccagggcccgggacgcgagagggggcgcgacggcggctgcggtcggcccggcgcccacctggtcgctcctgcgagcagcgccccgcgtcccgcccgcgcggagcccgcacctctcggccgcgccgccgccgccggcgaggagccgcacccgggcgcagcgccgc

SEQ ID NO: 32700 - DNA, 158 bp, Homo sapiens
  misc_feature 1..158: note = chr9:127267338-127267496
  misc_feature 1..158: note = hyper
  source 1..158: mol_type = genomic DNA
tcctccccccaagcccggcccgcgccggcaccctctccgcagtccagctcgagtcttcgccctcatcctccaggccccccagccgcagcccggctccccggaccccgagcgcggccagagagctgcggagcccgagtgccccgcgatctgggcaggta

SEQ ID NO: 32701 - DNA, 59 bp, Homo sapiens
  misc_feature 1..59: note = chr9:127421470-127421529
  misc_feature 1..59: note = hyper
  source 1..59: mol_type = genomic DNA
acatggacaaaggcacgagccaaaaccagacagtcctggccgttcgataggccagcagt

SEQ ID NO: 32702 - DNA, 488 bp, Homo sapiens
  misc_feature 1..488: note = chr9:128651926-128652414
  misc_feature 1..488: note = hyper
  source 1..488: mol_type = genomic DNA
taaacccaaagagcccgcacatgacacggaggctgctccatttacattaattatgcagtcagggcggtgagaattcgctgtcagccagcagggcgggggcgcgccgcggcggggagcggggccgggccgcggggcctcccggcgcgaacgcgggagggggagccggatcgccgtccgccgctccgcggctccgcgctgcgagaacaatgggcgcgcccgacgcccgcccgcgctcgcgctgcccggcgcgccccgaaagccgcggggcagagcgccctgagcggtcccccgcgccggcggccccggctgcgccccgctgtagcagctgaccttagccggctgcggccgagagaacgcgcgttgcccgccgaccttgtgccctggggtcagcacccactgcaagtcagaacctctccgtggtcccaaagttagtgcttttccaatccaaaccagaaacttgatttgaggcctggcgatggtagaggatg

SEQ ID NO: 32703 - DNA, 169 bp, Homo sapiens
  misc_feature 1..169: note = chr9:128984848-128985017
  misc_feature 1..169: note = hyper
  source 1..169: mol_type = genomic DNA
aggagattccagtgccgccgcagggcccagaaggggtgtaggaggcgtggccgcagccccaccctagaccccagggccgggcaggaagatgcgtctgcgcgtgcgggcaggtgtagggggcgaggaggtggggagcggtaggaaggggaagcagcgaggggagaggctg

SEQ ID NO: 32704 - DNA, 308 bp, Homo sapiens
  misc_feature 1..308: note = chr9:129276624-129276932
  misc_feature 1..308: note = hyper
  source 1..308: mol_type = genomic DNA
ctccgcccccaaacacgggttctcacgcggtccggccgcgcgggggcgcccggctccccggccctcgctgggccctgcgggaacgccccggccgcgcactggggatgctcggaccccagcacacacgaggcggagctccgcggactggaggcaaatcaatccctcggcaccgcgctacggacgtgtgtttggaaggaggctagcccgccgcgcaagtccccgcagcgccccgccggcctcccaccccctgcggcgtccggacctcgtggacctggggtggctcccatagactgcggggccgggcccag

SEQ ID NO: 32705 - DNA, 316 bp, Homo sapiens
  misc_feature 1..316: note = chr9:129372722-129373038
  misc_feature 1..316: note = hyper
  source 1..316: mol_type = genomic DNA
ggcagctcatagagccgtgctcgagggaggcgggtagcgcagaggagagggtgcaaggccctaagaagaggagcggggggactagggcggggctcaatggagctggggcgtccgcagactggaaggagccgggacccccgctccagagcctccctttccattctcgcttcttccagtgattccgagcccccgactcagtctttcccccaggtagagagaatccgaggctgtttctgccgctgaaatctgagcgggagagcatcccgaagccgcctgcgtggagcgagcagcccccgcgtcatgggccagaggcgcc

SEQ ID NO: 32706 - DNA, 51 bp, Homo sapiens
  misc_feature 1..51: note = chr9:129373250-129373301
  misc_feature 1..51: note = hyper
  source 1..51: mol_type = genomic DNA
cgaaggacccgagaccggccaactcagctgggagcacgggacacgaggagt

SEQ ID NO: 32707 - DNA, 30 bp, Homo sapiens
  misc_feature 1..30: note = chr9:129374814-129374844
  misc_feature 1..30: note = hyper
  source 1..30: mol_type = genomic DNA
tctgaccaagcctcccgcaggttccaaatc

SEQ ID NO: 32708 - DNA, 256 bp, Homo sapiens
  misc_feature 1..256: note = chr9:129375725-129375981
  misc_feature 1..256: note = hyper
  source 1..256: mol_type = genomic DNA
acctcggccgacagtcgggggttcccaagcggccactcccggccggcgccgtcccctggcggagccgccgcgctccctgccgtccgcgcagtctggcctcgctcggggccactcctcgtagcgctggagctttacaaaatattaataataaagaaggcagaggagaaaaaagaaagccttcgctccccaactcccaaatcaatttttcaagggggtggagcagagggatttgtttcgaagacgatcaaaacttctg

SEQ ID NO: 32709 - DNA, 131 bp, Homo sapiens
  misc_feature 1..131: note = chr9:129376187-129376318
  misc_feature 1..131: note = hyper
  source 1..131: mol_type = genomic DNA
cccgtatccctccgccgccagccccagctctaaacccggcggctcagcgggcgcaccatggcactggagtagcgcggggagcgcgcccggagccccgcggcccgctgcgccccgcccgggaccccgctgcg

SEQ ID NO: 32710 - DNA, 131 bp, Homo sapiens
  misc_feature 1..131: note = chr9:129376549-129376680
  misc_feature 1..131: note = hyper
  source 1..131: mol_type = genomic DNA
cacgacgccggggcccggggccagcgcgtcgccgctccacgatcgccgggggccggcgcaacccctgccctgcgggggccgcgcctccccggttccagggccgcggcggcggagagcgggtggacgggccg

SEQ ID NO: 32711 - DNA, 248 bp, Homo sapiens
  misc_feature 1..248: note = chr9:129377104-129377352
  misc_feature 1..248: note = hyper
  source 1..248: mol_type = genomic DNA
ctagagctgccactccgatgtggtaggtggcgggtggcaggggtgatggaggacctagcaatcaccttggcgagcttgggagaggcgcaaggtcacctggggtgggggagattctaagagaaaaacgtctccctggtcactcaaaccacagattttggggagatcggggatagaagaccacgaacgccaccgtggggcgtgtcagccagcgagcgccccagcctcacctcgcctgtcttggtcccagc

SEQ ID NO: 32712 - DNA, 44 bp, Homo sapiens; identical to SEQ ID NO: 10066
  misc_feature 1..44: note = chr9:129377592-129377636
  misc_feature 1..44: note = hyper
  source 1..44: mol_type = genomic DNA

SEQ ID NO: 32713 - DNA, 188 bp, Homo sapiens; identical to SEQ ID NO: 10067
  misc_feature 1..188: note = chr9:129377772-129377960
  misc_feature 1..188: note = hyper
  source 1..188: mol_type = genomic DNA

SEQ ID NO: 32714 - DNA, 30 bp, Homo sapiens
  misc_feature 1..30: note = chr9:129380664-129380694
  misc_feature 1..30: note = hyper
  source 1..30: mol_type = genomic DNA
tggggcacattgagccgaatttgataaaaa

SEQ ID NO: 32715 - DNA, 137 bp, Homo sapiens
  misc_feature 1..137: note = chr9:129386060-129386197
  misc_feature 1..137: note = hyper
  source 1..137: mol_type = genomic DNA
gccagccctggccagcggaagaaaaaggttagaataattgccttcccctgggcgggagagcttccttcgacgtccggacacgcggatggggcggctttcagcggcctccacccgcgcacccctccaggcccacctct

SEQ ID NO: 32716 - DNA, 193 bp, Homo sapiens
  misc_feature 1..193: note = chr9:129386429-129386622
  misc_feature 1..193: note = hyper
  source 1..193: mol_type = genomic DNA
cgcgctaggctgaagcccggagtccagggccctgcagcagctttcgggcttctcagcgtttcggggacccttggtggctcgggggctctcttgggctggggtcggggtgccccgccaggtggggccttacgcggtccagaaagagccagtgattctccttggagccactgcaggctcccgctggagggagtaa

SEQ ID NO: 32717 - DNA, 474 bp, Homo sapiens
  misc_feature 1..474: note = chr9:129387847-129388321
  misc_feature 1..474: note = hyper
  source 1..474: mol_type = genomic DNA
cgcactcctgcaggtctccagggttggccattcccggctgcatgctcggcccctttcttccgagggtgaattcctttgttccacccccacggaaaccctcttctccgccaggcccgtggcgcctttctcgccacctccgccgccgccgccgccaccctcgtcccaccgtttgcagggctttcctgcggcgctctggccgcagagacccagccctgtctgccgactggcccttcgacgtcgccgccgtgcctgagccccgctgcctgctcggacaagcagaactccggcaggcgcagcgggcgccgaggcttgggctttagccgtggcgctcgcctcggcgcagtggggagccgcgggcgtcggagaagcggccgcgctgttccgggtcactgcaccggctgaaaaaaccaaaagcaaaaccaacacccagaaacgaagcctgcgtgcccccgggggctccgttttgctcccctc

SEQ ID NO: 32718 - DNA, 352 bp, Homo sapiens
  misc_feature 1..352: note = chr9:129388892-129389244
  misc_feature 1..352: note = hyper
  source 1..352: mol_type = genomic DNA
agagactttctccctcgaaacacttgataccaactttgtttttttggcaagaaaaataagccttgtttggaaaggggtgggtggggggcgtcgagcgagcgagggaaggagcaaggaggcggcggcggagcaaactctgcggattaggtttcagcgcctccgccccacccccagccccgcggcggtgatttgtgtgcgggggtctgtgaccctgcaagcatcaaacggcccgcgggaaccggccgagttcagagggacagtgggccgaagggcggcctaagacaacgcagatggttcctatcagcccggccgggcccgcagcgtccgccggtccgtccgggctcctctgcag

SEQ ID NO: 32719 - DNA, 347 bp, Homo sapiens
  misc_feature 1..347: note = chr9:129400848-129401195
  misc_feature 1..347: note = hyper
  source 1..347: mol_type = genomic DNA
agtgattgccaggcccgcttggcagtttttaatcattttatctctgttctcggctctcgggggagacagccagtgcttagcagtctgctcagaaagacctcggggcgcgtggcgcagcggcggctcggagctcccattattagctgtgctcttcggagcgcgctccgatctctcccgggggagccggtgaaaaattaacacgggccggcggcgcgggcgcccgatgtaactgtaattactccattgatattcctcacacaatagcgctgtcatcagtcatttacataaactttctctccccaggacgggcggaggtgcctaatcctattgggcgcttccactgcatg

SEQ ID NO: 32720 - DNA, 93 bp, Homo sapiens
  misc_feature 1..93: note = chr9:129414430-129414523
  misc_feature 1..93: note = hyper
  source 1..93: mol_type = genomic DNA
gattgaaacccaaaccggaggagctgcctgtcacggtgcctgtgatcctgtgatccgaggcatgattgagagggggcgcggcaggagggggct

SEQ ID NO: 32721 - DNA, 640 bp, Homo sapiens
  misc_feature 1..640: note = chr9:129445255-129445895
  misc_feature 1..640: note = hyper
  source 1..640: mol_type = genomic DNA
cctgggatggctccccgggctcccggctgtgcccgtccctccctgtccctggcccgtgacctccagccccggctgggggctcccgacagcgcccctggcgcggatcaaagggccgaggggccggcggccccgcacagctgcgggccgcaggaagcgcaggggcagccctcgctgcaggcccggccccgacgcggcgaggaggccgggggaggccgggaggctgggagaggccccgcgaggcccgcagagcgcgcccgtctcgccgcgcattccagccgcgtgattgacgcgcgtaccggggcccccgcccgcggctcccgccgccgcccgcccggcccgcggccgccgcatcaaagcagatgtttgcagctggtttgagttggatccccatcaacaggcccttttttgtctcaaaataaaaaacagctacgcccggaatgataaggacgcggcaggcacgtgggggagatgtcagcgagtccggcagggaggaggccgggcggctccctctctaagtgacaggctgactctagcagcagcagccgtgacccccagagtgtctagggtcctgtcgcctagctcctgtgaactgcagctcatccttcagccggcatcatcagagccccgtcccgcccacaac

SEQ ID NO: 32722 - DNA, 92 bp, Homo sapiens
  misc_feature 1..92: note = chr9:129485680-129485772
  misc_feature 1..92: note = hyper
  source 1..92: mol_type = genomic DNA
agagccgcctgacaccgtgatatccgcctggctcgctgcgctccgggtgatggatggggcggagctccccaccccccagccccggaacctgg

SEQ ID NO: 32723 - DNA, 245 bp, Homo sapiens
  misc_feature 1..245: note = chr9:130461686-130461931
  misc_feature 1..245: note = hyper
  source 1..245: mol_type = genomic DNA
gggactgggcttggggaggccgggcttccggggctagtaagcgtctactagccgggctgtttagggattggtcgcctctggccctggaggcgggggttcctggagtaagacggttgctgattggctggctttccgaggcggggttgtgaagcgttggtcattctatctgggtgctgggttaggcagtacgaatactaaaattggaaccagtgacacgcagattggtgaagcgttccatatttttt

SEQ ID NO: 32724 - DNA, 30 bp, Homo sapiens
  misc_feature 1..30: note = chr9:130689420-130689450
  misc_feature 1..30: note = hyper
  source 1..30: mol_type = genomic DNA
aggccactcacctctcggagatgcggccgg

SEQ ID NO: 32725 - DNA, 115 bp, Homo sapiens
  misc_feature 1..115: note = chr9:131127226-131127341
  misc_feature 1..115: note = hyper
  source 1..115: mol_type = genomic DNA
gccggcccctccccccgaggagggggccctgcttcctcccggcctaatgatattctgggctcagccctcgtctttggcggcagtttaacccgagccggggcggatttctttctca

SEQ ID NO: 32726 - DNA, 193 bp, Homo sapiens
  misc_feature 1..193: note = chr9:131159439-131159632
  misc_feature 1..193: note = hyper
  source 1..193: mol_type = genomic DNA
ggagttaggtgaaggcgggcactgtcccaggcggagggaacagcgtgctctaaagaagtacttggcgagctcagagaaggaaggaaatttggtgtggctggagcgcagtgaggaaggggaagttccacataaagctgaggtcgaccttgccaggctcttaggctattgggaggatttgcgattatatcctaaa

SEQ ID NO: 32727 - DNA, 345 bp, Homo sapiens
  misc_feature 1..345: note = chr9:131872500-131872845
  misc_feature 1..345: note = hyper
  source 1..345: mol_type = genomic DNA
ggtgctaactgaagccggggtcccccttgtctttcctgggtcgttggaactgaatgctccaggacgtgggtttaatcccgcttctgaccttgcgccccaatctcctgctctgccaaacctgggacgcccgcctgaccccaccccatcagctggaggccgggtcgaacagcggccgcaggacgcggtctccgttcccggacgcaaccgcacggcccgcccaggccgtccagggccctcaggcccgggatccgccgcactcaccacggtcctggcagcgaaggctaacatcttcgctgcccgtccgcggacacgcagtccgctccgccccacacaccgggcaaagtc

SEQ ID NO: 32728 - DNA, 64 bp, Homo sapiens
  misc_feature 1..64: note = chr9:131872856-131872920
  misc_feature 1..64: note = hyper
  source 1..64: mol_type = genomic DNA
cgccgcggctggggtcggtgggtccttgctagagccttcgggccaaggtcgctgagttacagcc

SEQ ID NO: 32729 - DNA, 164 bp, Homo sapiens
  misc_feature 1..164: note = chr9:132020946-132021110
  misc_feature 1..164: note = hyper
  source 1..164: mol_type = genomic DNA
agcgagacaaaggaccgggggaggcggggaacgaagccgggcggaggggtccgcgtggcccgggcggggatgggccccgcgcttctcctgcgagcagggcaccccctcttcctttttattttgaaggaaagggaaaaaaggaattgctacggaaagagaggtgg

SEQ ID NO: 32730 - DNA, 95 bp, Homo sapiens
  misc_feature 1..95: note = chr9:132382260-132382355
  misc_feature 1..95: note = hyper
  source 1..95: mol_type = genomic DNA
gtggggtggtgggtgcggggacacaagggaccaccccccaccggaaatgactcgggcccgccccccgggccccgcggggcctcactcagtggctc

SEQ ID NO: 32731 - DNA, 383 bp, Homo sapiens
  misc_feature 1..383: note = chr9:132382634-132383017
  misc_feature 1..383: note = hyper
  source 1..383: mol_type = genomic DNA
gacgcccaccccgggcttggcgtccccttccggccaccacgcggcgccgccccccgggatcctccagtccccggagccccgcgcgcccagagccgctcggagcgcgggcggggtcagcttgggcagccgcgggtcgctgctgcgtcggaagtctccgtcgccagggagccccttgggcgccaggtcctgggcccctgggcgaagtcgacgccagaacatgcttggccccgcactcagctcaccgcaccctcagcgcgcgtgggtggggggcgccggctgaggtggggagggcatagtccagccccaggccatagtgccccgggcggggcagcgcggtgcggggtgaacgccaccggcccggcggacagcgagtggcttcaggc

SEQ ID NO: 32732 - DNA, 71 bp, Homo sapiens
  misc_feature 1..71: note = chr9:132428052-132428123
  misc_feature 1..71: note = hyper
  source 1..71: mol_type = genomic DNA
ggcggccggggctctcgctccgacccgcgcccgcgacccttcctgggacccgagcccgagacccccgccgg

SEQ ID NO: 32733 - DNA, 256 bp, Homo sapiens
  misc_feature 1..256: note = chr9:132428401-132428657
  misc_feature 1..256: note = hyper
  source 1..256: mol_type = genomic DNA
gatggtgagtacggccggccagggacgggggtggcggggccggggccggggccggggccggggcgcggggtccggggagccggcgcggggcgggcgaagatgcagggcgcgtggtcggcggcaggacttctgggggcgcgtgtaagtgacggtggacggcggttgaccagcactctgggctgggggagggggaccctcttcgggtcttggggtgcgtccccacggggaagtgcgctgccttcgctccccagtattc

SEQ ID NO: 32734 - DNA, 30 bp, Homo sapiens
  misc_feature 1..30: note = chr9:132459828-132459858
  misc_feature 1..30: note = hyper
  source 1..30: mol_type = genomic DNA
tggcgcgcacatggccgggctgggcggcgg

SEQ ID NO: 32735 - DNA, 30 bp, Homo sapiens
  misc_feature 1..30: note = chr9:132805863-132805893
  misc_feature 1..30: note = hyper
  source 1..30: mol_type = genomic DNA
cgagcagagtcagcccgggaggctcttttc

SEQ ID NO: 32736 - DNA, 174 bp, Homo sapiens
  misc_feature 1..174: note = chr9:133308867-133309041
  misc_feature 1..174: note = hyper
  source 1..174: mol_type = genomic DNA
ggcgtccccgccaaccgcaccgagctcagcatgctggagcccgacccccgcagccccttcgcgctgcgtccgctgcgcgcgggccttggcgcggtctacacccgtcgcgcgctcacccgcgccggcctctaccggctcaccgtgcgtgctgcggcaccgcgccaccaaagcgtc

SEQ ID NO: 32737 - DNA, 112 bp, Homo sapiens
  misc_feature 1..112: note = chr9:133320662-133320774
  misc_feature 1..112: note = hyper
  source 1..112: mol_type = genomic DNA
gttatttgttccctgcgcagccgggtcctttctggactccttgtcggatccggcttcctctgtgtcgtgaagcccccacatggagacctggggagtccggagcgtgtggggg

SEQ ID NO: 32738 - DNA, 390 bp, Homo sapiens
  misc_feature 1..390: note = chr9:133534580-133534970
  misc_feature 1..390: note = hyper
  source 1..390: mol_type = genomic DNA
cgagtctttgtacccctgcgtctccgactcggcctttcatctgctccctccacctcggcatcgccttgcctcagtctcccccgacccctgtctcgccccctctgcttccagaagcctgcgcctctgtctctcccaccgcccggtctcctggtgtccccggcgtctctcccgtcgttcccgccgccttgatcagcctgggctgtggcgctggcatcgctggcctggggaccggggtgtgggcgatggaagggggttcgagaggcgcaggggaggggcttcccctcctccgcccctgggcgcctggggagactcgcgtgccagtcacctgccggtcggggcgccgacttcgcgcctacgcactccacgtgggcgccccggggcgcgcctttg

SEQ ID NO: 32739 - DNA, 189 bp, Homo sapiens
  misc_feature 1..189: note = chr9:133535296-133535485
  misc_feature 1..189: note = hyper
  source 1..189: mol_type = genomic DNA
aaagccagagagagacgtgcgaggaggaagcggagagggtgtgcgaagctggagagggagtcggagcgccagcgaaagaggggagcgctggggaaggaggaagagaaggagagggggagaagagagacgcggatgctgggcgcgcgacggcagcgggcggaggaggggagcggccgggaacctgcgcgc

SEQ ID NO: 32740 - DNA, 200 bp, Homo sapiens
  misc_feature 1..200: note = chr9:133535734-133535934
  misc_feature 1..200: note = hyper
  source 1..200: mol_type = genomic DNA
cgcgggacctgcccccgccgctaatatctttttaatgagttcgccaggcttaaagcgagcgcgatctgccctccagggtggattttcccccggcagatgtttcgggaggaggaggcgcgcggagctcccgggaggggggacaaatctctccctccgaggggcgagaacaggagactttcttctaaagttcaaaagaaaga

SEQ ID NO: 32741 - DNA, 149 bp, Homo sapiens; identical to SEQ ID NO: 3472
  misc_feature 1..149: note = chr9:133535971-133536120
  misc_feature 1..149: note = hyper
  source 1..149: mol_type = genomic DNA

SEQ ID NO: 32742 - DNA, 196 bp, Homo sapiens; identical to SEQ ID NO: 3473
  misc_feature 1..196: note = chr9:133536149-133536345
  misc_feature 1..196: note = hyper
  source 1..196: mol_type = genomic DNA

SEQ ID NO: 32743 - DNA, 184 bp, Homo sapiens
  misc_feature 1..184: note = chr9:133536346-133536530
  misc_feature 1..184: note = hyper
  source 1..184: mol_type = genomic DNA
gcgctccgccctgagcggggcaacaactagaaattagccaaccccgggcggctgccgggccctgagactgtcttgcccgccccggcccagccacccctccgggtcgcccctgctcttctcctccacttccccttcaatgtccctccgtggggccgtcggcctgccgcggcggccctctctccac

SEQ ID NO: 32744 - DNA, 607 bp, Homo sapiens
  misc_feature 1..607: note = chr9:133536777-133537384
  misc_feature 1..607: note = hyper
  source 1..607: mol_type = genomic DNA
tcaagtcctacgagccgcccacaatggaccgatatactgagggcctctctattaacgcccatgaatattaaagagatcgccaagtggcggccagcgggcgaggggggcgacggagcctgagagctccggcccggccgaggggagggggcttttgcgcgagcacattccgcgcctgggccccgcggaaaatgacaaaataacacgggtcatccgctgggaaagcccggaatgtttcccctcgaaatctcctcccggggagatgtgagcacagggtcttgctccctatttcaatgcaccttgagactgggcgctacctacgggctcctttttccccgggcgggggtccaggtgggttttgccgctagactagaagcacaaaatgtgagcgcggtggagatttgggcgcaccagctgggaggacgttctgcgctccgcttctgcccggctcccagtactgctctccgggcttgcgggtccggaggagaggaatgggactccctggccgcagtccgagcccgtggtcactgcgccagcggaatccaagcctctaactctaagccggggttcaggacccaaacgctgcaccccagcacggaggatgcacaga

SEQ ID NO: 32745 - DNA, 1620 bp, Homo sapiens
  misc_feature 1..1620: note = chr9:133537600-133539220
  misc_feature 1..1620: note = hyper
  source 1..1620: mol_type = genomic DNA
tggaggaactgaggtcgctttcggggcttgggagctgccgcagcgcttggctcctggcagcgctccccgacgtcgtctccctcgctcctagcactttgtcctctccacctaggtcttcccagaagccaagaagtaggccccggtgaggctcccctgcaggagccatcggactccatacgccccctcagactcgagctctggccagggagccgatgcgacccacaagctgcgtcgaaaaatgagtggagggttcggcgaccctaacccacctccctcctcagcagcgctgccctctgctggcgccctgcccaacggtcctgccttctgccaggtgtgcccttccttgggctccagcctcgggcggacccggacgcagggtctgaaggccagctaccgccgccttcctccctttgcgtcccaacggggacgggggatgccggagactactggcaggaactggggaccaggggtctggagtctggacgccaggtgtgagaccctcttagccaaggcgcgtccgggtggtggaggggcgtctatgccaacaggcgtttggacagggtctcgctcatgggaggtcagctcgctgttcttccacccaagtcctccgcgctgaggagaaggtctagggagtccacacagtccagcggagactaatccgtgagcctgacccacgccgagagggtccaggcacctctgttagcggcatctgaaattgtaggctggtgatgggagccagaagtgcggcaggtggggtgagctccctcacccagcatgtcagggcctggggtccgaggcttgaggctgacactggggagccgcgaagcctgcaggaagcggggccttccgctgggctcagcagctacctgcttcgggagaggggatcgctgggctccgaggtgcctcgaaaccgccgcaaagcaagtctgctcctgggatgatgggcaggaggaatagaggagaggaagggaaagaagagagaggcagaggagaaagaaagaactaggaggcaagaaggaaggggcgccgcaacgccaccggcttcccgaggttgcagctcagcaaggagccggaaagccgggccgcaagccgaacccgcactgaggcctctcgcggagctgcctgcagtttctgagggacttcgctctcaggcacgcctgctcccacctaggaagggtctcgggacccctttcaatccccctatatcccgtaggaaattcttttcccagagacaggctgccagggcgattcctgtccgcccatctcgacccccgacctggccccgcaagggccgggagcctggccttccatgaagctgtctcaggccgggaccagccccagccccgacggccgctgcggccccgcctcggcagccccgtgagcccgcggaggagtttcgcacccgaccgtgcacagcgaccgagttggcgcggcccgtatgaagcgaagcgccggcttcagcagcgcagtctgagcaggggatccgcgtggcaactagggctgcgcgcgagctcggggcgactgtggcggcccggggagtgcagggccggagagggaagaggacgcgggctctggccggggagggagagcggtgcagggctgggccggccagccggggca

SEQ ID NO: 32746 - DNA, 553 bp, Homo sapiens
  misc_feature 1..553: note = chr9:133539679-133540232
  misc_feature 1..553: note = hyper
  source 1..553: mol_type = genomic DNA
cgagaggctagcgcgcgcctgagccccttgctgccgcttccctgcaaccacccgcctctcacccaccctgcaccccccgcacccgcctccgcctccacccgcgtctctccaccctccgcgccgcctttgccatctctacagatttcaccatctctcttcccctctccccctcgttcgctttcctcccagtcgccccctcacctcccgctccctcctgcgtcctcctcctctccgtcctccccctgctctggttccttctccatcgcagcgctctcctctcgccccttgggctcccctctcgcccgcccacctcccccgtcggcccggccgtcccccggcgccggggagctccgggccgcccatgatgggctccgtgctcccggctgaggccctggtgctcaagaccgggctgaaggcgccgggactggcgctggccgaggttatcacctccgacatcctgcacagcttcctgtacggccgctggcgcaacgtgctcggggagcagctcttcgaggacaagagccaccacgccagccccaagacagccttcacc

SEQ ID NO: 32747 - DNA, 37 bp, Homo sapiens; identical to SEQ ID NO: 10093
  misc_feature 1..37: note = chr9:133540453-133540490
  misc_feature 1..37: note = hyper
  source 1..37: mol_type = genomic DNA

SEQ ID NO: 32748 - DNA, 386 bp, Homo sapiens
  misc_feature 1..386: note = chr9:133541079-133541465
  misc_feature 1..386: note = hyper
  source 1..386: mol_type = genomic DNA
ggagccgaatgaatgcgatcactttaacagcgtgacaaattgcccgccgcgccgcaatggacaccgtttaacccccccctttcagccggcccgctcgccgggtattttcccaggtagcttagaggggaaccttgtaagacatggaggccgcccttgtgcgcctcgccgcttccagccctgccgcagatgcccgacaggggaaccctcggggagctgggggccgccgcggctcctccccgcccagagagatgacatcggggtttgtctgagcccgggcgccgccctccctggcaccccagggcctgggagcagagagggactcgggcgcgcccggggtcacacagcgagcgcagagcctggccagctgctgccggtgcttctttggc

SEQ ID NO: 32749 - DNA, 757 bp, Homo sapiens
  misc_feature 1..757: note = chr9:133541665-133542422
  misc_feature 1..757: note = hyper
  source 1..757: mol_type = genomic DNA
attcttaaacttatccggggcagaggatggaagaagttgcgaatgctttgagaattcgcggagagactaaaaacccacttctaaaaatgatccccaacgcaccactcgctttccagggcacggagggtctccaggttgcaaacagaggagaggtcgttgagcctccgcacatccgacttcctccacacccgggtggcttctctggatttggggccgacttgggtttggctggtctgggcaggaccgaagccggggtcccggcggggaaggaagggccgggcctcggctgcctcgggctctgaccggttttcctggccccgccgccgcagaagtgcagaagctgtccagcctggtgctgcctgcggaggtgatcatcgctcagagctccatccctggcgagggcctcggcatcttctccaagacgtggatcaaggcgggaaccgagatgggccccttcaccggccgcgtgatcgccccggagcacgtggacatctgcaagaacaacaacctcatgtgggaggtacgcgcgggctggggcagaggggcgcaagggccggcgaggggcgctggtcgcgggtaggactcgggcgtccggccgtcgccgcttccacccgggctgagagcggcggacactcctggcctggacgccccctgagccgggactctaagccgcccgagcctggagctcaccccgcctctaggctcctcccaacccgtgccgaaaatccgaccctccttcccccggacaccctggcag

SEQ ID NO: 32750 - DNA, 42 bp, Homo sapiens
  misc_feature 1..42: note = chr9:133884491-133884533
  misc_feature 1..42: note = hyper
  source 1..42: mol_type = genomic DNA
ccagcctccccgccccgcaggggaaggcgggtcctggcggcc

SEQ ID NO: 32751 - DNA, 30 bp, Homo sapiens
  misc_feature 1..30: note = chr9:133884902-133884932
  misc_feature 1..30: note = hyper
  source 1..30: mol_type = genomic DNA
cctggtggcagagcccgtccatggccttcg

SEQ ID NO: 32752 - DNA, 546 bp, Homo sapiens
  misc_feature 1..546: note = chr9:134151976-134152522
  misc_feature 1..546: note = hyper
  source 1..546: mol_type = genomic DNA
tgacttcctgccctccggccttccgcacgcgctccctccgggccccgcacccgcacccgcccggcgcggtcgaatcaattgcagagcagtttgtgttcacccggccgaggtcccggcgccctcggggcgagcgccgacccgcggcttccaggaggcgagctcagggctccggccgctcgccggtgacgggggagcgcggcgcgggtccccgtcggcgcccactcgcgggcgcgggccggacgtccccacgcaggggcgccgcgtcccttcgccgctgtcgctgccggccgccgtgcagggtcccggggctgcgctccggccgccgccgcctgcttcgccgcggccgccgaggacctggtgggaggtggaagggacagcgcgtcaaggccagcctcaaagttaagccgaactttgctgcggggggcgcgcgggggcggcgacgcgtgtgcgctgggcgcgggctgcggagctgacggcgcagctctgggcggtctccccggaggcggtggcccccgccccccgcgcccgccccgtcagtggcggccg

SEQ ID NO: 32753 - DNA, 225 bp, Homo sapiens
  misc_feature 1..225: note = chr9:134158243-134158468
  misc_feature 1..225: note = hyper
  source 1..225: mol_type = genomic DNA
gcccaacgccggcaccgcggagctgcagcgcgctcagcaccgccccgcccaccccgacgccgcccctctgcacccgctcaccaccagtcccacccagcagcctccgtccgagaggtcagaagcccacgagcaggagatgccagtggggggacgcgggcaaccccggccgggccaggggcgcgccgcccaccaacacgccccgcggtcccccgccccccgccgccg

SEQ ID NO: 32754 - DNA, 32 bp, Homo sapiens
  misc_feature 1..32: note = chr9:134421906-134421938
  misc_feature 1..32: note = hyper
  source 1..32: mol_type = genomic DNA
cccctcatcccccagcgcgactgatcttgaga

SEQ ID NO: 32755 - DNA, 84 bp, Homo sapiens
  misc_feature 1..84: note = chr9:135036830-135036914
  misc_feature 1..84: note = hyper
  source 1..84: mol_type = genomic DNA
ctgggcgcagggacccgctggcccccgggccgggaggcgatgtttaggcagcgaccccccagaggctgccggggccaccctggc

SEQ ID NO: 32756 - DNA, 154 bp, Homo sapiens
  misc_feature 1..154: note = chr9:135037134-135037288
  misc_feature 1..154: note = hyper
  source 1..154: mol_type = genomic DNA
ggcattaacttggagcggagtgcaggggggcagtgaagcgcccgccatctggcccgcgccgcgccggggggatgccccggctccccgacgagacgccgcgaagcccacccgggccgggggctgcccggcgcccgagcgcgggtcctccccgggc

SEQ ID NO: 32757 - DNA, 15 bp, Homo sapiens
  misc_feature 1..15: note = chr9:135037333-135037348
  misc_feature 1..15: note = hyper
  source 1..15: mol_type = genomic DNA
cgctcagcccgggcg

SEQ ID NO: 32758 - DNA, 111 bp, Homo sapiens
  misc_feature 1..111: note = chr9:135038352-135038463
  misc_feature 1..111: note = hyper
  source 1..111: mol_type = genomic DNA
cgctccggagtaagttggccgtctgggctgggggcggcggcggccgggtcgccacaggcggcagcgccggggcaaaggatacagccagttcctgggcgccctgctctgtgt

SEQ ID NO: 32759 - DNA, 153 bp, Homo sapiens
  misc_feature 1..153: note = chr9:135116312-135116465
  misc_feature 1..153: note = hyper
  source 1..153: mol_type = genomic DNA
gataggctccgtgcacgaccggtgcaacgagaccggcttctgcgagtgccgcgagggcgcggcgggccccaagtgcgacgactgcctccccacgcactactggcgccagggctgctaccgtgagtgcgcgccgtcccccgtgggcggggcctg

SEQ ID NO: 32760 - DNA, 30 bp, Homo sapiens
  misc_feature 1..30: note = chr9:135118020-135118050
  misc_feature 1..30: note = hyper
  source 1..30: mol_type = genomic DNA
gaggcccggtgaccacggaactcaccgtct

SEQ ID NO: 32761 - DNA, 47 bp, Homo sapiens
  misc_feature 1..47: note = chr9:135285476-135285523
  misc_feature 1..47: note = hyper
  source 1..47: mol_type = genomic DNA
aggggccggcgcgagcggggcgcgcctggctccggaggggtcctggc

SEQ ID NO: 32762 - DNA, 134 bp, Homo sapiens
  misc_feature 1..134: note = chr9:135285731-135285865
  misc_feature 1..134: note = hyper
  source 1..134: mol_type = genomic DNA
tcagccaggtctgcccgcccccgcggcggcccctgaccgtggcggacatccgttccggcatggagaacgagcggctgggggtcgtgcgggactccatgtttcagaaccctctcatcgtcaaggtgagcacccca

SEQ ID NO: 32763 - DNA, 169 bp, Homo sapiens; identical to SEQ ID NO: 10098
  misc_feature 1..169: note = chr9:135285880-135286049
  misc_feature 1..169: note = hyper
  source 1..169: mol_type = genomic DNA

SEQ ID NO: 32764 - DNA, 41 bp, Homo sapiens
  misc_feature 1..41: note = chr9:135286274-135286315
  misc_feature 1..41: note = hyper
  source 1..41: mol_type = genomic DNA
tgcacgcctggggtacgtctatgcagcggtggctccgtgtc

SEQ ID NO: 32765 - DNA, 30 bp, Homo sapiens
  misc_feature 1..30: note = chr9:135287745-135287775
  misc_feature 1..30: note = hyper
  source 1..30: mol_type = genomic DNA
ccttcgtgggttcttcggggtctttaaggt

SEQ ID NO: 32766 - DNA, 253 bp, Homo sapiens
  misc_feature 1..253: note = chr9:135454991-135455244
  misc_feature 1..253: note = hyper
  source 1..253: mol_type = genomic DNA
tgggaatcccgaaatcggaataaaacgatgttattgagagagggctaaatcccagagtaaatttcaaacgaaataaatcgcacagcacattttagatgataatagacggcggtaactcaatactaatgatagtgtactgacaacccgctaatagtcttgggctccaagaagcccggcaaaaccggctggggcggcaggaggtccggctttggtgttctttcccaccgggagaggttggagccaccctcactcc

SEQ ID NO: 32767 - DNA, 737 bp, Homo sapiens
  misc_feature 1..737: note = chr9:135455287-135456024
  misc_feature 1..737: note = hyper
  source 1..737: mol_type = genomic DNA
cgctttcgctgggtccgggatccaaatcccaacccaagagccaaaggccagaaaaggccctggcgttgccagctgcttgtcgccctggggaggggcggctccggacccgcccggggcagaggaggacagagcggacgctctggggaccaggcggtcccgcgcatgcttggccaggggcatcgccgtggctaacaggggggttgtgtggtggcgggggctcgccgtcgatctaagtgaggatctcggtgctccgaggaagatgagattcctcaggggatgcgggcgcaggcctgggaggagtgggtgatggggagggaagtggggtctccagagacgcccagagcaggagcaaggccaggctggggactggactggaagagccagggcagccggctctcctcgtgatttatgggcccctcctcatccaccaaactgaaatgagctgccggcccggaccgccgcgggaggtgcccactgcagtggccgccgccgatccagagcctgggcccccgccctcccgcctccccgacagcttgcagccgagccgggccactgtcccccgggagccgcccgtcctcacccccagcccggccggcggcggggccgcttccaatctgccggcgggcacagggggagagcgccgggagccgggcgcggggccaccgccgacctagcccgagggaggagaaagtttttgctcctcccgaccacgccaggctgcccccgggagaattctg

SEQ ID NO: 32768 - DNA, 126 bp, Homo sapiens
  misc_feature 1..126: note = chr9:135456079-135456205
  misc_feature 1..126: note = hyper
  source 1..126: mol_type = genomic DNA
cgacgtaggagccggggtagtttcctgggggctgggggtggtggcaggggcgtgcaggccgggctggaaaggcctggcttcccgagcctgcggggggtaaaaggacgcctctgacccgcccgacct

SEQ ID NO: 32769 - DNA, 140 bp, Homo sapiens
  misc_feature 1..140: note = chr9:135456234-135456374
  misc_feature 1..140: note = hyper
  source 1..140: mol_type = genomic DNA
cgccctttccgccgcagacccgggttgcgatccctggggctgtgcagagaggatccaggcccgggacacagttcggatctgcccgcggtcctgggccccaacgccgggggctgaccctagaaaggcgctggactggagcc

SEQ ID NO: 32770 - DNA, 139 bp, Homo sapiens
  misc_feature 1..139: note = chr9:135456760-135456899
  misc_feature 1..139: note = hyper
  source 1..139: mol_type = genomic DNA
ggctttccccactcccgccaggcccacagggtcccaagaggccagagagacaggactgcaaattgtcctacatgggaaacaccgagagcccaacagaaatgccgcaaacaacataacttgaattttcttccccacacta

SEQ ID NO: 32771 - DNA, 738 bp, Homo sapiens
  misc_feature 1..738: note = chr9:135456959-135457697
  misc_feature 1..738: note = hyper
  source 1..738: mol_type = genomic DNA
cacacacacaccacacttcttcctccgctggttttagtccctttctgctgctggaggaagaaaaacgggggaaggaaaaaggatctacaatagacctgccgacgaataatttgaataactgtgggaaagggtcggggaacgctaaaaaaaaaaaaaaaaagcccagcgcacatcccagcccaccgcagcgcagtcggctcggccccctcccctccagccgtaccccccttggctaatcaccctcattaggagcttcgtcaccggcctaatgaaagcaaaccgtgtggaaatcgccggtaaacagttgggtctgtgctgtaattaattcggtgtctcttttaatcaaactgaaagggaatcgggcagcggcttgcggagccgtgacatcacccccaaaatcggccagagccaatcagcgtcatcactccggggacacgtgggcgagtccccttaaaaaaacacacacaacacaacgaaaaaaaagaaacaacaaaaaaaaacccagacccaaagtaaaagtgacacaagttcattttttaaaggaagggggggaggagaaggcgcgcgcggaccggcagagagctgccgccgaggagcagggaggcgctgtccacggtgctgacgggcccccggagcggcgagggcgcggagagaggacctccccggccaggtggagagtcatgagccgcgggcagccgccgccgctctccgcggtgctgatgccgccaggtgcgctcc

SEQ ID NO: 32772 - DNA, 102 bp, Homo sapiens
  misc_feature 1..102: note = chr9:135457946-135458048
  misc_feature 1..102: note = hyper
  source 1..102: mol_type = genomic DNA
ctcggctcggcggctcggcgcgatgctgcagaagacgcactgagcccttttggatctaatgcgcagaggaggttggcccagagctcccgggctcccccaagg

SEQ ID NO: 32773 - DNA, 32 bp, Homo sapiens
  misc_feature 1..32: note = chr9:135458408-135458440
  misc_feature 1..32: note = hyper
  source 1..32: mol_type = genomic DNA
ctcccacctgcagcccgggcagctctcagccc

SEQ ID NO: 32774 - DNA, 191 bp, Homo sapiens
  misc_feature 1..191: note = chr9:135458456-135458647
  misc_feature 1..191: note = hyper
  source 1..191: mol_type = genomic DNA
cgtcacctcctcctttctgatcagggacatccttgccgactgcaaaccactcgcggcctgtgcaccctactctagcagcgggcagccggcagcccctgagcctgggggccgccttgcggccaaggccgcggaggactttagagacaagctggacaaaagtggcagcaacgcctcatcggactctgagtata

SEQ ID NO: 32775 - DNA, 159 bp, Homo sapiens
  misc_feature 1..159: note = chr9:135460044-135460203
  misc_feature 1..159: note = hyper
  source 1..159: mol_type = genomic DNA
ccccacacaaatggccgagcctccttcagccaggctgtgccgaccatgcctggaaagtaggcaggtttaacggagcggccaggaggagatccagaggcatgcgggtgtccccaggcccgggcccagtggtccttgctcctcccccggggggcctgctta

SEQ ID NO: 32776 - DNA, 30 bp, Homo sapiens
  misc_feature 1..30: note = chr9:135461292-135461322
  misc_feature 1..30: note = hyper
  source 1..30: mol_type = genomic DNA
tgagatttggatgatcgtttcctcaaactt

SEQ ID NO: 32777 - DNA, 537 bp, Homo sapiens
  misc_feature 1..537: note = chr9:135461541-135462078
  misc_feature 1..537: note = hyper
  source 1..537: mol_type = genomic DNA
tcagttgaaaagtctcgatccctaacggctcaattaaccggattattgtttcctacagagagaaatcaccttgcattcagctgaaccccgtcactgcaaacgccacgcacaatgaaactccaccataaaagaaaacagagaaaaaagggagtaggttgggggaaagccccagtctgagccgccaattttggggaagtggtctagctggttatataatcgctttagagggagaaggagggtgagcattgagcttgttcgattaagtgttttctgtgcagtcaaagccgaacgaaagtgtctgggataaagaaactacctgtgccaggtctatccttcgacctcaggagctgggcccccggtgtaattctgtcccgactgtggggtgtaaacacacgatgccacgcaggtgtagcaggagccatcgttagcgggcaatgtaatgacaacggaacgcagacctgggcaatgcgcgctgcgcccaaggggcaagcgagtggcagggtcgcttattctcccagtgctcggcgctcgcagacc

SEQ ID NO: 32778 - DNA, 301 bp, Homo sapiens
  misc_feature 1..301: note = chr9:135462647-135462948
  misc_feature 1..301: note = hyper
  source 1..301: mol_type = genomic DNA
cgggcaggagcgggagggcaccggcggcggctgcgaggccgggccctgacatgccgctgtgtccgcagtgaaggaggagggcgaccgcgagatctccagctccagggacagtcccccggtgcgcctgaaaaagccacgcaaggcgcgcacggccttcaccgaccatcagctggcgcagctggagcgcagcttcgagcggcagaagtacctgagcgtgcaggaccgcatggagctcgccgcctcgctcaacctcaccgacacgcaggtcaagacctggtaccagaaccgcaggtgaggcctg

SEQ ID NO: 32779 - DNA, 175 bp, Homo sapiens
  misc_feature 1..175: note = chr9:135464001-135464176
  misc_feature 1..175: note = hyper
  source 1..175: mol_type = genomic DNA
acagtgcgcagggctcgcagtgcgagccctggaggatggcaggtgcagcctgctccagccggcagggcgtgcgagccgggagcgggtcctctccggttgccatttcaggcctgctcgcttctgctagcttgcagcccggccagcctgcagaggaatcaatcgcattcccttccct

SEQ ID NO: 32780 - DNA, 189 bp, Homo sapiens
  misc_feature 1..189: note = chr9:135464750-135464939
  misc_feature 1..189: note = hyper
  source 1..189: mol_type = genomic DNA
gcgctctacctgtaccgcggccccagcgcgccgccgcctgctctccagagacctctggtgccccgcatcctcatccacggactccagggcgccagcgagccgcccccgccgctgccccccctggccggcgtcctcccacgcgccgcgcagcctcggtgaggcgcccgtcggctccggggcctcctcccg

SEQ ID NO: 32781 - DNA, 834 bp, Homo sapiens
  misc_feature 1..834: note = chr9:135465231-135466065
  misc_feature 1..834: note = hyper
  source 1..834: mol_type = genomic DNA
ccccaggagcgggtgcggctgattcccaggcttcgctctctcccacgccccttctacgctccaggtggagaacagcccctctccccgcgcccccgccagggagagaaggggagtgcggagccccgtctccctacccctcgagcacctgggccagcggctgagctgtacataccgtgtgcaaagtgtatatgaagttatttattcgtgacccatgagcccgtgaccgtgtccgtggattagtgagtctgtggcctgtgccctccccactcccaggcggggcaggaaggggccaagggggcttgcccacccaccccgaccccagcccccagcctcagccccggtccgggggcagccaggcctctcgggttctctcttttttaaatgtcgaaataaacttcttacaaatgaccaggcgcctgtccgcgctcgcgtcgctgggtccgcactcaacccctctcccatccctctcctggggactcggtttccttccatcctcaataacgaaacatttttgtcccccttctcttccccggtgctgtggacatgcgcgggggccccgacgggactcgctggggcccgggtctcccctccctggcctcagtcttcccatctctacagcgaggccagctcgttgttcccctcctcctcctctgtctccatctggttcctagcggctcccagacggtcccgagggccggggcgggggtccgtgccggaacaggcgggggtcagcgcggggcctcggtcggctgcgggccgggctgcggggccctcgccgagccgactcatctggccgcgacaagggccccggcagctggtgaccggcccgccggg

SEQ ID NO: 32782 - DNA, 488 bp, Homo sapiens
  misc_feature 1..488: note = chr9:135466117-135466605
  misc_feature 1..488: note = hyper
  source 1..488: mol_type = genomic DNA
cgcccagcgtccggccgcgctcgggctcccgacgctcgcgggcgccaaggcggcccgggcctcccggcctcccgcaccaggcaggactccgcgcgccttcgctgcgaaccagacgccacatcgggtaaacccccactcccacatcttctcacctcccctttaccccgggaggaggttggaaatgagacccagaggggagccaaatcccagcgtctgccccatctcttctggctgccccagaccgcagctctagcatctcaggggagaggggtttaagtcccgagtcagactcgaggcttccagttcacgtccaaagggccacggtcacctgagactgctccctctctggggaggtgggcgcaggtgctcccttcccacacaccacctgcagctcgctaaccctcagcgctgggaagttttgggggccggcaagccgtggcccctctagtttgggggcagggtttctctgaagacgggggctgtgttca

SEQ ID NO: 32783 - DNA, 280 bp, Homo sapiens
  misc_feature 1..280: note = chr9:135645863-135646143
  misc_feature 1..280: note = hyper
  source 1..280: mol_type = genomic DNA
caccctgtggaggagcgggctgggagcgcgggggatgcccctcgccctgcacgcgcgccctgcccctggctgtaacctgagcagcccgcgtgagggtcagtggtgacttccgggattgaattggctgggaagccggtcccatttcaacagagacctggggcagcgcggtgggcagcgggctgggccgagatcgagaccgggacaaggcagggaagagcgggatgggtcggccccttcaaggggagccctggggcgcagtgtggggcggtcttgctccctg

SEQ ID NO: 32784 - DNA, 456 bp, Homo sapiens
  misc_feature 1..456: note = chr9:136038991-136039447
  misc_feature 1..456: note = hyper
  source 1..456: mol_type = genomic DNA
ccgccggccccagtccgtggtcgggacccgggaccctgggtccgagatgcgcacctcctgggctcagggccctcctccttggccccttgcgtggcagggactgggtggggccaagggagcgcgactgtccctacggggtgcagacttactccttgctgccggcccggcgttaggacggttggaggggcgccaccccggcgcggaaaacggactcagctggcctgggcccccgcgatacccgggcgatcggcggcgcaggtggagcctggagcagggcaggcagcggggccgcgggccagacagaaaagaggaagacagacaggaaagaggacagaaaagagaagccagacgggaaagagggcgccgcagccccgcccacctaccgcaggccccgcccctgcggtcccagagccccttccctgcggcctgggagcaggatcccgggggaccgagcgc

SEQ ID NO: 32785 - DNA, 55 bp, Homo sapiens
  misc_feature 1..55: note = chr9:136400112-136400167
  misc_feature 1..55: note = hyper
  source 1..55: mol_type = genomic DNA
ggggtaggagcaccccgcgccctctggagccgttacataacgtggggaggcttgt

SEQ ID NO: 32786 - DNA, 131 bp, Homo sapiens
  misc_feature 1..131: note = chr9:136474260-136474391
  misc_feature 1..131: note = hyper
  source 1..131: mol_type = genomic DNA
cgggcgtccgacccgggcagggcgcagctagcggcggccgctcatgcccaggccacggcggtggcgcctggtgtggctgggcgggcgaggcgggcgctgagaagcccgggaggcccccggggaggcgactg

SEQ ID NO: 32787 - DNA, 161 bp, Homo sapiens
  misc_feature 1..161: note = chr9:136474431-136474592
  misc_feature 1..161: note = hyper
  source 1..161: mol_type = genomic DNA
cgcgactccggacgccccggctggctccctgcgagctgcacgcgcggctccagcctggtcccgagcgcagggcgcgcgctggcggggagggcgcgcgcccgagcctggcggggagcgcgcgtcaccggcccgcgcgcgcagtcgtcgggggatgccgggag

SEQ ID NO: 32788 - DNA, 30 bp, Homo sapiens
  misc_feature 1..30: note = chr9:136603602-136603632
  misc_feature 1..30: note = hyper
  source 1..30: mol_type = genomic DNA
agctccctctgagggcggcagagcagggtt

SEQ ID NO: 32789 - DNA, 30 bp, Homo sapiens
  misc_feature 1..30: note = chr9:136658309-136658339
  misc_feature 1..30: note = hyper
  source 1..30: mol_type = genomic DNA
cttcagtccagaaaacgcagtgtccagacc

SEQ ID NO: 32790 - DNA, 90 bp, Homo sapiens
  misc_feature 1..90: note = chr9:136931060-136931150
  misc_feature 1..90: note = hyper
  source 1..90: mol_type = genomic DNA
tgggtatgactacttcggagtgtagggcaggcactgtttgcaagtcccgtccttcattcaaagctcactcacttccgaagcaggcgcgag

SEQ ID NO: 32791 - DNA, 39 bp, Homo sapiens
  misc_feature 1..39: note = chr9:137295661-137295700
  misc_feature 1..39: note = hyper
  source 1..39: mol_type = genomic DNA
tccccttgacattggcgaggtccccggggtgggtgtggg

SEQ ID NO: 32792 - DNA, 37 bp, Homo sapiens; identical to SEQ ID NO: 10113
  misc_feature 1..37: note = chr9:137299217-137299254
  misc_feature 1..37: note = hyper
  source 1..37: mol_type = genomic DNA

SEQ ID NO: 32793 - DNA, 30 bp, Homo sapiens
  misc_feature 1..30: note = chr9:137533003-137533033
  misc_feature 1..30: note = hyper
  source 1..30: mol_type = genomic DNA
taacccagatgttcccgtccaagcacatgg

SEQ ID NO: 32794 - DNA, 42 bp, Homo sapiens
  misc_feature 1..42: note = chr9:137533555-137533597
  misc_feature 1..42: note = hyper
  source 1..42: mol_type = genomic DNA
gcgggcgttggggatcgacagcctccgcggctgccttccagg

SEQ ID NO: 32795 - DNA, 148 bp, Homo sapiens
  misc_feature 1..148: note = chr9:137533819-137533967
  misc_feature 1..148: note = hyper
  source 1..148: mol_type = genomic DNA
aaagtcgagccctcccgcccgtgggcgagcgcgccagccgccccttccagaacagccgccgccacaaagaagaacggggggtgccgaggtccccatgacctcctaaagtggtgcggtccctgctgagtgcgctgcccgggccgtgacc

SEQ ID NO: 32796 - DNA, 493 bp, Homo sapiens
  misc_feature 1..493: note = chr9:137534065-137534558
  misc_feature 1..493: note = hyper
  source 1..493: mol_type = genomic DNA
cgcgctccgcccgggcgccccgctgctgcccccgctgctgctgctgctgctgtgggcgccgcctccgagccgcgcaggtaagggcgccccggggcgcggggctgcgggatggggcgcgcgcagcccgggcgccgctgtcatccccgggcgccttcgcccgcagaacttttcttccttggcctgtggaatgcacgggccaagaccacgaatgccatttgctgggggcccccccgagatgacgacacgcagacacaatgcccgcgggcgcgccgccgccccctccccagacgggcgggtcgggtggggctgtcgcgcgagccgaggaaggaccgagggctggatcagcaggaggggttgtccacgaggcgggcaaacttttgtcccaaaaaccttccttctctgtcccacatcacaggcgcccagcttgggccctcacagccctacagcagaacttcctctgctccaaaccgggcagggccgccccctagagtta

SEQ ID NO: 32797 - DNA, 170 bp, Homo sapiens
  misc_feature 1..170: note = chr9:137967194-137967364
  misc_feature 1..170: note = hyper
  source 1..170: mol_type = genomic DNA
acttttggcacccaccgcagcccagcgcgcgttcgtgctccgcagggcgcgcctctctccgccaatgccaggcgcgcgggggagccattaggaggcgaggagagaggagggcgcagctcccgcccagcccagccctgcccagccctgcccggaggcagacgcgccggaac

SEQ ID NO: 32798 - DNA, 179 bp, Homo sapiens
  misc_feature 1..179: note = chr9:137967472-137967651
  misc_feature 1..179: note = hyper
  source 1..179: mol_type = genomic DNA
ggagccagcggagccggggccagagccggagcgcgtccgcgtccacgcagccgccggccggccagcacccagggccctgcatgccaggtcgttggaggtggcagcgagacatgcacccggcccggaagctcctcagcctcctcttcctcatcctgatgggcactgaactcactcaagta

SEQ ID NO: 32799 - DNA, 243 bp, Homo sapiens
  misc_feature 1..243: note = chr9:137967688-137967931
  misc_feature 1..243: note = hyper
  source 1..243: mol_type = genomic DNA
cggcccggcccctcgggagccccacaaagtccgggaacggctctggctccgcgccgccccgcgcccccggcctgggcgcccgaagtgccggggttggggagggggccagggcgctaggctggacctgggtgggagggaggggtgcaggctgaccggagacggcgctcctccagccccggctcagcagagctgacagctgccccctttttcctaggactccgctgcccccgactccctgctgag

SEQ ID NO: 32800 - DNA, 180 bp, Homo sapiens
  misc_feature 1..180: note = chr9:137979493-137979673
  misc_feature 1..180: note = hyper
  source 1..180: mol_type = genomic DNA
gcgcagcccgcgcagcgctcagagccggacggcgcttcccggtggcggcggaggagcccggagggacgcagccgggcaaggcagggcgcagggcgggcggcgcgaggcgcagggcgcggcgggcagaggccacctggccaccttccctggcgcccggggaaggcgcggcgatggccgggg

SEQ ID NO: 32801 - DNA, 167 bp, Homo sapiens
  misc_feature 1..167: note = chr9:137979977-137980144
  misc_feature 1..167: note = hyper
  source 1..167: mol_type = genomic DNA
gcaccggcgtaagtgcgcccgccggccgccttggcgcggctcctcctcctcctcctcctccccctcctcggtccggagccccgggctgggcgggcgccgcgcgggacccgagtcgcccagggaggcggcggggagcagggcgggcaagggcaggcgtcgcgggccgg

SEQ ID NO: 32802 - DNA, 756 bp, Homo sapiens
  misc_feature 1..756: note = chr9:137980216-137980972
  misc_feature 1..756: note = hyper
  source 1..756: mol_type = genomic DNA
cggcgtttccttcgtctgggcccctcgccgcggggccgggggagcttggtgggttctcggaggcttggagtcctgggtcagtaatcatgagccccccattgaaaaggttaggaaactaaggctggggacttggggacttgtccaaggtcacactcagcgagtgaggggtggagccgccgctagaccctagtctgggctcggtccagcggggactgagcccgccctagtttgtaaaagccagactggccggaccgggctgggagtggggccccagccggtgggctccggagctcctgcccgcgcctgcattcccaaagtcccaaggcgccctttcctccccagtccataggagggtttgttccttctcctccgaggacggtgccgaggggcttgggtggggcccctgggagcctgcccttgggcgctcaccccctcgcctttgccttcgtcttctgcgcgcacccctccctcctggcctctgaaattgaaatcgcgtctccctctcgagcctagcgggaggggaaccgtggccggggctgcttctgggcagagctgacttagatggctgagcgaggctgagctgaaaccgccacccggagggccgcgcggggaaggggccgctgccgggaaggcgcgccccagaccactggccctttaggctgaaaggagaggtgaaggacgtgagtctccctccctctctctttttgctgccaggggtttagtgccctgcgaagagggctccgtggtgtggctccc

SEQ ID NO: 32803 - DNA, 95 bp, Homo sapiens; identical to SEQ ID NO: 3486
  misc_feature 1..95: note = chr9:138606154-138606249
  misc_feature 1..95: note = hyper
  source 1..95: mol_type = genomic DNA

SEQ ID NO: 32804 - DNA, 72 bp, Homo sapiens
  misc_feature 1..72: note = chr9:138606523-138606595
  misc_feature 1..72: note = hyper
  source 1..72: mol_type = genomic DNA
gggacctgctgctgggcgacccgtccttccagaacgacgacaggtagggaccgggcgcggggtgggggctgg

SEQ ID NO: 32805 - DNA, 30 bp, Homo sapiens
  misc_feature 1..30: note = chr9:138607023-138607053
  misc_feature 1..30: note = hyper
  source 1..30: mol_type = genomic DNA
cctggtcacttattccgagtcaccgtgtcc

SEQ ID NO: 32806 - DNA, 30 bp, Homo sapiens
  misc_feature 1..30: note = chr9:138628067-138628097
  misc_feature 1..30: note = hyper
  source 1..30: mol_type = genomic DNA
gcaggccatcctgagcgccaggcctggtcc

SEQ ID NO: 32807 - DNA, 404 bp, Homo sapiens
  misc_feature 1..404: note = chr9:138628339-138628743
  misc_feature 1..404: note = hyper
  source 1..404: mol_type = genomic DNA
ccagccccccagccccggcacccggccgttccactgcgcggcggcgtggggagggcgcggcgcgagctgagatggttccgcccggcgccgcccccgctgcccgccgcccgccgcccgccgcgccgagcgctcccgcaggatggcgcgggccaagctgccgcgctcgccgtccgagggcaaggcgggcccggggggcgccccagccggcgccgcagcccccgaggagcctcacgggctcagcccgctgctgccggcccgcggcgggggctccgtgggcagcgacgtgggccagaggtaggggcgcgcgggcctgggaccccgcttgtcaaatcgcgcttgcatcctgctcgggctgcgctggctgggctgcacctgcgttgcctgcagcccggggaaggggggag

SEQ ID NO: 32808 - DNA, 69 bp, Homo sapiens
  misc_feature 1..69: note = chr9:139024452-139024521
  misc_feature 1..69: note = hyper
  source 1..69: mol_type = genomic DNA
ggtgcctgggacccccgaaggcgtcgggagttgggggcaaacggccgccgccggcccgcgtcaggcgcc

SEQ ID NO: 32809 - DNA, 155 bp, Homo sapiens
  misc_feature 1..155: note = chr9:139024749-139024904
  misc_feature 1..155: note = hyper
  source 1..155: mol_type = genomic DNA
gctgcagagcgcggagcccgggagctcgcaccgcctgttcgtggggtccctggggtgcaggggtggaggacataggagtgtgggggtcgtgggcagacccaggcgggacgctgtgccagtgccgccccgaaggcccagtgcgcagggtcccccgc

SEQ ID NO: 32810 - DNA, 54 bp, Homo sapiens; identical to SEQ ID NO: 10123
  misc_feature 1..54: note = chr9:139025663-139025717
  misc_feature 1..54: note = hyper
  source 1..54: mol_type = genomic DNA

SEQ ID NO: 32811 - DNA, 717 bp, Homo sapiens
  misc_feature 1..717: note = chr9:139084634-139085351
  misc_feature 1..717: note = hyper
  source 1..717: mol_type = genomic DNA
gggtcgggaccccaacgagcgggaaaaaaaaaaaaagacagaacgcgtgccggggagtatgaccccggccccggctccctgcaccccgggctgcgcagagccctcgccctccgggttccctctgccagcgacgccagcagagccgggcaggtcccatctcggggtctccccgcgcccggacgacccctctcccactgcggccccggccctgcctcacccgccgccccaccagggtccgagaccgggagaccccagccgcggggggggggggacatcagccttcgacctgcccccgcacctcccgctccgcggggagactgggcgccaggaaccccgaattcggggctgacaacccgcaggcgcgcggctaaagcttccaccgtccgcgagaaggcgtctccaccctggaaggaagggggctcggacccagggaggatgaggggtccgccttctccttcccctcacctcgctgcagcccagagcccgcagacagccccgcggcccaaggtctctctccgcccgaggtctgcagctctggctgggcgtcccccggcctggcgggggtccgggtgggggccgcggcccgaagtctgattctgggttcgccctcgcgggtacggagcaggagccggaggaggtcggagcccgcgtttctgtccctggggcgcggggaggtcacagggctccccccaggcccgcgcggggcggaaccgggta

SEQ ID NO: 32812 - DNA, 211 bp, Homo sapiens
  misc_feature 1..211: note = chr9:139085372-139085583
  misc_feature 1..211: note = hyper
  source 1..211: mol_type = genomic DNA
cgctccgatcgggaaccggaggccggcgaggtcacgcagacgcgctctccagggcaccgcgggtctcccatcgccgaggccgcctccgcaggccccgctcccctccccgcggcggccagggcggtgtcgggggcggccacgggctccgggattatcgacgcgccgccagctggagcgggcgcgggcggggtccccgcgggaacagtcggca

SEQ ID NO: 32813 - DNA, 36 bp, Homo sapiens
  misc_feature 1..36: note = chr9:139085792-139085828
  misc_feature 1..36: note = hyper
  source 1..36: mol_type = genomic DNA
tgcccccggagagttcggggtcgtccctccagcgcc

SEQ ID NO: 32814 - DNA, 174 bp, Homo sapiens
  misc_feature 1..174: note = chr9:139085985-139086159
  misc_feature 1..174: note = hyper
  source 1..174: mol_type = genomic DNA
cgctcggctccagtgttgccgccattcccagtggccgtcggggcccttctcccctcccgggaccgccctggtgatccgcgcgtctctgcgcttcccaggggtgctcggtgcctccttagacacagcgtggctgccagagcctgggggtcgaaggccatgcgccacagggaggga

SEQ ID NO: 32815 - DNA, 336 bp, Homo sapiens
  misc_feature 1..336: note = chr9:139089123-139089459
  misc_feature 1..336: note = hyper
  source 1..336: mol_type = genomic DNA
caggggcagctccctcgtgtgaggtgcagggtggagccgggcctgggtcagaactgagcgtggtctacctcatccagccaggaggcggggctggcagggaagtcggggtaacccccgctgctccccgtggataggtcagaactgggtccgttccctgccagcaccctcatgggtgggggcccgccgggggctcccgagggcacaaggcccaagctggtgtctgggtacaccaggctggagaggaggggctgggggccagggaggctctgcggggcggcgggggatggggggacaccgtaggggctgccgggacgcagctctcggtactgctctggg

SEQ ID NO: 32816 - DNA, 147 bp, Homo sapiens
  misc_feature 1..147: note = chr9:139090405-139090552
  misc_feature 1..147: note = hyper
  source 1..147: mol_type = genomic DNA
tgggaaattcagatccgcgggctccctgggacccctgcgaccccgccgacgcgcgctcgtccccccccgagctccgcgatccctccgcctaccggggaaggagacctcagcgtcgctgtcctgcccctcctgaacgctgtccttgtc

SEQ ID NO: 32817 - DNA, 156 bp, Homo sapiens; identical to SEQ ID NO: 10130
  misc_feature 1..156: note = chr9:139090586-139090742
  misc_feature 1..156: note = hyper
  source 1..156: mol_type = genomic DNA

SEQ ID NO: 32818 - DNA, 454 bp, Homo sapiens; identical to SEQ ID NO: 10131
  misc_feature 1..454: note = chr9:139091071-139091525
  misc_feature 1..454: note = hyper
  source 1..454: mol_type = genomic DNA

SEQ ID NO: 32819 - DNA, 151 bp, Homo sapiens
  misc_feature 1..151: note = chr9:139093772-139093923
  misc_feature 1..151: note = hyper
  source 1..151: mol_type = genomic DNA
ggacagcgcctcggccgcagctcgccgccggcgcccgcgtcgggcaaaagccgccccagcccaccccgcgccgcgcccgcgaccccagccttacgctgcatggcgactccagccctggcgggggctcctgtgtcagggatggcggggtcgg

SEQ ID NO: 32820 - DNA, 178 bp, Homo sapiens
  misc_feature 1..178: note = chr9:139094021-139094199
  misc_feature 1..178: note = hyper
  source 1..178: mol_type = genomic DNA
cggccaacccctcccaggaaccgtcgaaaaataaataaataagtagggaaccgcgagcccccacagcctggatgtaacccccttcccgccggccggtccctctcactccccactggctccggggcctccttccccatcctgcggctccagctggcccgggagtcgaggagaactgccc

SEQ ID NO: 32821 - DNA, 98 bp, Homo sapiens
  misc_feature 1..98: note = chr9:139094635-139094733
  misc_feature 1..98: note = hyper
  source 1..98: mol_type = genomic DNA
aaatacaggctgaggcgcccaggcgcggacgttccggggtcctcgcgcccactcccgcccagatcctctagctcctgccagcctccgcggccaggccc

SEQ ID NO: 32822 - DNA, 117 bp, Homo sapiens
  misc_feature 1..117: note = chr9:139095014-139095131
  misc_feature 1..117: note = hyper
  source 1..117: mol_type = genomic DNA
gccctggggcccggagcctctggccgagcggagggcggagcggccggggggcggggccgcggggcggggcggggccgggggtcgcggagaccagcccgggccactgcggactctgag

SEQ ID NO: 32823 - DNA, 320 bp, Homo sapiens
  misc_feature 1..320: note = chr9:139095165-139095485
  misc_feature 1..320: note = hyper
  source 1..320: mol_type = genomic DNA
cgccccgcgtgcccggcccgagggcgggcaccggtaagggagggcccaggtcagggcttcccgccagcgttcgtcccggccccgcagcttcctgcgccggagcggcccagaggcagaggcctgagctggagcacacgccaggagggctaaggttcccgggagaggggtcgagaaggcagcagggtcctcccgccgctgaggtttggcctcgggagcagcagatggtcggcgggagctcaacccgaaacgcagaaggggtgagtgtggcgccgagggctgcgtaccggaaccgcaaggtgccggaccgatcccagatgcta

SEQ ID NO: 32824 - DNA, 531 bp, Homo sapiens
  misc_feature 1..531: note = chr9:139096584-139097115
  misc_feature 1..531: note = hyper
  source 1..531: mol_type = genomic DNA
actcttgcaggccagcgtcaggccctccccgccaccctgggatctggaaactcactctctgcagtttccatctctgtgtcccgcctgcagagcggcgggactttctttgcctggccgctggccctgcacgcacccccttcctcgcgcctctgccgcccttgccgtttctgtcctcagtgtcctgctggggcttaccccgagtcccgcccaaggtgcagacggcggcggccccgggcctcgctcggtcgcgctcgagccccgtttccagcagcatcgcggccaccaggccgagtggcgcgagacgcgctcctcctaggtcagcgtcccctggagggttcggggctcccaagtcccgccgcgtcgtgcggggcagggagcccgggagccactgggcctggcgctgtccgcggtgctgaaggaggcgcccgctgcccgccccgcccgcgcgcccgcccacctcccggggcccctctcgtcgccccggtccccacccccgcctctgccccgtgtcgggcgcgcctccctccctgg

SEQ ID NO: 32825 - DNA, 373 bp, Homo sapiens
  misc_feature 1..373: note = chr9:139606331-139606704
  misc_feature 1..373: note = hyper
  source 1..373: mol_type = genomic DNA
ggcagctgctggctgcgccccacatccctcaccgtccaactcagcccccccaggtgtttaccgaagtgcaatgaaagcttctgttcacacggaacctgcctatggaggcggcaacggctcatccccgagcaccccacgcggaggcgaaggaagtgtcctcccggcgagtggccaaggcgcggggtctcagccaggagggaagggtcggaccccggggcgggctgcaggctcggccagcccagggctccgcgcgtctgaccccatcctgaggacccaggggaaggaccagccctggctctgcggcctcgaaccgggggcgcgcgtggggagccctgaaccccgcagcctgcgtagcgcacggggcctctctcca

SEQ ID NO: 32826 - DNA, 131 bp, Homo sapiens
  misc_feature 1..131: note = chr9:139607156-139607287
  misc_feature 1..131: note = hyper
  source 1..131: mol_type = genomic DNA
tgccccttctccaagcgcctgcaggtaagcgcggtgcgcgcccgccgcccccggccgcctctgcctggggaggccgagctccagccccggagtgggccgagtacggagcggggccccgggttcggacacga

SEQ ID NO: 32827 - DNA, 80 bp, Homo sapiens
  misc_feature 1..80: note = chr9:139739053-139739133
  misc_feature 1..80: note = hyper
  source 1..80: mol_type = genomic DNA
ccatggagaccctgccggagccaccgccgccggagtccgctgtgccgcgcgcccggacccgcgaagccgagccacgccgc

SEQ ID NO: 32828 - DNA, 54 bp, Homo sapiens
  misc_feature 1..54: note = chr9:139739447-139739501
  misc_feature 1..54: note = hyper
  source 1..54: mol_type = genomic DNA
cgcagtgctccagcacgccacccggggctcgcggtcctgcgggcccaccgaggc

SEQ ID NO: 32829 - DNA, 83 bp, Homo sapiens
  misc_feature 1..83: note = chr9:139872708-139872791
  misc_feature 1..83: note = hyper
  source 1..83: mol_type = genomic DNA
tgcgacgtcctctgccgcccgctgtatgggccaggcgctcagccagggcacagaatcgggaccgggggcggaggggccgaagc

SEQ ID NO: 32830 - DNA, 36 bp, Homo sapiens
  misc_feature 1..36: note = chr9:139879955-139879991
  misc_feature 1..36: note = hyper
  source 1..36: mol_type = genomic DNA
cggggcagctagggacgacagcgggggtgatggggc

SEQ ID NO: 32831 - DNA, 95 bp, Homo sapiens
  misc_feature 1..95: note = chr9:139943364-139943459
  misc_feature 1..95: note = hyper
  source 1..95: mol_type = genomic DNA
ggccccgccccgccccgccccagcccaccttcttctggaagatcacgccgccgaaggcgcgctcgtcgaagccgtagccgcgactcagcagctgc

SEQ ID NO: 32832 - DNA, 141 bp, Homo sapiens
  misc_feature 1..141: note = chr9:139948048-139948189
  misc_feature 1..141: note = hyper
  source 1..141: mol_type = genomic DNA
acagcccctgggctgcgttgacggactcggcggcgggcgcggaactcccgggacttgttccttcagcaccgcgtcgccctggaagcgccaccgccccccgccccctccgcgtacccggtcggggagcgcagagcgcggaac

SEQ ID NO: 32833 - DNA, 69 bp, Homo sapiens
  misc_feature 1..69: note = chr9:139971509-139971578
  misc_feature 1..69: note = hyper
  source 1..69: mol_type = genomic DNA
gcccacgccagctggcgcgacccagagggtcctgggatctctcggggcggggcgcggagtggacagggc

SEQ ID NO: 32834 - DNA, 145 bp, Homo sapiens
  misc_feature 1..145: note = chr9:140024626-140024771
  misc_feature 1..145: note = hyper
  source 1..145: mol_type = genomic DNA
ccgggcgcggcgtcgcgggggccgagggaaggaccggaccctcccgaggtcgcggacccggccggctggggcgaggctggggtggcccctaccccgagctaagctggccgcgccgcatctcaccgtcgccggggcccgagcgctg

SEQ ID NO: 32835 - DNA, 133 bp, Homo sapiens
  misc_feature 1..133: note = chr9:140024786-140024919
  misc_feature 1..133: note = hyper
  source 1..133: mol_type = genomic DNA
cgagcgagggggccaagcggccggctggacccacagtccccgcgccataggcgggtcggggctttcagactcggctccagccctcaaacctggtagccttggaggtcagcttgagatgactgcgcttcctgcg

SEQ ID NO: 32836 - DNA, 134 bp, Homo sapiens
  misc_feature 1..134: note = chr9:140024956-140025090
  misc_feature 1..134: note = hyper
  source 1..134: mol_type = genomic DNA
cggcgtccgtggccgccggaggcctgtgttctcccctgccgaacctcacgcgcggcccctccctcattttcttctggccaggctgccccctgccccttgggcgattctgctgcgtcccacggtcctggctgtgg

SEQ ID NO: 32837 - DNA, 40 bp, Homo sapiens
  misc_feature 1..40: note = chr9:140032911-140032951
  misc_feature 1..40: note = hyper
  source 1..40: mol_type = genomic DNA
gctgagggtgtgaaacggctggccccgaacacacctcgcg

SEQ ID NO: 32838 - DNA, 73 bp, Homo sapiens
  misc_feature 1..73: note = chr9:140033418-140033491
  misc_feature 1..73: note = hyper
  source 1..73: mol_type = genomic DNA
acccctccaggcacgcgctcacacgcacacgcgcgctccccggctcacgcgcgctccgacacacacgctcacg

SEQ ID NO: 32839 - skipped

SEQ ID NO: 32840 - DNA, 400 bp, Homo sapiens
  misc_feature 1..400: note = chr9:140033762-140034162
  misc_feature 1..400: note = hyper
  source 1..400: mol_type = genomic DNA
cgcacgcttcagcgccccttccctcggccgacgtcccgggaccgccgctccgggggagacgtggcgtccgcagcccgcggggccgggcgagcgcaggacggcccggaagccccgcgggggatgcgccgagggccccgcgttcgcgccgcgcagagccaggcccgcggcccgagcccatgagcaccatgcgcctgctgacgctcgccctgctgttctcctgctccgtcgcccgtgccgcgtgcgaccccaagatcgtcaacattggcgcggtgctgagcacgcggaagcacgagcagatgttccgcgaggccgtgaaccaggccaacaagcggcacggctcctggaagattcagctcaatgccacctccgtcacgcacaagcccaacgccatccagatggc

SEQ ID NO: 32841 - DNA, 141 bp, Homo sapiens; identical to SEQ ID NO: 10143
  misc_feature 1..141: note = chr9:140050956-140051097
  misc_feature 1..141: note = hyper
  source 1..141: mol_type = genomic DNA

SEQ ID NO: 32842 - DNA, 272 bp, Homo sapiens; identical to SEQ ID NO: 10144
  misc_feature 1..272: note = chr9:140051219-140051491
  misc_feature 1..272: note = hyper
  source 1..272: mol_type = genomic DNA

SEQ ID NO: 32843 - DNA, 262 bp, Homo sapiens
  misc_feature 1..262: note = chr9:140772069-140772331
  misc_feature 1..262: note = hyper
  source 1..262: mol_type = genomic DNA
gtgggaggcgcggggcgagggaggcgcagccggaggggccggggcggggcgggggcggccgcggggcggggccggcgcggcagggtgggcggggccggcgcggattggccgggccccgccacgtgaccggccccttatagggcgtggcgcggggccgcggagtcgggtgaggcggcggcggctgcggcggtggggccgggcgaggtccgctgcggtcccggcggctccgtggctgctccgctctgagcgcctggcgcgcccc

SEQ ID NO: 32844 - skipped

SEQ ID NO: 32845 - DNA, 623 bp, Homo sapiens
  misc_feature 1..623: note = chr9:140772756-140773379
  misc_feature 1..623: note = hyper
  source 1..623: mol_type = genomic DNA
cgcgacctggggaggcgtcgggagacgggcgaggggggtacggagcgccccagggcccctcggagcggcgggtgcgggagcatttccgtgagtgcggcgggcgcggggcggagcccctctgctccggactcgtccctccgcacgccgggtcctggggatcctggtcggtgcacagtgcgcggctagcctggagggcaccgagggcgaagccgcgtccgtgcaggtgcgagcgctgtggggacgcggccgtgcgcgcgcctggctgcaggtgcctgcgtgtgcgggctgagctggagcctggcgctgcgcgtgcgtgcgctcgcgatgcgggctacatgcatgttcacgtgcctgtgtaggtacatgtggctgcgtgtctggagggagcagcgtgcgcctgcgcggggtctccctccagcctcgcctgggggcgctcggccccctcccctcggggccctggagtcgggcggagccgggccggaggcgctgtccgcggtgctgacggccgcccgggtgtgccgaggggctggcggcccagactgcggaggccccgcctcgcggccgcccctagggatgggggcagggagtgagggagaccaggccgcttccgccaggagaggggc

SEQ ID NO: 32846 - DNA, 33 bp, Homo sapiens
  misc_feature 1..33: note = chr9:141044732-141044765
  misc_feature 1..33: note = hyper
  source 1..33: mol_type = genomic DNA
cgggacacctggggccgccgaggcaaaggtgag

SEQ ID NO: 32847 - DNA, 30 bp, Homo sapiens
  misc_feature 1..30: note = chr10:735019-735049
  misc_feature 1..30: note = hyper
  source 1..30: mol_type = genomic DNA
gaaggccgatcccgccgggcccgctgcatc

SEQ ID NO: 32848 - DNA, 30 bp, Homo sapiens
  misc_feature 1..30: note = chr10:830880-830910
  misc_feature 1..30: note = hyper
  source 1..30: mol_type = genomic DNA
ctcacggctgcgccacgtacccactgggcg

SEQ ID NO: 32849 - DNA, 40 bp, Homo sapiens; identical to SEQ ID NO: 10147
  misc_feature 1..40: note = chr10:1778568-1778608
  misc_feature 1..40: note = hyper
  source 1..40: mol_type = genomic DNA

SEQ ID NO: 32850 - DNA, 257 bp, Homo sapiens
  misc_feature 1..257: note = chr10:1778826-1779083
  misc_feature 1..257: note = hyper
  source 1..257: mol_type = genomic DNA
gatgggagtagctggcgcgagggctcgttcccccgtttttgggtaattcctttggcactgggagacgagatggcctccggagggtggaaggcagtgccagcccggccggccactggggactgcggggcccggagacgcgcggggtccccggggagctcctcgccgccctcgccccacttcgtccgggtccctcaaacatgtcgcagcgtggctgctcactgtcccctctgggcaagaggaggccccagacatttcca

SEQ ID NO: 32851 - DNA, 724 bp, Homo sapiens
  misc_feature 1..724: note = chr10:1779111-1779835
  misc_feature 1..724: note = hyper
  source 1..724: mol_type = genomic DNA
cggagcagccatcccgccagcaccccaaagtgaagctgctcacaacggacaagcccggagaccccatgagaggccggggtggagaagccgggggtgaaggggggcaggggccggcgcgccacgcggtccttacctttccgcttggacctccgcctcctcctcctcttggacttgcatttgagttgactgctcagccctccagaccctctgccgctccccaggaccgaggccatggccgagacccaggcgcggagcccagagccgcctccctcctgcacctgcacctgcctccttcccggcagccgccgccgccgctgctgcgaagcttgaggttgcaaacccgggagcggctcacttttcaggactgagcaggaaagcgcgctccgtctctctgtctctcgaattgttctctatgacttgctcccactgggctgggggcctcggctgggcgcctggagcgagctgctccctggtcagggagggcggggaagggcgcgcggcgtcctgagtgctccgagcttcccgcgggctctgcctcctgctctgggctcccagcgcagggaggctacttttgcgcctctgctagttgtttggcaccagccactttgaagccaatcacgcagggagcttgtctatttgctgcagcagcgtctaattagatccaatcacaactgctttctggctctgacatcagcagcagcaccagccgcaccgccgcctggcc

SEQ ID NO: 32852 - DNA, 220 bp, Homo sapiens
  misc_feature 1..220: note = chr10:1779836-1780056
  misc_feature 1..220: note = hyper
  source 1..220: mol_type = genomic DNA
cttgcaaactcagctcccgtttggacggtgaagctcccaggaccggcggctggagggaggctgctcccggggaacaaggacgcggcgcgggtgcgtctgggagagaccgggggagcctccaggagggaccctgcccgggaggacgaggcctcctgccgcagcctcgcggacagctcagctcgccctgctcagaaagacacagggacgggtttttccaacc

SEQ ID NO: 32853 - DNA, 94 bp, Homo sapiens
  misc_feature 1..94: note = chr10:3108959-3109053
  misc_feature 1..94: note = hyper
  source 1..94: mol_type = genomic DNA
ggaggatccactctccgtccgtccttcccgacctcaggctgcagaggaaacctgggggcgggggtcgaggaagccgagccccgaggctcccagc

SEQ ID NO: 32854 - DNA, 114 bp, Homo sapiens
  misc_feature 1..114: note = chr10:3109054-3109168
  misc_feature 1..114: note = hyper
  source 1..114: mol_type = genomic DNA
ccgccccaggaggaatcttgcgggccactagaagctgtgcgcgcggccgggctcggcccccacaacggcccgagcggccgggcctgccgcgagcctccgcgtccaggtggggtc

SEQ ID NO: 32855 - DNA, 30 bp, Homo sapiens
  misc_feature 1..30: note = chr10:4698935-4698965
  misc_feature 1..30: note = hyper
  source 1..30: mol_type = genomic DNA
ccaatatcaaagaagcgtgggcccttccgc

SEQ ID NO: 32856 - DNA, 195 bp, Homo sapiens
  misc_feature 1..195: note = chr10:7449995-7450190
  misc_feature 1..195: note = hyper
  source 1..195: mol_type = genomic DNA
aatcaactgtacatccgcttccacggcacggcctcgtgcaaaatcgcgggtttcggggccttggagcaaattgcgcttgtcagcggcgacgtcaggaggacaaggggaggggttcgcggctgaaactgcagcttcgcagcacagagccattttaggctgctccccacctcgcggggcccatgggaaagccggccc

SEQ ID NO: 32857 - DNA, 2528 bp, Homo sapiens
  misc_feature 1..2528: note = chr10:7450490-7453018
  misc_feature 1..2528: note = hyper
  source 1..2528: mol_type = genomic DNA
cgcgggcccggaggaggtcctcccacctgcccccgccagccccggggaccgtgcgcggcctccgtgtggcccccgcccacgaggtccctcgggcaggaaccgccgcgcgacctctgttcagcggccgcgtcctggccacgggcgacccctgtcgggaaccctgttcccggctaagctgcgttcccgcattccggtggctctcacccgagctcgcgtttgctggctttccctctggctcctctgcctgaccccgattttgtctccgaactccactcccagatcctccccgccctggaacgccgacctttcccccgcacttcgccgcccactcacatcccccggcgactgcccggcctccatgcccgccaagacaagaagatgcccctctccgatgcgccgagagggttcctaagccgagcaagggacaatttcttccccaaacgctgtccccatcccccaccttccctagagcgcgaaacccaaaagtaaggaaggcaacccctcgcctcgaccctacgtgcttgtctcccagagccgcgcgctcccgcccttctgccccaccccaccaccaccaccaccactttggtcttctccaagcttcggtcccggtcccccacctcccaccccagagcggcgtggaggaaagcaggagcccactattaagtgcagcgcgccccctgcacacacgaaatccggctggcgtctgcagcccgattgcacccaatacccgggacagttagtccttttaataagcacctcctcgccccacctactcggggatctacccgcgcaggatccagcacacacaaggcgagagctagctcgtctcctagaaagacaaaataaatcactccctctgccctcatgtactttacaccacgtgtccgcagtttgtcacgtcaaatcatggcagggtctggttccaagacgcacacacacattcggggtggttctctttgacacacacacccaaaaaaactgcgcacacgcaggcctgcacactaatccacaggcacacacgacagttgcgtttcggtgccctggtccgggccaggggcacttctccatccctttcccccctagcaatggacttgacacacagactctaaccacggaaaaaaaaaaccggacagcccattccttctttttttccccacttaattcgctaaagcgcttcctggggtagccaaagagagtcgaaactaaggggtggaaacttcagctgggttttttcccacctcaaaacctttattttcagtttttaaaagccaccttagcccgccatattgaaactggcacggtttctaaagactccttccccgcagttgtggcgcttccaagaaaacacgagtacggatcaggctctggatgagtgtccggccaccgagaatcagccacttcccaccctccaggatcccccagctccctccagccccttcccaccgcccctggtcaaaatcaataaatacatctcgcagttcctacagttgcattttggcggatttctgcaaaacatacacacacatacacatacccacgcacgcatattaaaaaataaactccagaaccagctcaagtcagcaattttgaaagggggtcgaataagaggagacaaccggaaagcccctaagtgacaggatattactttaaagagaaaataatgaacaaaaagaccatcctcgctggagcacgctccaaaactactactgccaattttatttcagttgctcaggcaaatgtttccaagggagcgattccgaatgtctgcacgatttttacccccatgccggtctccgattccccgtcctcaccatctttttctcccacccaaaccaaaagaaaggggagaccccagcgcggaggagacgcgggagcgcggggtaggtagcagcggcggctgcgtcgctaaaatgagtgcagaaacgaggaaggtgggcggcgggaggggacaggctgcgcccggggaaggaggacactttgcaactccggacggactcccgcacggctcggcttttccgagcccggagacgcaggcgaaggggacccgggaagcaaaaatgacaacctggagcgcacagaggagtttgaagcttcgctcaagtgcagtcgctttcttctcctgcccttctctttcgctcccctgcaccctccccagccttcccccacccgccacctccaaccccagctccctcaggcttccttcctttttttttttttccttttttttcctaggctggaaaaagcccctgaccagcgcactcaacctgcgggccgaagggctgctctccggccagcctgggcgccggggacagcagccggcgcggcgtcctacctggtgaagttcgtcctgccctcggcgtggacccaggccccggtcgccgcccgggagggcaccggcctcgctcgcttgctcgctcgcccgcccttgcccgctcgctccccgcccgccgcctccctcgcgcgcccgctccggtcctccggctcccactacagctcattccaatatggcatcctctctgtgcgcatgc

SEQ ID NO: 32858 - DNA, 579 bp, Homo sapiens
  misc_feature 1..579: note = chr10:7453078-7453657
  misc_feature 1..579: note = hyper
  source 1..579: mol_type = genomic DNA
tgtgtgcgtgcgcgtgcagcgaactccttcaacgaccttttccagcgcttgcaaaatttcttaagccaattagcctgcgggacgtgatcggctccttccccagccagctccgcgccattccctgcgcctaagcaggcgggcacccccaggaccctgggaccttccacgcccacgcggcctcctccccaccgcgctccccttcctcctttttgtgagctccctccatacatgatctgcagaaagttcccatcgcgggcgtttccgcacacccctccgcaaggacaactgggcaaactcccgtttccctggctgcggttcgtgagctgggtttccaatggctcagtcgaccgtgtgcacaaacttgcgctttatccgccggggatcgctgggagcggagataaattcaatccccagggcaatcttggccccgcccgccccaccccatcctgtgcttaaatagagcctttcttgaagctgcgaacatttccaggccccttgggcagggctggaggggccgaggagagctattcgagggaaaggtgccccgaggggcaggaaattaagttggggctgcccggg

SEQ ID NO: 32859 - DNA, 98 bp, Homo sapiens
  misc_feature 1..98: note = chr10:7453902-7454000
  misc_feature 1..98: note = hyper
  source 1..98: mol_type = genomic DNA
cgcagagcccaaacgaaatgtccccagtgcggaaaagccggtgacgccctggtagcaagaccaagagcttccgaagaacgctgcgcccttaactaggg

SEQ ID NO: 32860 - DNA, 158 bp, Homo sapiens
  misc_feature 1..158: note = chr10:7454448-7454606
  misc_feature 1..158: note = hyper
  source 1..158: mol_type = genomic DNA
gagatccagggcgggcgtccgcagccgtgaggccccctgcgccgccagtatgggaagatcctgcctccttacaccttggagaacgctgggcgacgactaaagcgccttccgccggcctgtcactccatgtgacacaggagccacgtgagacccagaag

SEQ ID NO: 32861 - DNA, 386 bp, Homo sapiens
  misc_feature 1..386: note = chr10:7708471-7708857
  misc_feature 1..386: note = hyper
  source 1..386: mol_type = genomic DNA
ctcagaaattaacaacgacgaacagaaatctgcgcaatcaacaggagccaagaagaaaaactcggctccgcaggacaagtcccgggcacagttctgcaggaagcctcaggccagatcaggcaccgcggctcacacagaggtgacgcacgagtgacccacagagagggacccctgggcctctggtgggggcctgggagacggtcgaagggggcccgggcagaagctccgcggccgggccggcggagggaagggggcggccgcgcccgggacccggctcccctcggctccacttacctgctccgaagagtggccccagctctgcgcctcttcctgcgaccccacacacagggacagccccaggcacagccccagcagcaggagcatgg

SEQ ID NO: 32862 - DNA, 17 bp, Homo sapiens
  misc_feature 1..17: note = chr10:7708954-7708971
  misc_feature 1..17: note = hyper
  source 1..17: mol_type = genomic DNA
cgcggtcccagcccgga

SEQ ID NO: 32863 - DNA, 15 bp, Homo sapiens
  misc_feature 1..15: note = chr10:8075930-8075945
  misc_feature 1..15: note = hyper
  source 1..15: mol_type = genomic DNA
gctggcagccaactt

SEQ ID NO: 32864 - DNA, 124 bp, Homo sapiens; identical to SEQ ID NO: 3501
  misc_feature 1..124: note = chr10:8076053-8076177
  misc_feature 1..124: note = hyper
  source 1..124: mol_type = genomic DNA

SEQ ID NO: 32865 - DNA, 984 bp, Homo sapiens
  misc_feature 1..984: note = chr10:8076340-8077324
  misc_feature 1..984: note = hyper
  source 1..984: mol_type = genomic DNA
cggtccctgggggcggggctctggcacgagggggaccctcccgggtcaagttcacagaggcggaggggcctgggctgcgccccagagccccagggggtcctctgctcccataaaaaacaaagacgggggcggcggagggtgtggaaggaaagaaattgaaaagggagtgcgggcgactgagggaagctggaggggaaataggggcctcggccaccagtggcctatgtccataactgccctttggttttggtggccttgcaggccgggaatcgagtctgccatgttcgctttcagacgggcctcctggcaagctcttggttgactgtccccagatgttccgggaacccacccctcccccacaccctcccgccccaaccctccgcagagaagccgaggaccacatccatccgcttcctaggaacctgcccgcaccagcaggccctgtttcctggacaaactgggcaaagaaacctaagaaccgcgcgatcccggcaggtggctttctgcggagccagggctgccagcgcggccgggcggcgcctcgggacccggcctggcatccgcgggcgcccggggagggccttggcgtcggcgggggtgggggtgggcggcagatccgaagcagggtcggggaaaaacggcgttgcgggagggttggggggtggcctctgaggaagtgggacaaaaggctttatttcagaaggtacgccaggaaaggggcgtgggtcaccaagtcctgcgcagcagagttggcgcggcctgggagccggggtcccttctgaccacagacgtggccaccgcctcttctcatcccgaaggtcccagccatcccgaggtggtcagagaagaccccgacgggcggatcgggcagtggagagacccgtggtcctcgcgcctgctgtgtcgctgtgtcaatgaccgtgacactcagggcaatccttaccaacacagagcaggacaacgataccccgcacccccccgtac

SEQ ID NO: 32866 - DNA, 352 bp, Homo sapiens
  misc_feature 1..352: note = chr10:8077891-8078243
  misc_feature 1..352: note = hyper
  source 1..352: mol_type = genomic DNA
gggggacccctgttccgctgcccgtctcctccccggcacccaactgcggggcacgcgcccgttgctcggccctaaaggggcctagagctgcgccccgggggcgcggaaggtgcggggagagggggtgaggaaggacagtgaggggccggtcctgggcccggaggactcagcagccgccttggcagcaaatcctgtaggctgtcccctgccttggttgtctcgatgttccgctcagcgctggggaaataaatcgaacctggtgcacacccctcccccaggttgtaacacaactgcccccccagccaacacacacgcccaagcacgcagactttgcacacgtgacatgggggtc

SEQ ID NO: 32867 - DNA, 30 bp, Homo sapiens
  misc_feature 1..30: note = chr10:8079721-8079751
  misc_feature 1..30: note = hyper
  source 1..30: mol_type = genomic DNA
ctccactcctggaggcgacaccattcatct

SEQ ID NO: 32868 - DNA, 391 bp, Homo sapiens
  misc_feature 1..391: note = chr10:8085599-8085990
  misc_feature 1..391: note = hyper
  source 1..391: mol_type = genomic DNA
ttctccctgggtcctcaaaacgcgccaagaacgtggctctgccacttggtggcggaaggcgggaggcacagggcaggaaggtggaggaggggctgcattcgtgacgacgggggagcagagagggaaggacttagggactccccagagggcagacagacctggccagcttggcaaatcataaatccctctccctggaccctcggcctaaacctacccccagggtgtgcagcggaggcgcacaggggttggctgacgggctggggtgcgcctgggtggaggctggtttggggttctggcgtctggaggcaggccatggaaccagaggagagggcaggagggcccaccgcgcagagctgcggcccggctcctagagtggcgcccccagcctggg

SEQ ID NO: 32869 - DNA, 30 bp, Homo sapiens
  misc_feature 1..30: note = chr10:8086710-8086740
  misc_feature 1..30: note = hyper
  source 1..30: mol_type = genomic DNA
cagagggtagcagcccgtcacccagcatcc

SEQ ID NO: 32870 - DNA, 130 bp, Homo sapiens
  misc_feature 1..130: note = chr10:8087215-8087345
  misc_feature 1..130: note = hyper
  source 1..130: mol_type = genomic DNA
tccctcttcgcaacccggaagagctccgctctctacagtgagcaggagaaggcggaggggagggggctcccaggaagaacgtacatcgcccaggttttacctctcgctggaagcccgcctgagatgcggt

SEQ ID NO: 32871 - DNA, 264 bp, Homo sapiens
  misc_feature 1..264: note = chr10:8090494-8090758
  misc_feature 1..264: note = hyper
  source 1..264: mol_type = genomic DNA
aagatgtccaaagcccgggagacccagggacgccggctgggctgcctccaccccttcttttcctcccgtggcacccacctgtccccccacctgccaaggccaggagggagggagagagctgaaaagggcacttttcctccagggtgactccaattcctttccactcaccctcaaggcgagttccttctctcccacccaacccggggctccccccaactgccactcgcctcacgtgtgagttgttaaacccgaaagcagaaatcc

SEQ ID NO: 32872 - DNA, 30 bp, Homo sapiens
  misc_feature 1..30: note = chr10:8091376-8091406
  misc_feature 1..30: note = hyper
  source 1..30: mol_type = genomic DNA
actgccttttcttcccgtttaggtcttgct

SEQ ID NO: 32873 - DNA, 140 bp, Homo sapiens
  misc_feature 1..140: note = chr10:8091858-8091998
  misc_feature 1..140: note = hyper
  source 1..140: mol_type = genomic DNA
cacggcccggtcctccggcttctctcctttgaacaggcgctggggacctccgcggcggccacagctggacgcgcgccgcgaaaggcgcggcggtcccgcgggcgcccggcgtgggctagagaggccggccctggcctggc

SEQ ID NO: 32874 - DNA, 89 bp, Homo sapiens
  misc_feature 1..89: note = chr10:8092446-8092535
  misc_feature 1..89: note = hyper
  source 1..89: mol_type = genomic DNA
cccagcaagattgatcgagctggaatgggaagggacttctcctcccccaggcccagctcgccagggcctcgggccgtgctgcagtttct

SEQ ID NO: 32875 - skipped

SEQ ID NO: 32876 - DNA, 107 bp, Homo sapiens
  misc_feature 1..107: note = chr10:8093718-8093825
  misc_feature 1..107: note = hyper
  source 1..107: mol_type = genomic DNA
tttccctcccccgcccgccaagggaggaggaagcccggcctgctcttgccggcgaggcgggtcaggccggcgcctggcctggcccggacccccgcagcccggctctc

SEQ ID NO: 32877 - DNA, 105 bp, Homo sapiens; identical to SEQ ID NO: 10171
  misc_feature 1..105: note = chr10:8093859-8093964
  misc_feature 1..105: note = hyper
  source 1..105: mol_type = genomic DNA

SEQ ID NO: 32878 - skipped

SEQ ID NO: 32879 - DNA, 261 bp, Homo sapiens
  misc_feature 1..261: note = chr10:8095198-8095459
  misc_feature 1..261: note = hyper
  source 1..261: mol_type = genomic DNA
tatggggtagaggagcgaagagggaacaatgtctccaattcaaataaaaccccaaattaagctctcagccccatcggtgggatagcctgcgggggaacccactccctctcctggcagcattgccctgggggcgagcagagagtggatttggagtcttcttttcccgcctgacccctgctcgcccgagcagcattttcgggccagcggctgcagccacccgggcgccgctaggggatgcagtggctcaaaggaccgagcggg

SEQ ID NO: 32880 - DNA, 186 bp, Homo sapiens; identical to SEQ ID NO: 10174
  misc_feature 1..186: note = chr10:8095492-8095678
  misc_feature 1..186: note = hyper
  source 1..186: mol_type = genomic DNA

SEQ ID NO: 32881 - DNA, 385 bp, Homo sapiens
  misc_feature 1..385: note = chr10:8096155-8096540
  misc_feature 1..385: note = hyper
  source 1..385: mol_type = genomic DNA
cacgtttccccacatcgatgcgctctcccaaacaccctgcattagatcctaataatgatccatgcgtgcctattttttaaaagtctgaaaaagaaaattctgcccatcgaaatgaacttcatgaatggggcaggctggctgcaccgggacggaatcgtccacccgacccgaatgaattggcaggagccgcggccacatttaaagggccagagcgcgcgttccctcccgtccgcccccaagccccgcgggcctcgcccaccctgcccgccgcccctccgccggcggccgccctctgcggcgcccctttccggtcagtggaggggcgggaggaggggcgggggtgcgcggggcggggggagaagtcctggagcgggtttgggttgca

SEQ ID NO: 32882 - DNA, 88 bp, Homo sapiens
  misc_feature 1..88: note = chr10:8096747-8096835
  misc_feature 1..88: note = hyper
  source 1..88: mol_type = genomic DNA
aagaagagagagagacggagggagagcgagacagagcgagcaacgcaatctgaccgagcaggtcgtacgccgccgcctcctcctcctc

SEQ ID NO: 32883 - DNA, 433 bp, Homo sapiens
  misc_feature 1..433: note = chr10:8097071-8097504
  misc_feature 1..433: note = hyper
  source 1..433: mol_type = genomic DNA
ccggctcccgcgagccgggctgcagggacgtccccgagagccctgcgggctccgcggccgtgtccccgcgctcccgtgcgggtctcgggtgcgctgggcgggcgggcggcgcgaggggaggttgtgccactccagcaactcaggggctcatccaggtctcccattctctcccttgcaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcatt

SEQ ID NO: 32884 - DNA, 375 bp, Homo sapiens
  misc_feature 1..375: note = chr10:8374353-8374728
  misc_feature 1..375: note = hyper
  source 1..375: mol_type = genomic DNA
gggaggtgctgggggcggtggcatagcgcccacaccgcgtggtccccgcgcgcggctgggctggcagcgccccaggcagcgcgcacggtaagcaggaagctgcggccgagctgagtcgctcaaaagctactggagctaatagattgtggtcatgaggagagcggcagcatctcggtagtgatgggaacactcaaaagcatcatcaaaacagttgcagaaacatgctgagctctgcactcccgagcccgtgcctgctgcagccggcttggagtttgctggtagccactgcagccccggccccgcgcgtccagcctgggggtgcgatgagcaagagaaatgaggtgcaaaatgttgcatccgcggagctgcttgcaa

SEQ ID NO: 32885 - DNA, 195 bp, Homo sapiens
  misc_feature 1..195: note = chr10:11059469-11059664
  misc_feature 1..195: note = hyper
  source 1..195: mol_type = genomic DNA
gcaagcacaccacaccgaggagcatcgaagcgaaccctcgggctgctcgcctcccgcggctgggctctgggagcgcggctcgggtatggaagtggagcgggctttggcgcctgggtggccctaaacctactccgagcggccacggcggcctcttgccagggacccccgggcgggggagcagagccaggcggggag

SEQ ID NO: 32886 - DNA, 226 bp, Homo sapiens
  misc_feature 1..226: note = chr10:11059932-11060158
  misc_feature 1..226: note = hyper
  source 1..226: mol_type = genomic DNA
ggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaatgtgagtggcgccgcgtcccgaggccgggcgag

SEQ ID NO: 32887 - DNA, 121 bp, Homo sapiens; identical to SEQ ID NO: 10180
  misc_feature 1..121: note = chr10:11060314-11060435
  misc_feature 1..121: note = hyper
  source 1..121: mol_type = genomic DNA

SEQ ID NO: 32888 - DNA, 117 bp, Homo sapiens
  misc_feature 1..117: note = chr10:11060512-11060629
  misc_feature 1..117: note = hyper
  source 1..117: mol_type = genomic DNA
ggggtccgggcggggtccatgagtccaagtgggaccggcgagccgggcgcggagtcccggggtccggtggggcgggcggggaccgggcggggtctgggggtccgggtgaggactgag

SEQ ID NO: 32889 - DNA, 81 bp, Homo sapiens
  misc_feature 1..81: note = chr10:11207195-11207276
  misc_feature 1..81: note = hyper
  source 1..81: mol_type = genomic DNA
ggcagggcgctgccccgtgctcccccggctctgctcgacagcagcacgcagtgagagcctcgccgccgccgaggagcaact

SEQ ID NO: 32890 - DNA, 37 bp, Homo sapiens
  misc_feature 1..37: note = chr10:11784349-11784386
  misc_feature 1..37: note = hyper
  source 1..37: mol_type = genomic DNA
cggggcggggcggggcgtgccggggcggggcgtagta

SEQ ID NO: 32891 - DNA, 359 bp, Homo sapiens
  misc_feature 1..359: note = chr10:13043175-13043534
  misc_feature 1..359: note = hyper
  source 1..359: mol_type = genomic DNA
cggcggcgccgccgggctcacctgaggaagaagaaataggagtagtcctggaccacggtgtgggagtggcacgagaagtagcccaggccggtgaggttgagcctggagccggcgggcacctccagcatgctgccccacgcctggtcgcacagcatctcgacctcggccgagtagaagaggcccccctggccggcgtggtactgccagggcaggtggttgtagaggccgggcgcctcggggtgcagcgccagcaccctggcgtacacgatggtctcggccagctcggcgcggcagccctcgctcaggggcctccactcggagggcagctggcaggcgcgcgcgggcgctgggggacccgc

SEQ ID NO: 32892 - DNA, 43 bp, Homo sapiens
  misc_feature 1..43: note = chr10:13043744-13043787
  misc_feature 1..43: note = hyper
  source 1..43: mol_type = genomic DNA
gtcccggggactggacgcgccgggcgcccgcctcccgccctgc

SEQ ID NO: 32893 - DNA, 33 bp, Homo sapiens; identical to SEQ ID NO: 3508
  misc_feature 1..33: note = chr10:13933506-13933539
  misc_feature 1..33: note = hyper
  source 1..33: mol_type = genomic DNA

SEQ ID NO: 32894 - DNA, 339 bp, Homo sapiens; identical to SEQ ID NO: 3509
  misc_feature 1..339: note = chr10:13933596-13933935
  misc_feature 1..339: note = hyper
  source 1..339: mol_type = genomic DNA

SEQ ID NO: 32895 - DNA, 14 bp, Homo sapiens
  misc_feature 1..14: note = chr10:13933982-13933996
  misc_feature 1..14: note = hyper
  source 1..14: mol_type = genomic DNA
cgccaccgcccgcc

SEQ ID NO: 32896 - DNA, 129 bp, Homo sapiens; identical to SEQ ID NO: 3511
  misc_feature 1..129: note = chr10:13933997-13934126
  misc_feature 1..129: note = hyper
  source 1..129: mol_type = genomic DNA

SEQ ID NO: 32897 - DNA, 145 bp, Homo sapiens
  misc_feature 1..145: note = chr10:13934168-13934313
  misc_feature 1..145: note = hyper
  source 1..145: mol_type = genomic DNA
cggaggtccccaagcgggggacccctggctcccccacaaaacccacccaaagccaccgctcgaggccctctcctaccctgagagcccggagacagcagctcccttggctgaaggcacagctcttacccctcgatctagtccaatt

SEQ ID NO: 32898 - DNA, 165 bp, Homo sapiens
  misc_feature 1..165: note = chr10:14215748-14215913
  misc_feature 1..165: note = hyper
  source 1..165: mol_type = genomic DNA
ggctgtctaatcaaccgagaggcgaactcatttactgaggttcccattgtccacgctgacagatggctcgctcccctctctgctctccccttcccctcagatcgcgctgccgtgcaggcaagcctattctttgagagatccagttgcaatcgccagcctagttct

SEQ ID NO: 32899 - DNA, 106 bp, Homo sapiens
  misc_feature 1..106: note = chr10:14216190-14216296
  misc_feature 1..106: note = hyper
  source 1..106: mol_type = genomic DNA
aacttgaatccccagcgcctgcaaagcgccgttcctggagaagcctgctcctctcctcgccctggtcccctctctctttctccctctcccgcgctctctctcctcc

SEQ ID NO: 32900 - DNA, 891 bp, Homo sapiens
  misc_feature 1..891: note = chr10:15760963-15761854
  misc_feature 1..891: note = hyper
  source 1..891: mol_type = genomic DNA
ctgtaacctcctgcccggggacactggggcaggcgtggagggcatgaacgtatttatgatgaggaccgactgtcaaacttgatttcctcttggaaacgggggtccgcaacctggtttgcaagaatgcaaacggtcctgcttctctaggtggagctctgtgggtacagtgagatgagagaagggggtggggtaggaggaagccaaggacagagcccagctgctggtagccgacagctcttgcgcccagacgcaatggttacagactctgcataaacagacctcgctgtggtggcggttttaactggcttgggtcttctgggtcctgttctctcctttgtaggatgcgtgcgtcttggtacctggaacacccaggacttgcgtgttctatgcaagtggcatgtctctagctcaaaattcacaaggcacatctagcatggcaggggagagaaggggctggtggcggggagagggacgggaccccgggcaggcggcaggacggggatcccaggctgcggggggactccgcggcagagccgctgggacctgacccgggagcgccttcgtccccgcgcgcacctccccgggtcgggcgacttacgtgcgggcgtcgggtatgtggaagtccacggcgtagccgaagtagctgcccttggggccgctgtacactgtgagcttttccacgtccaggttgaacgcctgacaggcgggggaccacagcaacatccccagcgcggccgcggcgcagcagaggggcgcgatcagcggcgcctggcttccccggggaccgcggctggccccgggcgacatctccctccgccccggtgggtggctgctacccaggagcgcgagccgaggacccctgcggggcaaggggggctggtggaatctggc

SEQ ID NO: 32901 - DNA, 259 bp, Homo sapiens
  misc_feature 1..259: note = chr10:15761855-15762114
  misc_feature 1..259: note = hyper
  source 1..259: mol_type = genomic DNA
gtccccagctgcccgtgtcccgggtcggtgcgctcggcgcacccgtggtgacagtgcccggcgtctgctcccacccgcccgcccgcccagccggctcggggggctggcccaggggctctagccctcctccggccgcgggcagggaccagctctctcgcggcgcctcctcgcggctggtctagagccagggactcccgggcggcccagctggtggctggagcgctgggtgcctcttcgggctgcccggatttctattgca

SEQ ID NO: 32902 - DNA, 258 bp, Homo sapiens
  misc_feature 1..258: note = chr10:16562368-16562626
  misc_feature 1..258: note = hyper
  source 1..258: mol_type = genomic DNA
cgcgcccttcctccgcgggctcccacccccatttccggggtctcctccctctcgcccgcaccttcccgcgctccctccccgccctccccgccgcccgcccgcgctcacctggttgtttttgcagagatcagcccacatgctggtgccgtcccctccgcgcatcaggacgtggtaggtgaagaagtagatgcccgggatggagcaggtgaacttgccggtggtggggtcgtagtggtttccgaggttggtgaccacgtc

SEQ ID NO: 32903 - DNA, 46 bp, Homo sapiens; identical to SEQ ID NO: 3516
  misc_feature 1..46: note = chr10:16562627-16562673
  misc_feature 1..46: note = hyper
  source 1..46: mol_type = genomic DNA

SEQ ID NO: 32904 - DNA, 956 bp, Homo sapiens; identical to SEQ ID NO: 3517
  misc_feature 1..956: note = chr10:16562709-16563665
  misc_feature 1..956: note = hyper
  source 1..956: mol_type = genomic DNA

SEQ ID NO: 32905 - DNA, 261 bp, Homo sapiens; identical to SEQ ID NO: 3518
  misc_feature 1..261: note = chr10:16563690-16563951
  misc_feature 1..261: note = hyper
  source 1..261: mol_type = genomic DNA

SEQ ID NO: 32906 - DNA, 70 bp, Homo sapiens
  misc_feature 1..70: note = chr10:17270334-17270404
  misc_feature 1..70: note = hyper
  source 1..70: mol_type = genomic DNA
ttaaaaacttaggggcgctcttgtcccccacagggcccgaccgcacacagcaaggcgatggcccagctgt

SEQ ID NO: 32907 - DNA, 589 bp, Homo sapiens
  misc_feature 1..589: note = chr10:17270666-17271255
  misc_feature 1..589: note = hyper
  source 1..589: mol_type = genomic DNA
tccgccaaggcaagtcgatggacagaggcgcgggccggagcagcccccctttccaagcgggcggcgcgcgaggctgcggcgaggcctgagccctgcgttcctgcgctgtgcgcgcccccaccccgcgttccaatctcaggcgctctttgtttctttctccgcgacttcagatctgagggattccttactctttcctcttcccgctcctttgcccgcgggtctccccgcctgaccgcagccccgagaccgccgcgcacctcctcccacgcccctttggcgtggtgccaccggacccctctggttcagtcccaggcggacccccccctcaccgcgcgaccccgcctttttcagcaccccagggtgagcccagctcagactatcatccggaaagcccccaaaagtcccagcccagcgctgaagtaacgggaccatgcccagtcccaggccccggagcaggaaggctcgagggcgcccccaccccacccgcccaccctccccgcttctcgctaggtccctattggctggcgcgctccgcggctgggatggcagtgggaggggaccctctttcctaacggggttataaaaacag

SEQ ID NO: 32908 - DNA, 76 bp, Homo sapiens; identical to SEQ ID NO: 3520
  misc_feature 1..76: note = chr10:17271443-17271519
  misc_feature 1..76: note = hyper
  source 1..76: mol_type = genomic DNA

SEQ ID NO: 32909 - DNA, 428 bp, Homo sapiens
  misc_feature 1..428: note = chr10:17271520-17271948
  misc_feature 1..428: note = hyper
  source 1..428: mol_type = genomic DNA
tccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcga

SEQ ID NO: 32910 - DNA, 102 bp, Homo sapiens; identical to SEQ ID NO: 10197
  misc_feature 1..102: note = chr10:17495534-17495636
  misc_feature 1..102: note = hyper
  source 1..102: mol_type = genomic DNA

SEQ ID NO: 32911 - DNA, 94 bp, Homo sapiens
  misc_feature 1..94: note = chr10:17496002-17496096
  misc_feature 1..94: note = hyper
  source 1..94: mol_type = genomic DNA
actccactctcaggccgtcgccgcccgtgggctgctccccgccgcggccaaaagtctccgcgcccgaggggaagcgatgggcggcttgggggtc

SEQ ID NO: 32912 - DNA, 300 bp, Homo sapiens; identical to SEQ ID NO: 10198
  misc_feature 1..300: note = chr10:17496544-17496844
  misc_feature 1..300: note = hyper
  source 1..300: mol_type = genomic DNA

SEQ ID NO: 32913 - DNA, 232 bp, Homo sapiens
  misc_feature 1..232: note = chr10:18429517-18429749
  misc_feature 1..232: note = hyper
  source 1..232: mol_type = genomic DNA
ggggcgctgcggggcgctgcgccgagaacggccgggcctgagccctgggcggcccccagagccgatcagagcgcggggaggcgggggcgaggaggaggggacccgccgccgggggctggctgcttcgctccgagccgacttttcgccaatggtccaaagggacatgtccaagtcgcctcccacagcggcggcggcggtggcgcaggagatccagatggaactgctagagaac

SEQ ID NO: 32914 - DNA, 103 bp, Homo sapiens
  misc_feature 1..103: note = chr10:18429750-18429853
  misc_feature 1..103: note = hyper
  source 1..103: mol_type = genomic DNA
tggctcccgcgggggcgctcggagccgccgcacaggtagcgagagcgcggcgccttctccttcctttgtgagccgccgggcagggcaccgacctcgggttctc

SEQ ID NO: 32915 - skipped

SEQ ID NO: 32916 - DNA, 64 bp, Homo sapiens
  misc_feature 1..64: note = chr10:18430183-18430247
  misc_feature 1..64: note = hyper
  source 1..64: mol_type = genomic DNA
cgctttctacgatgccgactctcctggccacgctccgagccggggtgggcgtgggtgtgaggat

SEQ ID NO: 32917 - DNA, 188 bp, Homo sapiens
  misc_feature 1..188: note = chr10:20105422-20105610
  misc_feature 1..188: note = hyper
  source 1..188: mol_type = genomic DNA
gcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaat

SEQ ID NO: 32918 - DNA, 66 bp, Homo sapiens
  misc_feature 1..66: note = chr10:20106628-20106694
  misc_feature 1..66: note = hyper
  source 1..66: mol_type = genomic DNA
gtgacctgggccaagcgggcgctggaaggggggcggggtaaatgcggccggcgcagaggtggggag

SEQ ID NO: 32919 - DNA, 63 bp, Homo sapiens
  misc_feature 1..63: note = chr10:21783695-21783758
  misc_feature 1..63: note = hyper
  source 1..63: mol_type = genomic DNA
gcgcgcggactcggcttccccaggtcaggacccactaggtgggccgctcggccccaagcctgg

SEQ ID NO: 32920 - DNA, 45 bp, Homo sapiens
  misc_feature 1..45: note = chr10:21789093-21789138
  misc_feature 1..45: note = hyper
  source 1..45: mol_type = genomic DNA
ggtgacaagggaaggcggcgggggtggagccgctctctggtggag

SEQ ID NO: 32921 - DNA, 243 bp, Homo sapiens
  misc_feature 1..243: note = chr10:21805094-21805337
  misc_feature 1..243: note = hyper
  source 1..243: mol_type = genomic DNA
tctcagataccctatcgttccttatctcagcgaaacaactccccaggctggccgggcagtacaccggagatgctttgggggcccagctctgcagattccactccgccggcgactccgctttgacactactcttgaggtcgggaagtctgccggcatcctcgaaagcagcgggtttggttgcagcggcggcggaggccagatggtacaagaagttggcctgcgcctgcacgctgggaggcttgc

SEQ ID NO: 32922 - DNA, 117 bp, Homo sapiens
  misc_feature 1..117: note = chr10:22518011-22518128
  misc_feature 1..117: note = hyper
  source 1..117: mol_type = genomic DNA
gaaatacatgcatttcggtggccccgttacatttcacgcgtcacgaagccgagcaagaccagcccgggccgccttccccgtgtacgcgcgggcctccggggacgcgcagagctggag

SEQ ID NO: 32923 - DNA, 37 bp, Homo sapiens
  misc_feature 1..37: note = chr10:22518491-22518528
  misc_feature 1..37: note = hyper
  source 1..37: mol_type = genomic DNA
accgattgcgccacagagacttcggtgtcattttccc

SEQ ID NO: 32924 - DNA, 98 bp, Homo sapiens
  misc_feature 1..98: note = chr10:22540740-22540838
  misc_feature 1..98: note = hyper
  source 1..98: mol_type = genomic DNA
cgggcgacgctcggctgatgggaccgggccgcgcaagcctcggatgcagccgggtggggggcaccaggcgctaggcgaaggagcgcaggaccaaagga

SEQ ID NO: 32925 - DNA, 789 bp, Homo sapiens
  misc_feature 1..789: note = chr10:22541062-22541851
  misc_feature 1..789: note = hyper
  source 1..789: mol_type = genomic DNA
aggaagaaggaaaaccgagtaaaggaggttattcataagaacaggaaaggggccgaggggtagagaacacccgaaggaaagcgcaggaggccctcgtgagagggcaagggggaaaagatcgacgaagtaagagcgaaaagaggaaaggaaagaaagactttctagatgcggagtctccattttcagcagcgccatattcgcttttcctctcgccgcttttggctgggttttgtgtgcggcggtggacaggcgccagcacatttctgcagcttcagcagctctgctcagacacctggggagggccgcagggcccgggcgggggacgcgcgctcttggcccaggcccgggcgcggccccctccccggcctggcggttcctgcgcagcgccagccccgcgctcctctaggctgcaaagggggcctccgactcgggcccggcccggaggggacacctcactcggggccccgcggcagcccccaggggacgcgggccctctagtttcgcccacggtgtggctgggcatgcgtgccaaggggatgcgtaaccgagaaccgaaaaagacgaacttaaccttcggggaggaggagagggcgcacgctgcgggtaccggggcttgggggcgctcctggaggtgacggggtcacctccacctgcgcggggccactctctgggagccggcgatcgatgcccgccgcggcgcctggcccaggcccccaggcctctcgcggctcccggaaaaacgtccgaggtcggggctcggccgggagccccaagcgggtcccctggcct

SEQ ID NO: 32926 - DNA, 226 bp, Homo sapiens; identical to SEQ ID NO: 875
  misc_feature 1..226: note = chr10:22542024-22542250
  misc_feature 1..226: note = hyper
  source 1..226: mol_type = genomic DNA

SEQ ID NO: 32927 - DNA, 29 bp, Homo sapiens
  misc_feature 1..29: note = chr10:22542567-22542596
  misc_feature 1..29: note = hyper
  source 1..29: mol_type = genomic DNA
ggccccgggataatcggatcctcccagac

SEQ ID NO: 32928 - DNA, 179 bp, Homo sapiens
  misc_feature 1..179: note = chr10:22624127-22624306
  misc_feature 1..179: note = hyper
  source 1..179: mol_type = genomic DNA
gagtgccggcgcccccggccgggcagaggagcgggtgggccgaggctgggacatcgcctccgaaagctgccgggacgcggcggcttcctgcagagcctgcgcctgccggatccccagaacacagaagcttctcggacatgggagctccccgtgcgccctaaaaccaggagaggaaggga

SEQ ID NO: 32929 - DNA, 560 bp, Homo sapiens; identical to SEQ ID NO: 876
  misc_feature 1..560: note = chr10:22624561-22625121
  misc_feature 1..560: note = hyper
  source 1..560: mol_type = genomic DNA

SEQ ID NO: 32930 - DNA, 401 bp, Homo sapiens; identical to SEQ ID NO: 877
  misc_feature 1..401: note = chr10:22625382-22625783
  misc_feature 1..401: note = hyper
  source 1..401: mol_type = genomic DNA

SEQ ID NO: 32931 - DNA, 292 bp, Homo sapiens; identical to SEQ ID NO: 878
  misc_feature 1..292: note = chr10:22625811-22626103
  misc_feature 1..292: note = hyper
  source 1..292: mol_type = genomic DNA

SEQ ID NO: 32932 - DNA, 190 bp, Homo sapiens; identical to SEQ ID NO: 879
  misc_feature 1..190: note = chr10:22633985-22634175
  misc_feature 1..190: note = hyper
  source 1..190: mol_type = genomic DNA

SEQ ID NO: 32933 - DNA, 108 bp, Homo sapiens; identical to SEQ ID NO: 880
  misc_feature 1..108: note = chr10:22634324-22634432
  misc_feature 1..108: note = hyper
  source 1..108: mol_type = genomic DNA

SEQ ID NO: 32934 - skipped

SEQ ID NO: 32935 - DNA, 215 bp, Homo sapiens; identical to SEQ ID NO: 882
  misc_feature 1..215: note = chr10:22634440-22634655
  misc_feature 1..215: note = hyper
  source 1..215: mol_type = genomic DNA

SEQ ID NO: 32936 - DNA, 1017 bp, Homo sapiens
  misc_feature 1..1017: note = chr10:22764573-22765590
  misc_feature 1..1017: note = hyper
  source 1..1017: mol_type = genomic DNA
tgcgtaaataatactcgattaccatgccacctacatctttttgttaaaaatgcctttatgaaggctataatccttatcaaattaaaccctgcggatcccccttttaatacacagggagtcctcctcatttatgggcgtcggcgctaagcagctctggaaacgggcagacccagctgtgcagcgatgtccagtgtcgccgcatctgccccgcggggtgcagcatgagtcttcctttgtggcgtgcggctccatcggaacgcgcgttgcgacgacaaattccttttttcccccccgcagttaacagttctggggcagaggctggtggagaggtccagagcccactcagaccgagatgaagatgaggaaaagcatgagcaggaagaggctggcggctgcggcggccacagggaagagctcggtgcgcggcgcagcctcccgcgaccgcgactcctgggctgcgtcgaggagccgcgttgccataggaaccgtagcggcgccccagtgaaaccctgcgttcggacaggagaagctaaccgcggccgcccactcccacccgcgcttcctccccgcccccaccggccgtgcgcgaaaagcagagatccgagaaccgcgtgcggtacaaacggcaaaagcttcgcgcgcattttccgggagttgagcgcgcggccgcaggccgggaacctaccgctctcaggctcccagcccgggcgctacgaccctgtgggcgccgcctgtgcagcccctccttccagcccgctcgggcgcatcccccaggccgggccagcgacgcgggcaccgggagcccctcccgccggtccgggctttggcccacacccggggaccgcggagtgggaaaggaaccaaagcgcggcgcctggccgaccgcggacgaaattcgaggccggagggcgttttcttttttgcaaaattgccccaaagccagggccgcatgtacctactgtctcctttgccccacatgctccaagaaaataagacacattctaccccgagtcctaa

SEQ ID NO: 32937 - DNA, 30 bp, Homo sapiens
  misc_feature 1..30: note = chr10:23001954-23001984
  misc_feature 1..30: note = hyper
  source 1..30: mol_type = genomic DNA
caaaagcagggaaagcgaacttacactttt

SEQ ID NO: 32938 - DNA, 18 bp, Homo sapiens
  misc_feature 1..18: note = chr10:23216825-23216843
  misc_feature 1..18: note = hyper
  source 1..18: mol_type = genomic DNA
ctggattcaggtaatcgc

SEQ ID NO: 32939 - DNA, 286 bp, Homo sapiens
  misc_feature 1..286: note = chr10:23216844-23217130
  misc_feature 1..286: note = hyper
  source 1..286: mol_type = genomic DNA
gacgcacttggctcctcccgcactggccgctgccctcggcgggacaatgggcgccctagcagccccgagcgttcccagggcgcaggcgcggcgcggcgtggcgtcgcctagcaacgaggcacaacaagggactgggggttcgtctgctgggtttgcggagcagctagctactcggcgggatctcccggcaggtaaaggtaaccccgtggggtggggaggcccaaggcagaggcctgaggaaaacctgggaaaggagaaggtgccacgtgggcgcagactgcttggg

SEQ ID NO: 32940 - DNA, 44 bp, Homo sapiens
  misc_feature 1..44: note = chr10:23460401-23460445
  misc_feature 1..44: note = hyper
  source 1..44: mol_type = genomic DNA
cagcaccaaggccagcgcacctggctccacgaggctcccagaac

SEQ ID NO: 32941 - DNA, 571 bp, Homo sapiens
  misc_feature 1..571: note = chr10:23461156-23461727
  misc_feature 1..571: note = hyper
  source 1..571: mol_type = genomic DNA
cgatccgcagttcttcgcccctccctctgtcccaattatctagaaacaaaaagagtagaaaatcgaaaatgagatggaggtcggcaggggtgtgaggccacggatggctgctgcttccttgcttccttcttttgaagccagaatcgactctgctcttgctcgatgacagcccctcgccggaggcgcggctcctggcctctgcgggggtccgcgcaatccgggcgcctccagctgcccccctcctccgagggtcgcagccacagagcgcaggcccaagctggggcagaccaagggcggctggggtgctcatgccggtgccggcatcactgccggagccgccctgggcgcactgcacccagcgctgcttctctcgctggttctgtgccgctgctcctcccgatgcttgggggaccgcagggaggccgaatgacaaccggggagcctcggggccgcgcctgaggcccagagtctgggctgtgcagagcgcagagccccagcttccccagctccctcctggattaatgcttggtgccagggagaagcgcagggctctttccgcctcctccccaag

SEQ ID NO: 32942 - DNA, 443 bp, Homo sapiens
  misc_feature 1..443: note = chr10:23462020-23462463
  misc_feature 1..443: note = hyper
  source 1..443: mol_type = genomic DNA
ccggaatccctgagtcgactcaccccctctcctttttttttttttttaaatgggcgaatacctgtttaagttttaaaagcacatggaaattgcccgcgagcgaccatataatttgatttgccaggcaatctgcagagcgatcgcacgtcatttataatgttcattgagcattttgcctaattgtgtctgtctctgaaagggcagcgcaccccctcccgaccgctagcagcacaagtggcgacattcccatggagcggccgcgccgcagcttgccgcattcagcgcggacggcctggccgcgcgcttccccgcccggacgaccgggcgcgcctgacactaatagctcgcggctcaggtacgagcgggcgccgcatttgactcaattcaattcacaaccggccgcgcttgcaggtgtcgccttttgaaaccgccattcaggcggc

SEQ ID NO: 32943 - DNA, 130 bp, Homo sapiens
  misc_feature 1..130: note = chr10:23462485-23462615
  misc_feature 1..130: note = hyper
  source 1..130: mol_type = genomic DNA
cgcgggttctgtagaagcgcaagaatggggctgattattccggtgcccacatgccgcccccacacgcccccacccccgtccggcgcaagacttcccttggccaaaagaggcgtttaattagttctggggc

SEQ ID NO: 32944 - DNA, 440 bp, Homo sapiens
  misc_feature 1..440: note = chr10:23462634-23463074
  misc_feature 1..440: note = hyper
  source 1..440: mol_type = genomic DNA
cgacaaagcccggctccccaggtaacccgggttccctgcggacccgggagggggcgcgcggggccggagcaccggccttgggctgcgcgctccctccggcgacactgccgtccccctggcctccggcccggtcccccgcaggccaaaggctcatctgccgggcttgggtggcccgggccagcgccgcctgcggtccccgagtgcggctggctctaaggccggcgccctctccccggctttcagtgctcagagccaggccagcgggaaagaaggcagcatggtccgcaaaagacaggtggcagtggcagtcttgcatgatacttgtccttcttccctgttccccattttggggaaacactggaaacacttttctctttatgcgcattcgcgtctcagcaccgagtgctccaagccctgcgcgcagcgccgggcttggaagg

SEQ ID NO: 32945 - DNA, 588 bp, Homo sapiens; identical to SEQ ID NO: 3535
  misc_feature 1..588: note = chr10:23463266-23463854
  misc_feature 1..588: note = hyper
  source 1..588: mol_type = genomic DNA

SEQ ID NO: 32946 - DNA, 190 bp, Homo sapiens; identical to SEQ ID NO: 3536
  misc_feature 1..190: note = chr10:23463887-23464077
  misc_feature 1..190: note = hyper
  source 1..190: mol_type = genomic DNA

SEQ ID NO: 32947 - DNA, 724 bp, Homo sapiens
  misc_feature 1..724: note = chr10:23479973-23480697
  misc_feature 1..724: note = hyper
  source 1..724: mol_type = genomic DNA
tctgtagagagaatacgcacgatggctgcgcttctgaactctcccggggtggaagctgcagcctggcttttaaccggaattgcccagaccttgaaagtgtttctttgttgctcttaaaaagaggaattcacgttgcatcgcagtctgtgataaagtctgtcttggggcagagctgcatacgttttgtgttttttttttttttcagaaaagaaaggtcgagaaagaaaaaaacaagtcattcagggatggtccctgtggccagtcggaaaggtgagagactcgggctttgaaaacgattcacattctgccctttaacttcaatgccttccctccggactgcgccggagcagacgattcaatggactccttttgtatccagtttattgctcagaatccctagggtctagatttgctctcagaagaaacgcgccccgctgagctgctctgggggctgcccctcccgtctccccattcctttctccgggccggggagggcaggggaggcagccactgagccgatgtcgctggggacccgcaccaggcaccacagccaggctccagagcggagtcccataggtgcgctcccagcccccgtgttgcgtctggaacgcagtgggagtgggcccggatcaccttccaatgacacccgcatatactctgcaaactgtgcaaaagcccttgaaaagtccagagatgggacagaagcccccagcagaacccaggc

SEQ ID NO: 32948 - DNA, 147 bp, Homo sapiens
  misc_feature 1..147: note = chr10:23480903-23481050
  misc_feature 1..147: note = hyper
  source 1..147: mol_type = genomic DNA
ggaaggagccggcgctgctcagcgcgcgcgggtacgcagcgggcaccgcgggacgcaggtgcccctggagccgcacgcggggcaggtacagaatccagtatgcagaggcagaggagagggaagagagcggtgcgaggagccccgggc

SEQ ID NO: 32949 - DNA, 82 bp, Homo sapiens; identical to SEQ ID NO: 10226
  misc_feature 1..82: note = chr10:23481303-23481385
  misc_feature 1..82: note = hyper
  source 1..82: mol_type = genomic DNA

SEQ ID NO: 32950 - DNA, 400 bp, Homo sapiens; identical to SEQ ID NO: 10227
  misc_feature 1..400: note = chr10:23481386-23481786
  misc_feature 1..400: note = hyper
  source 1..400: mol_type = genomic DNA

SEQ ID NO: 32951 - DNA, 446 bp, Homo sapiens
  misc_feature 1..446: note = chr10:23481787-23482233
  misc_feature 1..446: note = hyper
  source 1..446: mol_type = genomic DNA
gcttcccctactcgcccggctcgccgccctcgtgcctggcctacccgtgcgccggggcggcagtactgtctcccggggcgcggctgcgcggcctgagcggagcggcggctgcggcggcgcggcgccggcggcgggtgcgctccgaggcggagctgcagcagctgcggcaggcggccaacgtgcgcgagcggcggcgcatgcagtccatcaacgacgccttcgaggggctgcgctcgcacatccccacgctgccctacgagaagcgcctctccaaggtggacacgctgcgcctggccatcggctacatcaacttcctcagcgagctcgtgcaggccgacctgcccttgcgcggcggtggcgcgggcggctgcggggggccgggcggcggcgggcgcctgggcggggacagcccgggcagccaggcccagaaggtcatcatctgccat

SEQ ID NO: 32952 - DNA, 174 bp, Homo sapiens
  misc_feature 1..174: note = chr10:23482288-23482462
  misc_feature 1..174: note = hyper
  source 1..174: mol_type = genomic DNA
cgaaggctccggaggggctgggggagctgactgccaagcagacagtcggaccgacggattgtcggtgggcacggaaaaacttgaatgcgagctcgcgtttctcgtttttttttttttttttatttttctgccacgttgaccgcggctctcaagggcgcgcgtccccgccagact

SEQ ID NO: 32953 - DNA, 793 bp, Homo sapiens
  misc_feature 1..793: note = chr10:23483777-23484570
  misc_feature 1..793: note = hyper
  source 1..793: mol_type = genomic DNA
aaggtaggaagaagccgcccgctacccctgccaccttcgcaacaggcttacttccaaaactgagttcgttttgccttcatcagaacttggccctcctcggccagcaacctggggagaaggcgagcctgaggcggggggcgtagggtagccccctagcgaaggggagaagagcgagggcgcggccgaggtcgcttagccagaaagcctgggagtccaggcttgggtttgtctcctttgtggccaagagcgcctcccgggctctcggggcgtcctcccctgcccgccagagccggggcgccggcactgggccctgaggcctggcgcgcgcgcagatggcgttggcgcgagcgcggactggagacgcgctcattgacgtggcaccgtagccccgtgcggcgcaggcctggcccaggcggggtgtggttccgtgggccgcagcggcctggtgggcgaaggtacaattgcggatagcctctaatactcacggccctgccgcaggacaatatgttggcagcatgctaattgctttaacctagtttcagacccaccgaggggttccccgcgcgccgcgggtgccatggacctcgtccaagagcaattaaagcgaggccgcgagcccgaccccgcagcgcggcctggccagacacgcggagattctgggtcgcaaggctcccgggagccccttggccgtggaccctctcaccccttttaagccttcgcgccctctccctccactcctcctaaaagaagatttcacactggagacagaatttcagaacgagagaaaataatt

SEQ ID NO: 32954 - DNA, 173 bp, Homo sapiens
  misc_feature 1..173: note = chr10:23486241-23486414
  misc_feature 1..173: note = hyper
  source 1..173: mol_type = genomic DNA
gaactcctgtgaaatcggctgagaatgcttcccaggaccgctcatctgccagccccaggattaacgcccctccgtggagagggtgtgaagcctcttaaatccataaactcatcccatttccattaatgggcctttgcggtggcaccgagtaccagctgcgaggttgaacaaac

SEQ ID NO: 32955 - DNA, 413 bp, Homo sapiens; identical to SEQ ID NO: 3538
  misc_feature 1..413: note = chr10:23487742-23488155
  misc_feature 1..413: note = hyper
  source 1..413: mol_type = genomic DNA

SEQ ID NO: 32956 - DNA, 1673 bp, Homo sapiens
  misc_feature 1..1673: note = chr10:23488382-23490055
  misc_feature 1..1673: note = hyper
  source 1..1673: mol_type = genomic DNA
tcttcggaggaggcccggggcaactacgccccgcggccgggagggaagccctcgggcggccgcctgtagagggccccgtggcccggggcgcaggttgtggcgagctggtttttgcctctgggccgaggcgccagcgctagcagcgacagcagcggggggcgcaggtttctagccagtccccactttcggacctctgggggtctgcccttgcttctcggggagtcttggcccttgactgatccccgcaacttaaggccaatcccatccctagctggccggcacctgttccaaacaacctgttgcgctgacatcgctttggagaggcgccggcgctttgctggtggaggcgggttgtgtggaggccccaagccttcaggaaatagtttagggttccgttgtggtgagaggcaccccctccccgcttcctgtggcatgtggggtgtttcacctctgcctgtgtcccaggaacccaaggcgtcctgggcacctctgcacctcgcccactctagggacttctcatgtagagctcggcagtttgggtggattagacaaagatgaggattagagacacaccgccggctaattaaatgggctcttctcctctcctcgtcccctccccgcaacccgcagccagataggactcttcggttccctacccccactcctaggccctatgtaagtgcggatggagaaagctagttacattagcccttctgtcttagaggtaccggcacctcggggcattctcgctcttaaagatgcgttttctgaattatttctagttttacaatttctcttcggtgactgcacaggatcccttctagctcttttcctgttggagtcgctggacgtctcccaaacagctagttagtcgcctatctctggagcgcaggccttcggaattggattcagggtatgagtctagctaggggatgtttctagaagttttataaaatccatttgggcaagcgttggcattcggattttaaaaatatagacgtgcactggcattgggcaactcaaaaaaaaatgtgtctcctggcgcttgtcagtgacatgctaattacaaattttaaaacaagccacttctaagcgaaggacgcctggctgcaaccccacaactcacaccggtgcatataataaaatattagggttcaacagttggcatatgtggcaatagcaaatgtgacacctcgaagcgattatctggaagtttttccgtacttttgaaaatacacttgccgcctcatttctctgatggccgctcaatagacactgggagatggtagctgggccacccctcccaagagttcttcttgcgtgcagcgctttcatccagggcttgaattgtgttgtcaaagtttagcagacaagaggagggggcatgagaacgggagggtgtcttgaaaagtcttggaaatcggtgtattttgcaggtgtagaagtgcctaataaccatggctagtgcgcgctccccaatggcgagggtatgacagggacagctggctcagttttcagtgtgaaaacaccccctcggtggaccaaacacaacgacactgacctttcttcggggggaaccagggatgtgcctttgactgaattagccataaagacgtcttgctatgacttttgttccccacgaaagcaaagaaatattgcgtttaatatgagaa

SEQ ID NO: 32957 - DNA, 47 bp, Homo sapiens
  misc_feature 1..47: note = chr10:23491161-23491208
  misc_feature 1..47: note = hyper
  source 1..47: mol_type = genomic DNA
acctagctagttctgcggacctctttgttccgcggcagaaagtcaaa

SEQ ID NO: 32958 - DNA, 123 bp, Homo sapiens
  misc_feature 1..123: note = chr10:23633374-23633497
  misc_feature 1..123: note = hyper
  source 1..123: mol_type = genomic DNA
gcctggaggctgctgcgataccccagaggaaagctgcacccccgtaaataacccttcagcctcccgccgtgcccctggaccctgctcgcttcctcctctacccaggcgcggagctcagcctac

SEQ ID NO: 32959 - DNA, 896 bp, Homo sapiens
  misc_feature 1..896: note = chr10:23982384-23983280
  misc_feature 1..896: note = hyper
  source 1..896: mol_type = genomic DNA
ctcgcagttaaaaaccgttgccactcgacggtggcaaaattgctggctgcactggagatcactgcagagcgctcctgatgcctcgatgctgacggcggatctggcgcgggctggggcgcattgcacattctgctccagccgggaggcggcgggcgggcaactccgggttggtcactcggcagccggcagaggtgcgcagaaggcgcacagaaccaggcactcagcctcaaggatgtctgggtctctgctaagggacaaacgctccaggaacaaggaacaacctctagccatcccagcaccacctaacgaaccttcgtttggctctctcgcagaaagtctcttctatttttggcccccaagacaatttcagagaaccagtaaagttgggtgacaacgtggatcgctttctagtgtaaggtcccggggaatggcaaaactcaaatgtagcctcactgatgagctcaaggaactctgcttggagttgtcacccctacgactgacctcagacccaggacccaagggcggggccctcttgcatctggaatccagcctcggccttgacccctttcgcttgttcggagtgctttcgcccagcttctggcggaggttcacgcagggaggggactcaggtggaaaaggctggcccctttgatctctttgcaggaacttagtagacaggggccccgggctggagatttgcttcgagtaggctagaggcgcccttggcgcaccgaagctggctgccttgctggaacctgccgcgggggtggaggttgaaaggactctgagctcttcttccccaagccgaactccctcctacaggagcgtggaaaccaactctcccacaccgtctatcccactcttcccccctaaacctctagcgcagctttttaaag

SEQ ID NO: 32960 - DNA, 190 bp, Homo sapiens; identical to SEQ ID NO: 10237
  misc_feature 1..190: note = chr10:23983617-23983807
  misc_feature 1..190: note = hyper
  source 1..190: mol_type = genomic DNA

SEQ ID NO: 32961 - DNA, 728 bp, Homo sapiens
  misc_feature 1..728: note = chr10:23984047-23984775
  misc_feature 1..728: note = hyper
  source 1..728: mol_type = genomic DNA
cgcatttcgcagctgcgctggtgtggggcatgagagcgaggtggctccaggtctccgcggagcagctgccagtgggagagcgaggagaggcgagggggcggcagcctcggcccgaagtaagtgcagcagaagtttgcgtcggttgccccgccgctcccccagcgcgagtgggaggcacatctcccctccttggataaggaaaccgaggggagacttacaagggagccttgcgcgggagagcaagtgagcgtttcgagagagggcaaggacccccccaggagggccaggccgggaggggtcccggtgcggtgatggggtgccaaaaggagaagacccccaactgggaggagggactggagaggaaccggaccccggggatctcagaaagggaaggatgtggggagagtgaaggtggaggcagtcacacctatcctggtgaccttggcgtgcccccctggagtggcgagccaggggcttatataggtgcgactaggatgttgcctcgtttttcactcggggctgcgaagagggcattgctctttctgatggctggaagacaggggcaaggagagagagaaccggccccgagacgggctggagggtggggacactggggagtttggagctgggggttcggagtgggaggtttgggtcttctgagacgctccagactctccggaggcggcagaggtcgaggcaggaggcgaatgtgacgcttagggtcgcta

SEQ ID NO: 32962 - DNA, 146 bp, Homo sapiens; identical to SEQ ID NO: 10240
  misc_feature 1..146: note = chr10:23984841-23984987
  misc_feature 1..146: note = hyper
  source 1..146: mol_type = genomic DNA

SEQ ID NO: 32963 - DNA, 42 bp, Homo sapiens
  misc_feature 1..42: note = chr10:25241916-25241958
  misc_feature 1..42: note = hyper
  source 1..42: mol_type = genomic DNA
gattcccagatccaccgtcccagccctcgggctaacaatctc

SEQ ID NO: 32964 - DNA, 60 bp, Homo sapiens
  misc_feature 1..60: note = chr10:25463833-25463893
  misc_feature 1..60: note = hyper
  source 1..60: mol_type = genomic DNA
cggtgcgggtctgggcgcgcgccccgcgcctccgggcgaagcggtcgaggaggagccagt

SEQ ID NO: 32965 - DNA, 254 bp, Homo sapiens
  misc_feature 1..254: note = chr10:25464520-25464774
  misc_feature 1..254: note = hyper
  source 1..254: mol_type = genomic DNA
tcggctccctggagccgctccaccgatggcaccatcttggcgcagaaactcgccgaggaggtgcccatggacgtggcctcttacctctacaccggggactcccaccagctgaagcgagccaactgctccggccgctacgagttggcgggcctgccggggaagtggccagccctggccagcgcgcacccctccttgcaccgggcgctggacacactgacacacgccaccaacttcctcaacgtgatgctgcagag

SEQ ID NO: 32966 - DNA, 147 bp, Homo sapiens; identical to SEQ ID NO: 3542
  misc_feature 1..147: note = chr10:25465203-25465350
  misc_feature 1..147: note = hyper
  source 1..147: mol_type = genomic DNA

SEQ ID NO: 32967 - DNA, 204 bp, Homo sapiens; identical to SEQ ID NO: 3543
  misc_feature 1..204: note = chr10:25465351-25465555
  misc_feature 1..204: note = hyper
  source 1..204: mol_type = genomic DNA

SEQ ID NO: 32968 - DNA, 183 bp, Homo sapiens
  misc_feature 1..183: note = chr10:26055811-26055994
  misc_feature 1..183: note = hyper
  source 1..183: mol_type = genomic DNA
gatgccattatcagccgccaacagatggagcctatctgcgcgctgtcaatcatcccccacctgtggatcgcgcagcccagccaaaaaattaattgcttagaaatataaaatcggtggactcagatcggaaaggattaggagaaaaaaggttaagcgaggggaagaagccgtgctgtgccagag

SEQ ID NO: 32969 - DNA, 99 bp, Homo sapiens
  misc_feature 1..99: note = chr10:26223001-26223100
  misc_feature 1..99: note = hyper
  source 1..99: mol_type = genomic DNA
ggatggcgcggatggcgcggcctccacctgcgggcagtggagagagcggcgagaggaagaatattccccgcgagccgggataaggggccccttcggctc

SEQ ID NO: 32970 - DNA, 105 bp, Homo sapiens
  misc_feature 1..105: note = chr10:26223101-26223206
  misc_feature 1..105: note = hyper
  source 1..105: mol_type = genomic DNA
gttgacccaggtcagatcctcccgccgaccttcggcccgccctctacaggcggcccagttcttcccctgctcggctgcccctgcccgcccctcgagggagcgccc

SEQ ID NO: 32971 - DNA, 435 bp, Homo sapiens
  misc_feature 1..435: note = chr10:26223600-26224035
  misc_feature 1..435: note = hyper
  source 1..435: mol_type = genomic DNA
gccaggaggagggaacgggaagggtgaacctgaggggtggacttgagggaagatcttgtgggtgaacccgaggagggaacgcgaggggatagtgaggggggatctcgaggagggaacgtgaggaatgaacttgaggagggaacgggaggggtgaacgtgaagtggaaacaggaggagggaacgggaagggtggcgtaaggggtgaaggaagatctttaggggtgaacttgggaaggaaacgtaaggggaggacctcgaagagtaacgaggggcgagaactgagggggccctgcagggagactggagggaggaggcgccgagtctggcgggtgtcgcctcggagacctgtggcgcgcgcgggctttgcggcgccgcccacaggtggcgctgggtcggcccgtccctgagggaactgcgttccgggtgatttctcag

SEQ ID NO: 32972 - DNA, 279 bp, Homo sapiens; identical to SEQ ID NO: 887
  misc_feature 1..279: note = chr10:26500592-26500871
  misc_feature 1..279: note = hyper
  source 1..279: mol_type = genomic DNA

SEQ ID NO: 32973 - DNA, 136 bp, Homo sapiens
  misc_feature 1..136: note = chr10:26501026-26501162
  misc_feature 1..136: note = hyper
  source 1..136: mol_type = genomic DNA
cgctcggccctcaagtgcccgggccggccttcgtgctccgaaacaagagacctgggagccctcgggaaacctcccccgacgctctctctcggaactcccgcaccctcctttctcaccagcccgccagttgtggcaa

SEQ ID NO: 32974 - DNA, 39 bp, Homo sapiens; identical to SEQ ID NO: 10249
  misc_feature 1..39: note = chr10:26501446-26501485
  misc_feature 1..39: note = hyper
  source 1..39: mol_type = genomic DNA

SEQ ID NO: 32975 - DNA, 443 bp, Homo sapiens
  misc_feature 1..443: note = chr10:26503701-26504144
  misc_feature 1..443: note = hyper
  source 1..443: mol_type = genomic DNA
gagttttcgaccacccgggctcccacagcctggaacagacttcacctagcacgctcagtgccagccttcggcaggacgctatcaacgcccgactggtttcctgctctcatcctggcgcctgggcccagttgccatagtgtggatcccatgactcctcagggaacccctggactcaggcacgcgagaagaagacagcgctttgtggagagaattgaccagggacagttatgctcgagcacacaggacttgggcctgtatgcgtccagcatgggccccaggatgtcccttctaagcgagggtcgaggggtgctcgcccagacgggatccccgggtctctgctttgttagcagctttggtggctggttcaggaggtcagagaaataaaacgacttgtgaacacaatggaaatgacaggcgctctggccaggcgcggggaaggcagc

SEQ ID NO: 32976 - DNA, 694 bp, Homo sapiens; identical to SEQ ID NO: 3546
  misc_feature 1..694: note = chr10:26504190-26504884
  misc_feature 1..694: note = hyper
  source 1..694: mol_type = genomic DNA

SEQ ID NO: 32977 - DNA, 228 bp, Homo sapiens
  misc_feature 1..228: note = chr10:26505008-26505236
  misc_feature 1..228: note = hyper
  source 1..228: mol_type = genomic DNA
cgcccggggcgcgagctctcgaggtcgcagtgacctcagcacctgcttggaggaaaacggcgcgggaaccccgcttccttcccctcagctggagccagacctcaaacaaaaccccaatcgatgcacacagaaaactcctctgggccacgcttcccgcctcgccgaggtctccccagtctgcccctcgctgacgctggcgcgcagcggctgtggcagcacccgggacag

SEQ ID NO: 32978 - DNA, 62 bp, Homo sapiens
  misc_feature 1..62: note = chr10:26505441-26505503
  misc_feature 1..62: note = hyper
  source 1..62: mol_type = genomic DNA
cgctttcctgagtccgggctccgaggacccttaggtagtcccggtctcttttaaagctcccc

SEQ ID NO: 32979 - DNA, 114 bp, Homo sapiens
  misc_feature 1..114: note = chr10:26505504-26505618
  misc_feature 1..114: note = hyper
  source 1..114: mol_type = genomic DNA
gcttccaaagggttgccacgtccctaaaccctgtctccagctcgcatacacacacgcacagacacgcacgttttctgttcctgcgtgacacccgccctcgccgctcggccccgc

SEQ ID NO: 32980 - DNA, 640 bp, Homo sapiens
  misc_feature 1..640: note = chr10:26505713-26506353
  misc_feature 1..640: note = hyper
  source 1..640: mol_type = genomic DNA
cgacctgctccagtctccaaagccgatggcatctccgggctctggcttttggtctttcgggtcggaagatggctctggggattccgagaatcccggcacaggtaggaaggagaacgggggcctgcggcgggcgagttttgcggtggtctggggtttgcggaactacggagaagacgaaggaggtttttccacctgcaacaggaaacttcttcgggcgcttctccctgcttttgggctaagtccttgacggcccaagagctcaagacctctacagcctcttgtaccctgggaagacgcccaaatagtctcaggcccgttccacagaaggttggaagagccccccaaagaccgcggtgtctcggggacatggaattccgtggtcctggggcgctgctaagatccgggtgtctggaccctggggtgggacggagtgaccgtgaagatagaaaaaaaaaatgggaaaggtgagagatttctttatctagaaagacagtctgcgaaaaaatggatagcttcagtgtttaggaaaactcgtccaaggtaggcagggagaggaatttgcctgagccgattggcacctggaagggcagcggtgtgggcttctcctcgggaaacagataaaggaaatgagggctggccc

SEQ ID NO: 32981 - DNA, 265 bp, Homo sapiens
  misc_feature 1..265: note = chr10:26506354-26506619
  misc_feature 1..265: note = hyper
  source 1..265: mol_type = genomic DNA
ggccgccagcctcccgcttgccttctgcacctgccggcctcaccgagtcctgagcggcccccaggaggaaggcggcccctcctaggaccccggactgattgattttcacatagaacgaaatttcacacgtccgtctgttgttctctttctgcctcgctgtctgcctgcctattcttccttgcagcgcgagcctggtgccaagtggctcagaagttcacgggcggcatcggaaacaaactgtgcggtgagtgcccagggaccgggg

SEQ ID NO: 32982 - DNA, 545 bp, Homo sapiens
  misc_feature 1..545: note = chr10:26506902-26507447
  misc_feature 1..545: note = hyper
  source 1..545: mol_type = genomic DNA
cgtttctccatgcaacaggtaaagactcagcggggagccccggggcgcccctgcccctctctctgccccgcccaccgcggccggtgcgggtccggcgctgagagccggacaggggcgtcgaggtggcagcggaggcgggacctgccagaatcttcagataaaagcgagaaatgcgggacctgcccgctgggtccaagcccccgaacctggcctcggagctccaagagggctctgaggccgtggcgctcttcccccagcgcggcccttgggatggcgggtggccgacgatccaggcgctcgtgcgctcactgaatcgatgacggctggcttccctaggccgctggggcctcgggtgggactcagtttccaaataccgtgcccgagaattcagaattgcattttttttaggtctttagatcacgagagtgatttgtagctgcaattgcacaagagaacgattccattcacatgaaacccgcgcgccgagttttacccccgtgcacttacacaccgtctcccaaatgtacgcgcgcacacacacatgc

SEQ ID NO: 32983 - DNA, 30 bp, Homo sapiens
  misc_feature 1..30: note = chr10:26680701-26680731
  misc_feature 1..30: note = hyper
  source 1..30: mol_type = genomic DNA
acctgctggaaagctcgcagcagggcccgc

SEQ ID NO: 32984 - DNA, 171 bp, Homo sapiens
  misc_feature 1..171: note = chr10:26680960-26681131
  misc_feature 1..171: note = hyper
  source 1..171: mol_type = genomic DNA
gggcagactgtacccgggcaacggctccccgcagctccggctttttgcctgaagccccctgcaggcaaattccgcgtcgcgcgggcccgcgggcgcgctgcagtctccgagccccaggaagcagagacccaggtaggcaaagccaccgcctggccgcgtcagctcatgtgg

SEQ ID NO: 32985 - DNA, 741 bp, Homo sapiens
  misc_feature 1..741: note = chr10:26727076-26727817
  misc_feature 1..741: note = hyper
  source 1..741: mol_type = genomic DNA
tcctccacccccacccgagagacagctgaactccggccgggacgcgcgtgttgccagtccagccctgcaccgcgtcccctgagggcgggctgcaggcggccgggaagccttgcacaaccggcccaaaagaggaagcccagaaagtgctgaagtaaacactttgggagaccgttgcaacataaagcggcctctcagtctttggtggaaccatcactaggccccaatcccttagtccctcttgcgtcgaggctgcaaaatggttccattcgccaggagacgctcctgagagaagggcgcgcgcggcacaggtagggggaggcgcaacgtttcccagaattaaaataaaataaaataaaataaaataaaaatcccttcaaggtggttgtgtagtaggggtgggatgggggagagaaaatcaggcgcagactcgatgagttggagaaagcagcccctaactcggagtcctttacgcatatgtttgtctgtcccactgtctctaaccaggggccttccttgcacctcggagcaaagcagctcggatagcgccacacgtctgcgcgctgcgtgggaagggcagggctgacagcacttcctccccggggcagcgacctggagcccgggtgcggcagtctgcaccgcgcgtcgctttcccggccggagtctcgccgccttcccgcgccccgcagcgccccgcagagcagtcgaggtaagtggcgctcccagtcccgggagccctgggag

SEQ ID NO: 32986 - DNA, 183 bp, Homo sapiens; identical to SEQ ID NO: 891
  misc_feature 1..183: note = chr10:26727867-26728050
  misc_feature 1..183: note = hyper
  source 1..183: mol_type = genomic DNA

SEQ ID NO: 32987 - DNA, 763 bp, Homo sapiens
  misc_feature 1..763: note = chr10:27547569-27548332
  misc_feature 1..763: note = hyper
  source 1..763: mol_type = genomic DNA
caacctttcctaccgcgtggagtgagttgggatgcatactggggagttgtataagagtgtctgagaaagggaaatgcagagttgaatgaaagtgtttcccgggaggggccgagtggaaagcagcaggtggccggcgcgggtggaacccagcgcgggcgcagagcgtctctggcgtgggcattcggtgcagcgagtccgcgggaatcttggatgcgcggaggtccccggaccgcggtgacggacggggctgcgatcgtggccggtgagactgggagcggagggctggggcggcgcccgagggagggcacaaacccgggaggcctcagccgacggcgcagctttacgcggccgtagggcgcccggggttgagtggtgtcctagcaacaggtgggcgccgactgcggcggggcagggcgctgcaggtgacttcggccgggggtccccaggcccaccccatgggggctctgcagccggccgcgtagatcgggaaaccggggccgctctccggccccgccgctgctgctctcgcctgcttccctttccctcccgggggccgagacctgccccctccccttttctctcccaggcccatctcgctccttcctccccgcgagaccctgcctcggccctcggttggggaccgtctgctcctcagtccctgcgcccctctctgcactaccctggacccatcacctcccggatcggttctccacttaccccgctgtttccctgtctctccttccgcgagcccatctttctcctt

SEQ ID NO: 32988 - DNA, 84 bp, Homo sapiens
  misc_feature 1..84: note = chr10:27548400-27548484
  misc_feature 1..84: note = hyper
  source 1..84: mol_type = genomic DNA
cgaatccattcttggaaacttagggtctcagctctgacgcccccttcttgtaacgagtctggtgggggccgtcatcccacacta

SEQ ID NO: 32989 - DNA, 190 bp, Homo sapiens
  misc_feature 1..190: note = chr10:28030892-28031082
  misc_feature 1..190: note = hyper
  source 1..190: mol_type = genomic DNA
ggtcaggggaaaggtcgccgactggacatagggaataaagcaaaggagcattgccgccccggctctctttaagctatttcctttgatcttttaggaaaagggggaaactttctaaaggagttggtggtttgtggaggaaagctgcagaacccaaaaacaccgtcgggccgtttcccgactaagggagggt

SEQ ID NO: 32990 - DNA, 324 bp, Homo sapiens
  misc_feature 1..324: note = chr10:28031314-28031638
  misc_feature 1..324: note = hyper
  source 1..324: mol_type = genomic DNA
aaatgcaattccacccgaaacgactggtagtaacattttgacgaaaccgaatctctgttttactaagcagcgacgccgcagaacaagcagctgatgcaatcgttcaggtggaggcggctaggacggccgcccctccccggcggggcgcccggggagccgccggatcgggccaggcagagcctgccctccactcaccggcagtctgagcagctggcccacccgcaagctaccgccccccccagcatacccctcaccccgctaaactcaaacccggccccgcaggcccggggcctccccctccgggttcgccgcgggcccagccga

SEQ ID NO: 32991 - DNA, 881 bp, Homo sapiens
  misc_feature 1..881: note = chr10:28031863-28032744
  misc_feature 1..881: note = hyper
  source 1..881: mol_type = genomic DNA
aataacccccaactccgaggtccaggcagcggagggccgaggggcagctcctggcgcccttagtctccaccaagctctttggagctgccccgacgaattgatccctcatgttttaagataggagccccttaacatgagaatgcgcgagccctggaggggcagacctgcactcccagggaactccgggccctttcccgtccacccgcccgcgttgccacgggaccccgtcacagctcaccacccccacccctccgggccgcaggcgggcagggcccccaggggagtgcgcatacccggtcctccggtgtctcaggccgaggttgtccttgaggggcgggccgtcgggaatgcccacctcggggcgggcgtgaggactgtccaggacaccgctgtagggccggccaccccgctcccgctccgaggcgcctccgtcctcaaacagcaccgcaccgctgagcttgttgaagacgatggtgttcatggtgtcggttggtagggacgcgcggcgcggccgcagagcctcggggctgggccgccgggagctccgcagcggggctcggcttctaggagaggaaggtgcatctcgttacttactggctgagagtgctcagacccctgcaggttcagggccttgaacttggccgggtcgccgggctgcggagccgaggggaggagcggcgccgccgcaactggcagggaccctgcggctctccccagttggctacacgcccccgcccctgcaggttccccggacaggtacctgccctcttccttgcctgggcgatcgatccccccaatcccttcactccccagaactacaaccgggaatcattcacccgcagaggcaaaggaaacgaattcccaaacgagcctctgggttt

SEQ ID NO: 32992 - DNA, 688 bp, Homo sapiens
  misc_feature 1..688: note = chr10:28032952-28033640
  misc_feature 1..688: note = hyper
  source 1..688: mol_type = genomic DNA
gatttgggggattttcgtgttttctagatcgtggatggtttggttgaaacccccgcatcttctgtccgccaaggtcccccggggtgaggttgggttcaaggacaggaaaaagttaagtggcgtcaggacgaaagcaccacttctcccccttctctcccagaatcttcctatcatcccccaacgcgccccgggaagtgcatggtcctaaggtccaaggcgccaggacccaggtccccagagccctcaatcagtgccattctcttccgcagcgcgggtgtcagccgcgagctcgtagcccctcgacacccgcctctctctggggtctccggggaccctttcagaggctgtaaaggtgtcagaagcccaaggcaggaggcagcttggtcggcgcacctcccgggccactgctgccactgtcggggagagccagcagctcacctctggggtcgcggaggccctgagcctctgcctgccgcgcaccggcgtcaggagcaagtccgcgcggccgcggagccgcagagttacagccccaaggcgcgcggcggacttcgcccgccccatctcctcgcctcgcgcctcgggacagctcccgtttcctccgagcggcctcagcttcgctgccagcgccccctttgcccgtccagccgcggcatgggctgctactccactaacacacgcgcgcgcgcat

SEQ ID NO: 32993 - DNA, 388 bp, Homo sapiens
  misc_feature 1..388: note = chr10:28033700-28034088
  misc_feature 1..388: note = hyper
  source 1..388: mol_type = genomic DNA
cgccaacgcccccgccccgcccttcggccaccgcagcagaggccacgcgtgacatttaggaccacgcgtgaccaccgcgatcaaacgacggctacggtctgtgttcgtagggaagtgaagtcagacctctgctggatgtcgtgtgtcccctaggactgcgtcctcccgcgcagacaggtacgtgcctggggtgtgcacatagcctcggtgataagtgtcaaagagaattttcgtgcttgcagcccctgttctacagtcaagactcgcgttggtgttttcttttaaaatcatgcccttagggatgtgtgttcatgctgctttatttgtacaagacacccttccccggcccggccttctccgagccaccccagcgcgtcctcctagatgc

SEQ ID NO: 32994 - DNA, 193 bp, Homo sapiens
  misc_feature 1..193: note = chr10:28034326-28034519
  misc_feature 1..193: note = hyper
  source 1..193: mol_type = genomic DNA
cgcctcttctcaaatcacttaccccgattcactccagactgtggccggggaggtcactccctgcagaagtgtccccctcccccaacgccggcgaataattttaaagcaaaggaggcgcggccaggtgggctcccaagctccgcgcagacccttgggccagccttggccgctacccgagcgcctctccaccaga

SEQ ID NO: 32995 - DNA, 881 bp, Homo sapiens
  misc_feature 1..881: note = chr10:28034873-28035754
  misc_feature 1..881: note = hyper
  source 1..881: mol_type = genomic DNA
ggtatccacgttcccgggcgggtggagaggaagcgtccgcgcccgcccggccgcgggggctgctgttaacccctagcagaggagccgctgccggggagccccgggcccgccgagtcctccggagccgggcgcggctcccagatccgccggccttgcagtcgtggagcagacggggcttttcccttcgcactttaggagagaaattggagaagctgccgggagcgctcggctccggctccagaagctgagaggctgcggtgcaaatcccgtgtcttagctggcccgattgccggaaatttcactgcgcgtggctaggcgggagaggccactgtgacgcgccctgtattttcctctcgattagctggagggaagttagagctccgttttgcacctacagccctggagcgtattgcgggaagtgctagtgcccaggagcctcttttctgatgtcactgggcttctggggtcctagttgtctcagtcaaagccaggcacacattcacctccggggcaagggctggtgaggctgccctcgccgctgggtatagggatgggggaaagcaaggatgggatgagttcagcccaggtggccaacccgcggtggcccaagtgcagaagaggaagcgcgcccaaagccaaggatctgcacgcagcaaaggagatggaacttagaagaatcacaagctgggacacagggcaaagagagagaatggctaccagattctctgattgatgatactttgcttcctaacattaccgcaaatataagtagcgaaagcggcggtttaggtgcaactgcaagctcagagcttctggcagcccagaagatccccaaggtgccaacacgaagctgcctgcgctctcgccgaaggccctgtggt

SEQ ID NO: 32996 - DNA, 15 bp, Homo sapiens
  misc_feature 1..15: note = chr10:28287365-28287380
  misc_feature 1..15: note = hyper
  source 1..15: mol_type = genomic DNA
cgggaggcagagctg

SEQ ID NO: 32997 - DNA, 378 bp, Homo sapiens; identical to SEQ ID NO: 10270
  misc_feature 1..378: note = chr10:28287828-28288206
  misc_feature 1..378: note = hyper
  source 1..378: mol_type = genomic DNA

SEQ ID NO: 32998 - DNA, 537 bp, Homo sapiens
  misc_feature 1..537: note = chr10:28957458-28957995
  misc_feature 1..537: note = hyper
  source 1..537: mol_type = genomic DNA
ctggtttaaatttctcgagttacggggggaaggggttgcggtgggagcgagactgagaaccacagcgcgaacaggggcgcattggtaccaggatcggtacagggatgtctccagttcctatagactctagcctcggggggagtctgtccagactacaagtgtctgtgcccctgttttattttgagacaagtcggggtcgctcaatgagtcagcacagaggaggcagtgggggagacagacagcggctgggacgcgcgggactggggcgcgccttgcgcgctgggcaccggagctgcgcacgggcggcccggggcgggggccccagagagcccgggagggcgtggactcggccggggaggggcgggctcgggcgcgtctgggttggagctggatgatgtaaaacagcgcggagctccttggcgcctcggcaccattaccttcaattatcataattggtgcctctctccagcgtttgcatttcccccgagggatctctcactagttcccgttccttctcctcgccctctctcgctcact

SEQ ID NO: 32999 - DNA, 73 bp, Homo sapiens
  misc_feature 1..73: note = chr10:28958043-28958116
  misc_feature 1..73: note = hyper
  source 1..73: mol_type = genomic DNA
cgatctttttggatgttctccctgcctaaaacggatgctaatatctcttcgattgaaccgaaatggcgctgcg

SEQ ID NO: 33000 - DNA, 141 bp, Homo sapiens
  misc_feature 1..141: note = chr10:28965689-28965830
  misc_feature 1..141: note = hyper
  source 1..141: mol_type = genomic DNA
attgagtgtcagtctcggccagtgtcgtctcgttggcgccgggtgcttttggatttgctaattttcgttaagtgtctctagcccgctactcgtcccgcgtacccgggagaacctagcggctcctaacggatcaacagtcag

SEQ ID NO: 33001 - DNA, 124 bp, Homo sapiens; identical to SEQ ID NO: 10274
  misc_feature 1..124: note = chr10:29011038-29011162
  misc_feature 1..124: note = hyper
  source 1..124: mol_type = genomic DNA

SEQ ID NO: 33002 - DNA, 118 bp, Homo sapiens
  misc_feature 1..118: note = chr10:29011504-29011622
  misc_feature 1..118: note = hyper
  source 1..118: mol_type = genomic DNA
tccagctaacatcagcgctcagtctccccgcccaggtgggatcctccaagcgcctcaacgcaccgcccatcccggtgccaggtgtaaatgcgccccagcaacacgtggctctaggagc

SEQ ID NO: 33003 - DNA, 81 bp, Homo sapiens
  misc_feature 1..81: note = chr10:30026076-30026157
  misc_feature 1..81: note = hyper
  source 1..81: mol_type = genomic DNA
gcttaccctggagccctgagaggcccctttgagtctccagaccttccagggataaataaaatctggcgacctgtgccaacg

SEQ ID NO: 33004 - DNA, 259 bp, Homo sapiens
  misc_feature 1..259: note = chr10:30348156-30348415
  misc_feature 1..259: note = hyper
  source 1..259: mol_type = genomic DNA
aggggacgcccctcccgggctggcaggcgccctccaccccgaggctgccgggctaggcaccgcgcggggggcccaggcggggctgcgactgggggtgcagacatcccccaccgccagggtggctggaaccggagcgacgtcccagctggagaagttggggggagtgcgggaggctgcgggtgaggcccgcgaagcgccgtgggagcggccctaatggacggtgggagccaggagggttagacgccgggacttaccgagc

SEQ ID NO: 33005 - DNA, 30 bp, Homo sapiens
  misc_feature 1..30: note = chr10:31073324-31073354
  misc_feature 1..30: note = hyper
  source 1..30: mol_type = genomic DNA
gttcagctccaaaggcggcctggttcgcag

SEQ ID NO: 33006 - DNA, 32 bp, Homo sapiens
  misc_feature 1..32: note = chr10:31074146-31074178
  misc_feature 1..32: note = hyper
  source 1..32: mol_type = genomic DNA
cccagcgccgccccccgcggtgcaggggtggg

SEQ ID NO: 33007 - DNA, 48 bp, Homo sapiens
  misc_feature 1..48: note = chr10:31422926-31422974
  misc_feature 1..48: note = hyper
  source 1..48: mol_type = genomic DNA
ttaagcaaggggcttcggagaaattagaaccagcgttctaaattaagg

SEQ ID NO: 33008 - DNA, 335 bp, Homo sapiens
  misc_feature 1..335: note = chr10:31608744-31609079
  misc_feature 1..335: note = hyper
  source 1..335: mol_type = genomic DNA
cgccgcggccccggccggcgccgtcgctgtcgctcgggccccgcgactcgggccgggctgtgggcgcgcggcaggcgggctgcggcggcggcgggacggggcggccgcgggttgcgtggggtttgtgcgcgcgtgtgcgcgggcgccggctgtgcgcgccgcgggcggacagggttcggccggcggcggtaaagttgggacccgcgggccgggcgcgctcgcgtaacggggattagaggcgcgggggcgcgggtccctaagcgcccctcctccctggcgcctcccgctgcccggcccagagccccggcctggggactccgcggcgagccccgcga

SEQ ID NO: 33009 - DNA, 45 bp, Homo sapiens
  misc_feature 1..45: note = chr10:31609288-31609333
  misc_feature 1..45: note = hyper
  source 1..45: mol_type = genomic DNA
ggtgtgcgtgcgcctcgcgcttttctctttcggtttttggggaag

SEQ ID NO: 33010 - DNA, 397 bp, Homo sapiens
  misc_feature 1..397: note = chr10:31609668-31610065
  misc_feature 1..397: note = hyper
  source 1..397: mol_type = genomic DNA
gctttctctccctctcgtgcagcagcgaaatgtctgctgattgttattgtctggacagttcctgtggcgagaggggcgagacttgtccgcccgggggcggcgggagcgcagggagagcagcccccgcctgcgccgccccggtacctgtttgtataataatgggcggcaacggccctgccgccggccgcagcccaggctatataaggaattacacgtacatttcggaccgaggggctcgctttggttcctgcgttatttttaaaacgacttttaagagaggggcaataaatgcgtctataatgggaccgctgcagcgtcgagaaaacgaggaaatacgtgtttaggagaaaactctctcgtgctcccccagccccaccccccgcgcctgggctccctt

SEQ ID NO: 33011 - DNA, 47 bp, Homo sapiens
  misc_feature 1..47: note = chr10:33622724-33622771
  misc_feature 1..47: note = hyper
  source 1..47: mol_type = genomic DNA
actccagacagattacggaaggtgtacaaaggcgggggagggagttt

SEQ ID NO: 33012 - DNA, 74 bp, Homo sapiens
  misc_feature 1..74: note = chr10:33623014-33623088
  misc_feature 1..74: note = hyper
  source 1..74: mol_type = genomic DNA
cagcccaaggatcaacgtcaggagggagcccaaagacctgaaatcctcctgctctaaaccgcctgatctcattt

SEQ ID NO: 33013 - DNA, 237 bp, Homo sapiens
  misc_feature 1..237: note = chr10:33624107-33624344
  misc_feature 1..237: note = hyper
  source 1..237: mol_type = genomic DNA
ctggccagcccacctcgcgtgctcgctctgcacccctagagggagagctgggcagctcctgcaggcgcagatcccgccgccgcgcagtgcggagcgcccgggaggtggcggctgcttctcgcaacttcaaatcccggggcccgcgccctcggcggcgaggaacgcagggtcaccccctgccactcctcatcgcgccatcctgagacctgtggcggggagcagcggggcacccctgga

SEQ ID NO: 33014 - DNA, 98 bp, Homo sapiens
  misc_feature 1..98: note = chr10:33625772-33625870
  misc_feature 1..98: note = hyper
  source 1..98: mol_type = genomic DNA
tagggtgacccggagcgacctcggtccaggctcggagggagaggcgcctctcaggacctggcaggttgacagggaaggggaaccgggagggagcggcg

SEQ ID NO: 33015 - DNA, 158 bp, Homo sapiens
  misc_feature 1..158: note = chr10:35105055-35105213
  misc_feature 1..158: note = hyper
  source 1..158: mol_type = genomic DNA
cataaggaatcctaacgcgaatccgtgaacagtctattccgacggcgcagagaaatctcacgcggggatccccacgatgtgccggcgcttaacgcagacgcccgaacccaggggaaggctgcgactccgcgatgagtgacatgcgggcttgagacgtt

SEQ ID NO: 33016 - DNA, 348 bp, Homo sapiens
  misc_feature 1..348: note = chr10:35929333-35929681
  misc_feature 1..348: note = hyper
  source 1..348: mol_type = genomic DNA
cgctgcacgccaccttctcgtggcccgccaccaggcgcactaggtagcccaccgacacgaagaggtagcaggccgagaggaagataatgggccgctccgggtacttgaagcgctccatgtcgataaggaaggtggagacggtggcgaaggtggacacgaagcagagcaccgaccacaggccgatccagaagacggtgaaggcgcgctcgtcctggctgaaaaaggggttgtggcagggcagcgcgcagttagcgatctggcctgtcttgacgcggttgtagagcgggtggcgctcgctggacacgctcaccataggcgcgcggcactggcacccgggctcgcagggag

SEQ ID NO: 33017 - DNA, 335 bp, Homo sapiens
  misc_feature 1..335: note = chr10:35930004-35930339
  misc_feature 1..335: note = hyper
  source 1..335: mol_type = genomic DNA
cagccggccttggcgcgctcgcacaccgagcggcagggcggcagcggcttcttgtagtcctctaggcagatgggcgtgtacatgctgcacaggaagaacttgagatcgggcgagcactggatctccaccagcggccagaactggtgcacctccaggcccgcctcgtcttgcgtgtcgtggttgaactgattgggcatgtaggtgtagttgtagccgatgcccttacacagcggcacggtgatctcttggcatgccagctccttggccgaggcggccgcagcgccgctagagcgctgcagcagcgccaaggcggccagcagcgaggtcacttccaa

SEQ ID NO: 33018 - DNA, 43 bp, Homo sapiens
  misc_feature 1..43: note = chr10:35931819-35931862
  misc_feature 1..43: note = hyper
  source 1..43: mol_type = genomic DNA
gagcccagccttgggcgcgcgaggggcgcgggggacaaatgcc

SEQ ID NO: 33019 - DNA, 197 bp, Homo sapiens
  misc_feature 1..197: note = chr10:43248578-43248775
  misc_feature 1..197: note = hyper
  source 1..197: mol_type = genomic DNA
ccgtgcctactggcccggcagtcctgcgggtcagctcaggggagtgctctggagagccctgagcccacctcctgcgccccgcccaacctcgggtccccaggcccagcctctgacacgccgctcccagcgcggccacgccacagctccgggctgcgctcccccaggcaaaggcgccgccggcgcgtccagcgcggcct

SEQ ID NO: 33020 - DNA, 30 bp, Homo sapiens
  misc_feature 1..30: note = chr10:43249043-43249073
  misc_feature 1..30: note = hyper
  source 1..30: mol_type = genomic DNA
ctgcgcccaggtccccgacacccgccaggg

SEQ ID NO: 33021 - DNA, 636 bp, Homo sapiens
  misc_feature 1..636: note = chr10:43249483-43250119
  misc_feature 1..636: note = hyper
  source 1..636: mol_type = genomic DNA
ttcttccttgttttccgggtctcgcgcctctgaagcgaactgggcctggaggggtgctggggatcgagggagcggcgttggtgggtgaccgagggaaaggtggggccagcccctgggcaccggtcggaggaggattacgaggcggagccgctgcctgcccgcgcctcacccgcttggtccacccaatagctccgctgtagactcgcggcggcaggagcggcgggccagatggtgattacaacccggggcgctatccctttggaacctgacccccaactccgctcagtaaccggatttccggaagccgcgacctcgaagcccccagcgtttctccaccgacggcggggccggggctcctggaagcctcggagccgcagctccagcctgcagcgcacgccttggcccccagggagcagagaggcagagtacccccctgcatccggagcatagcaagcatgccccaggctgaggacctgcgacttggtgggacttcggtgcccgcccctccgccactacagggagcagaggcggctctggaagtcggtttagtgcggagaccgcgaccggaggagcgcagaacgctcctcccagcgtcctgggctccgcaggcacaatttttaaaccagaggcgaaatc

SEQ ID NO: 33022 - DNA, 644 bp, Homo sapiens
  misc_feature 1..644: note = chr10:43250136-43250780
  misc_feature 1..644: note = hyper
  source 1..644: mol_type = genomic DNA
cggggagggagcgtggccgcctagccgagccccttctctggctccgcccgcttttgcgccgcgaggccgcctggtgagttccagggccctgtggtcccccagccgccggcgctctcgggtgtcttttggccgcggcaggaacggagctgggcgctcagacggcgccggggtcgtttctgtgcccccgcccggtggccggagccgcagccttgccccttccccactggggcagcgcctgcctttctcgcggccggaccgcgccggagtcccaggccccaggcagcccgggccgcagctgtcatggagaagcccggcgcgtacttggggtgcccggcaggagccccggccgcctcgcgcccttcttctcacccacgactgtggccggcggcggcctctgcttcccggacaaagctggagatgctgctgcggagtcggccctgggacctgcttcttctcttggctccggggcccgcagccgtcggggcccggaagggctccccggggcgttccctcaggagcggtggccagggctgatggggcgtgtacgacgcgggaccccgagcccggcagcagccaagtatggcaaggaccagcgcgagcatctccccactgcggccggggacggcgtggggtgggagccgacc

SEQ ID NO: 33023 - DNA, 55 bp, Homo sapiens
  misc_feature 1..55: note = chr10:43250854-43250909
  misc_feature 1..55: note = hyper
  source 1..55: mol_type = genomic DNA
cgcccaggccgccggctcggtgagcgcagagaggggcccccggtttatgccaaac

SEQ ID NO: 33024 - DNA, 32 bp, Homo sapiens
  misc_feature 1..32: note = chr10:43332719-43332751
  misc_feature 1..32: note = hyper
  source 1..32: mol_type = genomic DNA
gggaaagttaaagaacgcgctgcagctacttc

SEQ ID NO: 33025 - DNA, 38 bp, Homo sapiens
  misc_feature 1..38: note = chr10:43361563-43361601
  misc_feature 1..38: note = hyper
  source 1..38: mol_type = genomic DNA
agtgcccggccgccgcgagctcgcggggtgtatgcccg

SEQ ID NO: 33026 - DNA, 102 bp, Homo sapiens
  misc_feature 1..102: note = chr10:43362008-43362110
  misc_feature 1..102: note = hyper
  source 1..102: mol_type = genomic DNA
cggtgcttgtgcacacgcgtgtgcgtgcgtgtgaacgcgtcagggtacccgaggatgcacacacgcacgtgtgagtgtgcgcgagtgcgtgctcagaggaca

SEQ ID NO: 33027 - DNA, 78 bp, Homo sapiens; identical to SEQ ID NO: 10283
  misc_feature 1..78: note = chr10:43393565-43393643
  misc_feature 1..78: note = hyper
  source 1..78: mol_type = genomic DNA

SEQ ID NO: 33028 - DNA, 177 bp, Homo sapiens
  misc_feature 1..177: note = chr10:43428400-43428577
  misc_feature 1..177: note = hyper
  source 1..177: mol_type = genomic DNA
ccagccctgtgctcccgcgcccccagtctcagcgggttccggcttagtccggcaccctgggggaatgctgcgctctggctggcagcacgccctgcctgcgctcgccccgtctttgctcctggtcaccatgcgtcctgcacagttaccatccgtgcccacatgctgccccggggtcgc

SEQ ID NO: 33029 - DNA, 23 bp, Homo sapiens
  misc_feature 1..23: note = chr10:43428954-43428977
  misc_feature 1..23: note = hyper
  source 1..23: mol_type = genomic DNA
gggctatggagaccacgctcctc

SEQ ID NO: 33030 - DNA, 131 bp, Homo sapiens
  misc_feature 1..131: note = chr10:43429066-43429197
  misc_feature 1..131: note = hyper
  source 1..131: mol_type = genomic DNA
cgccggccttcccaggccccgggagccaggaaggtctgaatggagtgatgcgcctggacttttgttcggaaatcccgcgtggagggcggcctagcggggagaggctggaaacaggcgaggaggagcagggc

SEQ ID NO: 33031 - DNA, 223 bp, Homo sapiens
  misc_feature 1..223: note = chr10:43429215-43429438
  misc_feature 1..223: note = hyper
  source 1..223: mol_type = genomic DNA
cgggaaccgggtcttccctcgctaagaaagggaagggtctcagccttactgagaggagcccctgtggaggaagcgggcctgcacctgcggcttccctgcaccccgcacgccgtgcccaggcacttcctccccaacacaagcaaaggtagcccagctgcagccggatcctccctgagcgcagcgcaggggtcacagcccccgacagctgcgcaagtctattcct

SEQ ID NO: 33032 - DNA, 229 bp, Homo sapiens
  misc_feature 1..229: note = chr10:43571989-43572218
  misc_feature 1..229: note = hyper
  source 1..229: mol_type = genomic DNA
gcctctgagaaatggcgcagcaagcgctccgcggagagcctggaggcggggcgcccttctctgagtccgcggggtcgcaccccgagccagtcggccagacctgcatcccgcgtagcatccctgccctctctgtgcagcggaaagggcaaaaggcagggactgcaagcgggcgcgcaccgggtaggaagagcggctctgcgtaggtgcgcggacccgggctcctgggttc

SEQ ID NO: 33033 - DNA, 284 bp, Homo sapiens
  misc_feature 1..284: note = chr10:43572495-43572779
  misc_feature 1..284: note = hyper
  source 1..284: mol_type = genomic DNA
agccggcgcttacctcgcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaag

SEQ ID NO: 33034 - DNA, 70 bp, Homo sapiens
  misc_feature 1..70: note = chr10:43600561-43600631
  misc_feature 1..70: note = hyper
  source 1..70: mol_type = genomic DNA
acgacgaggacgactcggcgcccaccttccccgcgggcgtcgacaccgccagcgccgtggtggagttcaa

SEQ ID NO: 33035 - DNA, 109 bp, Homo sapiens
  misc_feature 1..109: note = chr10:43697887-43697996
  misc_feature 1..109: note = hyper
  source 1..109: mol_type = genomic DNA
ccctcttggctgaaacgactccgaccctctcggaagatgcccgcgcggcctctgcccccggggagaggggactgtgcccgatgctcaggcgccgcgcccccatcctcca

SEQ ID NO: 33036 - DNA, 30 bp, Homo sapiens
  misc_feature 1..30: note = chr10:43698279-43698309
  misc_feature 1..30: note = hyper
  source 1..30: mol_type = genomic DNA
gccccaactcagacccgccccacagcccca

SEQ ID NO: 33037 - DNA, 626 bp, Homo sapiens
  misc_feature 1..626: note = chr10:43724462-43725088
  misc_feature 1..626: note = hyper
  source 1..626: mol_type = genomic DNA
ggtctccataaacagcgtgggaaatgccagtgctccatgctcaggtcctctccaggaccagttctccgcctgcaccctacagcgccctcgccctggagcgcacactcctcgaagccccacggtgggctccactctccctaaacgcacaggcgcgcgtggggctcacaaggcacaggcacggctgcgctccctcccatgtgccgtgaataagcgcgcccgcgcttccgcagccctcccccgcctgcacctcacacagaccacacaccgcggaccacccctcgcccggcacatcctcctcagagcaacaggtggttctgcgcccctcaagtcgtccgggctcctacacgcccgtccccaccccttccaggctcgcaggagccactgtgctctcggcgtccgcgggccgcgccgcgaagggcagggcaggagcagaggcaggctgggcgccgcccaccgggcagtaggtgctccagcggggacgcacagagggcggcgcgcgggtcctcagggcgggcaccctcccgcacgggtcgggatgcaggggaccgtcgcacccctcccgagcccgacagcgcaagaaccctgccccgcggccttgcgcctgggcccgccgcagccctacctgg

SEQ ID NO: 33038 - DNA, 30 bp, Homo sapiens
  misc_feature 1..30: note = chr10:43725334-43725364
  misc_feature 1..30: note = hyper
  source 1..30: mol_type = genomic DNA
aggctaggagcatggcgcggaggtggggca

SEQ ID NO: 33039 - DNA, 30 bp, Homo sapiens
  misc_feature 1..30: note = chr10:43762699-43762729
  misc_feature 1..30: note = hyper
  source 1..30: mol_type = genomic DNA
aaggataaggcatcacgcctgtaatcccag

SEQ ID NO: 33040 - DNA, 30 bp, Homo sapiens
  misc_feature 1..30: note = chr10:43818377-43818407
  misc_feature 1..30: note = hyper
  source 1..30: mol_type = genomic DNA
ccagtgcctttgtggcgcattaggagctaa

SEQ ID NO: 33041 - DNA, 220 bp, Homo sapiens
  misc_feature 1..220: note = chr10:43857606-43857826
  misc_feature 1..220: note = hyper
  source 1..220: mol_type = genomic DNA
cccgttaccgaagaccgccaccatcacgacatagcgcagcacatatgggtaaacaaatggactgagactcaagcaaagaagtaacccgagacgcgcgttacacggaaaacgactgcgcaagcgcggtagagcaggggcttgcaggtgagtgggagcagccaatccacgcgaagggggtcgggaccacttccgcggaggaaagccccgcccacacctcctg

SEQ ID NO: 33042 - DNA, 33 bp, Homo sapiens
  misc_feature 1..33: note = chr10:43892849-43892882
  misc_feature 1..33: note = hyper
  source 1..33: mol_type = genomic DNA
aggagagagtcagggcggcgggaagacatttct

SEQ ID NO: 33043 - DNA, 703 bp, Homo sapiens
  misc_feature 1..703: note = chr10:44185340-44186043
  misc_feature 1..703: note = hyper
  source 1..703: mol_type = genomic DNA
cctagcccctcaaaccgcaagctctcccccttggggtcctcgtcgtgaacgcccttctcgtctcccgccgggctcactctttcgcattttgctgcgaaagtttactggaaataggtccattcactggtcgattcagagggacactagaaacgcgatgcccatatctaacacatcctggccttttgaagagggataaaaaataatacccactagagccccgtgcctccggagagtggggcttcgcatttgcgcgtccgaggcccggcagggagagcttctgggtcctgggggcgcgcacatccggcgcgcgctgtgtcggggagcggcgctctgggctgggccggcagagggcgctgcggggcggccgtggaacaagcaggggagagcgtcaggggacccagcacagcctgcctgctgcgccctgctgccggccgcgccctcctccgtgctgcgttctcctgctcgacgctgcgtcctcatccaacactggcaccgcgcgctccttccagggtcggaggcccacagacccctcacgttcgcttctgtcaggagtagcggcagaatttcgataatttatgtctttgatggagactgggaaggtagcctggccgctgcgcaggagagctgcgcggggtccaggaggggagcgcggagtgggagcagtcgactcgggctgcgcagtgcgtgtcggctgtcacgggac

SEQ ID NO: 33044 - DNA, 30 bp, Homo sapiens
  misc_feature 1..30: note = chr10:44788550-44788580
  misc_feature 1..30: note = hyper
  source 1..30: mol_type = genomic DNA
gggcctcgggaggaccgcgggtgggaggtg

SEQ ID NO: 33045 - DNA, 223 bp, Homo sapiens
  misc_feature 1..223: note = chr10:44806396-44806619
  misc_feature 1..223: note = hyper
  source 1..223: mol_type = genomic DNA
gaaggggagggtgcgcggggccggctggtccagtgcactccggcgcggccccggcacccgtgggcaccgccatgtccttcgctcagctccgccgcggctacctgcggggtctgcgcggctgcggtggccaggtgaggacgtctctgcccttgcgcggcctgcgctgtatgcttcctgcctggcccgcgcttcccctgcctgcatcacccgctgcccgcgcggc

SEQ ID NO: 33046 - DNA, 216 bp, Homo sapiens
  misc_feature 1..216: note = chr10:44879180-44879396
  misc_feature 1..216: note = hyper
  source 1..216: mol_type = genomic DNA
ccagcttctccagcccgactcagctgcgctggtcctgctcacaccagcgcacagtccaagccagctaggacgccggggccacgtctgcaccaacccagccaagggctcgaggcgcgctgggcctgcacagcccgcggctgcaagagcactcagagtgtccttcaactctttgcaggaaacttcacagccaaggaagctcagcggcctgagccacag

SEQ ID NO: 33047 - DNA, 604 bp, Homo sapiens
  misc_feature 1..604: note = chr10:44879851-44880455
  misc_feature 1..604: note = hyper
  source 1..604: mol_type = genomic DNA
ggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatgg

SEQ ID NO: 33048 - DNA, 26 bp, Homo sapiens
  misc_feature 1..26: note = chr10:44880519-44880545
  misc_feature 1..26: note = hyper
  source 1..26: mol_type = genomic DNA
cggctgacggagagtgaaagtgcggc

SEQ ID NO: 33049 - DNA, 99 bp, Homo sapiens
  misc_feature 1..99: note = chr10:44880546-44880645
  misc_feature 1..99: note = hyper
  source 1..99: mol_type = genomic DNA
gtgggaggcgcgcgccgggcgctttagaggggagagccaggcggggcggggcggggcgcgcggtgaggggcgggcccggagccgagtgctggccgtggc

SEQ ID NO: 33050 - DNA, 357 bp, Homo sapiens
  misc_feature 1..357: note = chr10:44880673-44881030
  misc_feature 1..357: note = hyper
  source 1..357: mol_type = genomic DNA
cggcaccccccacccatccccttcgcccctcctccgctccctctgtgctcccgaggcgcagtgcgctccggcctttgaccttctcaggctccgctgggccccgcaccgctggcccggtctgcagtgaggtccgcagcctgagcgacgccggctggagggccgcttattgtccctgtgacagggccccactggagagactgaggaccttaggcgtaaagtggggcgcgcgtggaaagctgcgggacggggcctttcgatggcgggaactgaatgagaaccaatgaaaagcaaacaagttagtcccgggcggagggcctgctggcggtggcggcccaaggcagccgagggggtcctgct

SEQ ID NO: 33051 - DNA, 159 bp, Homo sapiens; identical to SEQ ID NO: 10295
  misc_feature 1..159: note = chr10:49731642-49731801
  misc_feature 1..159: note = hyper
  source 1..159: mol_type = genomic DNA

SEQ ID NO: 33052 - DNA, 86 bp, Homo sapiens
  misc_feature 1..86: note = chr10:49732002-49732088
  misc_feature 1..86: note = hyper
  source 1..86: mol_type = genomic DNA
cggccctggacaccccgtggcgagtccccgaggcggggctggcagcctctggcggcggccgcagggagcggggcgcacgtgcgcgc

SEQ ID NO: 33053 - DNA, 160 bp, Homo sapiens; identical to SEQ ID NO: 3561
  misc_feature 1..160: note = chr10:49732155-49732315
  misc_feature 1..160: note = hyper
  source 1..160: mol_type = genomic DNA

SEQ ID NO: 33054 - DNA, 239 bp, Homo sapiens
  misc_feature 1..239: note = chr10:49732316-49732555
  misc_feature 1..239: note = hyper
  source 1..239: mol_type = genomic DNA
cagcgggcatgccggcctccgggcagaccctgctaatcaataggagaacgcgcagatcgcgaccgccgcgccactgcccgcttttatctccgcgcgccggggcggccccgcgctgctccctgccctcgccggcgccctccccacggcccgttactctcccggggtgccgggccgcgcgctctcccaggagccgccagggggcgccacggagccggggctgcctccgcctccctgggagc

SEQ ID NO: 33055 - DNA, 432 bp, Homo sapiens
  misc_feature 1..432: note = chr10:50323255-50323687
  misc_feature 1..432: note = hyper
  source 1..432: mol_type = genomic DNA
cgcgctcacgggaggcgtcctctgaaccttggggaggcgccgctgcgcccgccagaccctcggcgagcccaccggagcgcgctggcgacagtgacagcgccgccccccgcccgcgcccggaggtggcagggcctccccaccaggcccggagccccggcctccccggcgcggccgcccggcccccacccttcccgctcccgcctggccccgccgcgcttacccggagccggagcccgcgccagcagcgcggccgccgccagtgccagcagccgcatctccccgccgccgcccggcgctgtgacgcgggagagcgccgccgcctggcccggccgccgccagcccgccccgggcccgcgctcgcgcccgcccccggcccgccccttgggccgcctgccacgcggggccggggctgctgggtcccgaggcccgcac

SEQ ID NO: 33056 - DNA, 228 bp, Homo sapiens
  misc_feature 1..228: note = chr10:50603003-50603231
  misc_feature 1..228: note = hyper
  source 1..228: mol_type = genomic DNA
gtgagagcagcccagcgacgggcccttgtaggctcgtgcagctcgtgatctgggccaggacgcggcgggtccactcgcctttgctttctgggatgtttgcagaagcaccgtgaaagattgatgcggccccctgggttgcggagccccaattagaggcgtgacaccagcatctgtgctgggaggattcggccggtccccgcggcacgcctagcccggggcgtcctggcc

SEQ ID NO: 33057 - DNA, 333 bp, Homo sapiens
  misc_feature 1..333: note = chr10:50603837-50604170
  misc_feature 1..333: note = hyper
  source 1..333: mol_type = genomic DNA
cagaagccctgcacccgggccaccgcagccaggtccggctagcgcgcaaggccatctgcgagctgcagctcaggccaggaaggcagccgagccccaaggcccggcgctcggggcccggcgagtgggtcaggagccgagcatacctcggcgggcggcggtcgaggaggtcggagcgtgaccgcctccgatccgcaagccctgctcggctggcggcgggcggggctcggcgcggctggcgcccgcaggaccaaagaagtgactcgggaagtggccagatgtcttgctgtctgtctgcagcgcgcgccgccgctcagcactcgcctttataatctc

SEQ ID NO: 33058 - DNA, 309 bp, Homo sapiens
  misc_feature 1..309: note = chr10:50604532-50604841
  misc_feature 1..309: note = hyper
  source 1..309: mol_type = genomic DNA
gggactctttgcacacggcttccctttccaaacgatcgtacaaaaggaaagtttgattttgttctcagcaaggggtccctgaatttatgttcgcttctcgatgcaaatgatatgcggtgggaccctttgcaattacttttaaaatgcatccgaggcagacactcaacggagagagaccgcccttctctctgcctgggtgaaaattaaactctaaagtaccgggctgaaattttcaagtcaggggcgcgggattggatcaaatcacataaactgcaaaaaaagcaagtctaatggcgcataattggttct

SEQ ID NO: 33059 - DNA, 1620 bp, Homo sapiens
  misc_feature 1..1620: note = chr10:50605142-50606762
  misc_feature 1..1620: note = hyper
  source 1..1620: mol_type = genomic DNA
aacattctaatgctgcgttagggagccttggcgaggtggtgggtcgggtccctgcacggcccgggatacagccttgatcttaaagacgcagcgctttggaaacaaaaggcctggcaggcccgccgctggacaccagcgctgggcaaggagcatcgagctgcaggacagagcgctgggtcccggccgccgttgacgcccctccgaaaacagccgggaggaagaccagtcccgctccggtcgaggcaagtcaggatctattccagtgaagcggcccttcctgggctcagtcgctccagagcagagtctgctctgcctcggggaaagaatcacaggaaacttccgctcgtttcagagcggagagagctcggggcgccatttccgccagggccaccgactccgagagtccaggcagccggcccgggaggagcggctagcaggtcccgaaggcgggtgaggtggcaggcaggggccggcagggcagccgagggcctttcctacgtcatgccaagagggctgggagcccctagagctgatcctcccttagcccaggtcaagagactggctcgcgcgcgctgtctctctccctgtctccctcagagggcccctgctctctggagctcttgacaagagcccgaggctcctcttgccgcctaggtctgccgaaagtcccctcgggttccctcctgccctaggcagcagttccctgcctgtgcgctttgggaacccggtggccgtgaagtgaggtgcggacagcttctgggccgcctcggccaagatgctcaggcgcacctgggggtgtgtgcgggaaccctcagcggcagcagcccagcccggggtgcagtgttggccccagaaaccaatgaggtccaaacgccagtctcagttccccatccctgacatcgaccgaggcaagttcctattaaggcccagagatgaccccgggacgagacaggctcatccggcgcggatgagacaggctcagacctgcgcggtctgaggacggcgcgctcgccgagcaacccggcaggtcagaaccctggacagcggcgccggtttccgcacccccacccacccccggctgctgcggagaaagaagccgtaccgggggcccagccggggcccctcgctgctcaggggtgggatccgcccggccggaccccaggcgtccggggaccgaccccaatcctctcccagtccaaacctgcgaaagttactccggacatgcgctcagcgctggcaacagagacaaaactcccttctccgcagtaccacgcgccgctcctacccggccgctgcagccggaaaccatctcgcggcccccgaggagagtccggccgcctcactgactagataaccagccgagctccctcaacacacccacctcgcgggggctctaagccggcttgggaccctcggcctcgcctcgcccggcgctcctctcccggagccgctaggctgggctccttcccgttggcaaaacagcgagtaaacaaacaaccaaacaaccttagaaacgaaaggctgcaccaaactttgatgacgccagccccctttttttccgaatgtctcgacacccgggagaaggtgactaataggtgttcgctacggtccccctccccc

SEQ ID NO: 33060 - DNA, 30 bp, Homo sapiens
  misc_feature 1..30: note = chr10:50815067-50815097
  misc_feature 1..30: note = hyper
  source 1..30: mol_type = genomic DNA
tcagatagaggagtccggaaaggaatttac

SEQ ID NO: 33061 - DNA, 574 bp, Homo sapiens
  misc_feature 1..574: note = chr10:50817080-50817654
  misc_feature 1..574: note = hyper
  source 1..574: mol_type = genomic DNA
ctggagcctctctcccgccagtccgcccactggaacacgggttccatgtgccatccagggtcaacgccgctctggggacgcgtcaggcccagcgcacagcctgggcagctcagcctgtcagctgagcacgggcgcctcaaggggtgcggccctctcagaaggaaggtgagtctccctggagcccctgacgacagcgaagcggctgggcgctctccggggagtgggcgcggcacccaagaagggtttcttacagttccaagagaggaccccagccacagtcactccagagcccacccggggcttggaggaggctctggaaaatgagggatgggggagtgtgcagaacagggggcggaggctggcaggagccgagggagggcttggtcgggtgcgaagagtgcctgggaggagttagagtggggagggggtgcggcggcggggagagaagaggcggagctgggggaccagaccgctaaaggagaaagggggattccaggcaaggggaatgtggccaggcagtgcgggagggcggcagcggccaggctaatattcgcgaccccgactggggcgcggc

SEQ ID NO: 33062 - DNA, 15 bp, Homo sapiens
  misc_feature 1..15: note = chr10:50817858-50817873
  misc_feature 1..15: note = hyper
  source 1..15: mol_type = genomic DNA
tccacaatccagctg

SEQ ID NO: 33063 - DNA, 480 bp, Homo sapiens
  misc_feature 1..480: note = chr10:50818152-50818632
  misc_feature 1..480: note = hyper
  source 1..480: mol_type = genomic DNA
cgagagcccttcctgggcctccagccctggagcatctggagagcggacccctgcccggccacgccccgcccccggcccccgccccgccgacgtcgcattagcatgagcgacgtaagtggcccgggcaccactcgggggctgggactcgccgcgtcacagccccgagtggaagggaaaaaaaaagaggaggcggcggaggaggcaagagccgacgcgaggggaggggagcgcagcggcggggctaacgggcgggcaagcgggcgggcggcaacagcatgtccctcggccagcgcgggcggcctcttagcgcggcgggggctgctctgggcgcgccccgggcgaagtgcgcccagtctccggccccggcccctcggcgcgcccgacttcccggccgcccctgagcccagcagccgcgggtcccgggatcggctaagagtagctgcaacgcctcgccggacggagtcctttcctttcccggga

SEQ ID NO: 33064 - DNA, 18 bp, Homo sapiens
  misc_feature 1..18: note = chr10:50818986-50819004
  misc_feature 1..18: note = hyper
  source 1..18: mol_type = genomic DNA
cggcgagggccccacccg

SEQ ID NO: 33065 - DNA, 178 bp, Homo sapiens
  misc_feature 1..178: note = chr10:50819747-50819925
  misc_feature 1..178: note = hyper
  source 1..178: mol_type = genomic DNA
cggcttccgagtgggagatgggcatggcctggctgccggccttcgtgcctcatgtgctgggcgtctacctcaccgtgcgcctggcggcgcgctacccacacctgcagtggctgtacggcgcgcttgggctggctgtgatcggcgccagctcgtgcatcgtgcccgcctgccgctcctt

SEQ ID NO: 33066 - DNA, 127 bp, Homo sapiens
  misc_feature 1..127: note = chr10:50821077-50821204
  misc_feature 1..127: note = hyper
  source 1..127: mol_type = genomic DNA
cgccctttgaggacacgccccacaccagcctcagagctctgaggtgcctgggctgagcttcccttcagaccagaatcccgccccgttgaggctttgagaaaggagtaggagccgagcattccggcag

SEQ ID NO: 33067 - DNA, 229 bp, Homo sapiens
  misc_feature 1..229: note = chr10:50821472-50821701
  misc_feature 1..229: note = hyper
  source 1..229: mol_type = genomic DNA
agagcctcaagccagcgttcgcgcaacactccatgtcccgaagaccgtagtctgatgatcgaggcagagtcttcccatcatagcgtgaagaggcggctggtcagggtcgcctgtgtgttagctgcgcctgtgagggtctgctctgctgttgtgcgcatgtctgtcctcgatctgcgagtcgggctgtgtgtgcctgggcggagtctgcctttgtcggtctgtctgtgct

SEQ ID NO: 33068 - DNA, 52 bp, Homo sapiens; identical to SEQ ID NO: 10308
  misc_feature 1..52: note = chr10:50822142-50822194
  misc_feature 1..52: note = hyper
  source 1..52: mol_type = genomic DNA

SEQ ID NO: 33069 - DNA, 67 bp, Homo sapiens
  misc_feature 1..67: note = chr10:50822825-50822892
  misc_feature 1..67: note = hyper
  source 1..67: mol_type = genomic DNA
tccttgggtctgacccgactcgcctgaattgctggttggcaaccgcttctcccgggagcagggggtg

SEQ ID NO: 33070 - DNA, 160 bp, Homo sapiens
  misc_feature 1..160: note = chr10:50887456-50887616
  misc_feature 1..160: note = hyper
  source 1..160: mol_type = genomic DNA
gattcaaccagataacgcagggaaaatgcttcgcacgccgcctgacacgaacttactgtgcctggctgctgctgttatttatcactaacacttgccacaccagctcaaacgcgcgtatttgcggaccaggcgctgagggtcacgtgagcagcttggggcc

SEQ ID NO: 33071 - DNA, 137 bp, Homo sapiens
  misc_feature 1..137: note = chr10:50887617-50887754
  misc_feature 1..137: note = hyper
  source 1..137: mol_type = genomic DNA
ggaggatcccctagcgccaccccggccccgcccggcgcgtagcgacgcccacgcgcccgggccggaagagaggttgcttagcagcgtgtgtttctcccttgcctctgcggcggcggaggcctggcgatgcccaagaa

SEQ ID NO: 33072 - DNA, 47 bp, Homo sapiens
  misc_feature 1..47: note = chr10:50887789-50887836
  misc_feature 1..47: note = hyper
  source 1..47: mol_type = genomic DNA
cggcaggcctaccggtggagcaccacaccttccgcctgcagggcctg

SEQ ID NO: 33073 - DNA, 516 bp, Homo sapiens
  misc_feature 1..516: note = chr10:50969896-50970412
  misc_feature 1..516: note = hyper
  source 1..516: mol_type = genomic DNA
ccgccaggtgcacagcgctgaccctccccatcccccgcacagccctcgcagctccgggccctcccctggccacggaaggcgcggggcagtctgaagtcctcgggctggagaaacccaccgcgagcacccgctcctctgcgcaggaccctggactagccgggtggtacgcgcgcgatgggctgggggtcccgggggaggccacggccagccaaggtcagagccaaggtcacagtctgttcctcctccccctccccccggcggggccagactcagggctgcgggcagcggcgccccaggacccaggagagaggagctgtggggccggtccccaggacggcaggagaagcagcggcgcagggaccgggagggggcgggccgccgcgctcaccgggcgggcgggccgggtccgcgctgcagcgaggtccggaggctgcaggtcagggggctgcgcggaaggggtgcgcgcgcgccgtgccaattacctgggtcacgtgacgcagccgcccacgggcgcgc

SEQ ID NO: 33074 - DNA, 30 bp, Homo sapiens
  misc_feature 1..30: note = chr10:50976382-50976412
  misc_feature 1..30: note = hyper
  source 1..30: mol_type = genomic DNA
ccgtcccctcacaggcggctgcacgctccg

SEQ ID NO: 33075 - skipped

SEQ ID NO: 33076 - DNA, 88 bp, Homo sapiens; identical to SEQ ID NO: 10312
  misc_feature 1..88: note = chr10:52177735-52177823
  misc_feature 1..88: note = hyper
  source 1..88: mol_type = genomic DNA

SEQ ID NO: 33077 - DNA, 135 bp, Homo sapiens
  misc_feature 1..135: note = chr10:52178170-52178305
  misc_feature 1..135: note = hyper
  source 1..135: mol_type = genomic DNA
gggtgtggcccggcagcagagggtttttggaatgcagggtgtggccctctaccacggcaaaaaagaaatgagtcagcccgttcagtcctaaccaataagcatgttcagtgtcggttaaggcggaactttcctttc

SEQ ID NO: 33078 - DNA, 160 bp, Homo sapiens
  misc_feature 1..160: note = chr10:52750888-52751048
  misc_feature 1..160: note = hyper
  source 1..160: mol_type = genomic DNA
gcctctcctctccatcgcttttagacttctcatcctcccctcggtgcttttagtccattcagcagaagcggatcgaagcaggaggctccccgcgccgcattaggggcgcactccgccgcgctcgagtacttagcgcccattcactcgctcacccgcgctc

SEQ ID NO: 33079 - DNA, 179 bp, Homo sapiens
  misc_feature 1..179: note = chr10:52751383-52751562
  misc_feature 1..179: note = hyper
  source 1..179: mol_type = genomic DNA
gaagttcaccaagtccgaaaggtaggcgcggaggccgtgggcccgggcgctcgtcccggcccgcggcgcagaggctgggggctctggccgcggcggcgggggcgggtcggcccagggcgccccctgctcgctgcggcgcgcggagtgggggtggccccgcggcccgggaatgggaagtg

SEQ ID NO: 33080 - DNA, 41 bp, Homo sapiens
  misc_feature 1..41: note = chr10:52751795-52751836
  misc_feature 1..41: note = hyper
  source 1..41: mol_type = genomic DNA
tggagagcttcccagcggcgaccccccggactcaggccact

SEQ ID NO: 33081 - DNA, 88 bp, Homo sapiens; identical to SEQ ID NO: 10315
  misc_feature 1..88: note = chr10:52833568-52833656
  misc_feature 1..88: note = hyper
  source 1..88: mol_type = genomic DNA

SEQ ID NO: 33082 - DNA, 113 bp, Homo sapiens
  misc_feature 1..113: note = chr10:52833864-52833977
  misc_feature 1..113: note = hyper
  source 1..113: mol_type = genomic DNA
gtagcgctcccgcctcgctccacccgcacacccccggcgcgcctcggaggcttatcaggctccccgcacgccccgcaagcttccttgggcgcccggcgcgagggactctgaga

SEQ ID NO: 33083 - DNA, 395 bp, Homo sapiens
  misc_feature 1..395: note = chr10:52834361-52834756
  misc_feature 1..395: note = hyper
  source 1..395: mol_type = genomic DNA
gcgggatttacagtacgcgctccaggagaagatcgaggagctgaggcagcgggatgctctcatcgacgagctggagctggagttggatcagaaggacgaactgatccagaagctgcagaacgagctggacaagtaccgctcggtgatccgaccagccacccagcaggcgcagaagcagagcgcgagcaccttgcagggcgagccgcgcaccaagcggcaggcgatctccgccgagcccaccgccttcgacatccaggatctcagccatgtgaccctgcccttctaccccaagagcccacagtaagcaggggtgacgcgccgggtccatgtggcgccctggcgatggggagctgcgggtctctgtattgtctgtcggcccccgcccctcccgcttg

SEQ ID NO: 33084 - DNA, 389 bp, Homo sapiens
  misc_feature 1..389: note = chr10:54068221-54068610
  misc_feature 1..389: note = hyper
  source 1..389: mol_type = genomic DNA
gcctttcccctcacccgcctctaattaagtcagaaaggccctgtatttatttgcccatgaactgacacagcaaaccaacagcagccattgtagtgtgaatggatttgcgaccaggcaaggggcttcagccgggattacccgccccgcagccggatgaatgtgctgagcacaaagtctgctcaaagccgagcaaacggactatttgtgaaaatgccatcctggctcaagtctgattaagaccgggggtccccaggccgtttgatcttcgctcatcaaagagagtctttaaacaagcttcattttacactactgtatgctagcgacgggttgtgacacccaagtgcagccaccgtgagcacccggcactgggagcgcgtgaacaataatgg

SEQ ID NO: 33085 - DNA, 752 bp, Homo sapiens
  misc_feature 1..752: note = chr10:54072904-54073656
  misc_feature 1..752: note = hyper
  source 1..752: mol_type = genomic DNA
caccaatttcaatgacgtcaaattcactttctaattcactttcagctcttcttctcctcaaggttgtttcttttctccctagaaagggtattgcgtggtcccgtgcaaggtaagacttgggagcaaaccctgcattcggaagcgttgcgatgtgatatactaatgaggaagtcaggcgctaagccctaagggtttcttatttctccacattagcccaccactgagaagggagaaccggggaaaggcgactgacctggcacgttggaccctgtccgctttggtcccggccactttgatctcacgcgtctgcctaatcaagttcatctaccgccgcgattgccctgattcaaagaacaacattaaatggtttgattatcggatggtcatttccctcttccctccacccctgatctaatttctaaacgccagtctctcgcctccctctctaaacttcccatcaaaagagaattagctcttcttccttcttaccctcgtttgatgtgcaaatttccttctctttgcacatttttctcgcagtggcggggggaggtgggggaggagggcaactgaaggacctcaaagccggggatctaactcagatctgcaaactgcgactctaaagggttaatgagcaacttgcacccgccacctggccctctcagaggcgtcttgctagagccattgaattacagaccggtttgtatttaatactgaatatgacttgtgtgcacagtcagcgagtattggcataa

SEQ ID NO: 33086 - DNA, 66 bp, Homo sapiens
  misc_feature 1..66: note = chr10:54074759-54074825
  misc_feature 1..66: note = hyper
  source 1..66: mol_type = genomic DNA
cgtgcaaatctgtctcgcctgcaggaagcgccgaaaacgctgcatgcgtcacgctatgtgctgccc

SEQ ID NO: 33087 - DNA, 1085 bp, Homo sapiens
  misc_feature 1..1085: note = chr10:57387425-57388510
  misc_feature 1..1085: note = hyper
  source 1..1085: mol_type = genomic DNA
ctccttcagcagcagcggacgtagggatcccgagcagccacggagcttaggtcccgcagagagctcctgccaagcgcttctctctcgactagttaccaattgagaaaaaaaagggtcagagacacacaaggatggtgatcaaaatccagtgtcaggcaccagggtcccagaaggttccggctcctcttctgcgccttacccagctcttttcgtctggcaaagggtcacccagcgagcccccagcagcagatccttcccttttgctcctcctgatagcgccaatcttcgccgccactgccacactgcgcgcccgctatccactcaccgcacagcgagaaggcctggcggagatagcgcggggggaggagggtggattaaaaggatagatttttggaagggtaagggagaaaaactttgatgttgtaaccacacacaggactgagaagaaaccaaaacaagttgcagcttcaggagcggggaggacgcttttcggggtaaaaaaaaaatcaccccctaccaaaatcagggggaggaagctccctgctccttgagcgatcacccagagcacctcgcaatctctgatcttcgaacccactgaaaaagcacagggcatggggagtcctgttggttcatgcccagggtacgaataccaaaagcgcctcccgctggagaggctgcggggaactcgaggcaaagacagaggcaaacgcaacgctgggaagagtgaggggagtccgagctgccgcctgcaaaagcagagacgcgtcgcccttcgggcaaagtgactgctacaaagtccgttccctcctgcgcagggacagagacatttaaaggcctgaatggacgtcagcaccagtcgagctcgctgggtgagcgccaggtctccccgccccacggattgtagcgcgcacagggcgatctgctgctcgcgaggtagagtggcttacttggggagaaaacagagctggtggcgctgcggagtgtcaaaccctggagcccatcgtcaagacgttatactggtggcagttctgctgtgagtgcacttgccgaattaaaaagagccagagctgcgtggagaggggtct

SEQ ID NO: 33088 - DNA, 46 bp, Homo sapiens; identical to SEQ ID NO: 10322
  misc_feature 1..46: note = chr10:57389890-57389936
  misc_feature 1..46: note = hyper
  source 1..46: mol_type = genomic DNA

SEQ ID NO: 33089 - DNA, 386 bp, Homo sapiens
  misc_feature 1..386: note = chr10:57390290-57390676
  misc_feature 1..386: note = hyper
  source 1..386: mol_type = genomic DNA
tcaggggagcatagtcggaaatcttcggttgtattcctgactcagcctgggtgcggagcgagcgcggacaggaaccgagatgcaaaggcggacgcaaccagcgcacccgcagacggcgcgcggcaagaaccaccttctagccctgagcctgcggtgccgggcgggctcaggaggctagtggggtattgtgatcactgggacatcaggatgaaggggtcactccaatcccttggagatcagattctcggggactccatggccagacccgaacggcgcccttcacatggtgggtggagagggtactccttggccgaattgacccctccctgtcccgcagggtcagccccgcgcccacccacacatccagtctccgggaacaaaactct

SEQ ID NO: 33090 - DNA, 194 bp, Homo sapiens
  misc_feature 1..194: note = chr10:57391166-57391360
  misc_feature 1..194: note = hyper
  source 1..194: mol_type = genomic DNA
gaactgcagctggtgcgccactgccttccccgcgcggtgcccaagagcgccagtagaaggaggaggtcggcacacctgctgttcctgcttccttcccaggaggccgattctctccatcccaactcgctccgtggctcctgcttgctcctgttccccctcccgactccccgggtaacagtcgaccttagggtcac

SEQ ID NO: 33091 - DNA, 109 bp, Homo sapiens
  misc_feature 1..109: note = chr10:60272038-60272147
  misc_feature 1..109: note = hyper
  source 1..109: mol_type = genomic DNA
ggtatgaactacatgcgagccacgtccatggcgatgcctgcgaaagacgggcatgatttcttctccaagccttctttttcctcttcctcacgttcgagcttgtggaacc

SEQ ID NO: 33092 - DNA, 272 bp, Homo sapiens
  misc_feature 1..272: note = chr10:60272562-60272834
  misc_feature 1..272: note = hyper
  source 1..272: mol_type = genomic DNA
tgtaggggcggcgggcggggagggggcgccgagccctgcggatggaggcgcgggcagcgcggcgcgctcattccgcgcgggcgttgctggcggggggcggcgcagccactggacccggaccggggccgcgacccggggtggcgggtggcgtgggcggcgcccggggctgggatgcgccgggggctcagtggcggcggcggcgttggcggtggcgtcggcggctgcagggggacgagctagcgccgcggcgctgggagccagttgagcccggc

SEQ ID NO: 33093 - DNA, 384 bp, Homo sapiens
  misc_feature 1..384: note = chr10:60272895-60273279
  misc_feature 1..384: note = hyper
  source 1..384: mol_type = genomic DNA
cgcccaccatggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgagcctctaactccttttcggacatccccaccgcgcgctccggcgcccgctactccagcctacggccggccggtttagctccaggcccgctcccccgcggagccggaggacacccagggactggagacttcgcgggactccccacccttcca

SEQ ID NO: 33094 - DNA, 352 bp, Homo sapiens
  misc_feature 1..352: note = chr10:60936378-60936730
  misc_feature 1..352: note = hyper
  source 1..352: mol_type = genomic DNA
gcgccgggtcctgctcggtctctcagagccgcacactccgcggagctcctgccacagccgtcgccttcgcggcggctctccagccccgcgcctcagcctcggcgccgcatcaccgcgtcccaggcctccttccctccctctgccactccccctccctttcccgctcttcttgcccacccggccggcagagagagcctggatacgaagcaggcgggcttcagagtgggttggaaaaatggaggtgccgcgcctggatcatgccctcaacagccccaccagcccctgtgaggaggtgatcaaaaacctcagcctggaggccattcagctgtgcgaccgggacggtaagagcggc

SEQ ID NO: 33095 - DNA, 62 bp, Homo sapiens
  misc_feature 1..62: note = chr10:60937041-60937103
  misc_feature 1..62: note = hyper
  source 1..62: mol_type = genomic DNA
gcagtccggatttcctgggtctctgggcactgaaggggaaatgccctcgggatgtttctagc

SEQ ID NO: 33096 - DNA, 36 bp, Homo sapiens
  misc_feature 1..36: note = chr10:61122490-61122526
  misc_feature 1..36: note = hyper
  source 1..36: mol_type = genomic DNA
tggagagttaccacacgaccccgacctcgccagccc

SEQ ID NO: 33097 - DNA, 82 bp, Homo sapiens
  misc_feature 1..82: note = chr10:61469912-61469994
  misc_feature 1..82: note = hyper
  source 1..82: mol_type = genomic DNA
gcgtttggggggagccggggtgtacaaatgaatgcgagtgttccttggtctccctggctcccggggccgctggcgccctcct

SEQ ID NO: 33098 - DNA, 30 bp, Homo sapiens
  misc_feature 1..30: note = chr10:62702560-62702590
  misc_feature 1..30: note = hyper
  source 1..30: mol_type = genomic DNA
ttactatctgctgctcgtcagaggacttat

SEQ ID NO: 33099 - DNA, 863 bp, Homo sapiens
  misc_feature 1..863: note = chr10:63212027-63212890
  misc_feature 1..863: note = hyper
  source 1..863: mol_type = genomic DNA
gcaagataggcaggccgttagccaagccccaaagccagcaaacccagacacctgaagctggcgctgtgctagagaacgcgcgacgcgcgcggctggagggaagggaagcggatgaaaccacagacgtgcagcgagggtcttctcgtcttaggagggtggccagtgtgctcagctcttgcgaaggtcgctgatgcccagcgaaggacattcccacatgtgcacgcacgcagagtaacccgcgcacactcacacaccccagtttcagaaggcacactacatggcaacctccttgtcccaagactcccctatttgcgggcacattcagcaaaatagaccagcgcttcctctctttactcatcttccaagtttccaaacctgagactgggtgactcttgcctaggctcacagatcgagccttcccagtgttgcactgggaccctagggtggccctggggtgcccaagagatgcgcaagcatctcgcgccttccaagcgatcagcgaggaaaaacggggtccaaattcgagtagaatctgcgggttgcgggaagatggcctgcgagtgcggtgggggacaataccctagggccccgtgcgccctcgctttcccggggcactctcaccatttgtagcctctgccgcgcttgaacttgagggtgagcgcagtctccaggaagagcaagaggttgagcagcgcaagcagccagtaccgcggctccttcttcacctcggtcactcgccagaccccgaccagcgagtgcagcaggaacagcaaccgagtggccagggcgttaaggaagaccagtccctccatgctggccggagcactctgcctacgtccccttgcctgcgcccccaggaccct

SEQ ID NO: 33100 - DNA, 92 bp, Homo sapiens; identical to SEQ ID NO: 10332
  misc_feature 1..92: note = chr10:63213120-63213212
  misc_feature 1..92: note = hyper
  source 1..92: mol_type = genomic DNA

SEQ ID NO: 33101 - DNA, 520 bp, Homo sapiens
  misc_feature 1..520: note = chr10:64133867-64134387
  misc_feature 1..520: note = hyper
  source 1..520: mol_type = genomic DNA
agtgtaatcctgagtcggatcgggctcccggctgggtggcgggggggcagatgatgctcccgccagctgggcagagcaagggtgttccccgcggaggtggcagccctgggccgcggcgttccggaacccccgcacccacggcgcggtgccccacggtgcccgcgagcgccgcccccgctggctagccgcgcctcgctccgccctggacgccgccggtcccggcgcggaggtgcggcggggagtgggagccggcccggctcagtctgatttacggctctgctgaaaaccgcttcgctcccgcagcatcagcaccggaggcggcggctgcagcagcagcagcaacaagtcgggtaagaggcggccgccggccatctgcgcccgcggctcggcggaggggacctgccggggtggccggggctggggagggggtccccgagcccgcagcatggcggggagttgggagagccggcttcccggcccccaccagcaggaactcatgtgcacacgaatccactctggc

SEQ ID NO: 33102 - DNA, 478 bp, Homo sapiens
  misc_feature 1..478: note = chr10:64574590-64575068
  misc_feature 1..478: note = hyper
  source 1..478: mol_type = genomic DNA
tgcctgggggttccacggctgaggcaccaagacaaacaccacccaagaatcgacctatcccagtcagtgccgtgatggtgccaaaccgagaggagagcccgagaagggggtgggtgatttcccggctgctccccatccccggcgccttgtgcctttttctccctccctctcccgctgcgcttcagccgagggctgctggagcgaatgggggatgtagaggaaggagtccgtaggtttccgtgccctcccaatcttctccgcctttcccgacagccgcgcgtccccgcctcagcccaaggccagtggcccggcctcgaggaaggcgcgggggccgcgagagacgactttccacagcatcgccaaggaaaccggcgtcgccggtgcccccgcgggcctccctcggcagtccgggggctgcttcccgccgttgcgcgccctcctccaccacccactcgctgcctccgccggccggagcccc

SEQ ID NO: 33103 - DNA, 685 bp, Homo sapiens
  misc_feature 1..685: note = chr10:64575127-64575812
  misc_feature 1..685: note = hyper
  source 1..685: mol_type = genomic DNA
cgcaagaagggagcgctccgagattttcccggggtcggctctgcccaggagggagctaccgacgctttcccctggcgcttctccgccgctcggctctccaggcgcgcagctctccccgagagccccgaactttaccgtcactttgcccctgccccgggagaggggaggtcgaagtgctgccggccagagggcctacgcaagcctcgaaacccggggggacgcctcttccacccccatccctgcgctcgcccggggctgggcgcgccggggcgcacgcacgccggtttgctggcgacctggcgcatctgcccgcgcgccctggtctcagctgtcgcaggttcctcctgcacccacttccagtcttcaaagccagtgcagtcagcaccgtccacctggagccccaatcctctcctgcgattcccgcacacccactgcaccccatccaccacctccgggccgcgcaggtccgggcctgcgaagacacgcggcttacctccggccactccgttcatctggtcaaaggggcctcccagttcggcattgggaaagatggtcaccgacgtggcggcgaggtcctccaccgggtagatgttgtcagacagctggtgcacaaaaccactgagagttactgggattttgtctacggccttggcggtcatcatttgctcctcgcacaacctggaga

SEQ ID NO: 33104 - DNA, 342 bp, Homo sapiens; identical to SEQ ID NO: 3567
  misc_feature 1..342: note = chr10:64578287-64578629
  misc_feature 1..342: note = hyper
  source 1..342: mol_type = genomic DNA

SEQ ID NO: 33105 - DNA, 15 bp, Homo sapiens
  misc_feature 1..15: note = chr10:64578651-64578666
  misc_feature 1..15: note = hyper
  source 1..15: mol_type = genomic DNA
cgagggggagctcct

SEQ ID NO: 33106 - DNA, 287 bp, Homo sapiens
  misc_feature 1..287: note = chr10:70320197-70320484
  misc_feature 1..287: note = hyper
  source 1..287: mol_type = genomic DNA
tggcccctctactcccgggtctgccccccgggacacccctctgcctcgcccaagtcatgcagccctacctgcctctccactgtggacctttgggaaccgactcctcacctcgggggctcgggccttgactgtgctgggagccggtaggcgtcctccgcgacccgcccgcgcccctcgcgcccgccggggccccgggctccaaagttgtggggaccggcgcgagttggaaagtttgcccgagggctggtgcaggcttggagctgggggccgtgcgctgccctgggaat

SEQ ID NO: 33107 - DNA, 71 bp, Homo sapiens
  misc_feature 1..71: note = chr10:70320857-70320928
  misc_feature 1..71: note = hyper
  source 1..71: mol_type = genomic DNA
ggctgaatataccagcggttggttccctggcccctttggggagttggaggtcggggcgcctcggggtgagg

SEQ ID NO: 33108 - DNA, 42 bp, Homo sapiens
  misc_feature 1..42: note = chr10:71267763-71267805
  misc_feature 1..42: note = hyper
  source 1..42: mol_type = genomic DNA
gcaacgcatgcagagcgtggtgtcggtcgacccctgctggag

SEQ ID NO: 33109 - DNA, 41 bp, Homo sapiens
  misc_feature 1..41: note = chr10:71327725-71327766
  misc_feature 1..41: note = hyper
  source 1..41: mol_type = genomic DNA
cgcctcactcccagacgcatctctcgcgctggatctacgtg

SEQ ID NO: 33110 - DNA, 229 bp, Homo sapiens
  misc_feature 1..229: note = chr10:71328773-71329002
  misc_feature 1..229: note = hyper
  source 1..229: mol_type = genomic DNA
gcattccaatggccccgggacgcttttgtcctccgactgaggccggctgggggtggggtgggatgggggcagggcaccataaatctacctgcttgtgtgccagcgcggcttgactggaaggaggagcaagattcatgtgcggtttttctggaagccagtcttgggctcagacaaaagcagaagaaggggggagagccattcgacgagagggtctttcctgcccgggttt

SEQ ID NO: 33111 - DNA, 183 bp, Homo sapiens
  misc_feature 1..183: note = chr10:71329076-71329259
  misc_feature 1..183: note = hyper
  source 1..183: mol_type = genomic DNA
cgggctccgggcagagaccgctagcagcgcggtttaaaaagccccaggactcaaaacgccgcaagaagtggaaggcggggacggtggtgcagagctagttggacaggccacccctagaaatgtttccgagcccttcttgctcaggggttctttggaaagaggcatggacgaggtttcccactc

SEQ ID NO: 33112 - DNA, 30 bp, Homo sapiens
  misc_feature 1..30: note = chr10:71329503-71329533
  misc_feature 1..30: note = hyper
  source 1..30: mol_type = genomic DNA
tggctccttaatgagcgccctcaaaagcag

SEQ ID NO: 33113 - DNA, 299 bp, Homo sapiens
  misc_feature 1..299: note = chr10:71331434-71331733
  misc_feature 1..299: note = hyper
  source 1..299: mol_type = genomic DNA
taaaaaaaaaagatgcgcggtgctccaggcacctgcagcgcagctcacgtttcaggcgcagttcgcagggaggctggggagatgctccctggccgggctagcgctttcccagttcacagcctggtcttccgccccgggagggcaatggctccgaaaagtgcacgaggagaaggcagagggtcgccttcgtggctttaaggcagagtgaggcgccctgaaatcccggacctgattgggagtagagcagatcggcagcgtctttggagcaaggcaaggggagtaagcgctgagagaccaaa

SEQ ID NO: 33114 - DNA, 517 bp, Homo sapiens
  misc_feature 1..517: note = chr10:71331951-71332468
  misc_feature 1..517: note = hyper
  source 1..517: mol_type = genomic DNA
tgcgttggcgcggctcggagggccggggaatgaacccagcctgccgcccccgtggaggcctgggccggccaggggtcagccagggagaagcagaaggaacaagtgcttttgagggccgccgccgtcggccaccctctacggctcccggctccctccctctcccttacccttagcacccacagcccagcgacagacaggtcctttcacagaaaatctgagaaagccagactgcctgggctcaagcaggcggaaaaggtggcccccagcagcccgggtcgctcctccagcgacgcggcgggactcaggctgccagcctgggagactggggagtagagggacccccagtccccgggggaaccgcctgggctgcccagctccccgcagtgcggcgccggcggctccagcgcgtacaagctgtggtccgctatgcgcagcgtttgagtcagcgcccagatgtagttgtgggcgaagcgcagcgtctcgatcttggtgagcttcgcgtcgtctgggaaggtgg

SEQ ID NO: 33115 - DNA, 260 bp, Homo sapiens
  misc_feature 1..260: note = chr10:71332821-71333081
  misc_feature 1..260: note = hyper
  source 1..260: mol_type = genomic DNA
gggtaagtttgagtccgtcactgggcgcagtccgcgattccgaggctaggtgggaaaaaacaaaaacagccatcctcccagcccccgctgggtcagaggatccctctttcccctgcccgtccctcggaggcctccaaatattacctttctaccggcgcaaaagaatagagagcgatgagcagcgagggccgtggggagctcagcgggcttctggtcgccaagttcagctgagctgcaggcgcccccgcctgggagttgcc

SEQ ID NO: 33116 - DNA, 22 bp, Homo sapiens
  misc_feature 1..22: note = chr10:71334335-71334357
  misc_feature 1..22: note = hyper
  source 1..22: mol_type = genomic DNA
cccaaggcgctgggaagcagag

SEQ ID NO: 33117 - DNA, 103 bp, Homo sapiens
  misc_feature 1..103: note = chr10:71334853-71334956
  misc_feature 1..103: note = hyper
  source 1..103: mol_type = genomic DNA
ggaggggacaggacccgacttcgagactgtagggtggggtgaggggatgaggtaggtctgtgagtctgccctagtgatagcctcttaccgcctaggctgcttg

SEQ ID NO: 33118 - DNA, 30 bp, Homo sapiens
  misc_feature 1..30: note = chr10:71337383-71337413
  misc_feature 1..30: note = hyper
  source 1..30: mol_type = genomic DNA
acccaacggctgctgcgccagctgagggga

SEQ ID NO: 33119 - DNA, 103 bp, Homo sapiens
  misc_feature 1..103: note = chr10:71338223-71338326
  misc_feature 1..103: note = hyper
  source 1..103: mol_type = genomic DNA
ggcatccacagaaaacgcgactgatgacacagatgcggagcgcgagatgcccatatgtccggctctgcgcccatcccggctggggaaacgaataggctgtgtg

SEQ ID NO: 33120 - DNA, 37 bp, Homo sapiens
  misc_feature 1..37: note = chr10:71562106-71562143
  misc_feature 1..37: note = hyper
  source 1..37: mol_type = genomic DNA
agagccttttggcagcggctgtcgcctttatttattc

SEQ ID NO: 33121 - DNA, 84 bp, Homo sapiens
  misc_feature 1..84: note = chr10:71562530-71562614
  misc_feature 1..84: note = hyper
  source 1..84: mol_type = genomic DNA
tccagactgttcagccggtgtccgcgggcgctcgctctctgcgagccccaggttcgcgcgagttgcctgcgggaggggtcgggg

SEQ ID NO: 33122 - DNA, 95 bp, Homo sapiens
  misc_feature 1..95: note = chr10:71813377-71813472
  misc_feature 1..95: note = hyper
  source 1..95: mol_type = genomic DNA
ggctgggggttgctgcgcggacacccgggcgccgcgggcgggcgtgcgccccggggccggcgcggaagagggcgcgaggccgggcactccccttc

SEQ ID NO: 33123 - DNA, 92 bp, Homo sapiens
  misc_feature 1..92: note = chr10:71813702-71813794
  misc_feature 1..92: note = hyper
  source 1..92: mol_type = genomic DNA
cagccctgcctcccccggctcccagcctccagccccggcgcacctcagccccagcccggccagccccccggatcgcccgtgggtgtcctccc

SEQ ID NO: 33124 - DNA, 193 bp, Homo sapiens
  misc_feature 1..193: note = chr10:72015202-72015395
  misc_feature 1..193: note = hyper
  source 1..193: mol_type = genomic DNA
acgcgcgctctgcgccgcgatgctcgcgggtccgcagcctcctcgcccccgggggccgggcccggggcctggcagagcttgcgcgcgatgcgggcgtacatgaccacgatgagcgccagcggcgccaggtagatgtgcgagaagagcacagtggtgtagaccctgcgcatgcccttctcgggccaggcctccc

SEQ ID NO: 33125 - DNA, 70 bp, Homo sapiens; identical to SEQ ID NO: 10347
  misc_feature 1..70: note = chr10:72043778-72043848
  misc_feature 1..70: note = hyper
  source 1..70: mol_type = genomic DNA

SEQ ID NO: 33126 - DNA, 15 bp, Homo sapiens
  misc_feature 1..15: note = chr10:72200050-72200065
  misc_feature 1..15: note = hyper
  source 1..15: mol_type = genomic DNA
gccccctcccatccc

SEQ ID NO: 33127 - DNA, 655 bp, Homo sapiens; identical to SEQ ID NO: 896
  misc_feature 1..655: note = chr10:72200117-72200772
  misc_feature 1..655: note = hyper
  source 1..655: mol_type = genomic DNA

SEQ ID NO: 33128 - DNA, 679 bp, Homo sapiens
  misc_feature 1..679: note = chr10:72200824-72201503
  misc_feature 1..679: note = hyper
  source 1..679: mol_type = genomic DNA
cgaggtgttatttattacacctatcctacagatgcgcagacccaggctccgggataagcaacttcacaagactggagattagaagctcccacccttccgcgctgcgctccgcgcaatcccaaaccaaaacccagagacaatggtccccgtcgaggacacaccctgaacgctagaatcccttcccgactcggccgtggatacgcccccagccaccaacgctgcaccccgagcctgctgacgcggagacacccgcagagctaggccctgggctcgggacgcccgggcggctgcaaacccggctcggagccgcagcccccaacccacagcacttcccgagtccgctggctggacgcggcggaggcgccccgggggtgcccagcagggcgcggcacgcggcactgcctaccttctgcctgtaggctgcggatgatgtctgccctcggcagcgggtcgcggtagaggctcagcatgtacgccagaggggatggcgacgagggctgcccccgcgtacgcaggagcgcagtggccaccgtcgcagcacccgcctggagtagggcccaccaggcgtgcagaaggaagggcaggcagtgggcgtgcatggtgggctggccaggcctgaaagcagcacctccagcccttatatcctgggcctcagcagccgccccgcccccacctttcc

SEQ ID NO: 33129 - DNA, 44 bp, Homo sapiens
  misc_feature 1..44: note = chr10:72218318-72218362
  misc_feature 1..44: note = hyper
  source 1..44: mol_type = genomic DNA
ggcagtgagtgttcccgccgggcgggtggcgttgtcgccgccaa

SEQ ID NO: 33130 - DNA, 183 bp, Homo sapiens
  misc_feature 1..183: note = chr10:72238634-72238817
  misc_feature 1..183: note = hyper
  source 1..183: mol_type = genomic DNA
tggcctgcccacctccggagccacctctgcccccgcatgggctggcgaagttgggaggagcgagctggagccagagcgcgcgccgggcgcgccccgtcgctgcctgactcggcgcccgcagttcgggcgcagcacgccggccgcaggagcacggatgccccccggagccgcgggctggcaggt

SEQ ID NO: 33131 - DNA, 158 bp, Homo sapiens
  misc_feature 1..158: note = chr10:72431955-72432113
  misc_feature 1..158: note = hyper
  source 1..158: mol_type = genomic DNA
agagagcaggccctgcggccaagaaagggggcggagcagccatagaaagcggctttgggccaccactccggggatcccaggcgtctgaggggacaatcggtccgtgcgccaggaacccctgctctgtctccgcgtggcacttccgatccccggccgca

SEQ ID NO: 33132 - DNA, 106 bp, Homo sapiens
  misc_feature 1..106: note = chr10:72432524-72432630
  misc_feature 1..106: note = hyper
  source 1..106: mol_type = genomic DNA
ggcgcttgcccagcccgcgtcccagcgcggccacatggctccactccgcgcgctgctgtcctacctgctgcctttgcactgtgcgctctgcgccgccgcgggcagc

SEQ ID NO: 33133 - DNA, 43 bp, Homo sapiens
  misc_feature 1..43: note = chr10:72432660-72432703
  misc_feature 1..43: note = hyper
  source 1..43: mol_type = genomic DNA
cgggggcccgtggggtccggggtgcacgcggtcagggtggccc

SEQ ID NO: 33134 - DNA, 73 bp, Homo sapiens
  misc_feature 1..73: note = chr10:72973309-72973382
  misc_feature 1..73: note = hyper
  source 1..73: mol_type = genomic DNA
gctgaacacaggaagcgcttcggtagcctcggcaggccggcttgcagggctcctgaagcggggagggctaagt

SEQ ID NO: 33135 - DNA, 204 bp, Homo sapiens
  misc_feature 1..204: note = chr10:73156664-73156868
  misc_feature 1..204: note = hyper
  source 1..204: mol_type = genomic DNA
caagggaaagttgatcgcggacttgagcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccgg

SEQ ID NO: 33136 - DNA, 369 bp, Homo sapiens
  misc_feature 1..369: note = chr10:73156912-73157281
  misc_feature 1..369: note = hyper
  source 1..369: mol_type = genomic DNA
cgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggtacccggagccacgcaccgcctcttccctcctcgcttccctctccttcccctcgccgttcgcccgccgcgcggcggggaagttggtggtgaccgcggctgccgaaccacttgttcccagcgcggccatcgcccgtggcgggcgctcgcggcatccttcggtcccaggcccctggccctagcctcgcgccccgctccgagctcccc

SEQ ID NO: 33137 - DNA, 417 bp, Homo sapiens
  misc_feature 1..417: note = chr10:73157508-73157925
  misc_feature 1..417: note = hyper
  source 1..417: mol_type = genomic DNA
ggggatggggtggggcgcacccctactgcgggctgggcagaggcgctgaggggaactaaaggcacgtagttctcccctcccctcatcaagtccctgtgcccgcgggagaccccaggggacttacacatcctcccaaattcggtccagctatgggaagacgcgcccctcgaggagccgggagccttttgcggctctcgcttcgccttcctggccctggaactggtccgctacgagcggtgctggctgcccccaggagctggcacccgggagcactgcccctcatctccaccgtaggtcagcccaggactcgagcagagcccgcgtgttccaaggcagtgacggcgccagccggcggggactctgcctggctttctcggagcgggcacctagagaggctgcctccgtgctgtgagcgga

SEQ ID NO: 33138 - DNA, 30 bp, Homo sapiens
  misc_feature 1..30: note = chr10:73723732-73723762
  misc_feature 1..30: note = hyper
  source 1..30: mol_type = genomic DNA
cggccccgggcgctccggcacggagaagcc

SEQ ID NO: 33139 - DNA, 282 bp, Homo sapiens
  misc_feature 1..282: note = chr10:73724117-73724399
  misc_feature 1..282: note = hyper
  source 1..282: mol_type = genomic DNA
cggacgccttggacgcggttcaggaatccgccgccgctagccggctcgggcctgagcggggagggcgccaggcaggacctctcgcaggctcgctgcgcaggacggcgcccgcctggcgccgcttcccttccagcgtgccgaccggccccgcagcgcctccatccctccggcccgccccggagaagacgcacagctcgggccgcgcgggcgccggggccgcggaaccgcttctgccgggatcttccaggaggaaagcgaagttgcgagcggatgctgcccgcg

SEQ ID NO: 33140 - DNA, 104 bp, Homo sapiens
  misc_feature 1..104: note = chr10:73847688-73847792
  misc_feature 1..104: note = hyper
  source 1..104: mol_type = genomic DNA
ggggggtcccagggccgccggcccgggccgcagggacaggggaggggcgctgggctgtgacccccagtactgtttactttccgtgtaattagccggccaggctg

SEQ ID NO: 33141 - DNA, 14 bp, Homo sapiens
  misc_feature 1..14: note = chr10:73848208-73848222
  misc_feature 1..14: note = hyper
  source 1..14: mol_type = genomic DNA
ggtgactggcggag

SEQ ID NO: 33142 - DNA, 15 bp, Homo sapiens
  misc_feature 1..15: note = chr10:75407398-75407413
  misc_feature 1..15: note = hyper
  source 1..15: mol_type = genomic DNA
cagattctgcacccc

SEQ ID NO: 33143 - DNA, 189 bp, Homo sapiens; identical to SEQ ID NO: 10358
  misc_feature 1..189: note = chr10:75407477-75407666
  misc_feature 1..189: note = hyper
  source 1..189: mol_type = genomic DNA

SEQ ID NO: 33144 - DNA, 33 bp, Homo sapiens
  misc_feature 1..33: note = chr10:76803629-76803662
  misc_feature 1..33: note = hyper
  source 1..33: mol_type = genomic DNA
ggtcgtcggcctccacgccgtggtactggatgt

SEQ ID NO: 33145 - DNA, 47 bp, Homo sapiens
  misc_feature 1..47: note = chr10:77161345-77161392
  misc_feature 1..47: note = hyper
  source 1..47: mol_type = genomic DNA
taatcctgggtggcccgcagcggagccgtggccgggctagaggagcc

SEQ ID NO: 33146 - DNA, 543 bp, Homo sapiens
  misc_feature 1..543: note = chr10:77162787-77163330
  misc_feature 1..543: note = hyper
  source 1..543: mol_type = genomic DNA
cccgccaccccaccccgccgccgcgagtcctcgcggggcgtgttgcgtgcggaggtcaggctgccaccctctgtagttccctaaccccaaactcggagacttctaagagccacaccaccaaggaacttctagtcctggaggtcaatggtggggcaaacctcgcctcaattctttgaccccctcgggtcgtaagcagggctaagaggctgcgaagaagaggcctggccatgggtgtatgggggaagaaacatctcaggctcactcatgccccctccccgaccttctcccacctgccgccatccccgcaggctggggagccagggtaactcggggctgctctctcgaatttattggaacgccgagtcggaatgagctgcgctaggagagccgagggaaggagcgagagagggagggggcggctgcctgtgggaacgcgggttcttccagggaagcggagcgggactgccgcgttcccctcgatttgcaccgtcactcgggttgtttgggaagaaaaggggaggcgctgtgcgtgccaccgggtac

SEQ ID NO: 33147 - DNA, 37 bp, Homo sapiens
  misc_feature 1..37: note = chr10:77163662-77163699
  misc_feature 1..37: note = hyper
  source 1..37: mol_type = genomic DNA
tgagccgggtgcgcgcgggggtcgggtctggaactgc

SEQ ID NO: 33148 - DNA, 520 bp, Homo sapiens
  misc_feature 1..520: note = chr10:77191185-77191705
  misc_feature 1..520: note = hyper
  source 1..520: mol_type = genomic DNA
cgggggagggaggggcgcgggcagtcggggtcaggccgccgtcggggcgcggggcgctgcgggccacctgttgcagcgggcggccagggctcacctgcgcggagaccgggccgaggggcggcggcggcgagcggcggagctgaggtccccgaggctagcccgcgcctccggcttccgccgggtcagctgactgcccagtgcggaactgtgcgcccgccgcgctcccctgccgcgctccccgctgctgccgccgcgcccccgcgctccgtcccgcgcgcccgcagcgtcctggccgccatggccgggctcgtggtgcgtggaactcaagtaagtcccggccagccccgcctccgcccggggcgcagtccgcgtggggagggacagcggggcacagaggctccccagggcctagacacccctgtccccgcctcagggggctgcgtctgcagggggtgagcttcaggtgctcaggctcgccctagtggggctaggacagacctcgtttcgggcctggcacacc

SEQ ID NO: 33149 - DNA, 579 bp, Homo sapiens
  misc_feature 1..579: note = chr10:79396686-79397265
  misc_feature 1..579: note = hyper
  source 1..579: mol_type = genomic DNA
tggctgtccccaccccgcaccacggcacccgagcctgtgagtccccgaccccggccccagccgcagccgccaacaaccctacaataaacaagaggacaggattgagcgtccgcgtcccggagcgcactggctgggggcaactcctcacccccggcgcgccgcccgctgccccgatccgagagcaccgggagagccgagggaagggaaggcggcgaggggaaggcaggcggggatggagggaggcacggcgcggcgcggagcgaggaggtgggctgcaggggacgccgagaagcggtggggctggcgcagagggcgggcgcccggggcgcgcgttaccttcgtcttgcccccgcagtggcagcacacggtccacaggtacttgagcgtccgccagagcaagatgatgaagaggcccccgaagaaagtcaccatggaggaggccaggaaagcccaccacatgcgttggccccggctgtcgcacggcacctccatggtcaccgggatgatgagcgcatccatcttgggctcgtggaccgaggacgaggaggaagaggaggaggaagaagaagaagaggaaga

SEQ ID NO: 33150 - DNA, 1238 bp, Homo sapiens
  misc_feature 1..1238: note = chr10:79397385-79398623
  misc_feature 1..1238: note = hyper
  source 1..1238: mol_type = genomic DNA
gccaccatttgccatagctagcaacgggcagccggcgcaggggctcgggggagctcctcccgccgccagcgccaccccaaacacccatcaacagccatattgctgctactgctgccgccgccgccgccgccgcggagcgcgggaggggggcggggaggcgcctgggctcggggcgctgtgcgcgacctggcggggtgcgccgagatatatacagcgagccgccgccgcccgcccgggggggagggggatggagtgcgcgggcagctccccctccccggcccgcgccccgctcgccccgggctgcgctggccccgagcgccgagagccagggggcgccgcgggccgcccgcgcccggggtctgcgccgcccccgggcccgccccggctccgcgcgcggtcccgggtgtcctcggcgccgcgccgcccgccgtgcgccacgggtgtgcgctgcgctcggccggtgacccccttccccgagcgcctcccgcgcggctaacgagccgctctccgcttattaggtggtaactcgttaataatggataatcggccccctccgcccgggcgcccctgcgccagccctcctcccccggctgcgctcggctccggctcgccgcgccagtgcgcgcccggccgcggcaggttcaccgcgtccggccgccggcccgtggccgcctgctagcccatgttctcgggaccccctagtcctgtcgccacgccgctgagcccctcggcctccgctcgctcttcctccttgccgcctccgactcctcctcgtccccgtcctcgccgcccaagcctcttcggcgcgcgccccgcgctccccgcagccgccagcagcagcagctgcagcaactggagcgggcgcggactcaggacgacccaggcgggaggggaggaggctcgccgcgctggctcgcctgggctccgggctgggcaggggtgggcagggcccctcggcagcggcccggcaagcgcccctgacccccagggcgcaaggtagagcgcccccagcccaggcgcggggccaggcgcctctctccaaggtgctgcgcccccagccgagagcggtggggtacactgggaggacggcggggcgccccggtcaggccgtttttttccccaaagagcccccagtggggaggggaggagtggccagctgtcaactggattccacaggctgagctccccaggaccctcgggcttcgggagtgaggaggaccccacgccaggatacacac

SEQ ID NO: 33151 - DNA, 146 bp, Homo sapiens
  misc_feature 1..146: note = chr10:79470925-79471071
  misc_feature 1..146: note = hyper
  source 1..146: mol_type = genomic DNA
taagaaggcagagctcgagggggccttgaagtcacatcgccggctgctgagtctacgaacagggaagcagccgcagtccccgaaaggacccgtcccagcgagccagggcctggttttccttccgcagaaggcggagggaccggagc

SEQ ID NO: 33152 - DNA, 75 bp, Homo sapiens
  misc_feature 1..75: note = chr10:80909909-80909984
  misc_feature 1..75: note = hyper
  source 1..75: mol_type = genomic DNA
accctggcctggccccgggccgcagccgtgcaggtcactaggcctcggcgagtggccacccgcccacccaacagg

SEQ ID NO: 33153 - DNA, 475 bp, Homo sapiens
  misc_feature 1..475: note = chr10:81664598-81665073
  misc_feature 1..475: note = hyper
  source 1..475: mol_type = genomic DNA
gcggacccggtggaacgcactgcgcagacggcgccggcgcctgcactcagctgttgacgagtctttcttccagctctaccctgaaagtcctccaggcaccggtcttttttttctgccttttgtttccctcccggcgagtcggcgcgacagtgaatttccgtttcccgcggtgtccaagcggacctgaggagttgcagctgtgagcaggttcggtggtgccgcgggctggggtaggcggcggtggggtccctggctctggggcactgggaagatcgcgagtcgtgcgcgtgggaaggtcctccggctcatctttgctccccaggagcagcatatttcgcatctgccagaggtgtgcccgggggtcgttgggagagggacggggtgaatccctgcagagagccgggacggggagggaaggtgtcggggagacgtggtttcctggcgacgtggtcccggcaggcgacttagacctgag

SEQ ID NO: 33154 - DNA, 223 bp, Homo sapiens
  misc_feature 1..223: note = chr10:81741708-81741931
  misc_feature 1..223: note = hyper
  source 1..223: mol_type = genomic DNA
cgtctccttgtctcccgtgcccgcgtcaggccgccagcctcgcccacctccccaggaagagcgcgccgggcgccgacttcccctggggcggcggccctggacgtgcggggggtctctctgggccggctgctgcgccttggccctgccctctagctcccgcgctcgctcccgccctcctggctctccgggcgcgcctggcggggcagggcggacatgggcacca

SEQ ID NO: 33155 - DNA, 346 bp, Homo sapiens
  misc_feature 1..346: note = chr10:81892268-81892614
  misc_feature 1..346: note = hyper
  source 1..346: mol_type = genomic DNA
gggcggccccttcctcgggaggcgcccaggtggcacgtcggtgcctcagctcccggggtctctgggctccgcgctgcccacggggtgccgaggggcctctggagggggcgggttctctcgagccagaaagtccggagccgcccaggaattttggctcgaactgagtgcatttcctctcgggccggccgggtgcgatccgggaagggcggctgcgggcagacgcggcgctgcgctcggccaggccggcaccatgcggcccctgctctgcgcgctgaccggactggccctgctccgcgccgcgggctctttggccggtgagtggggcgcagggcgcggcaggggacct

SEQ ID NO: 33156 - DNA, 472 bp, Homo sapiens
  misc_feature 1..472: note = chr10:82116661-82117133
  misc_feature 1..472: note = hyper
  source 1..472: mol_type = genomic DNA
gcagagtagagggggcgcggcagagtagagggggcgcggcagagtggagggggcgtgcaggagtaggagcccgccgcagagtagagggggcgcggcagagaggagggggcgtgcaggcgcggggcgcccggcagagagaaggggtcgtgcggaagggggcgcgcgccaggggagggggccagagaggagggggcgttcaggagtcgggcctgcggcagagatgaggcggtgtgcaggagggagagcgcgcacgagggggcaacgggcagagaggagagggaatgaaagaaggggagcgtggcagagagaagcgggcgcgctccagggggcggggtccagggaggagggggagcgtaggatcggggcgggaggcagagaggagcgggcacgcgggacgggcgtgtgctcgtgaggggtcgaggaaaggcgtatgtggaggcgcgcggggtgggtgagccgaggagacttgcta

SEQ ID NO: 33157 - DNA, 311 bp, Homo sapiens
  misc_feature 1..311: note = chr10:83633848-83634159
  misc_feature 1..311: note = hyper
  source 1..311: mol_type = genomic DNA
aggcaccctcccacccgcatccgcccccgccccctcgcccagcagcgtcagtctctgaccccactggatccgtacaggagacgactcacaatcggtcggaagctgcttttgcccccccaccccaccgcaaacgggggtttgcttggatcatttatctatcttgtgtgcattaagaaaccagcattagctgctagtgggaggcgctactctgcccgaatcccagcccgccgcggcgattctgcacacacacacgcaccagcctggcagccagagcccgtctggagacgccctcagcccggggtctgcgttcc

SEQ ID NO: 33158 - DNA, 282 bp, Homo sapiens; identical to SEQ ID NO: 10367
  misc_feature 1..282: note = chr10:83634933-83635215
  misc_feature 1..282: note = hyper
  source 1..282: mol_type = genomic DNA

SEQ ID NO: 33159 - DNA, 15 bp, Homo sapiens
  misc_feature 1..15: note = chr10:83635484-83635499
  misc_feature 1..15: note = hyper
  source 1..15: mol_type = genomic DNA
ctaccacttccacca

SEQ ID NO: 33160 - DNA, 49 bp, Homo sapiens
  misc_feature 1..49: note = chr10:83635530-83635579
  misc_feature 1..49: note = hyper
  source 1..49: mol_type = genomic DNA
cgcctcctccaggacgcccaaccggattagcactcgcctgaccaccatc

SEQ ID NO: 33161 - DNA, 30 bp, Homo sapiens
  misc_feature 1..30: note = chr10:83635788-83635818
  misc_feature 1..30: note = hyper
  source 1..30: mol_type = genomic DNA
ctcctcctaccttcacgattctactccctc

SEQ ID NO: 33162 - DNA, 59 bp, Homo sapiens; identical to SEQ ID NO: 10370
  misc_feature 1..59: note = chr10:83636287-83636346
  misc_feature 1..59: note = hyper
  source 1..59: mol_type = genomic DNA

SEQ ID NO: 33163 - DNA, 784 bp, Homo sapiens
  misc_feature 1..784: note = chr10:85954289-85955073
  misc_feature 1..784: note = hyper
  source 1..784: mol_type = genomic DNA
gccgctaattggtctcgtcaggcggccggcaggagcagatccgagccgtgtcatcctcttagcgccctcacgccacccgccgctcccgccccgtgccccctcccgccgcggctgcagtcgccgctacccccattgtggtctctgccctccccgcgggcccagggcatgctccgtgcccctgcgcccggtctcggcggcggcaggcgacactccgcgccggcggagacatgaggcgctgccggtgggccgccctggccctggggctgctgcgcctctgcttgggtgagtggccgctgggccgcgctggccgcgtggatggcgagggagatgggcgctggcgtcacccaggtggccagagggacatggtcctggaccacttccagagtgggactcgggctggtggacgggagcggagaagtccttccatcttcctggcccattcggtagtggggagtggggtagcggagtagtggggagctccggggcgcttctccagagctggcatcctagggccccagggtttggcgcccggacccccgctgctctccgcttgctgggaaccagagctgtaggcttggtggcagctccgatgctgcgtggggcaggagatagtgccctgactcgcggcttgaccttggctgggctggggcactgcccctctccgagcgcgggtgcaatctgcccattgatgaaggaggggttggattgctacctgggttctaagcgcccacatgctacgtgtccctgacaagcccgagcccaccgggggcggagtgggggtcag

SEQ ID NO: 33164 - DNA, 80 bp, Homo sapiens
  misc_feature 1..80: note = chr10:88124485-88124565
  misc_feature 1..80: note = hyper
  source 1..80: mol_type = genomic DNA
ctcccatttcctgtacgtctgtcgaggggagtgggggaaggggacttgtgtcctaggcgcctccacgttcagatctagcg

SEQ ID NO: 33165 - DNA, 30 bp, Homo sapiens
  misc_feature 1..30: note = chr10:88125245-88125275
  misc_feature 1..30: note = hyper
  source 1..30: mol_type = genomic DNA
tttcatcttctctcccggttctctctctct

SEQ ID NO: 33166 - DNA, 640 bp, Homo sapiens
  misc_feature 1..640: note = chr10:88125592-88126232
  misc_feature 1..640: note = hyper
  source 1..640: mol_type = genomic DNA
gccaggcgcacacagcgacacacgctgacaacacgcacccacacacattcacacacggttccggtccggcctctttgatcttgccctgccaacttggcgagccccccgctgtacctccccctgccccccgctgctctgagctgcgcagaagggccctcccgacccgccgacggccccgctaagggcgcgggtctcgacgcgcgtccatcccggtgttccccgaagcgtcggccctaagtgtcggtagaggccgcggggccccgcgcggagatcggagccccggggagcggcaagcagccagcgggagcgcggcgcggccggtgcacagctcctccgccgggcggcgcggcgcggcccttcgggggagcaccgcccgccgagcccctcggcccagggaaacgccaagtttggacgccgcgcaccccctgccccgttggggcccccgcccagcctcggcccggcctccagccgcgcttaccgatgtggatgatggagtcggcccgcaccgacacgcactggcatatccaggggagaagccacagcgtcagcgcttccatgtcccccgggcgcgcggctcatccacccgggcccggggcgaggccgagggcagcgcgaagcggggaggcgctggtcccggtgc

SEQ ID NO: 33167 - DNA, 149 bp, Homo sapiens
  misc_feature 1..149: note = chr10:88126704-88126853
  misc_feature 1..149: note = hyper
  source 1..149: mol_type = genomic DNA
gcgccgggtgctccacgctcccggctcgggggacgctcggagaccggcacagcggcggggaccggcctgggctgcggcgcgccgagctctgacggttcgggcctccttctccggttcgccaggggcgggagaatggaggagggccggcc

SEQ ID NO: 33168 - DNA, 279 bp, Homo sapiens; identical to SEQ ID NO: 10374
  misc_feature 1..279: note = chr10:88126854-88127133
  misc_feature 1..279: note = hyper
  source 1..279: mol_type = genomic DNA

SEQ ID NO: 33169 - DNA, 50 bp, Homo sapiens
  misc_feature 1..50: note = chr10:88127346-88127396
  misc_feature 1..50: note = hyper
  source 1..50: mol_type = genomic DNA
ggtgcctgcctcgggccggccaccaccaaagagagcgttaagctgttgtg

SEQ ID NO: 33170 - DNA, 318 bp, Homo sapiens
  misc_feature 1..318: note = chr10:88149300-88149618
  misc_feature 1..318: note = hyper
  source 1..318: mol_type = genomic DNA
ggcgtctctgaccaccgagcctgcgaagacctagctgattacgaccaggaaacaggaggggacatggcccaaggtgggcggggccagtgctgggaagccccgccccgcccccgatcctgtgctcccaggtctgggcgttaggattctctcagtcccggagccacgccggctgaccgcagggctcggggagcgcggctgggccccttttcccgggtccgggaagcgccgggccacgccgggtccgctggagagactgagggccagggtcgccgctgccgccgggaggcgacagagccagctgggcgcacctgggtgctg

SEQ ID NO: 33171 - DNA, 147 bp, Homo sapiens
  misc_feature 1..147: note = chr10:88391908-88392055
  misc_feature 1..147: note = hyper
  source 1..147: mol_type = genomic DNA
gaggatacagggagccgtttgcctgggttcgcgctcggctgtcctagctcacggggcgacctcggaaacgtccagcgtctgccctgtccccctgcgccgcgtctgagcagccagccccgggccaaagggtcgcgttggttggggcgt

SEQ ID NO: 33172 - DNA, 33 bp, Homo sapiens
  misc_feature 1..33: note = chr10:90342630-90342663
  misc_feature 1..33: note = hyper
  source 1..33: mol_type = genomic DNA
gggccttttcccgggcggcggaagtccccgatc

SEQ ID NO: 33173 - DNA, 50 bp, Homo sapiens
  misc_feature 1..50: note = chr10:90343138-90343188
  misc_feature 1..50: note = hyper
  source 1..50: mol_type = genomic DNA
cgtccttgaggagcaaacctggggctgcggagaaccggggctgtctgtct

SEQ ID NO: 33174 - DNA, 805 bp, Homo sapiens
  misc_feature 1..805: note = chr10:90966521-90967326
  misc_feature 1..805: note = hyper
  source 1..805: mol_type = genomic DNA
gacgctcatatactgcgttgccagcgcgaacgaggacgagttctggtggtgcaccttgtggaaggtgcggtacagccagggcaccttgtggtgcagcaggtgccacacgaagaactccatgtcgaagagtagcaggcagaacaggatgtggtgcagcagcaggagcagctcgggagcttcgtggggcaggagggccgggctgcgggcccaatgcagcagcgtcacggggaacacaaacatcacatgctggtagagggtctgccccaggcaaggtagcagctgctgcgcggatggcgagaagtcagggtggatcttgtagcgccgcagggcgggcacccaggagcacaggatatccaggaccacgaagggcaggcaaaagcccacgtatgtggtgatggagaagatgaccgggaagaagggcgactgtaggagggcctcccagctcctcaggtggtcccagaggggctgcaggaacagctgcccggagctgcaaaggacctgggggtcggagcagttgtggcagctcattgcgaggctgtgcaaggcagctgaggctgctgctcgagtcccatcgacttttcacaggactcacggccccgccccgagtgatgtcagctgcctttccatccctttcccggcgatgcgaagcttgaataagctagcaacccggcagagtggcccttcattgctgtaaatgtgctcatctatagccgcatcttaccggcttttagatatgcgtgtatgcagtggcacttcgtacttttcatgtaagttctgatttttcagttgacgtacaattaacacg

SEQ ID NO: 33175 - DNA, 532 bp, Homo sapiens
  misc_feature 1..532: note = chr10:90967624-90968156
  misc_feature 1..532: note = hyper
  source 1..532: mol_type = genomic DNA
ctttgcacagggaaccgctggtccccgaacgccggcggtgaccgtcagctcaggaaatcagacgggaagggtggccggatgggaacctccgccagctccagcttgtccccagagttttcctggccggcgggcagcaagctagagagaccacgcacgcaggctctccgggagaggccgcagcccggccgcgtagctaccctcggcggcgcgtcccggggcgccgggcccgcgatcggagccggaggcaccgcacagcggaaagagggctccgcggcggccaggctcagctttgccgggaaaatgctggatttaactcccagtctgcgccaatctggctaaaaagcccgttgtatctcaatttggggcgggaacacttaattcagcaaaccacctgcgttgttcgtcaagggaaagagatgtgagttcctgaagcctcccgggaggctattgaaggaccaggtgatgtcgtcactaccctacccttccccttgttggctttgcggggccaacttgcagtcgccctctgccaccg

SEQ ID NO: 33176 - DNA, 317 bp, Homo sapiens
  misc_feature 1..317: note = chr10:91295029-91295346
  misc_feature 1..317: note = hyper
  source 1..317: mol_type = genomic DNA
tcccaacccaagctgcgcgccgacgcacccaagttagggtcccaggctcccggcgcgggatgggcgctagggcagcggagaatggagggtccccgtcctcctccagctccaacgacagcgccagcgccccgccgtcccgccgcccttccttgaaggatgcccgtgtcacctgagccaccgcgccctctgcacaaccgtgtcagggagagggaagagggggagccgaggaagcttcttggccagggcgctggggatccgggagcgggggccgccggcgagactgagcccgggacagcccagagctccagcgctccagc

SEQ ID NO: 33177 - DNA, 145 bp, Homo sapiens; identical to SEQ ID NO: 10383
  misc_feature 1..145: note = chr10:91295347-91295492
  misc_feature 1..145: note = hyper
  source 1..145: mol_type = genomic DNA

SEQ ID NO: 33178 - DNA, 295 bp, Homo sapiens; identical to SEQ ID NO: 10384
  misc_feature 1..295: note = chr10:91295584-91295879
  misc_feature 1..295: note = hyper
  source 1..295: mol_type = genomic DNA

SEQ ID NO: 33179 - skipped

SEQ ID NO: 33180 - DNA, 413 bp, Homo sapiens
  misc_feature 1..413: note = chr10:92617122-92617535
  misc_feature 1..413: note = hyper
  source 1..413: mol_type = genomic DNA
caccaggcagttgcccgcgatcgtcagcagcgtgatgagcgtcaggatggagccgatcacaactttctcgactctgccgtagttgatctgttccccacagccggaggcattgtccgggggcgcgtcccaggtgggcgccgggctggctgtcacctcgctcagcaggtgcggcgcccaggagcccgcgaccgggtcggcgccaccgtcggggctcaagtcgggcagcccgcgccccacttctggcagaaggaaagagcggaggtgcccgtagaggtccgggcggccgctgctgttaacgtccatcatcgcgccgccgtgtgccgctgcccatggagccggcgccccggccacgcgcctccggctgccggccccggggcttcacctcaccggttccgctccgcccggcccagcca

SEQ ID NO: 33181 - DNA, 611 bp, Homo sapiens
  misc_feature 1..611: note = chr10:93647037-93647648
  misc_feature 1..611: note = hyper
  source 1..611: mol_type = genomic DNA
gtaacaccccagggccgcgtgaatagcggggaaggtaacgtgactgcggagctcagggccggcccgggaggggcgcgggcctggccagtgggaaggtcggacgccgaggggcgaaatcaccccaccggcatcagaccaccgcctccattcagcggaggaatgtgggcgggcagaggacgcgcggtcccctcgcccggcgttaaccctgtgcgcgccgggagcttcgcccggagcatcgcagcatcgcgcagcgcccggagcccggggccctcacagctccaccggtgcccggagcatctatctccccgcgggcggtgctgccactcgccacgttcacattcctccacgtgcacgcgtgactcttttggtgttatttttaaaaatctcactatttaatcgccatgtttaccttccccagaaccacatagtctcatcgcaattcaaataatttagaaaacattttaagataatcgtggagcccacgaagccagtgcaacgtaggtggcttcccttgctggaagtcaccgcaccgaggccagaagaaggtagccagcgcccaggcaagcgcttaaaactgcagcctcctccacacctttgcacgtggggaaacc

SEQ ID NO: 33182 - skipped

SEQ ID NO: 33183 - DNA, 443 bp, Homo sapiens
  misc_feature 1..443: note = chr10:94180324-94180767
  misc_feature 1..443: note = hyper
  source 1..443: mol_type = genomic DNA
cctgcagtatttaaacgattgtcggtggaagttcacgtcgtgctcctctttcgacagccgttgggtaacggatcaaaacccttaacggccgcggctggagcgcgagctcggggcgccgaggggctccgggcccgagcgtccaccgctcatctcctgggctcgggaggttttcgcggcgggggctcagccccagatcccgggactcaggaggagctgggccgagctgcgggaggcgtggaagccccaggagagggttttgcactacgaaaaaaccatatgcaaattgcctgggaagagtttagattctgtggccaaactgcaagcggccgttgctaaaatgggaagcatttacaggaaaaagcaaacggtttcatcgaggtggattcgacgacaaactaagcgaaggcaaaaacgatcgcgggagtcgacgtggagacagataa

SEQ ID NO: 33184 - DNA, 126 bp, Homo sapiens
  misc_feature 1..126: note = chr10:94449138-94449264
  misc_feature 1..126: note = hyper
  source 1..126: mol_type = genomic DNA
cgctctgagctcgggaaacggccggtgtgacagccagcgccactgttaatccagggagcgcacccaccgaggaggcgtcttaggccagcggcctctgctcccgccgagtcccgctgctccccgcct

SEQ ID NO: 33185 - DNA, 252 bp, Homo sapiens
  misc_feature 1..252: note = chr10:94449910-94450162
  misc_feature 1..252: note = hyper
  source 1..252: mol_type = genomic DNA
ctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctgctccgccacgaccccctgggtaaggcggccgggcgagggtgggggcgaggaagcgccacccggcaggtggcagcgcc

SEQ ID NO: 33186 - DNA, 349 bp, Homo sapiens
  misc_feature 1..349: note = chr10:94450377-94450726
  misc_feature 1..349: note = hyper
  source 1..349: mol_type = genomic DNA
ggggtggggctcccttagcgggagggacggggaaaggggcgtcgaggcgcccctggccggcccccgtggggcagggatcgcagccgggcccgggtggctacggggctggacctggttcaacaggcttgtgcagtgaaagagcctgaccctttccgttcatacaggaaatcttgagttctcgataggagtaaatctggtttcagaagctgttaagtgttttcctggctgcatgaagcagacccttcccccggagtagtgcacgctgctgattattttatcgacatcctcaatacagacaaattcaggaaacactcgacttctgatagccgggatccgtttttctgatatt

SEQ ID NO: 33187 - DNA, 56 bp, Homo sapiens
  misc_feature 1..56: note = chr10:94451448-94451504
  misc_feature 1..56: note = hyper
  source 1..56: mol_type = genomic DNA
ggttactgctgggaccgcgcaggaggaagcaaagagtttttcgagctagaccaaca

SEQ ID NO: 33188 - DNA, 30 bp, Homo sapiens; identical to SEQ ID NO: 10390
  misc_feature 1..30: note = chr10:94822377-94822407
  misc_feature 1..30: note = hyper
  source 1..30: mol_type = genomic DNA

SEQ ID NO: 33189 - DNA, 22 bp, Homo sapiens
  misc_feature 1..22: note = chr10:94828103-94828125
  misc_feature 1..22: note = hyper
  source 1..22: mol_type = genomic DNA
gtgatgtatagcatccgggaca

SEQ ID NO: 33190 - DNA, 701 bp, Homo sapiens
  misc_feature 1..701: note = chr10:94828193-94828894
  misc_feature 1..701: note = hyper
  source 1..701: mol_type = genomic DNA
cgcgaagattcccggggcgcctccagccgcttccattacatcccgttcggcggcggtgcgcgcagctgcctcggccaggagctggcgcaagccgtgctccagctgctagctgtggagctagtgcgcaccgcgcgctgggaactggccacacccgccttccccgccatgcagacggtgcccatcgtgcacccagtggacgggctgcggctctttttccaccccctcacgccttcggttgcggggaatgggctatgcctctgacatgcttgcgctctaggacacggcttggccggtggctatggcgcgcacgcagcgccacccatctgccgctccccattgtagcgtcgcgcgcccactctttcactcgttcaacaatctttcaacaaatgttcgccaaacgcggatgtgtgccggactcgaggaaggaggagggcgagccaccgctgccgcgccagagaagcatctaagcccatgggaagatgccttctgcgctccgcgcccagaggaaggaaaatgtcgtgggccaagcaggaatggagggaatagatagatccccacgaggtgctgcttggcttccccttcccgagccaatccagggagggtgcatggatgggggaaggcgaggtaggggtggcaggggagtgggaatattgcaactcggggacattgcagagacccgacgcacgcggtgggacctgcaa

SEQ ID NO: 33191 - DNA, 320 bp, Homo sapiens
  misc_feature 1..320: note = chr10:94831610-94831930
  misc_feature 1..320: note = hyper
  source 1..320: mol_type = genomic DNA
ttgagctgaacttggcgaggtggccccgcagagttcactcggatgtcacggtccggcctgcaggggtcacaggcgggtcaggcccgaggattgggaatgggccccaggtcacgtccccattcgtcggctttgcacaccggccggaggcgctgtccagaaaggggcggacccgggatttctgagaattacctccagcgcgattggcctggcttcctgcagtggccagaggttggttcgccgtgtttacagccaccaaatcgtttgccggagactgaaaccctgcccagagcctctgaaacactgggcaggttatggggaaa

SEQ ID NO: 33192 - DNA, 38 bp, Homo sapiens
  misc_feature 1..38: note = chr10:94831980-94832018
  misc_feature 1..38: note = hyper
  source 1..38: mol_type = genomic DNA
cgctaggattgtgcgggtccctccgacctctgcagata

SEQ ID NO: 33193 - DNA, 166 bp, Homo sapiens
  misc_feature 1..166: note = chr10:94833026-94833192
  misc_feature 1..166: note = hyper
  source 1..166: mol_type = genomic DNA
cagatctgcctattgcgcccgatgccccgaggctctctcttggactctggccctgagttcttctgcgcgatccttcggagacgtctggaggcctgctttatgcatctctcttggacctcagtttccccacacgtgggaggaggcagctggacgattcctgaaagga

SEQ ID NO: 33194 - DNA, 69 bp, Homo sapiens
  misc_feature 1..69: note = chr10:94833580-94833649
  misc_feature 1..69: note = hyper
  source 1..69: mol_type = genomic DNA
gtctgaccaaggtaacgtgggcagcaacctgggccgcctataaagcggcagcgccgtggggtttgaagc

SEQ ID NO: 33195 - DNA, 964 bp, Homo sapiens
  misc_feature 1..964: note = chr10:94834033-94834997
  misc_feature 1..964: note = hyper
  source 1..964: mol_type = genomic DNA
cccacttctctcctccgccttcctcccacagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgggggcaggaggcgacggctggacagggagggggaccccatttatgagcggaattccggctgatggatgctaggcgcgggctagcagcttgaggtgggctaggaccctctgccagctccaggttagctttcccagctcggagagtgccatgtgtctggcaggactgggggtgtctggaaggggacggcggtagacgagaggggcggatggaggcttttaacgctgtcccctcctcgggactcaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccgggtaagggcggcaaacgggctgcggactaggggcgcgggacctgggcgtctgctcaccgccgcgcgctctctgcgctcagggcatgaaggcgcggaacctcattcacgcgcgcatcgagcagaacattcgcgccaagatctgcgggctgcgggcatccgaggcgggccaggg

SEQ ID NO: 33196 - DNA, 81 bp, Homo sapiens
  misc_feature 1..81: note = chr10:95326983-95327064
  misc_feature 1..81: note = hyper
  source 1..81: mol_type = genomic DNA
cgctctgcctctctgcgtcttcttccgagtcgtcccgcaacggctccccggcgccgaccaggtgagcgcccctctgtgtgt

SEQ ID NO: 33197 - DNA, 193 bp, Homo sapiens
  misc_feature 1..193: note = chr10:95361207-95361400
  misc_feature 1..193: note = hyper
  source 1..193: mol_type = genomic DNA
cggccaggccaaatgcgccagcggccctggctcagttaccctgcactcgtgccagcggccgccagctgcggtctagggtggcctccggggccagtggctctggcaggaggctcgagtcaacctggcgggaagaccgtggcctcacagagcgagagcggacccgcgaggctccctggtgcgtgagtgcccaggc

SEQ ID NO: 33198 - DNA, 137 bp, Homo sapiens
  misc_feature 1..137: note = chr10:95753607-95753744
  misc_feature 1..137: note = hyper
  source 1..137: mol_type = genomic DNA
ctcacccggggcgggcgagttctgggaaagcccggcccagggcgggggccccgctgccgcccgcgcagccgccgctgtccgggcagcgcgcacatctcggcgggagcggactgtgaacggcgcgggtccacacggta

SEQ ID NO: 33199 - DNA, 30 bp, Homo sapiens
  misc_feature 1..30: note = chr10:98944811-98944841
  misc_feature 1..30: note = hyper
  source 1..30: mol_type = genomic DNA
agctggctcagaacgcggccgtagccccat

SEQ ID NO: 33200 - DNA, 33 bp, Homo sapiens
  misc_feature 1..33: note = chr10:98945047-98945080
  misc_feature 1..33: note = hyper
  source 1..33: mol_type = genomic DNA
gggatggggaaaccacggcgctcctggctcctg

SEQ ID NO: 33201 - DNA, 267 bp, Homo sapiens
  misc_feature 1..267: note = chr10:98945472-98945739
  misc_feature 1..267: note = hyper
  source 1..267: mol_type = genomic DNA
gccgctgaccatccccgtccggggccgcctccaggtgcagtcccggggcagagccaccgaagagcccgcgggcttgcgcgcggcgcccctgcgggctgggaggcaccttgctcctccaagcgacggcgcctgtgcgcggacggagggagggcgccttgggcggagggggctcggctcctctgccgtttcgccgcctgcgtctccctctccctccctccagctcccaactgactgctgcgaggaggaaaatgggcaggccccgcgcgc

SEQ ID NO: 33202 - DNA, 268 bp, Homo sapiens
  misc_feature 1..268: note = chr10:98945799-98946067
  misc_feature 1..268: note = hyper
  source 1..268: mol_type = genomic DNA
gctcccacccggcagtcatccatcaatcgaaaagcacacatccagggccaggctcctccccgccctcccccgccgcagcccccctctcccgacgaccactcagcggctgcaagccgcctacagtttcaaaggtggaacctccgaggcgccgtcagcgggcacggggctgcgggggatgggagaagagggaagggggtgtgactcgacccgccaagtcctggctgtacacacacacacacacacacacacacacacacacacacacaca

SEQ ID NO: 33203 - DNA, 92 bp, Homo sapiens
  misc_feature 1..92: note = chr10:98946094-98946186
  misc_feature 1..92: note = hyper
  source 1..92: mol_type = genomic DNA
cgcaccccggcacccgcggccccagctgctagtccagggtgggagggagatcttattttgccgcttggacgccttcccggggagtcagaccc

SEQ ID NO: 33204 - DNA, 185 bp, Homo sapiens; identical to SEQ ID NO: 3581
  misc_feature 1..185: note = chr10:99080262-99080447
  misc_feature 1..185: note = hyper
  source 1..185: mol_type = genomic DNA

SEQ ID NO: 33205 - DNA, 71 bp, Homo sapiens
  misc_feature 1..71: note = chr10:99080838-99080909
  misc_feature 1..71: note = hyper
  source 1..71: mol_type = genomic DNA
gcacgcactgggttgcgggacagagtagccaggttctgccggtgctcggagaagagcgcagtgttttgcaa

SEQ ID NO: 33206 - DNA, 151 bp, Homo sapiens
  misc_feature 1..151: note = chr10:99531148-99531299
  misc_feature 1..151: note = hyper
  source 1..151: mol_type = genomic DNA
caggccaggggaagccgtaggcctccatgagcggcgcgcagccggcgcgcacggcctcgcacagcgagcggcacgggtagatgggccggtcgagacagacgggcgcaaagagcgagcacaggaagacctgcgtatccgagtggcagcgctt

SEQ ID NO: 33207 - DNA, 98 bp, Homo sapiens; identical to SEQ ID NO: 10402
  misc_feature 1..98: note = chr10:99531512-99531610
  misc_feature 1..98: note = hyper
  source 1..98: mol_type = genomic DNA

SEQ ID NO: 33208 - DNA, 50 bp, Homo sapiens
  misc_feature 1..50: note = chr10:99531829-99531879
  misc_feature 1..50: note = hyper
  source 1..50: mol_type = genomic DNA
gccccagctccaaggcggggaggcagtgggggcggccctcagcccctccc

SEQ ID NO: 33209 - DNA, 142 bp, Homo sapiens
  misc_feature 1..142: note = chr10:99531880-99532022
  misc_feature 1..142: note = hyper
  source 1..142: mol_type = genomic DNA
caccctgcccgagcgtcccgcccagcgccaggtcttgcgcccctctcccggctcggctcccctgccgcagccctggcctcgcccagcgtttctccccagggctccctgcctccctgggcattttcctcgaccctcgccttct

SEQ ID NO: 33210 - DNA, 192 bp, Homo sapiens
  misc_feature 1..192: note = chr10:99789105-99789297
  misc_feature 1..192: note = hyper
  source 1..192: mol_type = genomic DNA
ttccacttggcttcacgtggaaagtcctgcacccatcccagaagacacctcaagtgcaactcaagaatgtgtcctgtcaggagaacggaagcatctcctgggatgtgcagaagccacactgggtgcacccaccagcagcagcagcggcggcggcggcggcggcggcggcggcggcggcggcagcagcagcaa

SEQ ID NO: 33211 - DNA, 218 bp, Homo sapiens
  misc_feature 1..218: note = chr10:99789739-99789957
  misc_feature 1..218: note = hyper
  source 1..218: mol_type = genomic DNA
tccccagcctggaagcgtaggcactcggccgaggccagtggcttcccaggcccgggtctcagcctggctgactgggagactctcccgatagcccggcacatccctcctcacccgctccgccccctccaggccccagaggccccctcccctgacagctgacctccagtgcgcccccaacactttctctgccagctgctggctgtcgcccccacacatca

SEQ ID NO: 33212 - DNA, 79 bp, Homo sapiens
  misc_feature 1..79: note = chr10:99790261-99790340
  misc_feature 1..79: note = hyper
  source 1..79: mol_type = genomic DNA
tgggaagcgggcgctcgctgccgcctctgccgccggcgccgccgcctgcttgctcccagccccggtcccgggctggcct

SEQ ID NO: 33213 - DNA, 323 bp, Homo sapiens; identical to SEQ ID NO: 902
  misc_feature 1..323: note = chr10:99790437-99790760
  misc_feature 1..323: note = hyper
  source 1..323: mol_type = genomic DNA

SEQ ID NO: 33214 - DNA, 260 bp, Homo sapiens; identical to SEQ ID NO: 903
  misc_feature 1..260: note = chr10:99790917-99791177
  misc_feature 1..260: note = hyper
  source 1..260: mol_type = genomic DNA

SEQ ID NO: 33215 - DNA, 158 bp, Homo sapiens
  misc_feature 1..158: note = chr10:100992033-100992191
  misc_feature 1..158: note = hyper
  source 1..158: mol_type = genomic DNA
acacagatacacaaacacagcgggtgcttgcttccgctccccaaataaagaatggtaatcaagtttctcaccatcctcatagtttttgagatagtaatccgggcccgggcccccgcggcttttcgccgggttcctcaggttctggaactgcaggaagt

SEQ ID NO: 33216 - DNA, 426 bp, Homo sapiens
  misc_feature 1..426: note = chr10:100992221-100992647
  misc_feature 1..426: note = hyper
  source 1..426: mol_type = genomic DNA
cgggcgaaagtccccgggccagggtcaccaagcgcttggagctgcagaggaagagaataagagaggaaaggttcccaggacaggacgagagcgcgtggggcacggagaagggccctcttcctactccctgagggcgacctggccggggctagaggctctgtgcctgccccagccggcagtccacgctggcccttggccgctgccctgcgccccagcccgccctcaccgcccggctctgggggctgtgcctcccgcttccagacgcccgcagcggccccctcccgcagacacccagatcctgatctcctaaaggctacagatagtgtttgttcatagagtgtttgtatggggtgggtgtacgtgctacgagcacggcgctaaagcgcagttgcccggcttctgccactgccaggaaagcgctccggg

SEQ ID NO: 33217 - DNA, 47 bp, Homo sapiens
  misc_feature 1..47: note = chr10:100992681-100992728
  misc_feature 1..47: note = hyper
  source 1..47: mol_type = genomic DNA
cgaccgttgccaaaaacttgtatgctgaaagccggcattgcctccgc

SEQ ID NO: 33218 - DNA, 451 bp, Homo sapiens; identical to SEQ ID NO: 906
  misc_feature 1..451: note = chr10:100993487-100993938
  misc_feature 1..451: note = hyper
  source 1..451: mol_type = genomic DNA

SEQ ID NO: 33219 - DNA, 756 bp, Homo sapiens
  misc_feature 1..756: note = chr10:100993939-100994695
  misc_feature 1..756: note = hyper
  source 1..756: mol_type = genomic DNA
gcaaccgcaccaacaggaaccgaaacggcctcggcaagggcagctacagcctctcagtcctccggctacctttcctccacgtggaaggagcgctccacgtggcgcctcccgctacctgccgcgtccgcagacccgacccgggccagggggacaaccccaagagctgagaggcgggcgcacctcaagaagcaaaactcgaatttcgcaaggagtgaaaaatacgaaggacgcacaacggacctggcctcggggcaaagtgggactgagagcgctgagggctcttcgaggggaacccacagctgaggctccaacttgtagggaatttttaaaaactcaacacttggattcgacattgcagaggatttatttcttattttacactgcaactctgtccctgatgggaagggatcgcagttgcctaactgccaaactgcaacaacccgggaagagtgtgagcccaattagattacaagccctagagcaaaggggatcacaaacctccgggtttgctaatctgctggtgcggagttcagatctccgaagcctccctggagtatttctaggactcttaccgcttcccttataacgctgtgaccccagcgaggattttttttttcctttaaagaaaagctaaactgtgcagttaccgcaggagatttaaggaggaggaactggcggggggaggggggcattccgtctataaaaagcgccttacaaagtcctgaagtctggaaatgacagcggaggatataaaat

SEQ ID NO: 33220 - DNA, 732 bp, Homo sapiens
  misc_feature 1..732: note = chr10:100995726-100996458
  misc_feature 1..732: note = hyper
  source 1..732: mol_type = genomic DNA
gctcgctcgctcgctcgttttgtttttttcttttttttttttaattttttttaattttttttttcagtgttttggtgctggtggagcgaactcacgcccctagccagccttccccgtgactcttgccaagagaactcgtacaccggcaccgcccctttaagagatttctactgcagacattttttaactttttaaaggtaaggggaggggagcaggcgggaaggaggagaaaagggtggcgttgtaccctcctaatttaaccctctagggtcaggaagcagagggaggaatccaaaccatgccgttgtaccgtctgggtacagagcaaagggtctcgtttttacgtccttccctgagaggctctggagggcggttcaagctccgactccgacccgaaagccccagcgccaacccgggacgcgctgggatagagttcccaccgacagcacgcttgtttctcctgacagcgtcaggcacttcgtccgctcagggcccttttctggttgaagcagcaataccaagggcggttaagttgcagaggggtcttgaggcggtgattcctgtcaaagcatagagccctgaaggacattccccgaagaggagccctgatctctgtgacgcgttggatagccacaccgaagcatcctctgacctccatagggcaaagagtagcaagaaggaaaaacatagtgacctggtcaagcagcttttccgatccgagggccaaaaggg

SEQ ID NO: 33221 - DNA, 30 bp, Homo sapiens
  misc_feature 1..30: note = chr10:100996680-100996710
  misc_feature 1..30: note = hyper
  source 1..30: mol_type = genomic DNA
tcctgcagggaagtgcgcctttacagtgcc

SEQ ID NO: 33222 - DNA, 499 bp, Homo sapiens
  misc_feature 1..499: note = chr10:101088928-101089427
  misc_feature 1..499: note = hyper
  source 1..499: mol_type = genomic DNA
ccgctacgcacagtgcggtgatgcctggccacctccagcctccagcggggacctcctgcccaggtggagtctgaatgcccaccgccaccagcccacgcgcgcagtgggcgtacacgtggtgacctgcctgcggctgggttcccagctccggctcctcctccctccagctctcgctcggcttcctgcagtatcacgtgcagctgcgctgggtgcaggatggcggcggccgcggcggcggcagcagcggtgggtgtcaggctccgggactgctgcagccgaggcgctgtgctcctgctcttcttttccctgtctcctcggcccccggccgccgccgcctggctgctgggcctgcggcccgaggacactgctggaggccgcgtgtccctggaggggggcaccctgcgcgccgccgaaggcaccagcttcctcctgcgtgtctatttccagccaggaccgccggccaccgccgcaccggtgccctcaccgaccctcaactcgg

SEQ ID NO: 33223 - DNA, 373 bp, Homo sapiens
  misc_feature 1..373: note = chr10:101089835-101090208
  misc_feature 1..373: note = hyper
  source 1..373: mol_type = genomic DNA
tgctgctagccttgtcggccctgttcagcggcctgcgcctgagcctgctgtcgctggacccggtggagttacgggtgctgcggaacagcggctcggccgccgagcaggagcaggcgcgccgcgtgcaggccgttcgcggcagggggacccatctgctctgcaccctactcctgggccaagccggagccaacgcggccctggctggctggctgtacacctcgctgccgccgggcttcgggggcaccggggaagactacagcgaagaggggatccacttcccgtggctgccggcgctcgtgtgcaccggcgcggtattcctgggcgccgaaatctgcccctactcagtgtgttcgcggcacgggctggccatcgc

SEQ ID NO: 33224 - DNA, 292 bp, Homo sapiens
  misc_feature 1..292: note = chr10:101280193-101280485
  misc_feature 1..292: note = hyper
  source 1..292: mol_type = genomic DNA
cacataaatcaccagcgccagagtctcgggaaaaggcgcatttttcattgctggctgcagggcgactccagaccgcgaacgagaaacagaagttgtctttagataaaccgttcaccggagcgcgcgttgtggcagcagggtccgcagagcacagggcaacctgggtctggcgctgcgcccccgccaccgatcacctcccagaggccccgcaagaaacccagatcctctcaagggctggtaccacgtcctcctgccagagaggagatagggagccaagcgggaaggaaaagga

SEQ ID NO: 33225 - DNA, 253 bp, Homo sapiens; identical to SEQ ID NO: 10421
  misc_feature 1..253: note = chr10:101283181-101283434
  misc_feature 1..253: note = hyper
  source 1..253: mol_type = genomic DNA

SEQ ID NO: 33226 - DNA, 44 bp, Homo sapiens
  misc_feature 1..44: note = chr10:101290117-101290161
  misc_feature 1..44: note = hyper
  source 1..44: mol_type = genomic DNA
tcctcaagagacaaccgcttaggcctggcgcaaggtacctggcc

SEQ ID NO: 33227 - DNA, 520 bp, Homo sapiens
  misc_feature 1..520: note = chr10:101290179-101290699
  misc_feature 1..520: note = hyper
  source 1..520: mol_type = genomic DNA
cggaatttggggtagaggggcacccgtgggccggctggtggggaggagacagccccctgcatgagctcacagaggcgccctggtgggctccggcggctgcagagcgtctgtgggcgtgtattggcgatcaggcgctggaggggcgctttgtcctggtcgcagttttaagacctggattgttgggctagatttatgaaaggcctaggagcgaagcgagatgggaagcaagggaatgtaacaaggagaaatgcaggcttcggttggaaactggggagagagagattgtttcgatagcctttctccttttctttttccagaatcatgaaatcaccgaggagaagaaaactggggactagaagagagcagaaacatttcccctgagacagttttgccccggaggtggggtggggaagtggcgctggagctcagcttcctgcttttatgctcggcggccaccgtgatgcacacacactcgaggtccgccaccccgcagtgccgtgcacccctctgcccccacctc

SEQ ID NO: 33228 - DNA, 443 bp, Homo sapiens; identical to SEQ ID NO: 910
  misc_feature 1..443: note = chr10:101290700-101291143
  misc_feature 1..443: note = hyper
  source 1..443: mol_type = genomic DNA

SEQ ID NO: 33229 - DNA, 27 bp, Homo sapiens
  misc_feature 1..27: note = chr10:101291230-101291257
  misc_feature 1..27: note = hyper
  source 1..27: mol_type = genomic DNA
cgccatcctgaccgccaaaaaatgctt

SEQ ID NO: 33230 - DNA, 531 bp, Homo sapiens
  misc_feature 1..531: note = chr10:101292333-101292864
  misc_feature 1..531: note = hyper
  source 1..531: mol_type = genomic DNA
gaagttttcctgccccgcgcagcagctgaaaaaaacacactcctggggcatccttccctggcgttggttcgtggacagcaagcctcccagaactggcctaggtcgggaaggtgcagccacgcgggaatcaatggttcaggaaccggatctgtgcagcctcgcccgcagcgtctcggacttcaggactctatactagtccttgtctatttctggtagagccgcaacatcccactcgcagagagcagggggcgtggcccacatgagccagaacctatagggagggaggttggggcgccagccccgcccccccaacgtgacgcaaatctcccggacagaggcttaggagcccgggccccagtccctgcagtggctgtaacaaaacccagacccccaggtcccggccaatggaggcgatttagactggagtgggaccgcgtctgtcaaaagcccgactcggcagcagcggcggagtccaggaggagagctggagccgccgcgctgcctccccgcccccgccgggatttattattt

SEQ ID NO: 33231 - DNA, 387 bp, Homo sapiens
  misc_feature 1..387: note = chr10:101293067-101293454
  misc_feature 1..387: note = hyper
  source 1..387: mol_type = genomic DNA
ggaggacgaggaagacgagggcgagaaattgtcctatttgaactcactagccgcagcagacggccacggggattcagggctgtgtccccagggctatgtccacacggtcctgcgagactcgtgcagcgagcccaaggaacatgaagaggagcccgaggtcgtgagggaccggagccaaagtgagtagagggggaaagaaaacgcacccgcacacctggagcaatggcagagcgcacacaaacagcccacagaccttgccagcgcagctgcccatccctttaccctttggctggggccatgcctccgccctggtcaccgacagctccacaaagcgcaggtacctgcaagggagccggggtggagagacaaggacgaggtgaccctgac

SEQ ID NO: 33232 - DNA, 261 bp, Homo sapiens
  misc_feature 1..261: note = chr10:101293671-101293932
  misc_feature 1..261: note = hyper
  source 1..261: mol_type = genomic DNA
ccaccccttcttctccgaaaagacagcccaagcagcctgtgtctctcgcacccgcaggggcaggaactttggtggaggccagctgggcggtttcctcccttctctgcttggagctcagcgtccttgaacccgtggcactcggtagagagagaggagatgatcggaaagtgcgtgggaacaatgtctattccgcgcgaccatagctctcacatccctaaggcgccagccttttttgaaaatccgtaacgttttgctttgtgt

SEQ ID NO: 33233 - DNA, 777 bp, Homo sapiens
  misc_feature 1..777: note = chr10:101294623-101295400
  misc_feature 1..777: note = hyper
  source 1..777: mol_type = genomic DNA
ccagccatttactaccgcacgctctgcgcagccaccaaaaagggtcacggtgctccaggacaggagccgcggtgcggccgggaacagctaaggacgctgttgtttgcttcttccgcagaaagctgccagctgaagaagtctctagagacggccggagactgcaaggcggcggaggagagcgagaggccgaagccacgcagccgccggaagccccgggtcctcttctcgcaagcccaggtcttcgagctggaacgcaggttcaagcagcagcggtacctgtcggcacccgagcgcgagcacctcgccagcagcctgaagctcacatccactcaggtgaaaatctggttccagaatcgcaggtacaagtgcaagagacagcggcaggacaagtctctggagcttggcgcacacgcgcccccgccgccgccgcgccgcgtggctgtcccggtgctggtgcgggacggcaagccgtgcgtcacgcccagcgcgcaggcctacggcgcgccctacagcgtgggcgccagcgcctactcctacaacagcttccccgcctacggctatgggaactcggccgcggccgccgccgccgccgccgccgccgccgcagcagcggcggcctacagcagcagctatggctgtgcgtacccggcgggcggcggcggcggcggcggcgggacctccgcggcgaccactgccatgcagcccgcctgcagcgcggccggaggcggcccctttgtgaacgtgagcaacctaggaggcttcggcagcggcggcagc

SEQ ID NO: 33234 - DNA, 185 bp, Homo sapiens
  misc_feature 1..185: note = chr10:101295401-101295586
  misc_feature 1..185: note = hyper
  source 1..185: mol_type = genomic DNA
cacagccgttgcaccagggtactgcagccggggccgcgtgcgctcagggcaccttgcagggcatccgggcctggtagggacggggcgggtcacgcggcgggcaccccagcgcagcctggcgccgcgggactgaagctcgagaagggcctgacctaaaggtcaggtcccctcgttaaaaaaatatg

SEQ ID NO: 33235 - DNA, 39 bp, Homo sapiens
  misc_feature 1..39: note = chr10:101296761-101296800
  misc_feature 1..39: note = hyper
  source 1..39: mol_type = genomic DNA
ccctcccttctcccccggcggccgcggctttatgcggct

SEQ ID NO: 33236 - DNA, 125 bp, Homo sapiens
  misc_feature 1..125: note = chr10:101300247-101300372
  misc_feature 1..125: note = hyper
  source 1..125: mol_type = genomic DNA
tgcatctgggacattcgacagaaggggaaggtggaaggacgtttcctgggggaggttcgagtcctctctagcccaccactgcagggaggaaagggtaaggagtggaaacccggcccctctccgcg

SEQ ID NO: 33237 - DNA, 144 bp, Homo sapiens
  misc_feature 1..144: note = chr10:101875008-101875152
  misc_feature 1..144: note = hyper
  source 1..144: mol_type = genomic DNA
cggacgacagctgcacggccgcgcctcggcccctgaacttttgcctgcaccggggccgccccgcaccccccgccaacccccagccccggcccggctgccgtcggggcgatgaggtcacccgcccttgcacgatatctgttgatt

SEQ ID NO: 33238 - DNA, 72 bp, Homo sapiens
  misc_feature 1..72: note = chr10:102322219-102322291
  misc_feature 1..72: note = hyper
  source 1..72: mol_type = genomic DNA
agagcctggggcccccgaccttccgccgactggccgtgggctggccgcagcccagctcggctctgtctcgag

SEQ ID NO: 33239 - DNA, 30 bp, Homo sapiens; identical to SEQ ID NO: 10430
  misc_feature 1..30: note = chr10:102414410-102414440
  misc_feature 1..30: note = hyper
  source 1..30: mol_type = genomic DNA

SEQ ID NO: 33240 - DNA, 230 bp, Homo sapiens
  misc_feature 1..230: note = chr10:102414708-102414938
  misc_feature 1..230: note = hyper
  source 1..230: mol_type = genomic DNA
ggccctggacgtccccgggcccccgtcttcctcctgggccttctctctagtccctggcagctgggagcggccctcccgcccctgcactccttcctgtcgcgctgtggttctgccctctggttgtcgctcccctagccctcccctctttctctctgcagtgtttcttggggctgttgtctttctgtctgtcactctgcgtctcggtctctctggagtccttctgcctctgt

SEQ ID NO: 33241 - DNA, 15 bp, Homo sapiens
  misc_feature 1..15: note = chr10:102415092-102415107
  misc_feature 1..15: note = hyper
  source 1..15: mol_type = genomic DNA
cgcactgcagcgcgg

SEQ ID NO: 33242 - DNA, 30 bp, Homo sapiens
  misc_feature 1..30: note = chr10:102415618-102415648
  misc_feature 1..30: note = hyper
  source 1..30: mol_type = genomic DNA
ccgagccttcctcctcgtcctcctccttgc

SEQ ID NO: 33243 - DNA, 135 bp, Homo sapiens
  misc_feature 1..135: note = chr10:102419132-102419267
  misc_feature 1..135: note = hyper
  source 1..135: mol_type = genomic DNA
tcagccccagacccacgcagtgcctcacgctcgcctgccccgcccgctccccgcgggcctgcgcgtgactttagcgcgcgcggctccgcccggaaggtcacctccttcatcacggattctatttgcatccggaat

SEQ ID NO: 33244 - DNA, 448 bp, Homo sapiens; identical to SEQ ID NO: 10431
  misc_feature 1..448: note = chr10:102419399-102419847
  misc_feature 1..448: note = hyper
  source 1..448: mol_type = genomic DNA

SEQ ID NO: 33245 - DNA, 288 bp, Homo sapiens
  misc_feature 1..288: note = chr10:102430682-102430970
  misc_feature 1..288: note = hyper
  source 1..288: mol_type = genomic DNA
tactcctgacaggatcgccgggggcacggctgcgagataaccattagcgcagccgccgataaagcggggaggctgcatttccaaaggctccgcggccattacgggaaagttagtgtgaaacatgttaaattatccccaaagtggagggagcgggggaggcggcgggggagcgggcgcccgagagagccacgagacccgccgcctccgccggggccgggtgactgcgccgtgcccgacacgccgacgtccaccagggggcggccgcgtgcggcccgagcctcggtctgc

SEQ ID NO: 33246 - DNA, 184 bp, Homo sapiens
  misc_feature 1..184: note = chr10:102470093-102470277
  misc_feature 1..184: note = hyper
  source 1..184: mol_type = genomic DNA
gcggctcctcccgggcgccgcgtcccgcgctcctgctgccagcccagccggcctggggcgccctagccgctggtcctggcccaacaagtagccaccgacccctcccatgtggcctaggacgggaggagcttctgcccggcagttgggggtgacaaggatggggtaaagaggggcgccgggcagg

SEQ ID NO: 33247 - DNA, 69 bp, Homo sapiens
  misc_feature 1..69: note = chr10:102470339-102470408
  misc_feature 1..69: note = hyper
  source 1..69: mol_type = genomic DNA
cgtgttgacatagaaatcagactggaaagaaagcaacatgtagaggggcttccccgggtgtgaggtgac

SEQ ID NO: 33248 - DNA, 305 bp, Homo sapiens
  misc_feature 1..305: note = chr10:102473411-102473716
  misc_feature 1..305: note = hyper
  source 1..305: mol_type = genomic DNA
tgggagctgggtgggcggggtggggcggacgccaccaggcgtggcgcggggaacagagcagaatgaaatgcagatgcaaaacgtgctcataagagtttcctctctctccccatctgccaaagccgagattttaatctttaatccatgagcaatcagcgagcagcggcgaatggcacattacagatgttttactgtcgcgggcgctcgcagctttcgcgctcggcacaggcgcgccgggcgcccccgctccgcccgccccctcttctccccctctggttcttcttcctctcccctccccaggtccc

SEQ ID NO: 33249 - DNA, 250 bp, Homo sapiens; identical to SEQ ID NO: 10436
  misc_feature 1..250: note = chr10:102473759-102474009
  misc_feature 1..250: note = hyper
  source 1..250: mol_type = genomic DNA

SEQ ID NO: 33250 - DNA, 146 bp, Homo sapiens
  misc_feature 1..146: note = chr10:102475263-102475409
  misc_feature 1..146: note = hyper
  source 1..146: mol_type = genomic DNA
gagagtgaatggccgcgtcagccgcaaagaggcccagacagatggacgcaggcaggaagacggacaggagagagagagagacaacgtgcgcccgaggctgaagagctgggtcaagaagagattcggcttccgggagcaggggcgtc

SEQ ID NO: 33251 - DNA, 23 bp, Homo sapiens
  misc_feature 1..23: note = chr10:102475555-102475578
  misc_feature 1..23: note = hyper
  source 1..23: mol_type = genomic DNA
ggagcgagaggcagcggagccgc

SEQ ID NO: 33252 - DNA, 366 bp, Homo sapiens
  misc_feature 1..366: note = chr10:102475579-102475945
  misc_feature 1..366: note = hyper
  source 1..366: mol_type = genomic DNA
tgtgtgtttttattattattatttctgattaaagaggaattcatctcgtatctgcctcctgccaggggccgaggctccgccattggggttaacggtgcggaagaatacaaaaaaatttcattgaggaggattataaaagttactagctggaacattaacagaagagtaacttgtaaaaaatgcaatattacaatattcacaaggacggcagagcgtggtaaagctataaaattcaacattaaaaccttccacagcctagataacctagttaacaaacatgggattggaactacttttctgtggagacaggaatacgcgccggggctggtcacacctcttccgcgggaggggcggggtcggcggcca

SEQ ID NO: 33253 - DNA, 46 bp, Homo sapiens
  misc_feature 1..46: note = chr10:102483750-102483796
  misc_feature 1..46: note = hyper
  source 1..46: mol_type = genomic DNA
gcggggaggaagggacgaggggagggggctcgatgggggaattgcc
